United States Patent 12,642,819 (COMPOSITIONS AND METHODS FOR TREATING INFLAMMATORY BOWEL DISEASE) - sequence listing, part 64

SEQ ID NO: 30 - DNA, 3175659 bp, Unknown (residues 1,587,831-3,175,659 of 3,175,659)
  Description of Unknown: Clostridiales polynucleotide
  modified_base (1104004)..(1104103): a, c, t, g, unknown or other
  modified_base (1570035)..(1570355): a, c, t, g, unknown or other
  modified_base (2082439)..(2082534): a, c, t, g, unknown or other
  modified_base (2641378)..(2641475): a, c, t, g, unknown or other
gatggtagaacaggaagagattcaaggtgagtctttgatctccagggagggacaaaaaaacgtgctttctgtactggtggagacgaaaaaccagctccgggtggccgcacgatccgaagatgtgaggcgaatttatgtagaaagccatctggcggctgctatgtgttccaatcaggaggaaagacaagagatccaaaggctctatgaagagagtaagattccgtggtacattgttttgccgcacattttccgcgagcgggcgaagcgcctgcttgacagcagatggaaggcaatttgtgaggttccgtggaagggggctcttgtaagaaacgtggagtctttggcatatttgcaaaaaaaaggctggaaaaacacggttcgtgcggaccatcatttgtatacattgaacaaaaaagcagtagaattcttgaaaaaggcggggataaatggtacaacaatatcattagagttaaatagtcaggagattcgtgagatatgtaccccggcatcggagatggtggtatatggctacgcaccaatgatgatcagtgcggggtgtgtaaaaaagtccatcggacgctgtgatggtaaagagagcatcacgagactcaaagaccgctatcagaagacattttatgtaaaaaattattgtgatacatgttataatattatctataatacggcgccacttgttttgttggaacagataggggagatcgaagagatgggaattcacgagatccggcttcattttacgatagaggatacagaagagacaaaaagggtgatccggatttacgcagatgcattctggaggggacagaaaactcttacggcagcagaggtatttgctgattttacaagaggacactataaaaggggaataaagtaggtgacaagttgtttaatatcataatggaaatttcaaaatatctgattctgctgatgatggtaatctacacgtttgagtgtttcagtgcgttcggttatcacgatgcctacacgaagatgtggatcttacgaaggcagagcatctggatctttatgatccattttctggcgtttctgacgttgtttttacggatgaaggaggccaggattctagtattttatgtgatacaggtggcgcttttgggatcgattatcctgctttatggttttttgtatccgaaagtatcaagacttgttgtcaacaatatgtgtatgcttttggcagtcgggtttatcatgctgacaaggttatcttacagtaacgccgtcaagcaggcgttgattgtagcggtatcggcggtattatcattgttcgtaccggtcattatccgtaaggcacggtttctctcccggttaaagattttctatgcggtggccggagtggtggcgcttgtggcagttattatcgtcgggcgtgtgtcatacggtgccatgcttggatttgaggttgggggaatcagtattcagccatctgagcttgtgaagattatttttgtattttttgtggcggccagcctctatagaatcagggattttcgcaatgttgtcatcacgactgcgattgctgctctgcacgttttgattcttgttgcctccaaggatctgggggcggcgctgattgtctttgtcgtgtaccttgtgatgttgtatgtggctacgagacagccggtctatattgcggcaggcttaggggcagggagtcttgcttcggtagccgcgtattttctgttttctcatgtgagaacgagagtaacggtctggaaagatccgtttgctgtttacagcaatgggggatatcaggtggcgcagtcgctgtttgcgatcggtaccggaggctggttcggacttggactttgccagggacttccggataagatcccggtggtcacgacggactttatcttttctgctatagcagaagagctgggagctgtctttgcgatctgcatcattttgatctgtgtcagttgttacatcatgtttctgaatattgcaatgcagatcagagacagcttctacaagctggtagcgctgggacttggaacctgttatattttccaggtgtttctcgcgatcggaggcgtcattaagttcatcccatccacgggtgtaacgcttccgcttgtgagctatggaggaagttcccttttaagtacgatgatcatgtttgcgatcatccaggggctgtatatattaagagaagatgaggaagaagatattgagcgacagaaagagagacaattacgggcaaagagaagacgacaggcgcagcaggccggaagacctcgatcaaatggaacaaggtcttcagcgggagcttcgtcgggagatcgaagaagaaagcctaagagccggggatcacagcgtgtaccaagaccgtagaccggttccgcacaagccgggaaaagcacaaaagaaaaaggagaagcaggaagaacgccgccgggacaagagaaagaagaaagccaaccgacagtatgtctttgtgacttactttttcgtactgctattcgtagggatgatcggatatttctcttatttcaatgtggtaaagggcagggatatcatcaatgattccaggaatccgagaatgagtctttatgaaaatcaggtgctgcgtggctcgattttggataaggatggaaacgtgcttgcaaagtccagggaaaatgaggacggtactcagacaagggaatacccgtatgagcagttgtacgcccatgtggtcgggtacgcagataaaggaaaatcgggcctggaatctgcacagaacttccagcttcagacttcggatgttccgctgcagacgaaattgctgaatgagctcagaggccgaaaaagtgaaggaaataatattactaccacactggatacgaatattcagcaggcggcgtatgatgctttaggatccaacagaggtgcggcggtggtaatcgagccgagcacgggaaagattctggcgatagtttctaagccatcctataatccgaacacgattgtggaagactgggagagtctgaaccagaatacagaggggattttggtgaaccgtgccacgcagggccagtatgcaccgggatctactttcaaggtactgacaacgttggcatatatgcgccagaatccggattacaaaaactacacgtatcgttgtaccggagagatcacagccgggaaaaatgagattcactgctatggaaatgaggtacatggaacagtggatctggcagaatccctggcatactcctgtaatacttctttttccaacataggtctcagtttggatgtggatgagttccgaaagacagcagaggatcttttgtttgacacggaattgccttgcccgcttatttataatgagagtaagttcaatcttaagaaggatgacggagatgcagccattgccatgacggcattcggacagggaaaattgcaggtcagtccatattatatggcaatgctgacttcctcgatcgcaaataatgggattttgatgaagccttatctggttgatcagattacgagtgcccagggagagacagtagagaaatacgtgccggaatcttataaggaactgatgacttccgaagaggcggcacagcttaccgaatatatggagggtgttatagagtacggtacagcccgttccttacattctcttggtgtttctattgccggaaagaccggaacgagtgaatacagtgatgataaagagaaaacgcactcctggtttatcggattttctaatgtagagaatccggatatagcattggcagttgtcattgagaattcagacagtactggagacgtagcgacagacattgccgaggagatttttaaggcgtattatgcaaaatagaggttctgaaaatgaggtattggaaagaactgtatgtcagtgaagagctaaaaggcagggaagaggagatcatcgagcatctggaaaagaaagaattccagttcagggtctatctgatcgccctgccggaaaatgagagaaatcaactggaaatataccatagcgggatgctgaatcaaacgtggtacagggaaaaagatgtatttgtggtaggtctggccaaaggatatctacaggcactggagcttgtcagggagcttatcgatcaggtgttccgggagaccggggatgcagatgtcaggcagtatatttggaagcggcagggaagttagaatgatcattgtacatattttactatggattctaaagatagcaggcatattgcttctacttgttttggggttgcttttgcttggaatattgcttctgctgtttgtgcctgtgcggtacgaactaagtgccgagggagatattcatactctggaagagatccgggtaagcgtttccatccggtatttctttcggctgatcacctttcacaccgtctatgaaaaccagaagttttggcggtatgtgagaattgcatggaagaagatcgggcaggataaagaagagaagcaagaaaccgaagaacaggagaatccgaaaccggagaaagaaatttccggcaagatggatttagaacgggaggagaaagagagcccggaagaagtaagagcgattcgcagtgaaaacaaagatccggaaaaagaggacaaggtgcgaagagagaaaccagaggtgaagcgtcctgtatccggcgaagcggggaaaaaggaaagtaaggcaaaggaagaaagtgaaaagaagaaagaagcaaaagcgactgtttttgagcggtttctcgagaaaatcaagtatacatttcacaggatctgtgataagataaaggcactgtccgatatcaagagccgggtggagacggttatcaaagatgaagtacaccaggcggcgttcagaaaaggaaaagaaaccgtatttcgtcttttgaaagcatggcttccgagaagcggctggggaaggatcgagtatggacttgatgatccttattatacaggaaagattttggccggtcttgctctgttttatccattctttggacagtggcttcagattgtgcctgattttgagaagactacccttcgtgggcgggtgttcatccgggggcatatccggatgaatcatttggcaggggcggccgtcaggctggcggcagacaagaatatccgcagtacggcaaaagaggtgctgcgtctgttaaaacggcagaaaaaggaggaagtataaatgtcagagagtaatttcaaatcaacgatggaagcattgtttcacggaatggataacgtgatttcatccaagacggtggtgggcgaggcgatccacataaaagatacgatcatcctcccgcttgtggacgtgtctttttccgtaggggcaggatcgtttaccgcagagaaaaatgaaaaaggagctggcggactgggcggaaagatgacgccgtgcgcggtgcttgtgatccagaatgggacaacaaggctggtaaacattaaaaatcaggatacgatcacaaagattcttgacatggttccagatctggtagaccgtttccgcaccaaagaagagacgaaggtgacagaagaagacgtcaacgagattctggatgaagggaaaaagcaggacgaataaagagaagaaaaaatgcatatataagaacaaagaagaaaacggcagggatatcgtatgagaagagtagtaggatttgcgtgttttatgatcgcggcaggactgattctttcgatgttcctgccgggtttggtttgggatatctttatcacggcagtgtttctggtgttgggatatgtgttattctgctgttaaataggaaacaaaaaaccaggacgatcgatcctggttcttgtgtatgcagaacttatgctctttctactttgccggattttaaacaggatgtacatacatacattctttttgctccgccttctgttttaacacgaacagattttacattagatttccacatttttggtgtttttctatgagagtggctgacattgtttccaaaatgagcccctttttcgcaaatagcacatttcgccatgattacacctcctaacgctcttactagtcctcatataagagaactcacaacactaactatattatcagatatattctggaaatgcaagagtttatttccgggaaatgagaaaaatttcattgttttagggataacatgaagagtatatgttgtaaaatatgcgtaaacaaggtataataaaacagaatacttcgtggaaagaacggaaatcaaggatagataggaattggaggtatcagagtatgaaaggcagcatgagtacagaactgggaattatcaccatttcaccggaagtgattgcgaaatatgcaggatctgttgctgtggagtgtttcggtatcgtcggaatggcggcagtcaatatgaaagacggattggtgagactgctgaaaaaagacagcctgacccacggcatccatgtggagctcacggaagataacaggattcaccttgacttccatgtcattgttgcatatggggtcagcatttcagctgttacggacaatctgatcagtaatgtaaaatataaagtcgaggaattttccaatatgccggttgataagatcaatgtttacattgaaggcgtacgggtaatcgattaatatgggaggaactttgaggtggctatgaaaacgataaatgcagacatgcttgcgaagatgtttttggcaggcgcacagaatatagaggctaagaaagagtacattaacgagttgaatgtatttcctgtcccggacggagataccggtacgaatatgtccatgacgatcatgtcggcagcaaaggaagtaagagccctggaacatccggggatgaaggagctctccaaggcgatttccagtggatccctccgcggcgccagaggaaattccggcgtgattctttcccagcttctgagaggatttacaaagtcgattcaggaagagacggagattgacgcggccggtattgcggcagcctgcatgcgggcgaaggagacggcctacaaggcggttatgaagccaaaagaagggacgatccttaccgtggcaagagggattgccgagaaagcagaagagcttgcctttgagacagaagatctggaggaaatctttccgaagattctggatcacgcacagcaagtgctcgagcagaccccggagttgcttccggtgctgaaagaggcgggggttgtggattccggcggacagggacttctggagattttaagaggtgcgtatgatgcgtttcttgggaaggagatcgattattcttctatcgaaccatccaaggggccaaagacatcctttgggaaggcaccgatggaggagaccgacattaagttcggctactgtacggagtttatcatccttaccggaagagagttctccgatcaggaggagcaggagtttaaagcgtatctggaatccatcggtgattcgattgtctgtgtggcggacgacgaggtagtgaaagttcatgttcacacgaatgatccgggtcttgcgattcagaaagcgctgagttttggacagctcacaaggatgaagatcgacaacatgcgggaggagcaccatgagagagtcattcaggaggcagagaagcttgccgctcaggaaaaacggcagaagccgcaggagaagaaacgaaccggcttcattgccgtttctatcggagagggaatgaatgagattttccgggagatcggagtggattatattattgagggcggccagacgatgaatccaagtacggatgatatgttacaggccattgatgaagtgaatgcggagacgattttcattctgccgaataataaaaatattattcttgcggccaaccaggccagggatctgacaaaggataagaagattgttgtcattccgaccaaaacggtgccgcagggaattacggcagtcatcagcttctcttcggacgaggatacggctgcaaatgaagctgcgatgacagaagcgattcaggcggtgagaaccgggcaggttacctatgcagtgcgcgatacgaagatcggggacaaggagattcacgaaggggatatcatgggaatcggcgacgagggaattctcgctgtgggaacagatatttccgatacggcgaaggacctgcttgcaaatcttgtgacagaagaatccgagcttatcagtatttactatggcgaggatatttccgaggaagaggcagagagatttgtgacttccgtggaggagacatatccagatctggatgtggatgctcactgtggaggacagccgatttactactatgttatgtcagtagaatagagaaagagaggaaagggatacttaaaaggtatccttttcccatgtgaagaggtataaaatatggatgaagattccagcattagagagatcaagggtattggagaaaagacggaagcgctctttcagaaattgggagtaaatacggcgggagatcttctgcgtttttatccgagggcctatgatatctatgaggatccggtaacggtcagtgagctggaggaaggtacggtagctgctgtggaaggctgtgtttacggaaatatccaggtgtcgccgaaccggaaacttcagacgacgaccgccatgatcaaagatgtgaccggaacactgaaagtgttgtggtttcggatgccgtttttgcgtaatacattgcgctccggaagccatatcattgtaaggggccgggtggtaagcaggcggggttctcttgtgatggagcatccggagatttttcagccggcaggcaaatatcaggaaaagcttcatacgatgcagccggtgtacccgcttactgccggactgtcgaatctgactgtgagcaaggctgtgcgggaagtgatggagcatgtacatctgcagaaggagacattgccggaaagtatccgtcagatctttgaactctgcgaatacaattatgctctgaaagggattcatttcccaacggataaaacgatgtatatgcaggcaaggaaacggcttgtctttgaggaatttctggaatttattctggcggtccgccagatgaaagaggagaaagaagcaagcgtcaattggtgtcggatgaagccggcaaaagaagtggatgatttccttggcagacttccgtatgagctgaccaatgcacagaaaaaagtatggatggaaatccgaaaggatctacagagcgatgatacgatgtccaggctgattcagggggatgtgggctcaggtaagacaatcgtagccgttttggcgcttctggaggcggcttataatggatatcagggagcgatgatggcgccgacagaggtgcttgcaagacagcattaccagtctgtctgtgacatgtttgagaaatacggcgtcgggttccgggcagagctgctgacaggttccatgaaggcaaaggagagaagggaggcttacgcaaggattgagagtggggaggcagatgtggtgatcgggactcatgcattgattcaggataaggttcagtatcacaatctgggattggttatcaccgacgaacaacatcgtttcggagtgcggcagcgggaagcactggcaaaaaagggaaggatgccacatattcttgttatgagcgcaacgccgattcctcgaactctggccattattatttacggagatctggatctttctgtgatcgacgagctccccaaggaccgcctgccggttaaaaactgtgtggtggataccgggtatcgggagactgcatatcggtttatgaaaaatcaggtggcagagggcagacaatgctacgtgatctgcccgatggtagaggaaagcgaagcaatggaggcggaaaacgtcatggattactctaccatgctttccgagaagctagggacagggatcacggttggatacctccacgggaaaatgaagcagcagcaaaaggatgagatcatgcagcggtttgcggataatcagattcagattcttgtttcgacgactgttgtggaggttggaattaatgttccaaacgctacggtgatgatggtggaaaatgccgaacggtttggacttgcacagcttcatcagctccgggggcgcgtgggaaggggagcgtttcagtcctactgtatttttatgacaggatccaaaacgaaagagacgaaaaagcggctggatattctcaatcattccaacgatggattttatattgcgggcgaggatctaaagctgagagggcctggggaccttttcggcatccgtcagagcggacttatggagttcaggcttggcgatgtcttccaggatgcaaaaatcctgcagatggcggcggaagcggcaacaatgaaagaagtacgggaatctccggtatttacaagaacaaaccaggatcatattcatgtactgtaaggaagcggtttatctgatggtaatcttctatggttgttttttagtcaatgaaaccgtatagaaaaaggatatggtgatacctatttcatacccgccatatccttaaaaagaaaaacaccgcaatctccgggaatactgggaatcccttgaaattgcggtacttttttgataagccgaaaatcagactcgaactgacgaccccttcattacgagtgaagtgctctaccgactgagctatttcggcctgtgctgtacgatgtccctacacgatgtctttccaacaggcacaagtattattatatacatttttaaaaaatttgcaactgtttttttgatttttttatatgaggtaaagatttaactgcgtaagcagcaaaaaagtagtataaactgcgaatttaagtcgtatggctgaatcttgatcattttagcgctttcgtttacacggtttcattaaagtttcattaaagacgaagataacgatgaaaaagagcatccctatttccttttatgaaaacggggatgccctttttggcgtttcacattcttttgttcagaaagagttatttaccagccatctgtctttcctgttcttcgatcatcttcttgaccatataaccgccgacagatccgttctgtctggaagtcaggtctccattgtatccgtctgttaacggaacaccaagctcacttgctacctcatatttgaatttgtctaaagcaccttttgcttctggtacggctgctttattagatgaacgatttgtcatgctaatgtcctcctttatcgtcgtgtggttttgtgtaactttttgttacagtcatagtatatgaacatttgtataaattactctgggaaaaacaggaaaatcctattgacaaaaaaacaggtttttaactacaatttttctggaatgtttttttgaaaaaagaggaggcagtatatgagagaaatggaatttaaaatggaaaggtccggattgattgaagaggggcaggaagcagaagtaacagaacttcaggcacttggaggatatagttatctgattgagccatctgtggcaatgagtgggctttacaaaagctgggatcgtttaaaatccagaaaaggcatcataaaagaaattaaagaaacagaccggggattttatgttacaatggagtttaacgaataaagccggatgtagagtctgacatggaaaaatctggatagatgaaaagtcattttgacagtagtaggcctgtatgataagatagggcgtgaaaggaaccgagagtataaaggaaaggaatggacataaagatgaggagaaagatacataggttttgtggtattgcactcagcgcttgcctgttgcttggagcctgcatcactccggcgctgacaggagatgcagcggacaagctttcaggtaatgtggcagaggaaacgacagcaactcggaatgagaaggtttcaaggaatgatttggagcctgcttcagagacagatcttttatctgaggaaaccggggacaaaacaggggggctgaccggacaagaggaggcgggatcgaccccgaaggacggaaagactacaccggagactgagacaaaagacgatcctgttgtcaatgagggagaaaccgatgataatgagacagtagaagacgaagatattactaaggcttcggaagaagagaccgagccggaggagttaaaggagaacagtttccgttatcagaacggagaactgatttccgagccgcaggcactttcaagagcatcctatccatatgcgtggcagaaggtgaatgggaagtatatgaacagcatcggtcaggtaattgaaggggcgacgaagaaaggaatcgatgtcagccatcaccagggcgttattgactgggaaaaagtgaaaaaagatgggattgactttgcaatcatccgctgtggttatggcggggattatcagtcctatgatgataggtactgggtaagaaatgtgacagaatgtgaacgacttggaattccatatggagtgtatctctattcttattctgaaaatatagaagatgccaaaagtgaagcggcccatgcgctgcggcttttaaaggggcataaaccggcgtatggaatttactatgatctggaagacgaaaatacgacaggaagagtgagcaatacaactatcggtaccattgccaaaactttttgcgatcagttatcgtcagcaggctacaaagttggtatttatgccagcaaatattggtggacagaaagactaacctcctctgtatttaagaatgaaaaatggtctaaatgggtagctcagtataacacatcctgtacttatgaaggaagctacgatatctggcagtgtacttctacaggaagtgtcgcgggaatcaatggagcggtcgatctaaatttctggatgggagatccgcaaaattctaatacaagtacttctatagacagaaatatcatttcaagtacagggcatatgcaggatgacggttggaccgcatccgtacagaacggtgatcagattggtgtaacaggacaatctaagcgactcgaagcgttccagattaagattggaaacggttatggagatctggggatccgttacgcttcttttgtggaagatcaaggatggcaagcttatgtgacgagtggaaaaacgtccgggacgaccggagagagcaaggcggttcaggcagtcaaaattcaactgactggttcaaaagcatcaaattatgatgtttattatcgtgcccatgttcagacgtacggctggcttggttggacaaaaaacggagcagcagcagggacgacaggttatgaaaaaagaatggaagcactgcaagttatgattcttccaaaaggagcggcagctccgggggccttatcaaatgcatataaggaaaaagcattgacgaaaggaattggttatgaagcccatatgcagacatattgctggctaggtgaagtaatgaatggtgcaaccggaggagtgaccggtgaatataaacgaatggaagctttaaaaatcagtcttgaaaacaaaaaatattcaggcggaatacagtaccgcgcgcatcttcagaataccggctggcagggttggaaaagcaatggggaaatggccgggacaaccggacaaagccgtcaaatggaagctgtccagatcaaattgaccggaaagatggcggaaaaatatgatatctattaccgtgctcatgttcaaacatacggttggcttggctggacaaaaaatggtgctaaggccggaacggaaggcctgagtaaacggatggaaggtattcagattcagcttgtagaaaaaggtggggcggcgccaggaagcacatctggctcatttaaagagaaagagaaacctcagaatattgtataccaggcgcatatgcagacgtattgctggctgggtgaagtaatgaatggtgcaaccggaggagtgaccggccaatataaacggatggaagctttgaaaatcaagattcaaaatccgaaatattcaggcggagtacagtaccgtgctcatcttcagactaccggatggcaggggtggaaaagcaatggagaaatggccgggacaaccgggcagtaccgccgtatggaggcagttcagattaaattgaccggaaagatggcggaaaaatatgatatttattaccgtgctcatgtccagacgtatggatggcttggctggacgaaaaatggagccaaggccggaaccgaagggatgagcaaacggatggaaggtattcagattcagcttgtagaaaaaggaaaaccgggaccatccagcggacagacagcttttcggacgaaataagaatacacataccctcacacagttttctatttcagaactgtatgagggtatgcttgttttgcgtcaaatttcaaaatcgtttcacatacttcaaaagtgtttctgatatactttctccactactccgatcactgcatacaacgccattgccatgatacaaagcaatacgatggacatcaaaagccaatccatcttaaacacctggctggagtagatgatcagatagccgagcccttccctggcggccagaaattccccgatgataacacctacaaggcagagaccaatgttgactttcatggtactgatgattgtaggaacggcggaaggcagtaccacttttgtgaggacatgaacagaggtgccgtgaagggtatagatcagtttgattttgtttttatcggtgccgataaaacaggtgtagagcgtcataatactgccaaagatcgccacagacattccggctacaatgatggttgtgcggttggcgcccaaccaaacaatgagcagcggcgccagtgcggattttgggagactgttcaaaacaacaaggtaaggctccagcaccgctgagagattcctggagaaccagagaaaaacggcggccagaatactgattccggtcaccagaagaaagcttaggatggtttcatacagcgtggcggacatgtgaggaaagatggttccgtctttcgccatcgtcaagaaacaggtgccgattttagaaggactgctgaaaatgaaagagtcaatgattccagtgtttgcagtccactcccagagaacgagaaagagaataaggacagcggcccgcagaaacagaataagctgatgttccctcctgattgttacaaggtaggcggactgggaagtggaaagatcaggatatttgatgttcatgttggttcagctccttccagatcagattgaaataggttttgaattccggagcgtttctccggagcaacggggtgtcctttgtaccgtctggatatgcaaaatgcagatagactgtctttttcaagtgtgcggggcgcccggagagaacgagaatacgatctgcgagactgatggcctcggataggtcatgggtcactaaaatggcggtttttccttcccggcggataatctggccaatatcgtcgctgacatttagcctggtctgataatccaaggcagagaatggttcgtcaagcaggagtacttccggatttaaaatcagggtgcggacaagagcagccctttggcgcattcccccggataattcagacgggcgggaatccttaaattgaccaagaccataggcgtccaggagttcgtgggctcttttgcggacctcaggagtgagagaccgctgtatttcaggaccaatcagcacattccgatagatgttccgccattcaagcagctcgtcgcgctgtagcatatatccaattttgtccttctgttcttctacaggtttttcatgaagaagaatttctccttgttccggttttaagaggccggaaatcagagacaaaagggtggacttgccacagccggagggaccgacgatggcgaggaattctccttgatttaccgaaaaagaaatatcacatagagcaggagtttctcctttcagggtatgataggaatggctgatctggtggatattcagtattgtgtccatgttgctgacctccttccatgtataccataatgtatgttgacagagaaaaagatgtgaattataactattagtagattttaggcgaagaaggagaacgaatgagacagcagaaaatcaattatcaaaaagaactggagaaaacactggaagcgatccggagagaggagcgggttccgacacttttgcttcatagctgctgtggtccgtgcagcagttatgtgatggagtatctggcggattttttccggattactgtcttttattttaacccgaatattacggataaggaagaataccggaagcgtgccgaagagcagcgccgtctcattgaacggatgaatgaaaagctgaaatacccagtttccgttttagagggtgagtacgacgcccatacattttttgagatggcaaagggaatggagcacctgccggaaggaggagaacggtgttttcactgttatgccatgcggctggaacgcacggcagcagaggcaaagaagagaggaatggattattttacaacgacgctttccatcagtccgatgaaaaacgcccagaagctcaatgagattggaggcagtatgcaggaaacgtacggagtttcctatctgttttcggactttaaaaagaagaacggatacaagcgctccatagagctttccaaagaatacggactttaccgacaggattactgtggctgtgtgttttctaaaaaagatagaatataaaactcagatatttatgacatatgtaaattataatatgatgtgactatatccaagaaggtgctatgattaagtcattacaggaaagtattcgtccatctacggatttacgaaactattatgccaaaatttccaagctgtaccgagaaaagaaagaggacgttgcaaacggcagggttgcaacgcttcaaaatacatttgatgaactgagaaacatactgaaggggaatcaaaaatggcaaagtatagagtgttacgggcggatacgttcggtgctgcacctacagggacataaggttctgattggaggttgtgatgcaaaaaattattgcctatgaaatgatatgtaataaagctcctgtcgaggagataaatatcgaatgtgttttatttcataaagattattggaaagattatatgcagatatataatgaatgtttttataaaatgagaaaaaatttaaaaatagagccagtaaatttttattcggatttttctcaaatgagagagaaaggggaaaacacttttttgtatgttgaaaatagtgagattattggagctgtctcatgttacaggaatgaaatagatgacttaattgtaagacagtcatttcagggaaaaggaataggaaaagagttattgatttgggcgatgcatcacataaaacaaaatggatatgaggatatagttttacatgttgcagcgtgtaataaaaaggcgataagtttgtatgagaaagcagggtttagtattcaaaagatagaaagggtgcgatagcttttaagttgttgatttggggaatttattcaatgaatatcgcataaagcaatgatgatccgactgatataataaagttaggaatttaatcaggtccatctggttttttaaaaagagacagaattactgctttacaaacagaataaaatttggtaaattatgttttaatagtttaattcattaaaatcaaaaagaaacggggaagacagatggcacagttatggggaggacgcttcacaaaaaagaccgatcagatggtatatgattttaatgcctccatcggatttgacaggcgtctgtacagacaggatatagaaggaagtatggcgcatgtaaagatgctcgccaagcaaaagatattgacggaggaggagcgggaccggattctccagggactttctggaattctggcggatgtggaggatggctccttgccgattacgaaggaatatgaggatatacacagctttgtggaggcaaatctcattgacagaatcggggatgcggggaagaagctgcacacaggacgcagtcgaaacgaccaggttgcactggatatgaagctttatgtcagagaggaggtccagaagacggaggggcttttgacggatcttctaaaagtgattctgcatattatggaggaaaacctggatacgatcatgccaggattcacccatcttcagaaagcacagccgatcacactggcacatcacatgggtgcgtactatgagatgttccgaagagatcgaagccgtctggctgatatctatgaaagaatgaatgtgtgcccacttggaagcggcgcacttgctgggacgacatacccgttggatcgagactatacggcggagcttcttggattttcaggagcaacgctcaacagtatggattctgtatccgaccgggattatgtgattgaatatctgtccgcactttccacgattatgatgcatttaagccggttttcggaggaaattatcatctggaattccaatgaataccagtttgtggagattgacgatgcgtacagtactggcagcagtattatgccgcagaagaaaaatccggatattgcggagcttgtcagaggaaagaccgggcgtgtctacggggcgctgatgtccatgctgacaacgatgaaaggaattccgttggcgtataataaagacatgcaggaggacaaggagatggcatttgacgctatggatactgtcaatgcgtgtctgccgctttttacagggatgctggggacgatgaagtttcaaatatccgtgatggagcgaagcgcaaagcgcggttttacgaatgcgacggatgcggcagattatctggtgaatcatggcgtaccgttccgggacgcacatggaattgtcggccgtctggtattgacctgtattgagaaagaatgtgccctggatgatctgacactggacgaatatcaggcgatcagtccggtgtttgaagaggatatttatgaagcaatcagcatgaagacctgtgtggaaaagcgtctgacgaaaggagcgccgggaaaaggcgccatgctggaggcaatcgcgatatacaaaaaggaactgggatgtgagtaggaggacagagcatggaaaagaaattgcgtgttggaattttaggagcgaccgggatggtgggacagagatttatttctctgctggaagatcatccatggtttgaggtcgtgacagtggcagcatcgccgcgatccgccggaaagacatacgaggaggcggtaggggatcgctggaaaatgaaaaaaccgatgccggaaggtgtgaaaaagctgattatacataatgtcaacgaagtagaagaagtggcttccaccgtggactttgtattcagtgcggttgatatgacgaaagaggagatccgtttgattgaggatgcctatgcaaagacggagacgccagttgtttcaaataatagtgctcaccgctggacaccggacgtaccgatggtgattccggaagtcaatccggagcattttgaagtgattgaagcgcagaagaagagacttcatacgacccgtggttttgtagcagtcaagccgaattgttcgatccagagttatgcaccggtcctgacggcgtggatggagttcgagccgacagaagttgtggcgacgacgtatcaggcgatctccggagcaggcaagacgtttcaggactggccggagatggtggaaaatattatcccttatatcggcggcgaggaggagaagagtgagcaggagccgcttcggatctggggtaaggtgtgtgacggaaagattgagaaagcatcttcaccggtgattacgacacagtgtatccgtgtcccggtactggacggacatacggcggctgtttttgtcaactttaagaaaaagccgaagaaagaacagctcattgaaaagttgagagattaccggggacttccgcaagagctttctcttccgagcgcgccaaagcagttcattcagtacctggaggaagataaccgtcctcaggtaacattagatgtggactatgaaaacggcatgggaatttccgtaggacgccttagagaggacagtctttatgatttcaaatttgtaggtctttcccataatactgtaagaggggcggccggaggagcgattctctgtgccgagacacttgtcgcgaagaattatatccagtcaaaagaatagtggcctcagaaagaggatttacgtcagggacgggaaattttacccgtccctgattgcacgtttggacagaaccatgtaaaatagtagggacaacaggcttacagatcgtaacagttcagtcagaacgccatatacaaagtatacaataaattttcgttttcaaacaagggtgaactcagatttttgtgactttgtgcatggctgaactgttactacagatcaaatggagaaaaggaaaatggaggaatcacaaatggacggggaacttctcaagtatacacagaaccgagagctttcatggctgaaatttaatcagcgggtactggaggaggcacaagatccggatgtgcccctgttggagcggatgaaatttgtggcgatttttacgagcaacctggatgagttttttatgattcgggtcggcagtctgtacgacatggcgtccttgaaagagatggaattggacagacgctccaaaatgacgccaaaagagcagctagaacggatttacgaggcggtggagcctctttataaggagcgggataagacctactcggagattaaaaaacggctcagtccatacggtatctgtggtctttctttcaaggagcttcaggatccagagaaaaaatatgttaaaaaatacttcaaagaacagattcttccggtgctctcgccacagattgtggaccggaatcatccgtttccccatctcctgaacaaggaaatctatgtcattgcgaatctgaaacggggcaatcaaaagctcttcggactggtcccggttccgacctacctctccgaaatccttcttcttccgggacatgatatccgttatatccggatggagaagattctaatggaatatctggaaatcatttttgataaatatgaagtgtcagacaaaaattatatctgtgtgacgagaaacggggacgtctcaccggacgacgaagctcttgatatcaatgaggatttccgtaacctgatgaaaaagacgctgagtaaacggaggaagatggcagtggtgcgtctggagacggcgaatcccctgacagaaaatatggagcgttatttttgcgatcggttttgcatcacgccaaagcagattttccgtacaaagatgccgatgaagttatcgtacattttctctgtggcggagaaagtaccggagcacatgagacggacgctggtatatgagccgtttgtaccgcagaagtccgctatggtggatgaagagacatcgatgatccgccagatccgaaagaaagacattcttctttcctacccatatgagtctatggagccgtttttaaagctcttaaaagaagcgagtacggatccttccgtggtgacgatcaaaattacgatttatcgtttgtcaaagaaagcaagacttgtagaatatctgtgtgcggctgcggaaaacggcaaggaagtcacggttctgatcgaacttcgcgcccggtttgacgagcaaaataatattgactggtcggagcgtctggaggatgccggatgccgggtgatttatggattcgaaaactacaaggttcactcgaagatatgcctgattacctgtaagaccagaaacgggtatcagtatattacccagattgggacgggaaattacaatgaaaaaacggctgccatgtataccgacgtttgtttgatgacggcggatcgggaaatcggacaggatggggccacatttttccagaacatgtgcatgggaaatcttggcggtagttaccgtcatttgcttgtctctccgtattcactcaagaaaaaggtgctggaactgattgaggaggagaccaggaaaggggaaaacgggcggatcattatgaaaatgaattccgttacggatgtagattttattgaacagatttcaagggccagccgtgcgggtgtggaggtagatttgcttgtacgcggcatctgttgtatccgtcctggtgtggaagggtatacggatcacgtgcgtgtgacaagtattgtgggacggtttctggagcatccgagaattttttcattcggaaggggaagcgcccagaagttgtatatcggttcagccgatatgatgacgagaaatacagaaaagcgtgtggaggtggcatgcccggtctatgatgaggacctccgggcaagactgaaccacatgttacaggtgatgctggaggataatgtaaaagcaagggttctggatgctgccggaacgtatttaaaaatggggcagggggagccgtttgtggacgcccaggaggtgtttatgcaggaggcagttcaggccgcggcggttaaaaagccggcgaaacgctcgattcgggaggtcctctttggcatctttcgcagataaaagaaggagaacaaggcaatggggaaatcgctctacatagcagagaagccgagtgtggcgcaggaatttgcaaaagcattaaaacagaacatgaagcgacgagagggatggctggaatccgacgagagcgttgtgacctggtgtgtgggtcatctggtgacgatgagttatccggaggtctatgatccgaaatataagaagtggagtctaagtacgctgccttttctgccggagacgtttctctatgaggtcattccgaatgtgaagaaacagtttgatatcgtaagcggacttttgaatcggaaagatgtggataccatctatgtgtgtactgattccggacgggaaggagagtatatttaccgtctggtcgaacagatggctcatgtaaaaggtaagaagaggaagcgggtctggatcgactcgcagacggaggaggagatcttaagaggaatccgggaggccaaggatctctcggcgtatgaccatctttccgattccgcttatctgcgagccaaggaagattatctgatgggaattaatttttcccgtattctgacactgaaatatggaaacaccatcgctggatttctgcataaaaattatgtggtgctgtcggtgggacgggtgatgacctgcgttcttggaatggtagtcagacgggaacgggaaatccgggagtttgtaaaaacgccattttaccgggtgatcggaaagtttgccgcggaccagacaaggtttgagggtgaatggaaggcagtgaaggggtcacgctatgaattctcgccaaagctctaccgggaaaatggattcaaaacgagggaagcggcacaggagctggtgaaggatctcaaaggaagtggtgggacagcaaagcttgtttctgttgagaaaaagaaagaaaagaaaaatccgcctctgctttttaatctggcggagctgcaaaatgagtgctccaggagatttaagatcagtccggatgagaccttgcggattgttcaggatctgtacgaaaagaaactggttacttatcctcgtactgacgcaagggtgctttccacagccgtggcaaaggagatccataaaaatttaaacggactttccaaatatgagcctacggcggcgcttcttggttacattgctaaagagaggacccacaaggggctggaaaaaacccgctatgtcaatgacagtcagatcacagatcactacgccatcattcctacgggacagggacttttagccctgcaggcagtatccggtacagcaaggcaggtgtacgacctgattgtgcggcggtttctttccattttttatccgccggcggtttaccagaaaatgatgcttgagttggaagtgggaagagaacatttcttctccaattttaagattctggcggaggaaggtttttacaaggtaacggggattcccggtacgaaaaagggaaaaacagacgaagaagaggagagcgttcccgactctgagctttttgatcggcttcagaagctgaaaaagggcgatttggttttggcggaggactttgagattcgggagggggagacgtcgccgccaaagcggtataactccggatccatgattcttgccatggaaaacgccggacagctcatcgaggacgaggaactccgggcacagattaagggaagtgggatcgggaccagcgccacgcgggcagagattttgaaaaaactgattcacatcaagtatctgacattgaataaaaagactcaggtaatcaccccgactttgatgggggagctgatctatgatgcggtgaatcattcgatccgctctctgttaaacccggagctgacggcgagctgggagaaggggcttacgttagtggcaaacggggagattacttcggaagagtacatgcaaaaactggaacagtttatcgccggcaggacaaacggtgttatcggactgaacaatcagtaccaactgaaggcctgctacgataaggtgtccccttattataaaacaacatatcaaacatctaaaaagtcataaggaaaaggaggagcagtatgaaagaactgacagtaacggagctttttgatctcgatgagacgattgcaggcgaaatctttgaagggattacctacccttgggaggtcctgccgaagatcggggagtttatcgtgaatctgggaaacactctgccagaggacgagtatgaaaaggcaggagaaaatatttggattgccagatctgccaaagtggcgtcgacggcatgtatcaacggaccgactatcattggaaaagatgcggaaatccggcactgtgcttttatcagagggaatgccctggtaggagagggcgctgtagtgggcaactctacagaattgaaaaacgtcattttgtttaacaaggttcaggtaccccattacaattatgtgggggactcgattcttggatataagtcccatatgggagcgggatcgattacgtccaatgtgaaatcggataagacgcttgccacggtaaatacaccagaaggaaagatggaaaccggactgaaaaaattcggtgccatgctcggagactatgtggaagtgggctgtggaagtgttctgaatccgggaaccgttgtaggaagagacaccaatatttatcctctttccatggtgcgcggctatgtaggggcaggaagcatctacaaaaaacagggggaagttgtagagaagcagtaattgcatggggcgctgcaaatcagcaaagctgaaaaaataaggaataccgattgccggaacagaggcggttttcggaaaaggggcttgcaggttgtaagcccctttttatgctggatggatttacaaaaattttattagaagaatccatgaggacgttgtataataaatacggaaatctgctgaagtttgtggagatcgggacttcggtctgtgatagtgctgtcgtgcttctgtgcggcagagtggtcatactgttttctatccggcgtttcgcccggaatttcaaaaatgatcttgacagcaaaatgagaatcagttactattaatattataaacgaacgtttgttcgtgcgtaaaggagatcaagacatggcaaataatgaagataaaaagaaagcattggaggctgcaatagccaaattagagaaggattttggaaaagggaccgtgatgcgtcttggcgatccgaaggcgcaggttgcagtggagacggtgccgacaggagcattgagtctggatatcgcactgggacttggaggcgtgccgaagggaaggattgtggagatctacgggccggagtccagcggtaagacgacggtggcgctgcacatgatcgcagaggttcagaagagaggcggcatcgccggatttattgatgcggaacatgcattggatccggtttacgcgggcaatattggtgtggatatcgatgagctttatatttctcagcctgacagcggagaccaggcactggagatcacagagacgatggtacgctccggagcgatggacatcgtcgtgatcgactcggtagcggcgcttgtaccaaagcaggagattgagggggatatgggggacagccatgtgggattacaggcacgtctaatgtcccaggcacttagaaagctcactccggtgatcagtaagtctaactgtgtcgtgatttttatcaaccagctccgtgagaaggtaggtgtcatgttcgggaatccggagacgacaacaggtggacgcgcgctgaaattttactcctccatccgcctggatatccgccggacggagacgctcaagcagggcggagagatggtaggaaaccacgtcagagttaaagttgtgaagaataagattgcgcctccgtttaaagaggcagagtttgatatcatgttcggtaaaggaatttccagggagggcgacgtactggatcttgcggcgggacttgatatcgtcaataagagcggtgcgtggtacgcctatgagaataataagatcggtcagggccgggagaatgcgaagagttacctaaaggagcatccggaggtgatggatgagctggaagcaaaggtacgcgcccactatggtctggatggaggaaccgggaaaacaaaggaagaagctgagggcgccggcgaggccggaaacgaagagtaaacgatgagacgagtcagaattgagccggttacgaagacccggtttcggatttatttagatggacagttcgcttttgtattatacaaaagcgagctggtttcctgtaaagtaaaagacggggaggagatctccgacgagcaggtggaagtgattctcaaagggatcatactaaagcgtgccaagcagaaagcgctttctcttcttcagagtatggaccggacgaaaagcgagctgagggaacgccttttgcgccaggactttccggagaagatagcagatgaggctgtccgttacgtggagtcttttggatatgtggatgacagaagatatgtggagagttttattctttccaggaaaggacgtaaaagtaaacgggaaatttttgccgaactttccagaaagcaggtggatgaagccattgtggacgagatgatggagcgctgctatgatgcggaggattccggggaagcgatccgccgtttcctgaaaaagagacattatgacccagagcaggcaaccatggaggaaaagcagaaagtctacgcatatcttgcgaggaagggcttttcctaccgggagatcaaagaggtaatagatctggctgcgatggaagaatagatgcccgtaacagttcagccgaacagcggcttatctgagctgctatggctgaattgttacggtttccacgaaagaaaagagtcggtgcttgacatatttgttaaaacagtataaaatttaagtgttgtaattgtacaatgaaaattaaataaggaggtgctcctgtgcaaattttctatattatcgttgcagtcgtgattacgcttgtcattacagcggcagttacttattatgtgacggtttccaacttgaaaaagaatgcagaatccaagatcgggaatgcagagagtaaagcgagagaaatcatagatgatgcactgaaaaaagctgagacgacgaaaaaggaagcccttctggaagtgaaagaggaatcgatcaagaccaaaaatgaactggaaaaagagacgaaagaacgaagagcagagcttcagcgttatgagaaacgcgtcctggcaaaggaagaagcggtggataagcgttctgaagtggtcgaacaccgggagatgaatcttgcagcgaaggaagagcagatcaaggagcgtgaagcgaaggcagacgagttaaacagacaaagagtacaggaactggaaagaatctcaggacttacctccgaacaggcaaaagaatatctgttaaaaactgttgaagacgatgtgaagcatgattcagcaagaatgatcaaagagctggaaaatcaggcaaaagaggaagcaggaaagaaagcgaaagagtacgttgtcaatgcgattcagcgttgtgccgcggatcatgtggcagagacgacgatctccgtagtccagcttccaagtgacgagatgaaaggacgtatcattggccgtgagggtagaaatatccgtaccctcgagacattaaccggcgttgagctgattattgatgatacgccggaggcagttgtgctctccggatttgatccgatccggcgtgaagttgcgagaattgcattggaaaagctgatcgtggacggacggattcatccggccagaatcgaagagatggtcgaaaaggcacagaaagaagtagaatccatgattcgggaagagggagaggcggcagcactggaagtcggcgtacacggaattcatccggagctgattcgtttgcttggacgtatgaaattccgtacaagctatggtcagaacgcgctgaaacattctatcgaggtggcgcaacttgccggacttctggcaggagagatcggactggacgtccgggtggcaaagagagccggacttctgcacgacattggaaagtctatcgatcacgatgtggaagggtcccatatccagattggcgtggatctgtgcagaaagtacaaggaatcagcagttgttatcaatgcagtggaagcacatcacggcgatgtggagccacagtcactgattgcttgcgcggtacaggcagccgatacgatttcggcggcaagaccgggtgcgcggcgtgagacattggaaacatatacaaacagattaaaacagttggaagatatcgcaaaccaatttaagggggtcgataagtcttttgctattcaggcgggaagagagattcgcgttatggtagttccagaacaaatatcagatgacgatatggtattactggcaagggagatttccaagcagattgagttcgagctggaatatcctggtcagattaaagtaaatgtaatccgagagtcaagagtcacggattacgcaaaatagatattagagtcgatattgtaaaagtagggatccctgatctactgcaaagtaggtcggggattcttttatatccatcaatcaaaggaggagtcaggaaaatgagcgaaaatattagacgagttggaagagaactgaaatataagggggcaattctggatgtatatacagatcatatggagtttgaaaacggcaacaaggcagaatgggattttatcaagcacaaaggggcggcggctgttgtggcagtggacaaggatggcagactgattatggtgcgccaataccggaatgctctggatcggtatacgctggagattccggcaggtgcgcttgacttccctggggaacctggaatcgtctgtgccggaagagaattagaggaggagaccggctttcgctgtgagaagctggattggctcatcaacattcgcacgacagttgctttctgtaatgaaaagattgaggtgtttgtggcaagagatctgatcccgtcccatcagaatctggatgaggatgagtatattgagttggaacggtatacagtagaggaactgaaagaaaagatctttcagggagagatcgaggattctaagaccatcgcctctattcttgcatatgatgcgaagtattgcagataggagaagaaattttcaaacaagtttgaactcagatttttgtcactttgtgcatggctcaactgtaacacaagatatattctcgcagggagattcaggaatacaaaatcggacaggtgaatatgtattagtatctgtttatgaggaggacaaagcttgtgagaatagaaagagcaaagcagtattttgcggtggcattcatggctggatttataggggggatcctgttcgctaatctgacggtgcgggactatgtgacgacgtccggcatctataacccctattttctaaaacagtatgctcagtcagatatccaggcgggagagtatattttgtatctgtgcggaatccgactgattcctcttgcgctgatcgcgcttttgggacagaccagggtgcggagaatactgagcatcgttgtattcgcatgggcagggttttctgctgggacgattgtctgtgcgggaattctgaatatgggcatccaggggattgtgttctgggtgatcgccatggttcctcagtttttattttatgcctttgcgtatctgatcgtgctgtggtatttctttactgttcctcagtccaggtggaatttggggaagactttgtttgttcttctctttatggcggcagggctgattacggaggcctatgtgaatccgattctcatgcagatgtttctggatacattgtaagctgcaaaacgacagcctgagtttccatataagtggaacaagggctgtcgttttgtgttttggatacttacggtgatgaaattcagaccgtgcggaccagtactcgtactgccgcggcaaacacaaagatctgacttgcaagaagtccggtcagatatccgctcattccagtctgtggaatcaggagaaagacaccggcaatccggatgcaaagaccggtaaaattaatcagaaacgccatgttcgtatgtccgagaccgttcagaatactgatgtaggttgagtttgtgtagagaaacggacagataaaagcgagaacacggatgtaggaagccgcctccgggctgtggaagaccgcagcaccaagaaagtcggcaaaaaccagaaaaccaagagtgcagagaaaaccaagcacgaggcaggaaccgctgaccttgcggatgagctgacgaagagtccggttctggcttgcagcctgaatttcagccacagtagggagcatcatcatggaaatggaattggtgatggcggaagggaacaaaatacacggcatggcgataccgtttaagattccatagtggctgagggctgaggaacgcgtaaatccgtagagcatcaggcttcttggaatagagacgacttccacgctttgaaggagattcagggagatccggttggctgtgacaggaacggcatgtttcagaatatcccgaagacattccagatagagggaaatcgtacgtctggagagggtactttttgtataaagtatccgtcggacggcaaaaatgctgtaaaaggctcctgcgatctcgcccagaacgagtccacacacggcaagaataatcccggccgatcccgtctccttcatggcagcggtgtagagcagatagactccaaggacacgggcgcactgttctacaagctgtgagatcccgggtatcttcgtctgttttaatcccagagaatatccacagatacaggagtggacactggcaaaaggcagcgcataggacatgacttttaataaaggctcacagcggctgtcattcaagaggaacacagcaatgtcctgtgcaaaaatctggatgcagaccatgcagagcaaagataatacagtagaaagaaacagggcggtctgaaaggatgccctggaaagatcaggccttccaagggaagcataccgggcggtcagacgggagagtgcagtctctatcccggcggcagacaaagaaatacaaagtgcgtaggcgggaaagatcagatggtagattccaatcccttccgtaccaaaggagcggctcaagaagatccggaagaaaaatccaatgacccttgagatcagaccgacaagcgtcaggacaaaagctccctttaaaaatatttttttacggctggaaagatgcataagatacctgactttgttttttactatgatattcttggatatgggttgacagaaccagatgggggtgctattctacaaaaggggaaaccctagtaaaaaagtaggattaaatgaggtgacaacgtgaaattatcaacaaaaggaagatacgggctgcgcgcaatgatcgatctggctgagttttctgagacagaaccggtctccatcggcagtatttcacaacgtcagggaatttcagaaagatatctggaacagttgatggccaagctgaaaaaggcggggctggtagagagtatccgtggtgcgggcggaggctatgtcatacatggagattcgggcagtatttccgtaggggacatcctacgtgcgttagagggaagtctggaagccgtgacgtgtgcggcgttccatgaggacgagtcctgcgaggcacaggatatctgtgcgaccaagtatgtctggaaaagaatcaatgagagtatccgtacgacagtggacgggatttatctggcgcagcttgtggaagagagcagaaagaataaggcaaagtgccacagacagatttccccggaagcgctctgcggcggttccagaaaggaaacaggaaaggaagaaaaccatgagtaaactgatctatttagataatgcggcaacgacaaagacagcaccggaagtggtggaggcgatgctcccgttttttacagaatgttatgggaatccgtcgagcgtttacagttttgcgtccaagagtaaggaagcggtgacgagacagcgcgaaatcatcgcaggcgcactgggcgccaaagcgaacgagatctattttactgcaggcggcacggagagtgataactgggcaatcaaggcggcagcggaagcctatgagtccaaaggaaaacacattatcacatccaaaattgagcatcatgcggttctgcatacttgcgagtacctggagcgccgtggatttgaggtgacttacctgaatgtagatgaaaatggggtggtggacttagaagaattgaaacaggctatccggccggacacgattctgatctccatcatgtttgccaacaatgagatcggaacgatggaaccggtaagagagatcggggagattgcaaaggaacacgggattttattccacaccgatgcggtacaggcatttggccagatcccgattcgggtggatgagctgcatatcgacatgttgagtgccagcggtcacaaactcaatggaccgaaaggaatcggattcctctacatcagaaaggggctgcgtctgaagaatttcgtccatggcggagcgcaggagagaaagcgccgtgccggtacggagaatgtgcctggaatcgtgggtctcggaactgcggtggcacgggccatccgtacgatggaagaacggacaaaactggaaaaggagatccgagattacttgattgaccgggtattaaaggagattccttacacgaagctgaacggccatccgaccgaccggcttccaaacaatgcaaatttcagtttccggtttattgaaggagaagccatgctgttaagccttgatatggcaggaatctgtggatcgagcgggtctgcctgcacatccggctctctggatccgtcccatgtgcttctggcgatcgggcttccgcatgagattgctcacggatccctgcggctgactctaaacgaagagattacaaaggaagatatcgactatgtggtggaacatctgaaagagattatctcaaatctcagggccatgtctccgctctacgaagattttataaagaagcagacaaaataaagaaacggacttaggaggaaatcatcatatgtattcagaaaaggtaatggatcattttcagcatccgagaaatatgggagaaattgaaggcgcaagcggcgtcggaacggttggaaacgcaaagtgcggcgatatcatgcggatttatctggatattgacgagaatcagatcattcaggatgtaaagtttaaaacgtttggctgcggcgcggcagttgccacaagcagtatggccacggaactggtaaagggaaagcatatcaaagaggctatgcaggtgacgaacaaggcagtgatggaggcgcttgacgggcttccgccggtgaaagtacattgttctcttctggcggaggaggcgatccatgcggctctttgggattatgctcagaagaacggcatcgagattgacggactggaaaaaccaaagtctgatatccacgaaggagaagaagaggaagacgaggaatattaaaggaaggcggacagacaaagaaagcatgaagaaagagaaagtagtcatcggtatgtccggcggagtggattcttccgtggcggcgtatcttctgaaagaagctggatacgatgtaaccggagtgacgatgatcacctgcgacgaggaacagtgcggacaggatccatcaagagacgcaaaaaaggtagcggaagaaatcgggatcccgcactatacagtggactttcggaaggaatttaaggccagtgtcatggactatttctgtgaagaatatctggaagggcgtacaccgaatccatgtgtggtctgcaaccgctttgtaaagtgggaggcactcctaaattgggctggacaaatcggcgcggataaaattgccaccgggcattatgcgaatatcattactcttccgaacggtcggtatgcagtggcgaatgctgatgtgtccagaaaagatcagacgtatgcactatacaatctgactcaggaacagctttctcataccctgatgccgatcggaacgtatgagaaggacgagattcgcaggattgctcagaaagccgggatttctgtggcacagaaagcggacagtcaggatatttgctttatcccggacggggattatgcttcctttatccggaattacacagggaatgtaccggcagaaggaaactttgtagacagacagggcaaaattcttgggagacacaagggaatgattcactatacggtaggacagagaaaggggcttggtattgccctcggatacccggcgttcgtacttgagattcggccaaagaccaatgaaatagtactcggaaatgacgaggaatccctgaccacaaccgtgcgggcacatctgttaaacgctatgggagtggaacgttttgatgagatggaaggcagcaggctgtttgccaaaattcgctataatcatcggggcggatggtgttccttgaaagtgaccgggccggatgagatcacctgcacctttgaagaaccacagcgggcggtgacgccggggcaggctcttgtcctctatggtgacggttatattctgggaggaggacggatcctttgatccgaaaaggagaaccataatgataaaagcagattaccatatgcacacgtatttttcttcagactctgatacgccgccggaggcaatggcgcttggagcaatcaaaaaggggcttcgatggatttgtatcacagatcaccatgactgggattatccggaggataaaagtcagttttgtatcgattttccacggtatcttccggcaatccgaaaactgaaagaagactttcgggaccggatctccattcagatgggagtcgagatcggattccagaaacatctagggccatattataaggaactggcagatacctatccgtttgattttataattggcagcacccatgtggtggatggcagagacccttataacggtgtgctgtttgagaatcaaacggatgccaaggtctatgagcagtcctttgaggaaacgatggaaaacattcggatcatccgggactttgatgtcctgggacacatggactatattgtgcggtacggcagacaccaggcaaaggaatataactggaaaaactgctcagatctgatcgacgagattttgagatggctgatcgagcacgggaaaggcatcgagatgaacatggccggattcaagtatgggcttggtttctgccatccgtaccctgagatcatccgcagataccgggaacttggcggggagattatcaccgtaggatctgatgcgcatcagccggatcacatcgcctaccagtatgaggacgcgggtcggattctggaacagtgtggtttccggtattatacgatatttataggcagaaagccaaaatttttgaagatcaattaagctgtcttgcgattcagaacaaaagacttttgaggtctaaatcgcaaaagagaattgggaaaaacttggataaaaatagaaaagagacttgaattctggtattttttttagtacaatcattatggttgatgaatctttaacaaggagaaatcaccattgctgcgttatgcagaggagaaactaaattaaactttaggaggaattaatcatggcagtaaaagtagcgattaatggttttggacgtatcggacgtcttgcattcagacaaatgttcggagcagaaggatacgaagttgttgcaatcaacgatcttacttccccgaagatgcttgctcacttattaaaatatgattcaacacagggaaaatacgcattagcagataaggtgacagcaggcgaagattccatcacagttgacggacaggaaatcaaaatttacgcaaaagcgaacgccgaagagcttccatggggagaaatcggagtcgacgttgttctggaatgtactggattctacacatccaaagagaaagcttctgcacacatcaaagcaggcgcaaagaaagtcgttatttctgcaccagcaggaaatgatcttcctaccatcgtttacaatgtaaaccacaaacagcttacaaaagatgacaacatcatttccgcagcatcctgtacaacaaactgcttagcaccgatggcgaaagcactcaatgatcttgcaccgatcaaatccggtatcatgtgtacaatccatgcttacacaggagatcagatgactcttgacggaccgcagagaaaaggtgatttaagaagatcccgtgcagcagcagtgaatatcgtaccaaactctacaggagcagcaaaagccattggattagttattcctgaattaaacggtaaattaatcggatccgctcagcgtgtaccaacaccgacaggatctacaacaattttaactgctgttgttgagggaaatgttacaaaagaacagatcaacgaagcgatgaaagctgcgtccaacgaatcttacggatacaacgaagatgaaatcgtatccagcgatatcataggaatgacatatggttccttatttgacgcgacacagacaatggttctgccattggacaacggaacaacagaagttcaggttgtttcctggtatgacaatgaaaactcttacacaagtcagatggtaagaacaatcaaacatttcggaacattattataatctttcgtttccgaatcataagtagggcgggaattcctgccggaataagactcaacgaagggtccggtctcagtggggccggaccctttttgtcagaataaaaggaggcacagacaatgcttaataaaaaatctgtagacgatatcaatgtaaaagggaaaagagttcttgtaagatgcgactttaacgtgccgctgatagacggtaagatcacagatgagaaccgtcttgtagcagcgcttccgacaattaagaagctgattgctgacggcggaaaggtgatcctttgttctcaccttggaaaaccgaagggagaaccgaagccggaattatccttggcgccggttgcagtaagactttctgaattattaggacaggaagtcaagtttgccgcagatccggaagtggttggggcaaatgcaaaggcagcggtagaagcaatgaatgaaggagatgtggtacttctcgaaaatacacgttatcgtgcggaagagacaaaaaatgaggatacattcagtgcagagcttgcttctctttgcgacgtatttgtaaatgatgcctttggaactgctcacagagcacactgctccaatgtcggtgtgacaaaatttgtggacactgccgtagtcggatatctgatgcagaaagagattgatttcctcggaaatgcagtagagcatccggaaagaccattcgtagctatccttggcggagcaaaagtatccagcaagatttctgtgattgagagacttcttgacaaggtagacacccttattatcggcggtggtatggcttatacattttctaaagcgcagggaggaaagattggtacttctctttgtgaggacgactatctggattacgcattaaatatggtcaaaaaggcagaagaaaagggtgtgaaacttcttcttccagttgataatatcatcggagatcagttttccaacgatgccaatacccagactgtagcggcaggagagattccggacggatgggaaggaatggacatcggaccaaagacagaagaaattttttccgcagccgtcaaagatgcaaagacagttgtatggaacggaccgatgggatgttttgaaatgccgaagttcgctcacggaacaaaagcagttgcagaagcacttgcaaatacagatgccgtaacgattatcggtggcggagactccgcggcggctgtcaatcagcttggatacggagataaaatgacacacatctccacaggcggcggcgcatccttagaattcctggaaggaaaagaattaccgggcgtagccgcagctaacgataagtaaacacttagcgaaagcaagcacgaaagtgcgccgcttggagcgggtggataatgaagaaaagagggtttttaacatggcaagaaagaaaattattgctggaaactggaaaatgaatatgacaccatctcaggctgttgctcttgtaaatgagttaaagccgctggtggaaacagaggaagcagatgttgtattctgtgttccggctatcgatattatcccggctatggaggctgcaaagggcagcaacatcgtaatcggagcagaaaatatgtactatgaggaaaagggagcatatacaggagaaatcgctccggacatgctgacagacgctggcgtcaaatatgtgatcatcggacattccgagagaagagaatacttcaaagagacggacgaggacgtcaacaagaaagtattaaaggcgtttgagcatgatattacaccgatcatctgctgcggagagactcttgcacaaagagaacagggtgtgacaatggatttcgtgcggatgcagatcaaaattgcattccagaatgtaacggcagaccaggcaaagacagcggtaatcgcatatgaaccgatctgggcgatcggaaccggaaagacagcaacaacagagcaggcacaggaggtttgtgcaggtatccgggcatgtatcggagaaatttatgacgacgcgacagctcaggcaatccgtatccagtatggcggctctgtaaatcctgccacggcaccggaattattcgcacagccggatattgatggcggactggttggaggagcttctctgaaaccggatttcggtaaaatcgtaaactggaaataagacagactgccctgcggatttgtttccgcagggtttgctcgtccctgagatgactagtgtagtggtttttcccggaagtgtaagtaacagttcagccatgacagctcggattagccgctatgcggctttatcgccacttgcgtggcaaaattctcgctgatggcagagcgccatatacaaagcacacaaaaaatctttgttttcaaacaagtttgaactcagatttttgtgactttgtgcatggctgaactgttacggaaatattgcaaaatatgactggggatagtacaataaaagggtcggatgatgacgggtaaagccggaatcggggaagggaaagtaagatggtaacgattaaagatattgcacaggcggctaacgttagcgctatgaccgtctccaacgtcatacatgggaggacgaaaaaggtttccaaggagacaaaggaaaggatcgaacagatcatggaggagatgcagtatgtcccaaatatgggagctcggatgctcgtccagaacgagtcgaggattatcggggtgatttccaactttctgtcggatacagagcatgagacactgtatcatccgcttgccgcggaaatgatcggtgagattgagaaggaagtacgtgcaaggggatattatttgatgctgtactcggcctctacggagaaggagatccgggatctgatccatacgtggaaggtggacggactgctgacgattgggattccgacggagatctgccgcaaacttggccaggagattaagatgccggctgtatttacggactgctatttccgggatgatgagagatacagaaatgtagggactgaggatgaagaaggcgcttatctggcagcatcctatctgattgaaaagggacaccgtaggattgcctttgtcacggatggcccgtatgacgagaacgaacggccgatggacggggcggaaagaaagctaaagggttatcaaagggcgcttcgggagtcacacctgtcgttcgacgaggagcacgtatacaggggcagtatgcaggcggaaaagcagcttaccatgatgcagtccctcattggtcatatctttgattatacggcagtgatattcagcagggattcgtatgctttggaggcaatggattatttccgccatcacggcgtctggattccgaaggacatttccgtgatcgggtttgacgatcttacgatgtcaagacttgcctatcctagacttacaacgatccggcagggagccggcgaaaagggacgagaggccgccaagcttttgtttcaggcactggaagaaaaggaagaaaagaaggtagagatcagaattccggttcggctcatggagcgagagacagtaaaggaactctatgtataaagcccagtcgggatgagatttgcctgtaccccctgacggggacagatttcctgcgcttgaaagaaaaggggagagcatgtaaaattggaagatagaaataaaggagagaaaacaatgagtaagaaaccaacagtactgatgatcctggatggttatggattgagtgataaaatgaacggaaatgcggttgcggaggccaatactcctgttatggatcaattaatggcagagtatccgtttgttcggggaaacgcaagcggtatggccgtagggcttccggaaggacagatggggaattccgaagtcggacatttgaatatgggagccggcaggattgtttaccaggatctcaccaagatcacgaaggctatccaggacggagatttctttgagaatgaagcgctgcttgcagcctgtgccaatgtaaaagcgcatgacagtgccctgcacctgtacggtctggtatcagacggtggtgtacacagccataatacgcatatttacggacttctggaactggcaaagcgtcagggtatctccaaagtctatgtacactgtttcctggacggacgtgacactccaccggaatccggaaaggattatgtgcaggaactttcctataagatgaaagagatcggcattggtgagattgcgtctgtcatgggacgttattatgtgatggatagagataaccgctgggatcgtgtggagcttgcttataaggcgcttgtatatggagagggtaaccaggccaaggatgctgtggaggcgattcagaattcctatgacgatggaaaatcggatgaatttgttgttccggcagtcatcacaaaaggaggaaaaccggttgcgaccattcaggagaacgactccatcatcttctttaatttccgcccggatcgtgcaagggagattacaagagtattctgtgccgacgagtttgatggatttgacagaggagaacgtgtccgtacgacgtatgtctgctttacagagtatgacgttaccatcccgaacaagatggttgcgttccataagacagagattacaaatacattcggagaatatcttgccaaaaaccatatgaggcaggcaagaattgcggagacagaaaaatacgcacatgtaactttcttcttcaacggtggggtagaagagccaaacgagggagaagaccgaatccttgtaaaatctccgaaggtagcaacttatgatctgaagccggaaatgagcgcctacgaagtttgtgacaagttggtagaagcgatcagatctttgaaatacgacgtcatcattatcaacttcgcaaacccggatatggttgggcataccggagtggaggctgcggcggtgaaagctattgaggctgtggatgaatgtgtcgggcggactgtggatgccatcaaagaggtggatggacagatgtttatctgtgcggatcatggaaacgcagagcagctcattgatgagacgacaggagagccatttaccgcacatacaacgaatcaggtaccatttatcatcgtcaatgcagatccatcctatggattacgggaaggcggatgcctagcggatatcgcaccgactctcattgagatgatgggaatgaaaaagccggaagagatgacaggctcctctctgctgattaaaaaataagatcaagataaaagaaaataaggaagaaccgaagcggaaagccagagcggcatactcccttcggttcttttttgtcagaatcaaaggacgtgtgccaatgtgtccgaaggcatcttgaaaggaaacataatgaataaattttaaaataaaaattcattttagacatgcagatttgcgaaaaattgaaaaaatagcaagaaaattgcaagaaagtcttgacggatagtcaaaacatagatagaataatattcagtgaaaaagaggaagggcggtagaaccatgacagcgtataaagatctgagtaaagacgagctgaaggctttgaaaaaagagttgaccaggaaatttgaagaggtaaaggcgaagggactgaaacttgatatgtcccgcggcaagccttctacagagcagctcaatctttcgatgggaatgatggatgttctgacaagcagttctgatctggtttgtgaggaaggtgtagactgcaggaactacggagtactagatggaatccgggaagcaaagcagcttctggcggatatgatggaagtaccaaaggacaatatcgtaattttcggaaattccagtctgaatgtcatgtatgataccgttgcacgttcgatgattcatggtgtgatgggaagtacaccgtggtgcaagcttgataaagtgaagttcttatgtccggtaccgggatatgaccgccatttcgcgattacagagcattttggcatcgagatgatcaatgttccgatgacccctacgggtccggatatggatatggtagagaagcttgtaagctcagatccggccatcaagggaatctggtgcgtgccgaagtattccaatccgcaggggatcacctactcggatgaaacggttcaccgctttgcaaaattgaatccagcagcagaggattttcggatctactgggataatgcctatggaattcatcacctctacgaggataaacaggactatttgatcgagattttgatggagtgtaagaaagaaggacacccggatatggtgtataagttttcttctacctccaagatcagtttcccgggatccgggattgcggcgattgcggcatccgatgccaatctggcagagatccgcgagcagatgaagatccagacgattgggcatgataagctcaatcagctccgacatgcgagatatttcaaaaatattcacggcatggttgagcatatgaagaaacatgcggcaagtatgagaccgaagtttgatacggtactggcatctttggaaaaagagctgggcggtcttgaaatcggaagctggcttgctccaagaggaggatactttatctcctttgattctttggacggatgcgctaaggctattgtggcaaaggcaaaagaggcaggactcattatgacaaacgccggagcgacgtatccgtatggcaaagacccgcatgacagtaatattcgtattgcgccatcttatccgactctggatgagatcaagcgggctatggaagtctttacactgagcgttaagcttgtcagtgtagagaagctccttgcacaagtaaaataatttacgccccttctttaaaatttatatatgccctatatgaaatgctgtatgcggatacgtcgtatctcgcatacagcattttgcgtctaagagaaagagacgatgactggaaagtaaaaagaccgccggacgtatcgatggaggatacggatctcgaacggtcttttgcttttataaacaaatccctatttctgtcatatggacgcctggatatctttttccagatttttgtttgccgtggagagcatcagcttgattcggttaagctggttgacctcgctggcacctggatcatagtcgatagctacgatattggattccggatgaagtcgcctgagttccttaatgactccctttccgactacatgattcggcagacaggcaaacggctgggtgcagacgatgttcctggctccattctcaatgagttccagcatctccccggttaagaaccagccttcaccggtctggttaccaagagagacgatttcgcttgccatggaggcaaggtgctcaattctggacggcggggtgaaacgtttactttttttgtaagcgtccacagccggtttccggaaccattccagaacgctgattccaagattggcaagccgagcggaggacttcttcattcccagatgagtatgcttaaagttcgtattgtagaagcagtacagtaaaaagtccgccagatccggaacaacagcctcagcgccttcatgttccagaagatccaccagataattgttggccgccggaaggaatttgacaaggatctctccaacaacaccgacacgtggtttcttctcgtccgtaatcggaagcgtgtcgaaatcgtgaatgatctgccggcaaagctgtttgaagcggcgtctggaagggtagccttcggagacaaatttccggcagacaagagcccatttctcatagagagcattggcagagcctttttcggcttcatacggacggatacgatacagacatctcataaagacgtcaccgagcaatgccgcatagataccgcgcagcgccagcatcggtgtaatcttaaatcctggattcttttccaatccgcttaagttgatggagatgaccgggatgtgctcatacccggctttttttaaagcacggcggataaatccgatatagttggacgcacggcagccgcctccggtctgggagataatcactgccagatggtctgtatcatattttccggagagaatcgcgtccatgatctgcccgacgaccatcagggatggatagcaggcgtcgttgttgacatatttcagtcctacattgactgcgtctttattatcatttggaagaacttcaatcttatagccggatgcgcggaaggccggttcaatcaggtcgaagtgaatcggcgacatctgcgggcagaggatcgtatacttcttcttcatctctttcgtaaacggtactttccggatcgcggcgctgtgaacttcccgtttttccttcttggcgtcccggacacggatcgcagccagaagagaacgaatccggattcttgccgctcccaggttgttgacctcgtcaattttcagtgaggtatagatctttccggaaccggtgagaatgtcggatacctcatctgtagtaacggcatctagcccgcagccgaaggaattaagctggatcagatccaggttttccgtcgtcttgacatagtttgccgccgcatagagacgggagtggtacatccactgatccatgacatttaacggacgttccaccgggtttaagtgggagatggaatcttccgtcaggaccgcgattccgtaagaagtaataagctccggaattccgtggttgacctcaggatcatagtggtatggccgtcctgccaggacaataccgtggcgtccggtttgatccaggtaagcaagggtttcctctcctttttttcgaatatcctccctgcaggtttccagctctgcccagcctttgtgggcggcgtcccggattttttcctccggaatctggaatttctcccggaagatttccaccaggcggtctgccatgatttcttctgttgtcagggcaagaaacggattcataaaatcgacatgcccctggacgatctcgtccatattgttcttgatattttccgcgtaggaggtgacaatcgggcagttgtaatgattgttggcatccggaaattcatttctctcgtacggaatacaaggatagaaaatccggtccacattctgccggatcagccattccacatggccgtgcgccagctttgcggggtagcactcggactcactcggaatggattcgatgcccatctcatagatttttcgggaagaagcaggagagaggacaacggaaaatccaagctcagtgaagaaagtaaaccacaatggataatcctcgtacatattcagtacacgaggaaggccaatcgttccgtaaggcgcatcctctttggccaatggtttgtagccgaagtagcgttcattcttatacgcaaataagtttggaatatccgtatttgttttttcttttcccagacctcgttcacagcggtttccagtgataaagcgtctgccgccggtaaacttgttgatggtcagacgacagtggttagcacatctctggcattttgccatggaagtgtcgtaggtcaggttttcaatgtcctcgatagagagcatggtcgtctctttacagtcgtatgtatgataacgctccctggcgatcagagcagcgccaaaagcacccatgataccggcgatatccgggcggactgcctcacatcctgcgattttttcaaaacttctgaggaccgcgttgttatagaaggtaccaccctgcacgacgatattctttccaagctccgaagcgtccgataccttgattaccttaaacagggcattcttgataacagaataggcaagtccggcggaaatatccgcaacggaagccccctctttctgagcctgcttcaccttggagttcataaataccgtacatcgggtaccaaggtcaattggatgtcttgcataaagtgcttcatccgcaaagtcttctacggaataattcagcgacttggcaaaggtttctatgaaagaaccacatccggaggaacatgcctcattgagctgtacagagtcaactgtatgattcttaatcttgatacatttcatatcctggccgccgatatcgaggatacagtccacatccggctcgaagaaggaagcggcatagtagtgggatacggtctctacttcgccctcgtccagaagaaaggcagccttcatcagagcctctccgtatccggtggagcaggagtaagcgatccgtgcgccctccggcagcttggaataaatatccttaagcgctgtgatcgtagtggcaagcgggtctccgtcgtttccatggtagaaggaataaagaagtgttccgtcttcgccgaccagagcagcctttgtagtggtagaaccggcatcgatgcccaagtagacatttccctgataacttgccagatcctttacaggaacctggtgtttgtcatggcggtctttaaactcccggaaatcatcctcggaagagaaaagcggctccagacgctctacctcaaaatccatctggatatgatccgccagacgttgttgcagctcaatgatcgggatatccagatcttttttcgagttcagcgcagatcccaccgccgcaaagaggtgggagtttttcggcgcaatcgtatgctcgtcgtccagattcagagtccggataaaggcttcccggagctcagaaaggaaatgaagcggaccgcccagaaatgcgacgtgcccccggatcggctttccacatgccagtccactgatggtctgattgaccaccgcctggaaaatggaagcagccaggtcttctttcgcggctccatcgttgatgagaggctgaatgtctgtcttggcgaacacaccgcagcgcgcggcaatatcatataaagcagtataattctttgcatattcattcaggcccgtggcgtctgtctgcagcaaagaggccatttggtcgataaaggaaccggtacctccggcgcagattccgttcattctttgctccacgtttccattttcaaaatagataatcttcgcgtcctcgcctccgagctcgatggcaacatcggtctgcggtgcataatcctgtaaagccgtggatacggcgataacttcctggacaaacggaacaccaagatgctttgcaagtgtcagcccgccgcttccggtgattaccggggaggcgtggatcgccccgagctggtggacggctcttccaagcaaatcagaaagggtttcctgaatgtttgcgaaatgtcgttcgtaatctgagaataacagctcatttttctcgtcaagtactgcgatcttgacggtcgtagagccaatgtcaattcccagagtgaataaatccctttggctcatattacgttactccttttctattttgtacctgtagatgtatttcttcttatgattaatatatttttgcaacatcgattattatacgacaaaaagaagcaagatacaataaaatcttcctaaggaaaaatgaatttcttgtaaagtcttctgagctaattgacaaaaaaacattcagaagctacaatgggaatcgagtatgaaaggagagaaaaaatgaattggatttcacgtttagagcgtagattcggcagattcgcaatccctaatctgatgtatgtgatcatcattttgtatgcggtcggctttttgctgaacattctcaatccctatttttatatccagtatttgtcattgaatgtttcggagattctgcatggacagatttggaggattgttacctttttgatccagccgccgtcggacaatgcgatatttttgctgattgcactttacttttactatatgatcgggaacgcactggagcagacgtggggatcgttccgctttaacctgtatttttttacgggtgtgctgtttcacgtgattgcggcattccttatttatctgtttacaggacaggtttatctgctagggacgacgtatctgaacctgtctttgttttttgcttttgcagcggtttatccggatatggagttccttttgttttatcttattccggtgaaggcaaagtggctggcatggtttgatggggtattcttcgtctggaccgttgttcaggcgtttctcccgtcatacgggggaacatattccagctaccgggcgagcgcttttgcggcggttgtatcgcttctgaattttttgattttctatttttcgacgagaaattacgcaaagatttctccgaagcagcagaagagaaggcgggagttcaaaaagcagatgcaaagaagagagccaaatcactacagtgcacagccggacggacgggtgccgagacaccgttgtgctgtatgcggcaggaccgagctggatcacccggaactggaattcagatattgttccaaatgcaacggaaactatgagtattgtcaggatcacctatttacacacgaacatgtaaaatagaaacacgcagctgagtttacgaccagaaaggaatggaagagatgaagaagacgaagattgtatgtaccatggggccaaatgccaacgacgaggggctgatgcggaatctcgtgaaaaacgggatgaatatcgccagattcaacttttcacacggagattatgaggaacataagtatcgcatggatatgctgaagaagatccgggaggaggaaaagattccggttgcgattcttctggatacaaagggaccggagatccgcaccggtgtattaaaagacggtaagaaagtcatgctggaagcagggcaagagtttaccctgacgtctgaggaaatcataggggatcagaaacgggtttctatcacatataagggtctgacagaagatgtcatgccgggacgtaagattctgattgatgatggattgatcgaactggaagttctgagaattgagaaccatgatattgtctgccggatcatcaatggcggagagctcggtgaaaagaaggggatcaatgtgccgaatgtaccggtacgtcttcccgcgattacagataaggatcgagaagatatcaagttcggcgtcactcaggggattgacttcattgcagcatcctttgtgcggaatgcagagtgtatcattgagatccgaagctggttaagagaatgtaatgctccgtacatcccgatcattgccaagatcgaaaacgcagaaggaatccgtaacattgatgagattatccgaagcgcagatggtattatggtagcaagaggagatatgggcgtggagattcctgctcaggaagtgccgtatattcagaaagaaatcataaagaaatgtaacgataactttaagccggtcatcacagcaacgcagatgctggattccatgattcgtaatccgcgtccgactcgtgcggaggtaacggacgtagccaatgcggtttatgacgggacagacgctgttatgctttccggagagacggcacaggggaaatatccattggaggcacttcagatgatggtgcagattgtggagaatacagaaagccatctggattatgaagtccttctgaaaaaagcgcagcagcatagaaaacagagtatttccagtgcgattgggttttccactgtggcaacggcggacaatctgaatgcaaagtgtattgtagccccaacgatgtctggagcgacagcaaaagttgtatccaagtttaaaccaagggcggacgtgattggcgtcagtccggatgagtcgacgctccgcaggatgcagatttattggggagtacggccgctgaaatcgattccccttcgttctacggaagacgtttgtgagaatgccctggagatggtgaaggcgaagcagttcgtagagccaggagatgttgttgttttgacagcaggacttccggcgccaatgggaacttattcctactccggtaacggtgggagcaatatgatgcggattgcggtaattgaataagaaactgaatcaggacggatcggacagatccgtcctgatttatacttgactttctaaggagaaccgactatagtagtactataaagagctactaaggagagaaaatgggtaaagaacaatttaaggaacatttgatgaaatttgatttgacaagacaggaagccgcagtctatgagagtcttctggagaatggaaagctgaccggatatgaggccgccaagctgaccgggatttcccgttcgaatgtctatgtggcgcttgcgtccctgtgtgaaaagggagcggcctatctggaggcgagtgagaatggaaagcgttatctttctgtgccggtacaggagttttgcgaggacaagattgaccagttgaaaaaagaagaggactggcttgtaatgcatgcaccggttcggaaagaagaagaggaaggttatattacgatttccgggcaggagaccattgaggcgaaagcaagagctcttctgaaacgggcaaaagagagggtgtatctgtcttctggacgggcttttctggaggcagttctgccggagcttaccgagtttgccggagatggaaaaaaggtcgtcattattacggactgggaagcgtatgtcggccctgggaaggtatattacactgcagacaggaaaggacagatgggaatgattgtagattcctcctttattctgagcggcgaatatagaaatcaggatcgcaatacctgtctgtatacaagccagcgcaactttgtggagatctttaaagaggcgatggcgaacgagataaaagtaattgagcttacgaaaggagaaaccaactgatggaaaagaaaccatttgtttccaaggaaaaactggaagagatcataaaggagttcccgacgccatttcatctgtacgatgagaaagggattcgtaagaatgcaaaagcactgaaagaagcgtttgcatggaacccaggctataaagaatatttcgcggtgaaagcgacgccgaatccgtttctcattcagattcttaaggagtacggctgcggctgcgactgttcttcctttacggaattaatgctttctgacgcgatcggtatgaaaggagaggatattatgttttcctctaacgacacgccggcagaagagttccgtcttgcagaccgtctgggagcaattatcaacctggatgatattacccatattgaatttttggagaaagccatcggccatattccggagacgatcagttgtcgttacaatccgggcggagtgttcaagattaccaatgatattatggatcatccgggagacgccaaatacgggatgacaacggagcagatcacggacgctttccgtattctgaaggaaaaaggagcaaaagagtttggaattcatgcatttctggcaagcaataccgtgacgaacgaatactatccgatgttggcagaagtcctttttcagacagcggtccgtttaaaggaagagaccggagtgcatatcaagttcatcaatctgtccggtggaatcggaattccttaccacccggatcaggagccaaatgatatccgtgtgattggggaaggcgtaagaaaagcatacgaatccatccttgttccggccggaatgggagatgtggcgatttacaccgagcttggaagattcatgcttgcaccgtacggatgtctggtgacaaaagcgatccatgaaaagcatacccataaggagtacattggtgtagattcctgtgcggtcaatctgatgcgtccggccatgtatggtgcttatcatcatatcactgtgatgggaaaagagcacgctccgtgcgatcataaatatgacattacaggttccctttgcgagaacaatgacaagtttgcaatcgatcggatgcttccacagattgatatgggagacctgctcgtgatccatgataccggagctcatggatactccatgggttacaactataatggcaagctgaaatccgctgaagttctgctaaaagaagatggaagtgccaagctgatccgccgtgcggagacgccggcagactactttgcgacgtttgactgctttgatattggaaaagagctgatcgcagagtcaaataaaatttggaaataaatgtgaaaataatttcttgcaatcaaagaaaagttatgctataataattttcggcttcaatagccgagaaaagccggcgtgtcggaatggcagacgaggcagactcaaaatctgttgtgggcaaccacgtgcgggttcaagtcccgccgccggcaccagataatgataatccgaacccggttccaatcggggcggcttcggatttttagtatattttgagtgctaaagcaaaaacggtggtatcgtgagtgataccgccgtttttgtcataatgactttgacgacggtcagaaaggcgtttattggttctgggagagtaataccatataccacggaatcttgtaagaattgcattttgataattgcgtttttgcaattattctgtataatggagatatgcgaagaaagtgcgtgtctatgagtttaccaggaacatccggacagtacaggagaagcaacggaagcttcgcacccttgattgtgacggcgtcggctacggaagggattggaaaggtcatgccattggatgaggaaaagtgagcggcaagaaatagtaacctggatttggaggattgattgtgaataaagaatggtcggaacttaacaaaacaatgcaaacacaaattaggaagaatgatacctatgaggcgggtatcgatactctatttgaactgcggaatcggttaatgaaaatcttaaccgtattctatagcgaattaaatagagaagaatttaatgccatcccttttctaaatgcagacggttatcatagcaaaaccattgcatattcaatctggcatatatttcgtatcgaagatatagttgcgcatatcttgataaacgaagacgaacaggtgttttgcacagggggggtatcaggagagaatcaattcacccataataacaacaggcaatgaacttgaaaaacagcagattgcggatttttcaatgcagcttaatttgaaagagctttattcatatatttttgaggtaaaagcaagtactgaaaggatactcaaaagtctgtcttatggcgaaatgaaaaagaaggtatcgaaagaaagaaaagaatacttaaaatcgctaaatgtcgtaagcaatcatgaaaatgcgatttggctgattgattattggtgcaataaagatatacgaggactgatccaaatgccgttttcaagacattggattatgcacatagaagcaagtttacgtataaggaataaaatacatttataaatctttggagtgtaggtacctgaaaatgaaagaaaatattgtagctaagctgatatggaaagatgatagatgcgcctgcacacttgccgataaaatgatatattcgctcttttttcggtgcggacgttcataaaagaaaagagacaaaacagcggaaccattcatcttgaggatttcgctgtttttgtatattaagggaaaggtacaatgatcgataacaagatttcaggagggtgagacttttgaacagaaaatatgtcaaagaagcgataggctgcatgatgatatcagtggtaattgttttactactgctgggaatggttgctgtatttgaatatctggaaatccatgttccgggcagcagggaaatgtggatcgggctcattggagcagtacttgggggcgcgtttactctgataggagtcctcattacgctttatcatcagaaagagagcaatgaggagaacagacgtctggaatatatgccgattttaggatttgaagctattatgagtgagacagatccagagctcattttgacaatcacagaagaaggggtgataacgagtggttttttctgcctgaaacagaaaatttgctcgcagattgagataaaaacaatcaatcataattgtgtttttgattttcagattgagggatgtgcagtcaacgggaaaaagattgcttctggaagtgctttttatccggcaaaaagacgtctgacagataaagaagctaccagcattgtgtttgattatgatattaatacaaatgttttttgtctgcttagaatctcatataaggatgtatttggtgcttcctattatcaggacctgccatttacctatgctgagacgatctatgatggtgaagacagggtaaggcagattgtagagcttagggatgtaaaggctccgacactccagaaggatgcgaaagatctggaagaagctgtaaaagactatctcgattacaaggtattttgtgaagcatcttcgtatatatcctgatgagcgagaagattagccagcatatcactcaggacaacaagatcggcggccagcatggtaagttcctgctctgacagacactctgaaagtttgcaggcgatggtagaaagatagaacagattggaacattgtttcatagtataacccttgaacacgattttgtgattataatatacggaaagagagccaaacgtgacagaaggctctctattttttgtggttattagatctaaaatcatggaactgtaatcttaaaaagggaacaggagagatctctcccttccgcccctgtagtatattatttgtttataaagtccttttgattttatccttcaaaaaagtaattctttttatatctcataaaatacttaaaaagatattttgatattcgttatagaaaataatttcttttgcagtacagtgacacactgtattgttgtcattgatatttattcatctattgatataattgcataaattaaaaacttagttttgaagaataattgtatttgttgcacaaaaatcaagtaaaaaatttgtcaattattctgcggaaaaggtaactgtcaacagttgacttttaaacacggggggggggtataatgagcataaggattttcacaaagtaaagtgaaaaaggagagcactatgacaaaaacacccatatcaagaaaaacattaagagagcaggtagccgagattttaaggaaaaagattctgaatggagatattcagtctggggaacggattgtagaggctgatctggcaagggagcttcagatgagccgggggccggttcgggaggcgctacgtcaaatcgaggaagagggtttggttgtctacgagcctcacaagggctgtgtcgtcaagacgatgacgtatgatgagatgcaggaagcttatctgatacgatccacactggaaatcctggcagtccgtatgtgttccggaaagctttcaaaagagcttgataccaaaatggagcagaatctggttgaaatcgggaaagcggcggatgccagggatctttaccaggtaatcgaactggatgaacagtttcattcttacgtggtgatggcatcccacagtgaaaagctctacaaggtttggaagtcgctggaaagtgggaatacagcagcatactacaccatgagatcggaatcattgatgccatatgaatatattcaacaaaaccaccagaagattttggatgcgttccgggccaagtctgtggaggagatctgtgaaaagatccgccggcattatatgatcgtgccggagacgctgttccaggagcttcagaagaaaagacagtcagaggcaagctgacgggaaaagaagggagagaaaaagatgctgaaatttattggaaaacgactggcgtacgcaattcttacattatttttgattgcgaccgctacattctttcttgtggcaggggcaccgggagatccgattgcggcaaaggtcggacagatgccggagcaggcgcaggaaattattgagaagaaatatgggctggataagccggtatttcagcgttacacaacctatatgaagaatctgattactactggagattttggagagtccatcgtctatacaggaaagtccgccaatgatgtgatcaaagaaaatacgtggacgtccgccaagatcggtcttctggccatcttgtttcaggtaacaatcggtgtggctcttggaatgatagcggcactgaaccgggggaagccggtcgatcatgtgattcgggtactggtcgtactcgcgatctgtgtcccgagcttcgtatttgccgccgtgcttcagtatttcctggcatttaagtggaaacttgttccggtatttggctggggacagttaaaacattacatccttccggttgcggcctatgcgatcggcggaatcgcttcttatacgaagtacacgagaagcagcatgatttctgtgattggagaggattatattgtcaccgcacaggcgaaaggctgcaagagaaaacggatcgtcaaaaagcatgttctgaggaattcgatgattccaatcattactatgatcgggcctgcgatttccggagtgtttgccggttcttttattctcgaaaaaatgttttccatcccgggacttggcttttattatgtaaaagccgtatccgacaatgattacaccatgattatcgggcttaccatcttttttgcaatcctgtttgtaggagcgctgattgtggtagatattctatatggtatcgcggatcctagaattcgtgtggcaaaaggcaagaaatagaaaatgaggtgatcattatggaaatgaaagaaaagagaaatagcgagatgtccgttggggatacggaggacttgtttaaaagaatcggaacagaaggactctcgggggaggagatcggagcgaaatcgcttacatactgggcggatgtctggagaagatttcgtgcaaataagctggcgatttttggtttgatacttcttaccttgattgtgctgctgctgtttgttggcccggtgatttccggaaaagattatcaatacatcaatgcggctttgaaaaatcaaggcccgaattcggaatactggttcggaacagatgatatgggacgagaccttttcacacgtgtctgtgtcggcggacggatttcgatttatattggtctgtgctgtacagcggtcatgtttgtgatcggagctttagccggggctttggcaggattgaaagggggtcttgtggatgatattatcatgcgtatctgtgagctgatcggaaaccttccatatctgattattgtcacgatcctttcgatggtgatgggaagaagtttgttttctcttgtatttgccatgagccttacggcatgggtcggcacagcccgaatggtaagagggcagattcttcagatcaaagaacaggactatgtgcaggcagcaagagcgcttggcgcttccacgggaagaatcattatcaagcatctgttaccaaatacacttggaattatcatggtagacattacgatgtcaattccaggatttgtattcagtgaagcgtttttaagttatatcggtcttggagtcagacctccggagacgagttggggagctttggcgtccgcaggacagcagcagttgatgttttatccccaccagttattcttcccatgtcttctgattgtcctgaccatgttgtcgtttcatctgattggagacggactttctgacgcattggatccgaaactgagaaaataggaggcatcgtgatgagtgaaaatatattggaagtaaaaaatttgcatgtttcctttaaaacctatgccgggatatcacatgcagtaagaggagtggatttcagtctgagaaagggagagacacttgcgattgtaggggaatccggatgcggaaagactgtcacgtccaaagcgattatggggcttttgcctgctcagaataccatgattgataaaagtaatggagcacagattctctttcagggagacaatctgctggactatacggaaaatcagatgacagagatcaggggaagtaaaatttctatgatttttcaggatccgatgacatcgttgaatccaacaatgagaatcggggagcagattgcggaaagtattttgatccatactcagacatcaaaggagcatgccatgaaagaggcagagagaatgttggagttggtaaagattccgaatgcaccaaagagaatgagacagtatccgtttgagttttccggaggaatgaggcaaagagccatgattgcggttgctcttgcatgtaagccggaaattctgattgcggatgagcctacgacagcgctggatgttactatccaggcacagattatggagctgatcggaagtcttcagaaagaattagatatggcagtcattcttgtaacacatgatcttggcgtagtggctagtgtggcagattatattcaggttatgtatgcgggcaagattgtggaaaggggtacggtggacgaaattttctaccactttactcatccatatacaagggcgcttttgaattctgttccgaaaattcatacgaataataaagaaactttgtattctctgaaggggacccctccggatctgatcaatcctccaaaaggatgctcttttgcaccacgttgcgaatatggcatgaaaatctgtaggatgcagtatcctgaggagacgaaattcagtcattctcagaaatgttcctgctggcttcatcatccaaaggcggatgtcagcggacttccggaaaatatggtcagaagggggaatcagtaatgaatgagaaagaggttctgattgaagtcaaagacttaaggaaatattttcaggtaggacgccatcaggtattaaaagccgtggacggggtcagcttcaagatttacaaaggcgagacgctgggacttgtcggggagtccggttgtgggaagacgacatgcggcaaaaccgtgatgggactttatgacgcaaccgggggagaagtgatttttgacggagtcgagattcatagtcttcataaaaaagagaaaaaggaattcacaaaaagagcgcagattattttccaggatccgtattcttcgctgaatccaagaatgacagtgggggatattattggggaaggaattgatatccataagctgtatacagggaaagagcgacaggagaaaatctacgaactgctggaactggtgggcttgaacagggaacatgccctacgtttcccgcacgaattttcgggaggtcaaaggcagaggatcggaattgcaagagcgctcgccattgaaccggaattcattgtctgtgacgagccgatttccgctttggatgtatcgatccaggcacagattgtgaatctgctgatcgagctgcaaaagaaaaggaatctgacctacctctttattgcccatgacctttccatggtcaaacatatctcagaccgggtgggagtgatgtatcttggaaacatggtggaattcgcgtccagtgatgagctgtatagcaagcctctgcatccttatacaaaggctctgatgtcggccatcccgatcccagatccgaaagaagagaagaagaaaacaaggattcccatcgaaggtgagatcccaagtccggtgaatccaaagccgggatgccggtttgcggcacggtgtaaatatgcgacggaactttgccgcagcgagacgccgaaactggaggagatggaagaaggacattatgtggcctgccaccgggtaaaggagatctgataagagaggagatcttatgtgacgagcattagaagcgcaagttctatgattccaaatccgaagctgtacggatttaggataataaaatttttcaataaaggaggaatattatgaaactgaggaaaaaagtgctggcgggacttcttgctgctgccatgacagcagggcttcttgcggggtgcgggggcgaagaaaaatcaggtggcggaggtggtggatctgccgagcaggtgctgaatatttctactaacagtgtggtagtcggcttaaatccgctggtcaacacaacgggaccggacaataaagcgcacaatatgatttatgatccgcttgtacgggatcgttcggcaaaggacaatacggatgagatcgtgccggcagccgctgaaagctgggacgtgagtgaggacgggctgacgtacacctttcatatgaatccggacgcgaagtggagcgatggatcgaaggtgacggcaaacgattttgagtttacgttcaagaagatggccgatccgaatacggccgcgacaaatgcatggctgtttgatggggttattgagaatttctctgaggcgttgtataataacggaaagacgccggacgaaatcggcgtcgcagcgacagatgagaatacactggaaatccaactggtgcatccggcttcctatttcctggagctggtagcgggttccgtttatccggtcaatgaggcaaagtatgaagagttcggttccgattacggcacagctccggacaaaactgtctacaatggacctctgaaagtgacaagttggaatcagaacacggaaatgaatctggagcagaatgatcagtactggggaaaagacgatatgaagcttcaaaaagtcaatcttcggattattcaggatccttccaccgctgtccaggcatttattaatggtgaactggatgtagtgagcacctctgatacgaactggggcaagacaatttcagcggcaggcgattccgaagagatcacagttccgacaaacgcaccggaatttttcatgttcaacctgaaaaatgaatacctgagtaatacaaagatccgtcaggcgctttccattgcttttgacagacaggagatggtggatgctctgcgtgatggaaaatctgaaccgatctattctctgatgccggatacaatgaaagtaggggaaaagacatatacggagctggtagatggaaagaaccattttgtttccgagatgcaggagcagtatccggatccgaaggtgcttctccaggagggattgcaagagcttggaaaaagcacagacccgtctcaggtaacgattcgctatgcaagccgtggaacagatgaactgtctaagaaaatcggggagtggatgaagcagacatgggaagaaaatcttggtatcaatgtacagattgatatgatggaatggaacattatgtgggacaagattgatgcaggggattacgatattgcccaaggcggatggggcccgtattataatgagccgagtgcatttcttcagctttttgatccggataatggttatttcaactctgcaaaaacaggatggacaaatgaagagtccaaacagtataaagaactgcttgaaaaagctaaaaatatcgttgacgacaaagaaaaggcagagatttatctggaggcggaaaatctggttgtcggaaatgcattgattgcgccgacttacctggaggcatcaccgacctatgtgaaaaactatgtgaaaaactattttgtaacgacaaatggaacagtggatttttcacaggtatcgattgaaaagtagagaacagacagatcagaaggccaatcacaagcgggtggttggcctttttcaaaagagaaggagggaaagcagatgtacctgattaagaacggcgttgtccatgtgggggacggcacgattctgaaggactgcgatattttaacaaaaggatcaacgatccaaaagattggccagggacttgattgtcccgaggctgaggtggtcgatgcgtcgggctgcgaggtatttcctggatttatcgatccacattcgatgattggagcgcttggaattccatccagaagtctggataaccaggaaaaatccgatcctatcacaccagagctgaatgtcaagtactccgtagatcctgacgaactaaacggacaggaattttataaaagcggaatcaccacggtcggactggctccggggaatactaatatcatgggcggacagattgtggtggtgaaaactgcgcctatgaaaatgagcaggcgtatagtgaaagaaaaagcggcattaaaatgcagcgttacggcgtcggtcaaatcggtttatgggaagcaaaacaagatgccgatgacaaggatgggatcgttctggatgcttgaggaggcaatccgaaaatcagaaaaaagtggcggaggtacagaaaatcaagagagagatcgggtgatccaggacgtctttgacaaaaaaaagatgccagtctttgcggcggcagagcggatcggggagatcgcaggtctacatcatttgatggaagaaaagcaggtgccattcgtcctggtggacgggtatgagtttggagatgtcatagaagatatgaagcgtcagcatacgggactaatccttggcaatgtaaacgatggatccaggattgcaaagcatagaatggatcttggtaaaataaaggaattggcagaaaacggaaacaagatagcttttaccaattccagcagtggctcttccgaaggaagagaagtgttcctctggacagccattgaggtattccgcgccggcgtggatgcagaagaagtggtaaagatgatgacgatacatccggccgccatgcttggcgtgggagacagaattggagcgctgcgggaaggaatggacgccgatcttgctatctatacgggacatccggtgaaaacatatgcggccagagtcaaacacagtatcatcaacggggaggtggtcttctgatggaacacatattgattcaaaacgggacattatatacgatggaagagggaacagaaccatttcagggagatctgcttgtcgcagaaggaaaaatcaaaagcatcgcaaaagagatttgtccggcaacactgccgtctgatacgaaagtggtggatgcgtccggaatgaacatctttccgggactgattgacgcacattcccatatcggactctttgattttaacggtgagaattcggtcgacgacgctaacgaaatgacggggcctgtcactttgtccgtggacgccagatacggtgtcaaccccaaggcaaaagaattccgggtggcatatgagcacggcattacaaccatgcttctgacaccgggaagcggcaatgtattctgtggtctgccgtttgccctgaaaacatatggtgacaatgtatttgacatgtctatcaaagcgccatgtgcggtgaagattgctcttggggggaatccgaaagggacctacggggatcgaaaccagcttccgatgacgaggatgggcgtggcaaaggtgctctgggaaacctttggaaaggcaaaagcctatcaggaagcaaaagaaaaaggagaagccttggagtatgacccggatatggaggcgatgcttttggcacttcgtggagagatcccgtgcaagatccactgtacccagtatgatatgctgacagcgatcgaagtggcgaaggcctttggggtacgtttttctctggaacatgcatggggcgccacagattatatggatgagattgtagagagtgggtgcgacatctgttatggtccgatcgggacataccgctgcgtgggagaacgaaggaaggtagatattgaggcggtaaagacattggacgagcgaggggttacggtagcgctgattacggattctccgattctcagcgaagagtctttgtatcaccacatcggagaggctgttcgggagggggtaccgtggatgcgggctcttcgaatggtaacggtgaatccgtcgaagattctcggagtggaagagcggatcggcactcttacagagggaaaagacgcagatttaattctggtgaaaggacggctgggattggatacagatgcaaaagtactttgtacgatgataaacgggcagattgtatatcagagcacacgttaaagaggatcgggaatgagcaggtgctgatcccggatccatctatcaccaccggaaagaccatcttaatgccagagaatatactatggcggcaaggcatgcggcatggagaggactaaatctccagccgcttttctcgttttataggaaactgcattatcagaaaggattacaaaaaacagttgaaagaacgggcaatgtcggttataatacaatctggcggaaacgccggcacaaagaaaaatggaaacataagggagtagttggcacttttacagtgtgacaaagtcaacatattggagagatcctggctttgtatgaaacagcgagacttatctgtatcagacgatgatatgggtaggactcgtttttttttgcccttttgtaaacaggttgtgcgtattcaaaggaagaaaagaagaagcaggaggaaactgaacaatgggatttttagagctgttctttatcgcagtgggtcttgccatggatgcctttgcggtgtcgatctgtaaaggactgtccgtaggggtggcaaagccaaaatacgtgttgtgcgtaggactttattttggaggatttcaggcgctgatgccgacgataggctattttgtaggagtcaatttccggggagccatcgagagtgtggatcactggattgcgtttattttgctggctatcatcggaggaaatatgatccgggagtccagaggagaagaagaatgtgtgggagcccgttttgatgtaaaagagatgacggcgcttgcggttgccaccagcatcgatgcattggcagttggtgtaacattcgcttttctggacgttagtatcgctccggcagcggcgtttatcggctgcctgacgtttgcgatttcggcggcaggactgaaaatcggtacggtttttggaacaaagtatagaaacaaagcagagtgttttgggggaattgtcctgattctgatcggtctgaaaatcctctttgagcatcttggaatattttagcgttgtaaaagtggacaaaacgaagtaaaataaaagaagtattttaacaaagaacggagtttggcgatgagtgaaaaacagtttcaggatcagaaaatcgttctgattgacggacacagtattttgaaccgggcgttttacggtcttccggacctgacgaatgcggaaggacttcacaccaatgcggtgtatggatttttgaatattctttttaaaatactggatgaggaaaagccggaatttttgaccgttgcgtttgacgttcacgcaccgacgtttcggcatgagatgtacgaagaatataagggcaccagaaagccgatggctgaggaactgcgtgaacaggttcccctgatgaaagatgttttaaaggccatgggtatccgtctgattgagaaggcgggactggaagcggacgatctgatcgggacgctttcgaggcgctgtgaggaggcggggatggatgtggttgtcctttccggagaccgggatctcttacagcttgctacaaagaaggtcaagatccggattcccaagacgaaaggcggcaggaccgaagtagaggactatctggcggcggacgtcaaggagaagtaccaggtgactccgcaggaatttattgacgtcaaagcgttgatgggtgatacttccgacaatattccgggggtgccaagtatcggagagaagacggcgacgaaaatcattgtggaataccaaacgattgaaaatgcgtatgcccatgtagaggaaatcaagcctccaagggcgtccaaagccctgaaggaacattatgatatggcgcggatgagtaaagaactggccaccatcaacgtccatgcggatttcccttacgaggtggaagagggacggatcgggaatctctttacgaaagaggcgtacgagtggtttcagagacttcagtttaaaaatctgctcggaaagtttgagattcaggtgccagccaatgccatcgaagatagattccggacggtgacagatccggcagaggcccaggcagtgctggggcgtgctgcgtccgcaaagacagtgggtatcgctctggagaaaaacagggagaatatgcttccactcttttccatgggaagtgaaattaccggcgcggcattcgctttttcccatgacggcaaggaagaggtcgtctctattttggtaggaggcacattgacagcggaagcgctgctgaagcagatttccgcacttacggagagcagggcagaaatttccatgttcgatgtgaagcaggatatgaaaaacttccgggtgtgcagaccggagaatgtctttgacgttcatgtggcggcatatctgctaaatccgctgaaaagctcttatgagccgaatgatgtcgccagagaatatctggatctgacgattgacgggaaactctctgaggagaagaagcgttgttatgaggcgtacaccatgtaccagggagcggccatcctccgggagaaactgcaagagagcggtatggaggcgctttttgatgaaattgagatgccgcttgtctttgccttgtttgatatggagcaggcaggtgtgaaagtggaggcgcgagagctgaaagcctatggagaggagcttggtgtccagattgaaaagctggaaacggagatttttgagctggcgggggaggaattcaatatcaattccccgaaacagcttggagctgtgctctttgagcatttacagcttccgcacgggaagaagactaagaccggatattccacggcggcggacattctggagaagctggcgccggattatccgatcgtttccaagattctggaataccgtcagattgcaaagttaaaatctacctatgcggacgggctggcgcattttattcaggatgacaatcggatttacggcacctttcatcagactgtgacagctacggggcgaatcagcagtaccgagccgaacctccagaatatcccgatccggatggagctgggacggcagatccggaaagtatttgtgcctaaggagggttttcaatttgtggatgcggattattctcagattgaacttcggattctggcacactgttcagacgacgaggcgctgatccaggcataccgggaggcaaaagatattcaccgcacgaccgcgtcccaggtgttccatacccctttcgaggaggtgacggatcttcagaggagaaacgccaaggcagtcaacttcggcattgtctacggaatcagttcctttggacttagccaggatttaagtattacgagaaaagaggcggcagagtatatcgaccgttattttgagacttatccgggtgtgaaaaaatatctggacggcgaggtggcatttgccaaagaacacggctatgtgacgacgatgttcgggcgcagacgtccagttcctgagctttcttccagcaatttcatgcagagaagtttcggagaacgggtggcgatgaattccccgatccagggagcggcggcagatattatgaagatcgccatgattcgggtcaacagacggctcaaggaggaaaatctggaatcgagaatcgttatccaggtacacgatgagcttttagtggaggcgaagaacgaggaagttgagcaggtcaaagcgattctcaaagaagagatggagcatgccgccagtctgaaagtcccgctgattgctgacatgagcgtgggtgccaactggtatgaggcaaaataggttatagatgggtgtcagatgaaaacgataggaattacaggaggagtcggggccgggaagagtacggtcctagacttcttacgagaaacatatcaggcctccgtctgtgaggcggacaaggtagcccacgaactgcaaaggccgggggagggctgctatcaggagattctgaaagtattcggaccggagatcttgtgtgacgatcagaccatcgaccggaaacggcttggcagcatcgtctttgccgatgtggagaaattaaaacggctgaatgggatcgtacatcctaaagtcaaggaatggatccgcaaaaaacaggaagaagagcaacgggccgggacgaagctttttattatagaagcggcgcttctgctcgaagatcattatgaggaaatctgtgatgagctctggtacattcgtaccccggaggcagtgcggagaaggcgtctcagggaaagccggggatattcggatgagcggatcaaaggaattatgcagaatcagaagtcagaaacacagtttctgaaagcgtgtgacagagtcatagaaaatggagaggatttcaaagagacttgtatccagatccaaaaagcgttagaatcgtactagaaaccgtgaaggagaagaagaacatgagaatttgcagtatagccagcggaagcagcggaaactgtatttatgtgggagatgagcatacccatgtgctggtggataccgggatcagcaagaagcggatcgaagagggattaaaagatctggacgtcaaaggggatgagctggatggtatttttattacccacgagcatgcggatcatattcaagggctgggtgtattcagcagaaaatatgggatccccatctatgctacaaagggcaccatcgagggaatcaaagattaccggagtcttggaaagatgccggagggacttctgcacgagatccgtgcagacgagccttttactttaaaggagctgacagtatgtccgtttcggatttcccacgacgcaaatgaaccgaccggatatcggtttgaaaatggtgaaaaatcagcggccgtagctacggatcttggaatctacgatgattatactgtggagaatctgaagggtctggacgctatccttttagaggcaaaccatgatatacatatgctggaggtaggagtttatccatactatttaaaacagcgggtaatgggaaagcagggccatctttccaatgagttatcaggcagacttctgtgtgatattctgcacgacgatctaaaatgcgtgatgcttgggcatttgagcaaagagaataattacgcagagctggcttatgagactgtgaagctggaagtcactcttggtaacaatccgtataaaggagaggatatcccgatcatggtagccaaacgggataccaggtcggaaattatcactgtttaggaagaaaaggagaggatgatatgagtcgtgttgccgttttaactgacagcaacagtggaatcacacaagcagcagggaaggaactgggagtaggaatccttccaatgccgttttttattgacggagaagaatattttgaagagatcaccttatcccagaaggagttttatgagcgtttgaaagcaaaccatgacgttaagacatcccagccagcgcccggagacgtgatgggaatgtgggacaagtatttggaagagtatgatgaggttgtctacattccgatgtcaagtggtctgagcagttcctgtgagacggccatcatgctgtctacagactatgacggtaaagtacaggttgtcaacaaccagagaatttccgtgacacagaggcagtcggtgctggacgcgctgaagcttcgggacgcgggaaagaatgcggccgagatcaaagagattctggaaaaggtcaaactggaatccagtatttatattactgtggatacgctcaagtatttaaagaaaggcggacgcattacgccggcggcagcggcgattggtacagttctgaatttaaagccggtgcttcagattcagggcgagaagctagacgcttacgctaaagttcgcggatggaagcaggcgaagaagacgatgctggacgccattgagaaggatatgctgcaccgtttcggaaagcagccggttcatttggaagcagcttatacctgctctgaggaagaggcacggaagtggaaagaggagatcgaggatcgtttcccggaatatgaggtggatatggatccgctttctcttagcgttgcctgtcatattgggccgggagcaatggcagtagcgtgctccaaagtgctgacagtgtaaaaggaaaacagactgacaggaaactgtatcagttgtaaaaaagagctctttaccggacaggaggatctgacgggcctcatgttcgttcggtaaagagctcttttatcttttccaagagaaggggaatccggtatttatacgatgacgagagggtggctgtactcgttgcaaaacggagtcttaaacttattgctaatgaccgactcgtacagatttgacgcaaaaatatccagatgaagcatctgctgtccatgttcggaaagggagtccatatcactgagctttggaagcagcggaatccgggaattcttcttgataaaggaaagaatttccttttccttctggacgaagccaagcatccgggcataatggataaagccgtcggcggctacacgatccagaaaagaagcctggatgccgagcatgatatgaagcagacaacggctgatccgggagtaggtcacctcttttgtctttatcaggtcacagaactggtcaaagttctgatagctgttgagatgcttcataatacgattggcaagctcctcggagacatccgcatatcgggtaagcgttccgcggctttcccgaataagctgatatttgataagcagggaaaaatcattgctgtatatcgggtagcgggttagatgagtcctctccagcaggttgacacattcccgcggcacatgatcttccagccgtgccaaaatggaggagagctttggctcgtcgtaaggtgtgtcttccactgtgcgtagagaacttcctgaaaaaaggagaagtctgcggatggcggtagcggagctgaaattcccggccggttctagggtatcagcatgataccgggagtctttccggagaatggtataaggccggattgtgctttcctgccggatcagtgctttgatgtattccactcccagtgtattgttcgggcttgccaaaatccgggacagggcaggatcgtgaagataatcctgcagagcccgttctctggcagatggaaagggaagcccctctttgagcgaagcacgaaggagagcccggtattcttcaggctcatcggagagcacttcagcgatccgggtgagtggctgaatatctccacattcgcttccgaaacacagggcgtccacgcagcccagactgtccagaagggccacggcaccctgggcaaaatattccgcgcttcccgtggcaaagcataccggaagttccaggacgagagaagccccggattttaaagctactttggctcttaggtgttttggcatgatggcaggagcgccgcgctgtacaaaattaccgctcatcacaacaatgacagtatccgctcctgtcacttcttttgccttttgtatatgatattcgtgcccattgtggaaaggattgtattctgcaattaaaccaactattttcataatgtccttgtaatatcctccttattgtgattatactataaaaggaatccgcttgcaaaaaaatctggtggaacgaaagggggatacacatggaccagaaagcgctgttggcacttttggaagaacgaaagtttaaagaattaaaagaagaactgggaaatatgtaccccgttgacatcgcggaattgctggaggaggtagacgaaagacagatgatactgattttccgtctgctcggcaaggaagaggcggcggagacttttacggatatgagcagtgaaacaagagaattcctgattaatgccttgacagattccgagctggaagaggtcatggacgagatgtacgtggatgacacggtggacgtcctggaagagatgcctgctaatgtggtagacagacttctgatggcaacagatgaggagacaagggtgcagattaacgccctgttacagtatccggaagacagcgccggaagcgtgatgaatattgattatgtcagtttccgaaaagagatgacggtagaggaggcgattctcaaaattcgccaggttggcatcaaccgggaaaccatttatacctgttatgtgacggagaagaagaagctcatcggatgggtggatatcaaggacctcctgacttccagcgagagcagaacgattgaggagatcatggataccaacattctttatgcacatacccacgatgaccaggaagaagtggctaccatgatccgcaaatacggacttgtagcaattccgattgtcgactatgagatgtgtatggtcggtatcgttaccgttgacgacgctatgatcgttttacaggaagaggcaacggaggatatcagcatgatggccggtgtcagcccgaacgatgattcctacttcggaacgagcgtctggcgacatgccctttccagaatcccatggcttttgtttctgatgctgtcagctacggtaagcggccttctgcttgcctattatgaaaacgcaatgtcggccatgccgattttaattaccctgatcccaatgctgatgggtaccggggggaattgcggttcccagagctctaccctgatgatccggggactggccgttggtgagatccggttcaaggatctttttcgggtgatttttaaggagatccggattgcgctcattgtcggtgtggtactgtctgttgccaatgggatcagaatttatgttatgtatcaggatatgaagcttgcgtttgtgatcggtatcacgattattgcgattgtctgtatggcaaaggtggtgggatgcgtccttccgcttgttgcaaagaggatcgggcttgacccggcactgatggcgacgcctttgatctcgacgcttctggatacgggtacgatacttgtttattttgcgattgtaacgctgatgtttcgattgtgagttatagaaaaggggaattgtatcaaaaaagagacagattatctcttgtatacaatttccctttacgttataataatagcatctgagaaaaaatggaaaggagtcattaaatcatgggatttattgatgaaatcaagacaaaagccaaagccgatctcaagaccatcgtacttccggagacagaagacgtccggacttacgaggcggctgaggccattttaaaagaggggacagcaaagcttgttctgatcggaagcgaagaggaagtcgcaaaaaataaggggaatttcgatatcagcggagcacagattgtggatcccgcaaagagcgagaagacggagagctatatcgcgaagctggtagaattaagacagaagaagggtatgacagaggagcaggcaagagagcttcttctgacgaactacccgtactacggcgtgatgatggtgaagatgggggacgcggatggaatggtttccggtgcctgtcactctacagccgataccttgcgtccgtgtttacagatcctgaagacgaaaccgggcaccaagctcgtatccgcattttttatcatggtagtgccggattgcgagatgggggagaatggtacattcgtattcggcgactgcggtctaaaccagaatccgagcccggaagagctggcagcaatcgcaatctcttccgcagagagttttaagcagcttgtaggggcagagccgagagttgcaatgctttctcattcttccatggggagcgcaaagcacgacgatgtgacaaaagttgtagaggcagtcaagatcgcaaaggcggaagcgccggatctgatgctggacggagagctccagttagacgctgcgattgttccttccgtaggggcatccaaggctccgcaaagtccggtagcaggaaaggccaatgttttgattttccctgacctggatgcgggaaacatcggctacaaattagtgcagaggctggcaaaggcagaagcttatggtccgatgacacagggaatcgcagccccggtcaacgacctctccaggggatgcagcgcaaaagatattgaaggtgttgttgccatcacggcagtacagtgccagtcaaagtagaaaggaagaaagaaaatgaaaattttagtaattaactgtggaagctcttcattaaaatatcagctcatcgacatggaaaatgagagcgttctcgcaaaaggactttgtgaaagaatcggaattgaagggtccaaactcactcacaaaccaacaggaaaagagaattacgcgatcgaaacaccaatgggcgatcataaggttgccgtgcagcttgtactggacgctctgatggataaagaacacggcgtaattgaaagcacagaggagattacggcaatcggacatcgagttcttcatgcaggaacggtttacagcgatgcgacgttaatcaatgaagacgttaagaaagtcattcgtgactgctttgaccttggccctcttcacaacccggcgaacctgatcggaattgaggcatgtgaagcggcaatgccaggaaagccgaatgtagcggtatttgacactgcgtttggtatgaagattccggagaaagcagcaatgtatgcgatcccatatgagtattatgagaaatacagcatcagaaggtacggcttccatggtacaagccatatgttcgtatccggtgagacattaaagaaaatcggaaaagacgatgcgaaagtcatcgtatgccatcttggaaacggtgccagcatctccgcatccattggaggaaaatgtgtcgataccagcatgggactgacacctctggaaggtctgattatggggacaagaagcggtgacctggatccggctgttctgcagttcatctgcaaccatgagaatatcgatgtaaatgagatgcttaacatcctgaacaagaagtccggtgtccttggaatgagtggggtatcttccgacttccgcgatgtaagagaggcggctgacgcgggaaatgaacgtgcgattatggcactggatgcttacagataccgtgtggcgaaatatatcggttcctacacagcggcaatgaacggcgtggatgcgatcacatttacggctggcgtaggcgaaaatgatactcagatgagagaggaaatctgcgaatatctcggctacctgggtgtgaagatcgacagtgagaagaatgcgcaggctcgtggaaaagaagaagaaatctccacaccggattccaaagtcaaagtatatgtcattccgacaaatgaagagcttgcgatcgcacgcgagacaaaggctttggtataatctctttccttataaaaaactgttgacaaaaaaatgtgacatgatataatagtcaaggtatgaataggagcaatgaatatgctgttaaacctatccgacgtactgtccgaccagcacagtccgattgatgcggctgttccactggaaattaacacgatgaagctgccgggaggttcatatcccttcgaggagaggagcaacgtacagattcatgtggagcatgtaaaagggaaagagatcgctgtctcgggaaattgcagtctgactgcggtgattccgtgtgaccgttgtctcagtccggtgagagttccgatggagatttcatttgagaagcgtgccattgtcggtggagaggctgaggagacagacgaagcatcagattatattgacggatatcatcttgacgtcgacaaattactctattatgagattttgataggatggccgacgaaaaccctgtgcagggaagactgcaaaggactttgcagtgtatgtggtcagaacctaaacgagggtacctgtgactgtgaagacacgggtcttgatccaagaatgtcagttatccgcgatctgtttaagaattttaaggaggtgtaaccgatgtcaatttgtccaaagaataaaacttccaaagcaagacgcgacaagagaagagcaaactggaaaatgagcgctccgaatcttgtaaaatgcagcaaatgcggcgcacttatgatgcctcacagagtttgcaaagcttgcggaagctacaacaagaaagaaatcattactgtagaagactaatgagaacaatgaaaaagggagtttgcaaatgcaagctccttttttcgtgggaatttaccacacttcatcttcgcaataacaataacagtatcagcatccttataatttcccaatactgcgtcttcccgtgatttttccagtttctgtaataacatttcttcgtccataaatgcatatggattacgttctagtctcttgatttcaaatgggaatccgttattggcaactgcttgtgttaaaaacaatctgattgcagatgtagtaatagcaatccgagagttcagctattacacctccttgccgggaaactgagcataatatgagttccatatcccggttcgctgataatctcaaagccattttcttccggatagaggatcgccagtcggtcacggacattggaaatgccgatctggttgccggttccggacgtagaagaagcatgtagaagcatcgccacctgctcttttgacatcccgtcgccggtatctgtaatatcacagtaaagcttccccttgttctgatagataaaaatatgaatgctcccgctcttcgtctgttgaaacgcatggaaaaacgcattttccacaaggggctgtaaaagaagattcggaatctccagatcggcacagtccggcatagcgtctgcatcggcctggatcagtccaccgtatcgaggtgagataatagaaatatagttccggatattctgcaattcatcagagaccgatacttttttgtttgttttattcaatgtacttcggaatagggagatcagagaatcgatcgtcctgcaagcttctgaagtatttttcatttctaccatatgtttgacactatcaagtgtattgtagagaaagtgtgggttgatctgcatttgcaggatactcagttcgtcctgtcgccgccgttcgtgtgcctcatctatctctttgacataagagttcagcgaagtaatcatctgattataggccgaagcgattccttggatctctgtggtatctgaggtgtcagacagaataataggatcgggaatcccctttgcatctttcatatgatttgccagagtgcgcagaggcagcagatttttccggatgatgaaaaaggaaagtaacatgagcagcagaagggccgtacagatcaccagaatggactggatccttggccagaactcgttgagcaggagggaggaagtaatctggctgacaatgtatgcatcgtaatatggaagataacgggataaaacaatccaactaccagaaaggtcagagtactcacggccccgcttctgattttccctggcagaaaataataggctttggtttttttctccgatatcgtcagtcagattacttgataaaatcgtaccatctgaggagagaagaagaatactggtgctctgactgctgaagctctgatagaactgtctcagactttgttccggtataaggatgaacagtgcgccgtacaacgagccgtcagagccggtcagtggcctgcatccgtagataacagggatatgctgtgtcaaaaaggtaaaaccttcttttcttccttcatatgcgatgcggtctgtgtggattgcggtctgcagcgcaggaagggtgagcagttccgaagacgggcaggtgacgccgccgtttccggaaccgacgacaattccatttgctcccactagaaccagctcataatcgaccatggcggctggcattccggagaagatccggctcagattctggcgagcctcccactcggctgtgatatcattaagatccgaggaaagagccctcccaagcaagggggtgttctggatttccacagcaatgccggaaatatggtcattgacaagactaaggctggtggcagtctggcttaaaatttccagattggaggaaacagcggcccgcttggtctggtggatgtaaatcctggatgaagtgaaggaggctgacagcaatagtaggatggtgaccgcaaagattggcagcattaaatttaggaaaatggtttttgtacggtgcataaatgtcagtcctttctctggtattgattgcgaaactgcaggggggtcatacccacttgttttttaaatacttttccaaaataactctggtcagcatatccgatcgtttcactgatatagctaatgctgaaatttgtgacacttaaaagctctttcgcatggcggatacgtgtatcattcagatgttcgctgaaatgtttccctgtttttctgctgatgtaggcagagagataggaatagttcatatggagattgtcagcaagatcatataggctgacctgctccatataatgctgttcaaggtagtcctccagttctgtaaagatcagatccggtgtctgggaaccggaacacagtacagtcagttccccataagcagatgtgacagcttcgcagaactgtgaaaaggtgaaaatgtagtctagctgtttaaaaagcttcaattcaatccgggagatttccgaaaaattctgcgcctggtttcttgcgtatctcagggagctgtaaaaggtatgctccacaaactttttaaaccggaatggattcattttcgtgctgtttttcagatccatcatataagcaagaagcaaatcgcaggcgtcctgccagcatccatgctcggcatagcaggtgtagcgctcctgctgaaatggaggggcggattcttcagaagaaagcagatcattttcaaaaaagcaaagctgattctcatataaaatagaataaccgcagagatccagaagcttttctgccctttcacgaaacaaggacagatcttgaaacggagcactgactacacagcttgtatgacgcagcctaaaagccatcaagttaagaagaggccggatgttcgcatcggaagaagagaaggcccagagcacgacggcatggttctgagtagtaaagcatgagagagccggtacctctgtactgctacggtccagcatctgttgcagatcttcttcactttcaaaatccggtttgggagaagcgagaagagcgagacagtaatactgccctataagtcgtttcttaacataagatgagaaagagtccgaatccccatttgcatacccgtccagtacttttcttgccagaagtccgaaggttttttctgtttgaccggataggagcgactcctttgctgggcctaatcggttcagacattcaagcagagaatcttttgtcacccggttttttaaaagatagtcagaagccccgtattgaaaagcttccctcactttgtcaaattcattgaaattactgagcattacaatcggggctttggaatagcggcggagcattgcgacaaactggatgccgctgattcccggcatgacaacgtcgcagagtacgatatcgggctggagtttcagaaaaagttccagaccttcttttccgttcgaagcctctccggcgatcgtataattgtttgcttcccagtccatcatatatttcagaccctggcggaagataaattcatcgtctataatcatcaaacgtctcatctggcacgctccttttcgcttttgtttttttgattataccatacgaaaaagattccaacatcgaatcactttgaaaaaatgccgactgccaaaatataacaaaataagtcagaaaaagatcaaaaaataatcagaaaatgacagataccaaacaaaaagcaaaaataaatccgaaaaacaaagaaaaagattctataattttgtgcagaaagacgataatattttatctaaatacatggccatgggaaacaatgaaaccgacagaaaatacaggaggagagaagatgagaaagaaagtaatatctgctttattgatttcggcaatgatagccggtctttgtatgggatgtggaacttcttcatccggagatggagcgaaggattcctctgatggcaagaaaaaggttgtcgtctgggcgtgggatgtggaatacaatatcccggtgatggaagaagctgcaaaacgttatgaagaaaagcacagtgatgtcgacatcgaaataatggaatatgcatatgacgatattactcagaaactcaacacgaatctgagttccggtatcacagacggacttccgaatatcattttaagtgaggatgcaaatgtccagaagtacatccagtcctatccgggagaattcaaggatatgtcagatatcgtggatttttccaactttgcggaatacaaagtggaagttctgaccatggatgatggcgtatacggagtaccgtttgatatcgggacagaaggactgttttacaggaaagattatctggaacaggccggttacacgaaagaggatttgacggatattacctgggatgagctgattgagatcggaaagaaagtcaaagaagtgaccggaaaagacctgatgacaatggatccgaacagtatgacgattatgcgtgattttatgcagtcctcgggaacctggtactttaaagaagacggagatctgaatatcgccgaaaatccggtgattgaggaaggatgccgtatttacaaagaactgatgaacagtggagtgatcaaacttacaactggatggggagatatggcggctgccctgaataatggggatgtcgcttctatcgtgagcggatgctggattgtaccgaccatcaccgcacaggaagatcagtccggactctgggaagtgacaaggatgccacgcttaaatattgagcagggtacgaattatgggaatcgtggaggttccaactggcttgtcttggaacatgcaaagaacagtgatatcgcggcggactttttaaatgaaatctatgcaaacgatacagaattctatgagacgattctgactgaaatcggggcgattggcgcttatattccggcgcagtccagcgaagcgtataaggaaccggtagaatacttcagtggagaaccgatctgggctaactttgcggaatgggcaaagcacgttccaccgatttcagtcggagtctattctgacgaggtggattccacgcttgtgacgcagatggcaaatgtcctgaacgattccacgagtattccggatatgctgaaaacagtagaagaccttgtgaaatcacagatacagtaaactatgatttggagttggagtataagttatgaacaaaagatcatcaaaacaatggttccggcttgcaaacaatgggtgggcgtttgtgctcccatccattgtcctcttcctttggcttgtcttatggccgatgatcagcgcctttttgatgtcgctgcagaaaggaaaaggaacagtcgtagaatttgcgggactggataattacatccgcctgtttcaggacccggtatttatcagcagtacgatcaatacgattacatattttattatccaggttccggtcatgcttgtgttggcgttgattatttcttcgatcctgaataatccaaggctgaaattccgcggatttttccgtacagctattttcgtgccgtgcgtgacaagcctggtggcttattctttgctgttcaaaagcatgttcgcgacagacggtattatcaatcaggtgttggtgtcactacatatcgtaagtgaaccgattccttggcttttggagacattctgggccaaggtggtgattatttttgccatcacctggcgatggaccggatacaatatgattttctatctgtccagtatgcagaatattgaccgcggggtttatgaagcggcagagatcgatggtgcaggggcatggcagaaattctggtatattaccgttccgttgctaaagccagtcatccttctgactgcgattatgtctacaacagggacgctacagttatttgacgaggtcgtgaacattacttccggcggaccggcaaacagtacgatgtcgatttcccagtatatttacaacctgtcctttaaatacgccccggattttggatacgcggcgactgtttcctatgcaatctttattatggttgcggtgctgtctttgattcagatgaaagtgagtggtgacccaaatgacaactagacatacagaaatctatagtggaaaagcaaaaagaagagtaatttacggcgtccaatacctttttttgatcgttgtctccattgtctgtgtgttcccgtttctatggatgctgatcggggcgacaaacaaaagcatggatattacccttggaaagatgtctttggggaatcagttttttaacaatctgaaaaatcttctggaggcgggagatctgctgacatgcctgaaaaactctgcggttctcagtgtattcattacggttttgagtatgttgatttgctcttttgcgggttacggctttgtgatcttccagagcaaaaagaaggagttctttttctcattgattttgctgtccatgatgataccgacatcttctcttgtcattccgatgtttaagatgttcaacagtatgcatctgctcaacacaaaactaggagtggtgcttcctgctcttagtacggcatttttaattttctttttcaggcagaacacaaaaaactttccgctggagactatccagtcggcccggattgacggtctgggagaattcgggatcttttttaagatttatatgccaatgatgaaatccacttatgcggcagcggccattatcacctttatgtcaagctggaacaactatatgtggccattaatttcgttacagaccaaagatcagagaacgcttccgcttctgatcagttctctaggaactgcgtacactccggattacggaatgattatggttggaatcatcatcacgaccatcccatcagcggctatttttttcctgatgcagaaaagttttgtcaacagtatgatgggatctgtcaagtaggatcagaaagaggaatgtgtatggaacgatcacaaataaaacagcatctggcggatccggaattttttgcagagaaccggttacggccggtatcagatcatatgtggtatgagacggaaaaggaggcgctgaaaaaagaaaaaatgcgtcttcggatgagtttgggcggagcatggaaatttttctatgctccgaatccggatagtgtaccggatggatttgaaagaaacgactattcctgcgatggatggaataccatttctgtcccagcccatatggaattacaaggctatggacgtccccattatacggatacggactatccgtgggacgggatcgaggaggtcacgcctcacggcatcccgcagatctacaatccaacaggatgctatgtacgatatttttctatcccggagcagatgaaaaagaaaaagctactgcttacctttgagggagtggagacggcctttcactgctggattaacggtcactatgtaggatatggggaggatagctatacgccatcggtgtttgagattaccccgtttgtagaaaacggggaaaataaaattgcagtggaagtgtcgcgtttttcctctgggagctggctggaagatcaggatttctggaggatgggagggatcatgcgggatgtatctgtcactgcggttccggggcttcacattcgggatctggaggtaacggcctgtctggatgagaagatgacagagggaaaacttaaggttcggtttgatttggaaggagatccggcggtattgaaaagcagaaaaggaaagattatctggaaacttttgaatggaaagatccgcatggaacacaccggatctgaagaaacagagaaaatcatgtccggagaattgctgatagaccgggaggatatccagatgacagtatgtgtgtcggatgtaaagttatggagtgcggagagaccttatctgtatcggcttgtttttacggtgtatggcgaagagggagaaatctatgagagtgttccgcaggacgttggatttcggaaagtggagatccgggattcggtgttgctttttaacggcaggcgtctgcgtctatatggagtgaaccggcatgagttttctgcccgaaaaggacgggcaatcgggaaagaggaaatggagtgggatatccggtttttgaagaggaaccatttcaatgcggtgcggacgagccactatccaaatcagagttactggtatgaactatgcgaccgctttggcatctatgtgatggatgagacgaacttggaaactcatggtacctggcatctgaaacaatttaaccacacgctgccaggggacaatccccggtgggatgaagcagtgatgagccgagcccgtgcgatgctggaacgggacaaaaatcatccttgtatcttctcctggagtgtagggaatgaatcctggagcggaaaaaacctgtatgagatgagtatgtatttcaggaaaagagatgacagccggccggttcattacgaaaatgtatgccatgaccgcagatggggtaggacaacagattttgagagcaggatgtacgcctcgcctgaggaagcagaagcgtatctgaaagatcatccagaaaagccgtaccttttgtgcgagtattctcatgccatgggaaactcctgcggaaatctgcgggagtacatggaactatttgacaaatatccgcagtacagcggaggatttctatgggattacattgaccaagcactgtaccagacaggaccaaacggcaaggaatatctggcctacggaggcgattttggagatcgcccgaccaattataatttctgcgggaatggtgtaatcttcgcggatcggaccatctctccgaagatgcaggaggtgtcgtatctgtatcagccttataaacttacgccttcagagacaggagttaccatccgaagtttacagctttttgagaacggagagtattaccgaatcgtctggcggctggaaaaagaaggaagggtattaaaatccggagaagcgccgcttgtgatcgaaccggagagtacggttttcgtagaggcggacctttcgattccagaaaaggcagaggcaggagaatatgtcagaacagcagctcttgtcatggagagagacactccttatgtgaaacgtggggaggaaatctgcttcggtcagaccacagaacaaaaagaagagaaaggcaaaagagaagaaaacaagcatcctctgcttcgaacagtggatggcgatagttctttttccgtagtgggagcggattttcggattactttccagaaagcgactggaaaactggtctcctggaaaatcggggagaaagagctggtgtacgatccggtacatacgctgtcgctggaattttggagagcaccgacagataacgatgaaggataccacatgacggagaaatgttatttctggaagatggcgtctttgtatccgaaagtaaaagaggtcacgtgcggtacgatagaccatcatgcggtgatcgataccatctatacgctgggagaaactgctcagtgcagattacggatacagattgacggagacgggaatatggatgtgacagagtcgtatactggtatggaaaatcttcctgatctgccatgttttggcgtttcctggaagttgccgaaagcgttttcccacatcacatggtatggaaaaggacctcaggaaacctatcgggatcgtcaggctggaggaagactggggcggtttgaaacaacttctgccttaagctgtacgccgtatctgattccgcaggaatgtgggaatcatgtggagacgaggtgggtaaccctgacagactcttccgacacagggatccgggtggagagtgcggtgccttttgaattttccgttcttccttatacttgtcacgagctggagggagccagacactggtttgagcttccgaaaccgtatgcatctgttctgaggattctggagcagcagaccggggtaggaggagacaatagttggggagcgtgggcacataaaccttataggttaagcggggaagaaaccaggacgttctccttttccatacggatgctccaaaatggcagaactgcataaagaagtccttgtccatccctcttttctatgttaagatgaaatgaaaccaacgaaaagaggcgcatgacaatgtggaatatggaaaaagtgactctggtgacaaataatgacagggtctatgaaaaatatagagaggatatggaagtgctgcttctggactcctacagggacgttcttttgaaagtccgggatctggtctatgaccgtcatatcctactgactcatccgcaggcatccagcctaaagccgaatcagacgccatatcggtccatcatggtatatccgaaaggggaagaggacaatatgaaagatatcatgctgatcgaaaaatgcattgagacatatgaccagtggcaggagatcgcggccacaccgcacaactatcagaaatcagtagcggaagatttcaagacgatcgatctgtctgtgattgagaatatcgtgccaaggctgatgtaaaggcaggcgacaggtatggaggaaaggaaaaaatattttaagggactgacgagaagggattatattgccaaggcaaatgagattatccaccgggagggaatcgaggcagtgactattcggcggatcgcaaaggagatgggatgctcaacagcgagcctgtaccggtattttgacagccgggatgaactactgtattatgcagaattaggtgagatgaatgactatatccgacggctcaatgcggcagaaaagcattggaggaatgtgtgggatatctatgttggggtgtggtattgctactctatggaggcattccggaaaccggaagcatataatctgttattttttgccaacaataacacgaagctgagggtttctatccgggagtactatcagatgtttcctgaaaatctggagctgtccaaccgggtttttcatgagatgctccagacagcggacttcatggggcgtgattttgaaatgtgcagaaaatgtatccgttccaatgccattgggtatgaaaatgcggtatctctcaatcggatggtctgtcttttgttcaaaggatattttaaaacagtctgcgatgatggaatcaaagaagaggaagtaaatgcaagagtacgtcagtttatccgtgatattgaggatctggttcgaatgctggcaaaggatctgaaagggtataaagcgtatcaaatttaacgaagagcaggtttcgggaaagcaataacaggccggaatctgctcttttttggcggaattgctgtacttatagaagttatcgaaaaaatgtatagataaaatgtataaaaaagcttgataattgtaagacaacagcatataatggacataaagaacatgaaaaaagataacaaagtttttttttgacttaatgttatcgcgattacaaagaaggagggatttacctatgaaattggaattaggtaagattaagatcgacgatatccaatttgcagaaaagacatatgtgaaagatcatgtgctctatgtcaataaggaagaagtggaagagcttgttctggaagacgacaaattaattggatgtagcctcgacatcgcgcgtccgggagacagcacccgcatcacccctgtgaaggatgtcattgaaccaagagtaaaagtatcgggcggagagatattcccaggagttgttggaaaagtaacgccgtcagtcggagaaggaagaacgcatgcgctggacggatgctgcgttgttaccgttggacggattgtcggattccaggaaggtgtcattgacatgagcgggcctgcagcggattattgcccgttttccaagaccgtaaatctctgtgtagtaatcgaacctcaggaaggacttgagacacacgtatatgagaaagccggaagaatggcaggactgaaagttgcggcatacctcggagaggccggaagaaatgtagagccggatactttggagacattcgagacaaagccgattttcgagcaggcagcaatgtacccggatctcccgaaggttggatatatccacatgcttcagtctcagggacttctccacgatacatattattatggtgttgacgcaaaacagtttgttcctacatttatgtacccgaccgaaattatggatggtgcgatcgtttccggtaactgtgtagccccatgtgataaggttacgacataccaccacttccacaatccggtgattgaggactgctacaaacaccatggaaaagatatcaactttatgggcgtaatccttaccaatgagaacgtattccttgccgacaaagagagacactccgacatggtagcaaagctggcagagtggatgggactggacggcgtgttgatcacagaagaaggctatggaaatccggatactgacctgatgatgaactgtcggaaagttgagaagaagggcgtcaaagtcgttctgattacagacgagttcccaggcaaagacggaaaatcccagtcacttgcagatacctgcgatgaagcagacgcacttgcttcctgtggacagggaaacgcaacattacagttcccggtaatggataaggtcatcggtacgatggattatatcgaaagccagatcggcggatgggcaggatgtgtcaatgaggatggttcctttgaagcagagcttcagattatcatcgcttctacgattgcaaatggcttcaaccaccttgcggcaaaaggatattaatatttggaaggaggaaccaacatggcaaaatataaaattgttcattatattaaccagttctttgccggcattggcggtgaggaaaaggcagattacaaaccggaagtaagagaagaagcactcggaccaggcgcggctcttgcacaggctcttggtgaggattacgagatcgtagctaccgtgatctgcggtgacaactatttcggtgaaaacctggatgaagcgacagatacgattatcgatatggtaaagaaatatgaaccggatgtattttttgcaggacctgcattcaatgccggacgttacggtgttgcctgcggtacgatctgtaaagctgtggaagagagacttggtattccggtgctgacagcagcatatgaggagaaccctggtgttgatatgttccgtaaggacgtgatcacagtgaagacaggaaattctgccgctacgatgagaaaagtcctaccttccatcgtcaatctgattcaaaagatggctacaggagcagagatccttggacctgcggaggagaactatcacgaaagaggaatccgtgtcaactactttgcggaagagagaggatccgctcgtgcgattaagatgctcgttaagaagatgaaaggtgaaccgtttgagacagaccttccgatgccgaagttcgacagggtaccgcctgcaccggcgatcaaagatatcaaacacgcaaagattgctgttgttacatccggtggagttgttccggtaggaaacccggatcatattgagtcttccaacgcgacgaagtacggtgtgtactctatcgaaggaatggacgccctgtctccggacgatttcacaacaatccacggtggatacgaccgtcagttcgtcatggcgaatccgaacctggttgttccgcttgatgtactgcgcgaaatggaaaaagacggagagttcggtgaacttgtaaacttcttctgtacaacaaccggaaccggaacagctaccggatccgctgcaaaatttggagatgagattggtaagatcctcacagaacaggagcatgttgacggcgttatccttgtcagcacatgaggtacctgtactcgttgcggcgcaacgatggtaaaaggaatcgaaaaatatggggttcctgtcgtacatatggcgacggttgttccgatttcccttacaattggagcaaacagaattattccgggcgttggtattccgtatccgctgggtgatcctactcagggcgaagtggattccaagaagatccgtaagagaatggttcgtcgtgcattaaaagcacttcagacagaagtagacggtcagactgtatttgaaaaagataacttctaaataaacaacagacaggaaattgtgggtacggtgcatctgtactgtacccacattgaatttataaggataggaggggactctatgggcaaagaaagcggtgcggtgaactggaagagagttctgattctggctggagccgtgattgcgtttacaatcggttccgggtttgcaaccggacaggaaattattcagtattttacagcctatggctggcagtccattttggttattcttggatttgcggttgcatttttgtattacaatttcaactttgcaaaagcaggtgcggagcagcattttgaacatgggaacgacgtgtacaaatatttctgcggaaaatacgtaggtacattctgcgattactattccacggttttttgttatatgtcattttgggtaatgatcggaggagcggcatccacactgcatcaggagtacggacttcctacctgggcaggcgcagtgattctgaccatcctgacgaccatcaccgtaatcggcggactgaattctctcgttgacgccatcggtgtggtgggaccaatcatcgttgtcctttgtatctttattggtcttgttacctgtatccaagatggcggcaatgtcgctgctggtcttgatgtgatcaagaacagcgcctatgcgggagcagaaggtggagagacgatcaagaacgcaggagcaaactggtttatctctgctgcatcttacgctggattcgttcttttgtggtttgcaagtttcacggcagctcttggttctaagaacaagaaaaaagatctcaattacggtattatcggcggaaccgttgcagtatgtgtggcgattggtttgatttcctttgctcagatcgcaaatatcaacactccgctttcaggcagcgacagcacatttgtatggaatgcggatattccgaacctgatccttgccatgaagatctggaaaccgttctcagcgatctttgcaattgttgtatttgccggtatttatacgacagcggttccgttgctttacaatccggcatcccgcttcgcaaaagagggaacgtcaaaattccgtatcctgactgtgattcttgcggttgtcggattgattgtcggtctgttccttccgttcagaacactggttaatgtgatctatgttatcaacggatatgtaggagcgattttgattctctttatgctaaagaagaatattacggatctgttgaaaaagaagaaaaaggcttaaggaagaagataaagaacagcaaccattatggttgctgttttttctgggaaaataacgaaaaatcttttagaaaaaggatgaaaaagcacgcgatttttgctaaaatatgagaggattcaagaagaaaaaaggaagtggagtgaggtaggaggatgaattatcacagaatcattgaaggaatcctggatattggagaggaaatgctaaaaagcggggcggagaattatcggctggaggatgctctctatcgaatgttgaaaagttatggctttatcagatacgatgtgtttgtcattccgagcaatattcaggtttcggccaagacgccggaaggagagttaatcacgcagatacggcatatcgagtcatttgagaatgattttgacagactggatcatttgaacgatctttccagatatgtatgcgcccataagccggatgcggatcatctcaaggctaaatttgacaaagtcatcagcctcccggagcagccggagattctgcgctatgtagctggagttatggggggtgctggatttgccgtattttttggaagtggatttgcagatgcgatcgtagcagttattgtttctttaatgattgtgtttgtcggaaaatggctgagtatgagggaaggcaacttgatgatctataacttaattcttgcatttctctcggaggtcattattatcctggcaactcgaaacgggatcggaactcacccggatcggattatgatcggaatcgtcatgcttttgattagtggccttggcacaacgaatggtttccgagaacttttacagagagatttcatttcaggatccattaatattctgaattctattttaggagctacgggaattgcacttggaatcgctcttgcaatgctgctttttcacgagcggctggaagaaggatttatgctgaccccaagcattccgatgcagcttatctcctgtacgattgcgtgtattgggtttgccatgtggtttaaggtacgggggagaaaagttttttattccggagtcggagcttttattacatggggaatttatgctttgatttatgagattgaaccgagcaatttcctggccacgctgattgcggctgtctttgttggattttacgcatttatcatgtcaagagttaataaagcgccgtcaacgatctttctgacggcatctgtattcccgttgattccaggaccgaacctatactatatgatgtatggatttgtcagcaatgattcagctctgatatccagcgaaggggtgctgctcgcgactacgtgtcttgcgattgcatttggattcaatatcgtggatgttgtatccagggtcataatgagcacattaaaacgggaatttcgtgtaactaagaactcataaacacgaaggttatcagaaaagcattgatttttataacaatgtctagtagaattactggtagaatgctaggaggtagaagcatggcggaatacacaaaagtggcgcttgatgccatgggaggggattatgccccggcagagatcatcaaaggtgcggtggacgcggtcaataaacgtaaggatatccgtgtggtggttgtcggaaaagaggatatcataaaggcagaacttgcgaaatatacttacgacaaagaacagatcgagatcagaaacgccagcgaggtgattgagacagcggagccgccggtgatggcgatccggaaaaagaaggattcatcgcttgtcgtcgggatgaatatggttaggcagaaagaagcggacgcccttgtgtccgcaggaagttccggagctatccttgtgggaggccaggtgatcgtgggaaggatcaaaggagtagaacggccgccgcttgcaccgcttttacctacgaagaaaggattttctctgttgattgactgcggagcaaatgtggatgccagaccatctcatctggttcagtttgcgaagatgggctcgatctatatggagaacgtcatgggtgtgaagaatccgaaggttgcgattgtcaatattggagccgaagaggagaaaggtaacgcacttgtgaaggagacgttcccgatgctgaaggcatgcccggagattcatttcaccgggagcattgaggcgcgtaatattccatatggagacgcggatgttgttgtctgcgaagcttttgcgggaaatatcattttgaagctttatgagggcgtgggaggcgtactcgttgataagatcaaagaaggcatgatgaagagtcttcggacaaagatcggggcacttcttgtaaagccggcactgaaagagacgatgaagggatttgacgcaggggaatacggaggagcgccgcttctgggactgaatggtctggtagtaaagacacacggcaattccaaagcacgtgaggtctgcaattccattatccagtgtgtgacattcaaagagcagaagatcaatgagaagatcagagacagcattcagaaagagaaagaataaactttttaaggaaggaatgtaactatggaatttgaaaaattgcaggggattatcgcagatgtattaaatgtggacgcctcagacattacaatggagaccacgtttgttgacgatttgggagcagattctttggacattttccagattatcatgggaattgaagaagagttcgatatcgagatcgataacgatgacgctgagaagatcgtgacagtgggagatgcggtagagcagatcagaacggcagcaaataactaaaacatatatgcggaaaagcccgtgagggctttttcgtgttaattgggggttttatgagaaaaatcagagaactggaagagaaaatcggatactgttttcaggatcaggaactgctaaaacatgcattgcgccacagttcctatgtcaatgaaaaacatatgaaaaagcatgaatgtaatgaaaggctggagtttttgggagatgcggttctggaggtggtatccagcgaatttttattctttgagcatcagacgatgccggaaggagagcttacaaagaagcgggcaagtatggtctgcgagcctgctcttgcgttctgcgccagagatattgatctgggagaatatctgcttcttggaaagggcgaagaggcgaccggaggaagaaagagagattctgtcacatcagacgccatggaggcgttgattggggcgatttatctggatggtgggtttgctagtgcgaaagagtttatacaccggttcattttaaatgatctggaaaataaaaagctcttttttgatagcaagactatcctgcaggaaatcgtgcagggaagttccgatgagcacgtttcctacgagctgatccgggaagaaggaccggatcacaataagacattctgcacagcggtcaggatcgggggccgcacctacggcgaaggggaaggacggacaaagaaggcgtccgagcagcaggctgcgtaccaggcgattttgagattacaggagaaacagtaggagcgctatgtatttaaaaagcattgaagtacaaggatttaagtcatttgccaatcgtattgtctttcagtttcataatggaattaccggtatcgtaggaccaaacggcagtggaaagagtaatgtggcggatgcggtgcgctgggtacttggtgagcaaagggcaaagcagctccggggcggcaatatgcaggatgttattttctccgggacggagaaccgaaagccactaagttatgcatcggtaggaatcacactggataactccgatcacaaacttccggttgattttgaagaagtgacggtgacgagaaaactttaccgatccggggagtcagagtacctgatgaatgggagaagctgcagactcaaggatatcaatgagcttttctatgataccggaatcgggaaagaaggctactctatcatcggccaggggcagattgataaaatattaagcggaaagccagaagagcgaagagagctctttgatgaggcggccgggattgtaaaatttaagaggagaaagaatacttctctgaaaaagctggaagaagagcagcagaatctggtccgtgtgacagacattctctcggagttggaaaagcagtacgggccgctcaagaaacagtctgagacggccagggaatatctgaaaaagaaggaagagctgaaaaagctggatatcaatctttttcttgtacagacggagacgttacgggctcaggaaaaagagacgctggaagcgctttcaagagccgaggaagagctggcggagacaaagaagcagtatgaagccatgaaagaagaatacgctgaagtggaaggccgtatcgaggagatcgatcttgcgatggagactgccacaaagcagttaaacgatacgaagctgattcgacagcagtacgaaaaccggattgatctgctaaaagagcagatcaaaagtgtccggacgagcgacgcccattacgtggagcgaaaagagaccgtagaggtggagattcagaagcgggaggaagagcttcgcgatctgaaagctcagcgggaggatttggaagatcagatgcgggaaaaggaagcccagagcgagtcagagaggaaaacgcttaccaatctccaggaagagatggcaagaatcagtctctctacagaggagaagaaaaatgagatcatgcagattctctccggacgtgcttccacaaaagcacggctacagcattttcacaccttacgggagcagcttcgtgtacagaaggcggagcttgccaagcagcttctggcgattacccaggagacagaggtgtaccggacggattatgagaaatacgaaagtgaatggaagacattgtctcaggagattcgtacctgtcaggagacgattgccggatatgaaagcgagatcaaccgtcttcagcaggaaatcacccgagaaaatgaacagatccgaatcggacagagcgcttaccaccgagagcagtcccggctggaatcgctgaaaaatatgacagaacggtacgaaggatacggaaatagtatccgccgggtgatggagcaaaagagccgggagccgggaattttaggtgttgtggcagatctgatccgtgtggataaaagatctgagacggcggtggagacggctcttggaggcaatatccagaatattgtgacaaaagatgaggagacagccaagcggatgatttcctttctgaaacaacataaatttgggcgggcgacgtttctcccgctgacaagtgtccggggatcggagtttctaaagccggagattctggaagaagatggcgtcatcggactggctcacacgttggttgagacggacaggcagttccatgatctgatgaagaacctgctgggacgtactgttgtcgtaaaaaatattgacgtgggaatctatctggcgaggaaataccgccagagtgtaaggatggtgacgccagagggcgagctgttaaatccgggtggatctatgacaggtggagcctttaagaattccagcagccttttaagcagacgtcgggagatcgaggagtttgaaaagacggtgcagatgttaaagaaagatctggatgaggcgatcgcttctttggagacccataagcaggaacgtgccggatactatacaaagatggatgcactcaaagaagagatgcagaaaatctatgtccggcagaatacagccaggatgaatctttcccaggtgcagagccgccagaagaccattacggagcggaaatccgtccttcttcatgaaaatgaaggactggagagccaattaagggaacttcaggagaatcaggactcgattgagattgaacttggcacttcggaagaactggagaagaagttaaagtgggagaccaaggaagaacagagggtactggaggagaaaaaagaacaagaacagattctgcaaaagagggcggaggaagcgcatcttctgtttgtggagctgggacaaaaagaaaacttcctaaatgaaaaccaggatcgtattttacaggaatatacgaaatacatacaggaaaagaagttgttggaggacaaccagggagacaacaagcgggagattggagaaaaagagcaggagatggggctggcaaggcagaaaatagagaatgccggggagctgatcgaagagattgaacaggaattacaggaaagcgcaaaggagaaagaagcgctctccagacgacataaggaatttctgagtaaacgggacgtcatttctgagacgatgtccgatctggataaagaggcgtttcgtctcggaggtaagcgggacagcctatctgagacgatggaaaagcagatgaattatatgtgggaggaatacgagatcacatataatcatgcacttcagtatcgagaagaagagccgggggatcttttgtttatgaaaaaggagatccagagaatccgctctgagatccgcgcccttggcaatgtcaatgtcaatgctattgaggattttaaaaatctggaggaacgctatgagttcttaaagaaccagcatgaggatctcattgaagcggaagtgacattaaagcagattattgaagaattggatactgctatgaggagacagtttgaagaggagttcgcaaagatcaaagaagaattcaacagtgtattcaagcagttgttcggtggagggaaaggaacacttgagcttctggaggatgaggatatcctggaggccgggatccgtattatcgcccagccaccgggaaagaagcttcagaacatgatgcagctttccggaggagagaaggcattgactgcgatcgcgctgctgtttgcgattcagaacttaaagccgtcaccgttctgtctgctggatgagatagaggcggctcttgacgactccaatgtcacaaggtttgctcagtacctccacaagctgacaaagaatacccagtttatcgttattacccacagaaggggaacaatgacagcggcggacagactgtatggaatcaccatgcaggagaagggagtatcgacccttgtttcagttgatcttttggaaaaccagcttagtaaataaagaataaaggagtgaaagagatatggcagaggagaagaaaggattctttcggcgtctggtatctggtctgacaaagacaaggcagaatattgtatctggtctggacagcctgttccatggtttctcaagtattgatgaagagttttatgaggaactggaagaaattcttatcatgggagatctcggagtcaaagcaacgtatgagattctcgatgatcttagagagaaggtaaaggaacagcacatcaaggagccagccgactgcaagcagcttctgattgacagtatcaaagcccagatgcagatcggggagacggcctatgagtttgaaaatcggaaatccgttgtgcttgtgattggtgtcaacggagttggaaagaccactaccatcggaaagcttgcgggcaagcttcgaagtgatgggaaaaaggttgtgattgcggcggcggatacattccgtgcggcagcgggtgaccagcttaaagagtgggcagatcgggctaatgccgaatttatagggggacaggaaggctcagatccggcggccgtcgtttacgatgcggtggctgccgcaaaagcgaggaaggcagatgtgctgctctgtgataccgcaggacgtcttcacaataaaaagaatctgatggaagagctgaaaaaaatcaatcgtgtcattgagagagaatatccggacgcataccgggagactctggtcgttctggatgggacgacaggacaaaatgcactgtctcaggcaaaacagtttgcggaggcagcggagattacaggaattgtactgacaaagatggacgggaccgcaaaagggggaattgtggttgccattcagtccgaacttggaattccggtaaaatatatcggagttggcgagacgatcgacgacttgcagaagttcgattcggatgattttgtaaacgccttgtttacagcggattcatatgaggaagatggggaagaagagtaaaaggaaacagtgacacggaaggaaagaaggttacagcgatgatgacattggaaaaatttgaagaagcaagtgagcttgtcaaaaaagtgacaaatccgacaaagcttgtgtacagtgagtatttaagtgaagagactggaggcaagatctatttaaaaccggaaaatatgcaacatacaggcgcatataagattcggggtgcatattataagatcagtaccctcaccgaagaagagaaggcaaagggactgattaccgcatccgcggggaatcatgcacagggcgtagcctacgcagcaaagctatttggatgcaaggcgacgattgtcatgccgacagttactccgctgattaaggtgaatcgcacgaagaatctgggggcagatgtcgtactttatggcgatgtatatgacgatgcctgcaacagagcttatgatctggcagaagagcatggctatacgtttgttcatccgttcgatgatctggaggtagccaccggacagggaagtattgctatggagattgtgcaggaacttccaacagtggactatatcattgtaccggtaggtggaggcgggctcgtcgcgggagtatccacccttgccaagatgctcaatcccaagattaaggtgatcggtgtagagccgtctgaagcggccagcatgaaagctgctctcaaagcaggagagccggttacacttccgagcgcaaatacgattgcagatggtactgcagtaaaacgggtaggaagcttgacatttgagtacgcaaagaaaaatgtggatcagattctgacggtggatgatgatgaactcatcggtgctttcctcgacatggtggagaatcacaagatggtggtagaaaattccggccttctttctgttgcggcactgcgtcaattagatttgaaagggaaaaaggcagtctgcattttaagcggtggaaatatggatgtcatcaccatggcttctatcgtacagcatggtctgatccagagagaccggatcttctctgtctccgtcctgcttccggataagccgggtgagctcgtacgggtggcaaagacgattgcagacgcccagggcaatgtcattaaactggagcataatcagtttgtcagcacaaaccggaatgcggcagtagaactgagggtgacgatggaagcattcggaaccgagcataaacatcagattttggaagcgttggaaaacaatggattccgtccgaagcttgttacgacaaaactgtattaagatgggactgtaaaagaaaattgtaaaaggagggaacgccgtggaaaacttacggccggaggaaggtggaatttaccacagcctgtcaggaactgtctatcggtatcttggcatggcaagacactgccagaccggagaggagcttctgatctttcaggagaaggagacgcaaattttgcaggcagtgacggtaccttattttacaaaagagtttcagaaagccggagaggatccggaacaagggcttctttatgcttttctgaatgcggactccaatgaagagaagctgattctgctgcagcagaatcgctcggaaatgacagaggcagtactggaaacagtggcgcagagtctggattatacgcttgacagcagcgatccggacagaatgtttttggatctggaacagtgtcttagaacaaaaatcaaatatgagcgcagaagaatataaagagcttcccaccgggcggtcatatgaccggatctttggtggggagttttttcacgtcttattggagaaatgttatattctgggttgacacattttgtataattgtatacaattatacaaaatgaaaaggagtgaaggaaatggataatagaaaagtttacatgaactaccataataatttattgcagctcgaagaacatatgtatccattggtggatgttgatacgccgaacgtattccggaatctttttccttatgatgaggttccgaagattgcgtttaacgaccgtattgtgccacattccatgccggatgagatctggatcaccgatacgacatttcgggatggacagcagtcccgtgcaccgtatacgacggagcagatcgtgacgatctatgattatctgcacagacttggcggcccggaagggaagatccgccaaagcgagtttttcttatatagtaaaaaggacagagacgctgtctatcagtgtttagagaagggctatcaatttccggaagtgacaagctggatccgcgcaagcaaaaaggactttgagcttgtcaaagagatcggtctcaaggagacaggaattcttgtaagctgttctgattatcatattttctataagctgaaaatgacaagacgagaggcgttgcggcattatctttccattgtccgggactgcctggaaatcgggatcagtccacggtgccacctggaagatatcaccagatcggacatttatggatttgtgataccgttttgcctggagctgatgaatctgatgggagagtacaggattccgattaagatccgtgtctgcgatacgatgggatatggcgtcaactatcccggagcggtgatccctcggtctattccgggtatcatctacggtttgatggttcatgcaggggtgccgagcgaactcattgaatttcatggccacaatgacttctacaaggcagtcagcaatgccacgacagcatggctctatggtgcctgcggcgtgaactgttccctttttgggatcggagagcgtaccggcaatacaccgctggaagcaatggtctttgaatatgcacagctccgtggcagtcttgacggtatggacacgaccgtcattacggaacttgctgagtactatgaaaaggagatcggctatcatattccggagcacaccccgtttgtcggcaagaacttcaatgtgacgagggctggtatccatgcggacggacttctgaaaaatgaggagatttacaatatttttgatacgggtaagttcctgaaccgtccggctgtggtctctgtgtccaatacatcgggaattgcgggtattgcacactggatcaatacatattataaacttccggatgagcggaaagtaggaaaggattccgaacttgtcgcagcggttaaaatgtgggtggatgagcagtatgacgacggccgcgtgactgtaatgacagatgaagagatggtgcagaagatcactgaaatctgccgggaaaaggaaatcattttataacgaagcctgcaaataaaaagtcaaggctaaattgaaagaactttgaaaattttatacaggttgcaaaagggtatcaaaaatcagctctgcccggagtaactaatgacatatcttatatcagttttttcgagtttacacaaaacttgaaacggtctctataccaaccattttttctcaaacaagtcaagttctaaacacaatgacttaggagccgacctcaacactcaagcttctgaggtatataaacagattaaaatattaaactctaaaattttaaaattttcaatagctttagggaggcttaatcttttagagataaataactccaaactaaaggaatatagtgataactacatccacactgcatatgcttcaattcagtatatttccaatattatattagaggatatcaacggagtaaagaaaggggacttttttaaaaatttttttaattcaatagaaaccttaatttctctacatgacaccttaaaaacagtttattctcatctgatatgcattgagaatggattattagagccaattcctacagatattcctacagataatctttctatgctagaattgcgttcaaaaaaagagaatttaagcttttcagaagtagcaagtgatctttttttattatcatcttttctggataatctggaatatattttagctactcaaactggacacactactttcttcgtccgaaaaattgaaactggatctttgcgaatagtatggggtggaactactatcgagctatcttgtatctctgatattatacaggcagttacaaatgctattaaaacttttagattaacaagcgttgaaaagcgacttaaagaggaaaaagcaaattctatccacttagacaacgaggcaaaagctctatccattataaatacccaaattgacacaatttgccaaaagattaatttagatccatctaaacctgaagatgttgaaacaatacaacgaatgtgcttaccattagttaaatatataaacaacaatcctatcggatacgtgggtgattttcaatacaatctttctgatgagataaaattattagaagacatctatttttcgaccaaagagtaatttgtatataacctcttcggcgcttatataaagggtttgggttttctcgaaaaaaagagaaagagaggaatggaaaatgattgattttcaaaacaaaaaagtatttaaactaagcaaagccaaggaaaaaaatattccaaaagaaatttatgaattattgatccctggtgaagaaatcgtaggatactacagtgcattaagagattacgtcgtattcacgaataaaagattaataacttgcaatgtccagggaattacaggatcaaaaaaggatttttcaactcttccatattcaaaattacaggctttctcaatcgaaacagccggaacattagacctggatgcagaattaacactgtgctatagcggtcttggaaatgtaaaacttgatttttccgctggtggagaaattaaagaaattggaaaaatcatatcttcctacttgttataggttaaaaattttagaaattttccattgcaaaaagtaaatggaggaatgtcttggatattaaagaatacctaaaagaacgggtcgacgatcaaattaattggtacgaccaaaaatcaaaatctgcacaaaaatggtataagcgtttgcaaatagctgaaatcatacttgcttcactcataccattactatcaggttatatgccttcttacaaatggatagcattcattgtaggcttattcggtgctattattgcagtaattgaatcaataacaaaattgaataaatatcacgaaaactggattcaataccgctctacttgtgaaatgttaagataccaaaaacatttatatctcactggatctgccccttataataaccaaaatgagactatcgacaatatttttgtccgtaatatcgaaagcataatttcttctgagaacaatcagtggaaaaatcttaatactgctagagaaaatgccaacgacaacgaaaaagttaattaactctcttatatgttttttcaaaaatatctggtttgcatggatactgttctccatctaccccagttataatccaatctcctggagatgctttcatttctccttcaagcgtatggattattatttcaatatctgtttgatatgcctcaataacaactggctttttttgaaatttttgaatttttttcaacataatcacctcattaaagaaaggaatgaattacatgccaaaattatatgattaccgtctatttattagccatgcatggaaatatggagcaaattatgatagactaataaacctattagacaatgcttcatatttttcctattttaattattctgctccatcggagaaacctttgttccctcccggaactcctaaaacaaattcgcagatacgagagttaatttcggcaaaaatacgcccatcacaaatcaccattgttatatctggaatgtatgtagcttatagtgactggatgcaatatgagcttgatgaatctgtgcgaatgaataaacctattctcggtatttatccctggggacaagagcgcgcaccctatgccgtaacaagtgttgccaatgaaatggttcgttggaatacttcttctatcattagtgcaatccgtaggttggcgtaatattatttatactaaaataacatactaatctataaatttcaataataaaaaccgtccgggtgcgccaacaccaggacggatcacatatccgaagatatgcaagtactttgatcgataatattgtatcatcttcgggcagccaccgcaagcggaacacacgttcctgctggctgttgtttttatacccaaaatctgaaaggagatgattttatggcactgatccaatgtccagaatgtgaattgcaggtaagcgataaggcgttgtcatgtcctcactgtggatatccgctaaacgaaaaagatcagacaaaaggtcgaggaaaagcaaagccaaaacgaaaaaggcttccaaacggattcggaagtatcactgaaatcaaagggagaaatctcagaaatccgtttatggcaagaatatgcgttggaaaaaatcaatatggtagaccagtgttaaagttactaaaaccaaccgcatattttcacacttataatgatgcgtatgctgctttattagaatataacaagaatccatacgaccttgattccgatatgacagtaaaagagctatacgaaaaatggaccgatgtatacctaaaaaattcatcagaagcatatgcaagaacggtatcttccgcatggtcttactgttcatctgtgtatgatatgcgagcgaaagatttacgggcaagacatataaagggatgtatggaagaaggatatcgaattgaaacaagagggaagaaaaaaggtgaaaagatttatgcaaccgcaggaactaagtcaagaatcaagtctttatttaatgtaatgctagattacgctttggaatatgaaatcgttgatcggaactatgcacgaacattcgatgtgtcaaatgatattgtggaagaaatacagacagccaaacggaatcatataccatttacagagaaagaaatggaatccttatgggcaaatgttgataaggtcaaatttactgactggatcatcattcaatgttacatggggtggagacctcaagagcttgctactctccgtttggatgaagtgaatcttgaaaagtggtatatgcaggcaggcatgaaaacagacgctggaaaacagcggatcgttcctattcattctaaaatacgggacttggtaaaacggaactatgaatttgcattatctattggaagtgaatatcttttgaatgacaagggacagacacacgcaggaatctggaaactaacatatgacaaatatgccaatcgttttaaaaaggtagtttccacactgaaattaaatcctgaacatcgccctcacgatcccagaataacattcattactcgtggcaaaaaagcctgcatggatgaatacgctttaaaagaaatggccggacactcgatacaggatattactgaatcggtctataccttaagggatttagagtggctacggcaagatattgaaaaattaccatagccaccccagtatacaaatctagatgtacaaataatgtacaaatagtatacaaatgaacgagtatttcccgttttttactactttcaccagcttctaaaaatcccgtaaatccggcgtttattagaatttgccagccttagcggcttcctcaatggcaactgctaccgctacggtcattccaaccatagggttgtttcctgctccgataagccccatcatctctacatgggccggtacagaagaagatcctgcaaactgtgcgtcagagtgcatacgtcctaatgtatctgtcataccgtaggaagccggtcctgctgccatgttgtctggatgaagtgtacgtcctgtaccaccgccggacgcaacagagaagtatttctttcctgcttctacacactcttttttgtatgtgcctgcaaccggatgctggaaacgtgttgggttcgtggagtttcctgtgatagatacgtctacgccctctttccacataatcgcaacaccttcacgtacatcatttgctccgtagcagtttactttggaacgaagtccgtcagagtatgcggtacgggaaacttctttgagctctcctgtataataatcgtactctgtctgtacataagtaaatccgttgattctggaaatgatctttgcagcgtcttttccaagcccgtttaaaataacacggagaggttttttccgtactttatttgctttctcagcgataccgatggctccttccgctgccgcaaaagattcgtgtcccgcaaggaacgcaaaacagtccgtctcctcttccagaagcatctttccaagattaccatgtcccagacctacttttctctggtcagctacagatcccggaatacagaaagcctgaagaccttctccgattgctgccgctgcgtctgccgctcttgtacagccctttttgattgcgatagcggcgcctacgatgtaagcccagcaagcattctcaaaacagatcggctgaattccttttacctgattataaacgtcaagtcctgcatcttttgtaattttctccgcctcttcgatggaagcgattccataactgttcaatacagcgttgattttatcaattcgtctctcatatgattcaaataaagccatttctaaagtcctcctctcgcctattcctgtcttgggtcgatgatcttcactgcatcatccacacggccatactgtccctgcgccttttcccatgcttcgttcggtgtgtcacctttcttgatgaaatctgtgaatttcccaaggcttacaaacttgtaaccgatgatctcattgttttcatctaatgcgattcctgtcacatagccttctgccatctccagataacgaggaccttttgcaagggttccgtacatcgtaccaacctgggaacgaagacctttccctaagtcttccagtcctgcaccgatcggaagtccatcttcagaaaatgcgctctgtgtacgtccgtaaacgatctgtaagaaaagctctctcatagcagtattgattgcatcgcagacaaggtctgtatttaatgcttcgaggatcgtctttcccggtaagatctcggaagccatggcggcagaatgtgtcataccggagcatccgattgtttcaaccagtgcttcctggataattccgtctttgacattgagtgtcagcttgcatgtaccctgctgaggagcacaccagcctacaccgtgtgttaaaccggaaatatctttaatttcttttgcctgtacccattttgcttcttctgggattggagctggtccatgattcgcaccctgtgctactggacacatcatttctacttcgtgtgaataaatcatctcaaggactcctttcaactatatgtaatctctcttggaggccgtcttttgtacagcctatatccgtgttaattttctcacaaaaaggaggtttcgtcaatcagctagttgcacaaaacatctcttttttaacctatatagatcccactatcttacctgtccgcagcgagcagacattcccgcagaagaatgagtgctcttgccactgtgtactcacggttcttctgacgattccccgtaaagcggaacttctctacttttgtccgtcccttgaccatgcatccaatataaacaagtcccaccggcttttccggcgttccaccttccggaccggcaattcctgtcaccgcgatggaagcatccgccccggataaccggcaagctccttctgccatagcccgtgctgtctcttcactcactgccccatactgctttaaaatctcatgtggcacatgaagaatccgttcctttgcctcgttagaataggtaatgtgggcttcattaagaacactggacgcacccggcacatttacaagcctgccgcagagcagtcctccggtacaggattccgccgtcgtaactgtcatctttctttcctccagcatctggatgacagcttcctccaatgtcacttcctctttcgtcgtataaatgtgatcgccaaaacgttttttcagttcctccagcatgggagccatcagacacttcgccgactcctcgtcctttgccttggctgtcacccgaaaatgtacttctccggtttttgcgtaaggggcaagggtaggattcgtctgggcgtccatcaggtccgccaccattgtttctgccctgctctctccgatggcgcatacttttaccatactggagtaaatcccttccggttgaaggtcagacagatacggagcaatctgagtttcaaacatgggaatacactcatttggggggccgggtatcaaaattgccctctttccttcgtagccgctgccttcgtccccaataacaatcagccctggcgccgttccattctgattctctacaatgattgctccttccgggataagcgcctgtttccagttattctctgtgatcttctccccgttatgaatcttttggaagaattccatgatccgctcttttgtgtgggcatcctcacagagcgcttttttgaatacctttgccgtcacttcttttgtcagatcatccttggttggcccaagtcctcctgtgagaattacaacgtcggaccgctccaacgcgcggcgtatcgtatcttccatacgcgcttcgttgtcccctaccacactttggtgatataaagacaaacctagcagagcacacttctctgctaggtaagctgcattggtatttacgatattgccgagtagaatttcagtaccgacggaaatcaactctgcaaccatcttacatccctccttttgtcaacacttctttgttctttgcaatataatcaatcagggataccacagtcaggatcagagccaggtagatcagcactgtctcaatcattaccgcggtatgtcccggaagatccagaatcaaaaagataatcataaacatctgtgaaaccgttttaaacttgccccaatagcttgcagcaatgacaatcccgctgtctgacgccaccagccggaatccgctgatgatgaattcacggctgataatgacaatgacgatccaggccggaagtttgtccatcggaatcaggcagatcatagccgctcccacaagaagcttgtccgcaagcggatccataaactttccgaaatttgttaccagattgtattttcttgcgatctttccatccagcatatccgtaagacttgccacgcagaaaatcacaagagcgatataattgctgtactgtccgcccagatccgtcagcataaagacaacgaaaaacggaatcataatcacacgcagtaccgtaagtttgtttggcagattcatttacatcaactctcctatcaaatcatattcgcacgcgcctgtcacccggactttagcaaagtcacctgacaacagttccgtgtccgtatttacgaaaatcagcccgtctacattcggcgcgtctttgtatgtccggcctacataggcattttcgtccgcaacctttccttcgatcatcacaagcacttcccggccaatcatctgctctgcctggtcaaatgcaatttcctgctgaagctccatcagctctgccctgcgggcttccttaacgctttcttctacctgatccggcatctgtgccgccggggtgccgtcctctgctgagtaagtgaacacaccaagccgatcaaacgccatctcatctacaaaatccatcagctcttcatgctgctcctttgactcccccggaaatccggtgatcagtgttgtacgaagcgtgatgtccgggatttcttcccggatcctggaaatgatatgaataagctcctcctttgatgtacggcgccccatccttttcaggacgtcgtcgctggcgtgttgaatcggaagatccaggtaatgacagatcttcggctcctctttgatcgtctggatcagttcttccgtaatctcctccggatagcagtacaaaatgcggatccagcggataccgccgattttgcagagccggcgcaaaagctccggaagttttttctctccatagagatccttcccataaagcgtcgtctcctgtgctaccaggatgatctccttcactccgtcatccgcaagctgctttgcctcccggagcagatgctccatcggaacactccggaaattcccccgaagctttggaataatgcagtaagtacaatgcttatcgcatccttccgcaatcttgagatacgcataatgccctcctgtcgtcaccatgcgatgagtattcacaagaggaagtgtatccagcggctccatttttaaataggattgccctgccaacgccccgtctaccgcgtccaggatatgcccgtaagaagcagttccaaggacagcgtccacttccgggatttcctttgtgatttcctcccggtagcgttcagccatacaccccgtaacgatcagcgctttcaggctgccggacttcttatactctgccatctgaaggatcgtttcaatgctctcctccatggcatcatggataaaacaacaagtattcacaataatgacatccgcatcctcctcggtgtccacaatctgatatcctctggaggcaagaagtcccagcatggtctcagagtcggcaagatttttgtcacaccccagtgagataaataagatcttcatgtattctctcctaacatttcataaggcagatacttgtttcaaaagcacctgccttgttgtctcttattcttcggtatcttctccgattacctttaactttccactgttcatttcatcgatcgcaacggacaacggcttttccccgtcttttgtcggtacgagtggatccgcatggtcgatcaactgtcttgctctctttgcggtggcaagtacgatggaataccggctgtttacaattttggtatctccctcttctacgtcctgattcaccactttcattaaatctgtataagatggatgcagcataacatcattctcctttcttctacttttacaattcatttaattcttttctgattttcgagatgaactccccgttccttgcgacttttttcttttcattctggatcaccgaatgaagctcgtctacacagctctccagatcgtcgttcacaatgagacagtcataatcgtcaattccttctgcctcctctttcgcacgggcaagcctctgttcaatcacttccatggactctgtcccccgtccgatcagacgtctgcgaagctctttggcacttggaggggtaataaagactaagagcgtatccggaaatttctccttcaccttcagcgccccttggatttcaatctccagtatcacgtcttttccattctccaactgctcctccacataagagcgcggtgtcccataataatgattaacatatctagcatactctattaattcgtcttgtgcaatcattttttcaaattcttctgtcgctttgaaaaaatattctcttccgtccacctcgccttcccgcggatttctcgtggtggcggaaatagataaggcgtaatcatcgtatttctccatcaggcgtttcattgccgtccctttacctgctccggaaaatccggacaaaactgtcagtatcccctttggcatcgttttcctttccctttcctgctactcaatattctgaatctgttcccgtactttctcgatctccgtctttaaatctatcccgtaattggacaccgtcaggtcatttgccttggataaaatcgtattcgcctcccggttcatctcctgggcaatgaaatccagtttccgtccgattccctctcctgtcaggagtgtggccctcatatggtcgatatggctctttaaacggacaagctcctcatctgtacagatcttgtccgcaaaaattacaacctctgcggcgatacggctttcctcgatctgagtatccgctagaagctcccttactttttcctccagattcgcccgatactcggaaagaatctgcggggaacgctcctcaatcttctccacaagggctttcatggcatcaagctttccggtcagatcgtcgcgaagcttctccccttcggtttctcttgcctttacaaactgcacgcaagcgccgtcaagcgcctctttcagtccgttccacatctcgtcttcgtccacatcctgttcttccatcgtaaagacctccggataacgggaaagcgaagaaatccggacatcattttccaaattgaatttctcctccatctggcgaaaataatccagatattccgctgccagcgcctcattgtactttaaggacatctgcccttgggagagatcctcgtaggatataaagatatctacctttcctctctgaacgtacctcttcaaatatgtccgaattgcggtttcaaaaaaatagagctttttcggcatacggatattggcatccagataacggtggttgaccccctttatttcgaccgtaaatttcttctcccctctttgaatctcgcaccggccaaagcccgtcatacttctaatcatggtatcttcctctatatgtttattttgctggttttcattataattcatttaatttttatcgtcaactatgttatactgtaaaataaaatgaaaaaacaacgattctgccatgcggatcagattcgcatgacaactgaatggttggcaaaaaaggagaatacctatggcattagatggaattaccattgcaaatattgtaactgaactgcgctcctctctccttggagggcggatcgcgaagatcgcgcagccggaggcagatgagctcctcctcaccatcaagacgtccggaggtcaaaaaagactctacgcatccgccagtgcttcccttccccttgtctatctgaccggagagaataaaccgagcccttttactgctccaaacttttgtatgctgcttcgcaagcatattgcaaatggacaaattatttctattatacaaccgtcactggagcggatcattgtcctggagatcgagcatttggatgagcttggagatctctgccgtaagaagctgattctggaaatcatgggaaaacacagcaacatcatcttctgtgatgcgaacaaccggatccttgacagtatcaaacatgttccggcacagatgagttccgtgcgcgaggttctcccgggacggacgtatttcattccggacacaatgcataaagccgacccactgactgtcagtgaagatgattttgcggcactgttaacagaaaaaccgaccgcactttcaaaggctctctatacgagtatgaccggaatcagcccggtagcagcgcaagagatctgctatctggcaggtctcgattctgatttgccgccatctgagctatctaaagacctgatgacccacctgtaccgacagttcacgctgttcctcgatcaggtgcgccaggaagattttcatcctgcaatatataatcggaacaatgagccttatgaattttcttccgtccctctcactcatctgaccgggtgttcccatcaagactacagaacgatttcggaagtgctctcctcctactatgcggtgaaaaaccggatcacccggattcgccagaagtctgcggatcttcggcacattgttcagaccgcattggagaggaaccgaaaaaaatatgatctccaggcccgccagcttcaggatacacaaaagcgtgagacctacaaggtctacggtgaacttctccagacctacggctatcaggcagatccggaatccaaagaattagaggcactcaattattatacgaatgagatgatccggatccctctggatcctacaaaaacacctctggaaaactccaagcggtatttcgaaaaatataataagctgaaacggacatacgaagctctttcccgtctcatagtggaaacgaaggatgaaatcatctatctcgagtccatcagcaacgccctggatatcgcccgtaccgaagacgatctggcagaggtaaaagaagaactgactcagagtggctacgttcgccggaagttcacgaagaaaaaggaaacatttaaaagccttcctcttcattatcgttccagcgacggttacgatatctatgtagggaaaaacaatttccaaaacgaggagctgaccttttcttttgcgtctgggaacgactggtggttccacgcaaaaaaagtgcccggatcccatgtaattgtcaaatccaatggggaagagcttccggaccgggtctttgaagaagccggaaagcttgctgctttttattccaaaaataatggaagtccaaaggtagaggtggactatgtggagaaaaagcacgtcaaaaaagtgaaaggccagaagccgggatttgtcatttaccatacaaactactccctgattgctgacaccgatatcagcatgttgcaggaaatatcggaatcctgaccggaaacgttcaaaaaggaatcaaaaggtcctgcggctaaacgccgcaggaccttttctaaatcctatttctataacgaacggataaagcgctggaatgaagctcttccctcttccgtgcacttgtaaacccctgcgtcttccaggacatgcacaaagacttttccgatttcctgctgtaagatttcttcgatgttttcttcgttgacttccggataggacggaaggaaagtttctacccagtccgcatgtttttcgatcttttcgttacttcggacgtccttgcctgtcaggatgtactcttttaaaagctccatctcttctttcaggcgggccggcagcacggcaagtcccatgacctcgatcagtccgatgttttctttcttgatatgatggtactgcacatgtggatgataaacgccaagcggatgttccggagtcgtaatattgttcctgagcgtcagatccagttcatatatgccatccctcattctggcaatcggtgtaatcgtattgtgcggctctccatctgtctcggcaaagataaacgcctcttcatccgtgtatcttctccaaactttcagcacatgatccgcaagatcgatcagccgtttttcgtctttatggcggattcgcaacacggacagaggccatttcacaattcctgcctccacatcctcatagcccggaattgtcacttccctttcgatcggagcctttgccatggcgaaggtatagtgtcctccctgaaaatggtcgtggctcaaaatggagcctcctacgatcggaagatccgcattggatccgaggaaataatgcgggaactgtttcacaaaatcaaagagctttacaaaggcaggccggtcaattttcatcgggatgtgttctccgttgaatacaatacagtgttcattgtaataaacatacggtgagtactggaatccccattttgttccattgatcgtaagtggaataatccggtgattctctctggccggatgatccagtctcccggcatacccttcattttccaagcagagctgacattttggatatgctgttgcctttgcgttctttgccgccgcaatggctttcggatctttctccggcttggataaattgatcgtaatatcaatcgttccatacggactttccactgtccatttcttatctttttttacccggtagcgacgaatataatcgctgtcctgactgagtttataaaaatatttcgtcgctgtctccggggatgtttcataggcctcccagaattctctctgcacctgagcaggacggggtacaagacagttcatcaccttggtatcaaaaagatctctgtaagcaatactgtcctcaatcagtcctcttttcactgcctcatctaataaatctgccagtacgttttccagatccacatgctcctttgtttgttccggctccacgtagctttcctcacaaaacagatccaaaagcaagtttgtcgcgtaaatcttctcacactccgggagcagtccggtctcgatcccatattgtatcagtttgctgatagattcatttaacattttttcttccttctttcctataatcttcttgcgccgtcaccgatctctaccacatagaattccgcctcatgtcctgtctgctctttgtaaccttttccaacctgctcgacaaacgtctctaccgcgtcatttttcacaatgctgacggtacatcctccaaatcctcctcctgtaatccgggagccgaccacaccattgatcttccacgcaagatctaccagaatgtcgatctcttcacacgacacttcataatcgtcccgcagagagatgtgggactgattcatcagacgtccgaacccggcaatatcattctcctttaacgccttcacagcacgaatcgttctctggttctcgtaaaccgcatgtttcgcacgcttcttgcagatttcgtctccaatagcgtccttatgaatttcaaactcctcttccgtcagatctccgagtgtcctgatatccactactttctgaagatccttaagcgctgtctcactttctcttcttctgtcgttgtaagcagaatccacaagactatgttttaccttgctgtttgtaataacaatcttagcatcctcaagcttcacagtcgcatactcatattgaagcgtattcgtatcaaggaataccgcacagtcttttttccccatagctacagcaaactgatccatgataccacagttgcatccgttataatgattctcagaatattgtccaatcagggcgatgtcctgcatggaaatttcaatatcaaataaatctttcaaaatcacgcctgtcaatacttccaaagaagccgaagaagaaagtccagatccgtttggaatattaccatagaccagcacatccatcccctgggcaatagaatatcccttcttttcaaacgcccagatgacacccttgggatagttggtccactttgcagccggagacggtacgagatcgtcaaggcttgtctccatgacgcccaaaccgctaaaattgtcggaatagaaacgaatctttctgtcgtttcgctttcttgcaattccataagtaccaagagtcagcgcacacgggaagacatggccgccattgtagtctgtgtgctctccaatcagattgactcttcccggcgaaaagaaggtccgtatatccccctctcctccatacagcttttgaaatgtctccattagtttcttttccatacttcattacctgctttctctttgttttctgattgattttctttaagtaaaattataatgcgttttccaaaacataacaacaaggatattgctcaaaactataacgatattgagtttttgtaggttgattttctccggataccagcgtatgatacaaaggaagaaaacgaagttctttcttcttgatgaaacaaaacatattttcggaatttccgggcaaaccggagcggattgtaattggagtttgacaaatcatgcagatacagattaacgaagaaaaaaaggaattaaaacaacacggggattacacatttccggttcatctaagtggtgaaatgctttcccgctatgagggaggctcttttttctggcactggcacacagaggtggagctgactctgattttaaaagggcagatcgaataccgggtcaatgagcgcacctatcatctcaaggcaggggaggggcttttttgcaacagcaacgccatgcatgccggaaaacggatcgatagtcaggactgccaatacttttccgtcacctttcacccccgctttctctatggatttgaaagcagtattctccagacaaaatacgtggatcctatcctgaatacgtcctctttctcctccgccgccctccttccctcagaaaactggggtgcaaaagtcgtgccgcttttagaagagatcttcggtctctaccagacgccatctccggaccaggagctgcggcttcatatcttgctctcggaaatctggaggctactgtacggccactttacaagctgttcctttaaagagcctgccttctctgattccatcggccgcctgaaagacattctctctttcatccaagcctcctatgccaaatctattaccctggcggagatcgcagactatgttcatctttctaagagtgaatgctgccgctttttcaaacggcatatgaatatgaccttgtttgattatctgttatattatcggattcagcaaagtcttcccttgctgcgggagggattgtgtaccatttccaaagccgcggaatcgtgcggattttccaacgcctgctattacggaaagctattcaaacgctatatgaactgtactcccagacagtatcagtcccggttccgctcctaatgagcgtaccgggacttttttgactttccttgattgctctttccttgcgtcagtccagactgatcgcgtctattcttgcaagctcttcgtccgtaaacggcgtccggctgatttttgtggcattttccacaagctgggatgggcaggacgctccgacaaggacactggtcacctcatgatcttttaacacccagttcaacgccatctgagaaagagtctgccctctcttttcggctacatcctgtaagccgcggatcttcgccatcctctcttttgtcagtgcgttttcattcaggaaacgtccgtccgtgcggattctgctgtcagccgggatgccattgagataccgatccgtcagcatcccttgcgccagcggactgtacgcgatgatgccttttcccaggctctttgccgcctctttcagtccgttttcttcgatcgaacgatcaaagatcgagtagcggttctggttaatgacaaacgggcagtgggcttcctccagaatctctgccgccctccgcatcgtttctccatcatagttggaaatgcccacatacagtgccttaccgctcttcacgatcgaaaccaacgctcccatggactcgtcaagcggcgtatccggatccatgcagtgatgatagaatatatccacataatctaaccccatccgcttcaggctctgatctaggctggcgaccagatacttcctgcttcccccagatccatacggaccatcccacatatcgtaacccgctttggtgctgatgatcatttcatcccggtatggtgaaagttcccgcttcaaaatccgcccgaaattctcctctgcacttcccggaaccgggccgtaattatttgccagatcaaaatgggtaatccctaggtcaaaggcagcaaagcacaactctttcatggtgtcatacgccgcgttgcttccaaaattgtgccacagtccaaaagaaacggctggcagtttcagcccgctttttccacaatttgtataactcatctgctgatatctcttctctgaagcctgatacatgattctcctccttaattccctctctctttgatagtaccggaccggtatgctccgatcagttcttttaactccgcaatcttctttaagagctgctttccattatctgtatcccccaccgtctttcttttctgattgtaactgactgcaatttggtgggatacaatatctgtctcttcctggatcgcgatctcggtcgtctcaaacggttcatgcgccgcaagagacataccataggaattataaatcagcgtatatccagcgattcctgtctcccgatgatacggtctggaaaatccgccatcgataatcagaacttttccttcacatttgaccgggctttccccctctttttgatgaatcggaacatgaccgttgataatacgtgggctgtcgccttccaggccaaattctttcagaatcagctccgccgtctcttttctttccagcaacgtataataagcatttttcacctcccggtgagtctccttatcttcgatcagatatcgttcaaaggtagccatctgacttctgccatagagcggggatcccggagccgaccagagaaaccagagaatatgtttgccacgttctttttcctgatcttccatagagaaaaacgccttccgcacatactgctccaatacgtcatacagctctttcccctgataatatgtcccatagacagggacttccatcagtgtcccatccccgttcatcggcatacagccgtgatagagcagattgccattatagactttgtaaagacttccctgcttaagcagaaacttcacatgcttttgcagtttctcacagtttttaaaggcacgtgtcagccgttccattacgttttgttctttctctgtcaaagcgtatggatctgacggatctatcgtcggaaatatagtatccagaagtgcatactgcttttgcccgatcttcacctgcatcgtatcataatcgatccgctctaacagccttcgcccgtccataccgaactctggattctccatggcgagcttcccctcgattttaaactggatcacagaaatcgctttgtgcatacgctgctgaagcgccagcgaaatatctgctttctcctccggcgtcttaattgcaaaccgcgccgcgtcatcgtcaccgtaagtctccagcgcaaaggtcacaaggggcagcatgttgataccgtatccgtcctccaggatatccagattgccataccgcaggcagaggcggatcactgtagcgatacacgcctgctgtccggcagcagcccccatccagagcacgtcgtgattgccccactggatatccagagaatgataatccatcagacagtccatgatccggtgcggctgcggtccccggtcaaaaatatctccaataatatgtaaatgatccaccacgaggcgctggatcagctctgccatagcgatgataaacggctctgcccgtccgatatccagaatcgtctggataattgcctcatagtaagcttccttgtcagagagctccggcttttccgtgatgagctcttcgatcacataggcataatcctgcggcaatgcctttctgaccttggatcttgtgtacttggacgacactaccctgcaaagctcgatgagacggtaaagcgtcacccgataccagttctgcatatcctccccggactgacgaagctgctctaatttttctcttggataataaatcagagtcgccacggatcgcttctctgccgtccccagcgtatgtccgaatacatcgtcaatcttcttacgcacagcaccggatccatttttcagcacatgggaaaatgcctcatattccccgtgtatatcggaaaggaaatgctccgtacctttcggcaggttgatgatcgactggaggttaatgatctctgtggacgccttctcaatagtcggatataattccgccagatactccagatatttattttgttccatgatttcctccttttagtttggattagaacgcagacgaatctctggggctttcttttcaacgtatacacacacctcacagatcttcgcactcctccgcatgattaggatgattatatcatacttttggatgtttgcgggagaatagatatacaactgacaatcacgttcccaaaagaaaccgctcacgactttcccttggaactgatttttctgttagatatcatttctgtattcttatcatttttctttatagaagaatgattccacaggcaaatccaaacctctcttggtgagcgagcgccatcctttgtaaggatgtcttcaaagtcccctgcttaccaaacagattctccattgcctgttccgcataatgacatgtcccgatcacataaaacggatcagcaaactgccgaatacgagagtcagcaggaagatgccgtatcatatccggatacaacaaccaactgtaacagagaatagctcgaaatccagcatccggaaatatttctgaaaagaattgcttggcgctctgaatagatatctctacgttttctctgcttaggtccgctcctcttggaatatgacaattcaacacccgactaccaggaggaagcatttcttttgcgttctctatatagataaaatcaaaaccatccatcggctcttccacatacatcatctcaaacggctgaaattgcagagatcctatctgaaatatttccgtttccatgatatgacgaaaccaaaccacatcatcctgatccagaccaacttctccgattttctgaaaatacagctccgcccttaacgctacatcccgaaaggtatcccatatcatattttccggaactcctatcttctgatattttttatattgttcacacagtaagtaggtcactacagccagtcgcatagctggtctctgactacacaactcgaaatcaaatctttctcctttataggcagtaagggaacggagttctatttctctctgatggtaagcaaattcttttaaaagtgccttttcaataccggcagtaaattgtaattgttttactatagtatcaaaattcatcccacactctctacagtcccatctcttccatccactttttcacctgtgcctcggacacagaagcgttcatcttcctccctgcaagcacgtttgccgccggacataccttttgcagaatctcacttgttttccccataccgctgccaccggacgttgcgaatgggacaatggttttgcccgtaaaatcatattcctccaaaaacgtatgaatgatgcggggagcttcataccaccagatcggaaatcctacaaataccgtatcgtattgatccatgtgatccacatgctctgcgattgccggacgggatgacggatcgttcatttccagagtagaacggctttttttgtccgtccagtccagatcctcacttgtgtacttctgtaccggttcaatttcaaacagatccgctcctgccgcctctgccactgtttttgcaagtctctgagttactccgcttgcgctgaaatatgctactaatgcttttttcatatcttacactcctctactttatcatctctaattgatctttcatccttgttataatccggatcttcatcgctgtacgacccagataaaacaaacttatacagatctccacctgaccgttctgccgtatatgccgcaatagactttgtattgcctgtcatagaaaaatatgatataagaaccatcccgtcttgcggcgcctctgtccaggatattccctcattcatctatctccagtaacttcttggccgctgaaagagtcatgtcataaatggaaaaacagtgaactgggactcctgccgcctccatagctgccttttgctttggtgttattgaagaataagggtaaatcccatacacaaaagggaaaaacgcatagagaaatattatactgtcttcttctgacagttccggtatgcagcggctggcacattccgccgtcagatttaacgattccccatacacctgtttaaagtctatcagtttctcgatgctgctattctcttcaatatcatacatattcatggagagaagtttcagcatcagttcccgtttggacaaggtctcggccagcagaatagcaaaatccatacggctcatagacgtcttcttccgtagagcgctccttaagtcaatgttccagtgctcatattccctctgtagcaaagcaagaaaaatctcctctttcgtctgaaaataattatagatcgaagttcttgtaaacgatgtggtttttccgatttccttgatggtaatctccttaaagctctttgttctataaagtttcttacaggcgtctataatttcgttttcccgctctttcgtcagttcttccgatccttttggcatagtctactccttttattctgacactgtgtcactatatgcaatataacactattctgacacgttgtcaacacatgccgcatatcataatggagatttggtgatattttaatagtctctctacatttcctgtggtaaaatcatagtaatcacttaatagacttctccggacaggatgtggaagcgttatattccctttatcgtaatgcaggaatcgaatttctgaaaggccatgctcccaaacccaagctgtcaggaagaatgataaggaggaatcctatgcaatacattagtcattattcatctcctctcggatatattttgctggcggcagatgagactggcctgaccggattatggtttgaggggcaaaaatattttgccctctatcttgataaggtgtatgaggaaaaagaactgcctgtactgaaacggacgaaacaatggctggatctgtatttttccgggaaagaaccggatttcatagtaccatttcattttacaggaacgaattttcaaaatgaagtgtgggaaattctctgtacaattccctatggaaagaccgtgacctacgggcagatcgcaaaacagatctctgaaaagtatggcaaaaagcaaatgtctgcccaagctgtaggtcaggctgtgggacacaataaaatctccattttggttccttgccatcgtgtagtcggaagcgacggcagtctgaccggatatgcgggaggtatagaaaaaaagcagctttgctgactctggaaaaagcagatctgcacagagataggtagcggcaccaaagcggagtttagactctatctgtcagacgtcaagatctgctttaacccaagctgaatacggatgaccgggcagaagtgaggtgacttgcttctgctttttctcaaccactcacctcgaaactaccacgatacattccgtatgctcagtatgcggaaataaatctaccggctggatcatctgtactctccacccttttttcttcaaaaactccagatcccgtttctgtgtctttgggttacaggaaatgtaaatgagcttctccggattcatccggctgacagcgtcaagaaattccggtgtgcttcctgtccgcggcggatccagaaagaccacatccacccgttctcctcttgccacaatcttacggattgcttttgtcgcatcctcgtttagaaagtgcgcgttgtggatcctgttatctctggtattctggatcgcgcaccggatggcgcttccattcttttctacacccaaaacactttttgcataggctgccgccgcaagtccgattgttccgactccacagtatgcatccagaactgtctgcgttccattgagaccagcagcctcgatcgccgtccggtaaagaatctccgtctgcaccgggttaatctgataaaaactagaagccgcaatccgaaaccggattccgcaaagttcgtccacaatataaccttttccgtacagaatcttttccgaaaagccaagcacggcgctagtggatctgttattaatattctgcacgatcgtaccgactttcggacagaattccctcaccctctttacaaatgttttcgctcccggaaggaaaggtgacgctgtgaccaatacaatcagtacttcatccgtcagaagactgtgccttaccaggacatggcgtaaaagtcctgtctttctatcctcatcgtaaggacgatacttacatagtctcgccgctttccggaccgcccgaaccgcctcatcaagtcttgggtgatgcagcaggcaagtgtgaacaggaaggacataatgagtaccacgggcatagatcccactgatcaactcacgccccggtccttccgcaaaggttgaaattgccttattccggtactgccaaggatactccatcccaatcaccggacgcactttcccaaaattccccatcagttttttcatttccttttgtttcatatgaatctgctcttcataaggaatggaaaggagcggacatcctccacatcctttttcctgtaaatgacatctgttttcctgtctatccatgttccacctcttcttccgttctctttccttattttatcataaaacacgccacaaaacagcaaaaaaagcttcgacagcaccgacggtctatctcctttactctcagtccgttcctactgccaaaagcttttctcacgttttctatcgctggtagatgcactctccgttcatatataatgcttccactttcacctgatcgatctcttccttaggaatagtaaacaggttccggtccaaaatggcaaaatgcgccttataccccttcttcaactgtccgattctccgaaatcccgccgcttttgcggattcccttgtgtacagtttcactgccgtctctacatccactttctgatcctgcccgcagtccgtaccgtcatacgccttccttgtgacagcagcctttaaacatggaaacgggtcgtatggaaccgcccaggatgtggcgggagcgtctgtagaaaaacagagcttcacaccctgatcgagtatcgtcctaaccggatagcactgtttcatccaggtttctcccagatttttcagatagctttcaatctctgcataaaggaaaatcggctgcatcacaaagaaaatgcctttctccgccgctttgcgaatactctcccatgacggatcagtcagatgttccaaacggacatacggagtatcatccagcatccagttttcctcccggtatgctcgttccacggctcttgtgatggcctgtccacccatagcatgcatggaaagctggcaatgatattgcttgcaaaaagcaacagccgattccatcagagtatccgaacaggtggaaatcccgtattccctgtcagtgtcaagatatggcttatccatccatgccgttcgccctgacacacttccatctccgatcagtttcaatcctgccacaaacacctgtccgtttttattgcggcgctcttttggaatcctaaacttcggatcatcagcaaaatagtcccacatataatagatagcggtttcctgttgatatccatgccgtatcgcttcttgatacagtgaaaaattgtccccggtgtccagattgcccatatcacatacagccactattccctgagatttcaaccgattgccaagatccaccaagttctgcactttttcctcgtaagtctcctttgggataaacggaagcacaagatctcttgcggtttctttgagcactccggtcggttctcccgatgcatctcgttcgatctcaccgcccaccggatccggcgtatttcgtgtgatcccggcaagctccaacgccctgctgttgacacagcgaatatgtccgcacgtccttgtaatggaaaccggggcgccggcactgctctcatccaaatcatagcggtttaaagaacgcttctcctcaaactttccttcatcatatccccatccttcgatccattccccggcttttttagtcttgcggacttgccggattcgctcttttaattcttcaatcgaatggacttccggtggaagtgcagaaatctttttgctgaaatctgccagcataaccgggtgcatatgtgcgtctataaaaccaggaaccacacaggctccctttagattcacacgctcatagtctccctccgcaatagcttcccgtttcccaatccactgaatcgttccgtcagagacaagcatggcatctgcataaaggtttgtgtcgtcggatgtaaaaatcattccattttcaaataaacagtctttcatctcttttcctcctgccccttattcattcagtataaggtcttccattttttcttgcaagcagaataaagaagaatttttattatttacggtattagtcgaagatggtttatgccgccgaatgacctctttgactacctttctggcaggctgcggcaaattcacgaagcttttgctctgcttccggtgtcagtgtatccggcacctgaatctgaactgtcacatactggtctccatgtacggaaggttgattcatccgggcgacccccttgcctctcaatcggattttcgagccggactgtgtcccttttcggattttacaaactacgcgccctgtcagtgtctccaccattacttctcctccaagtgccgctgttacaaatgggatctgaaccgtcgtatagagatcggcaccttttctctcgaatccaggtcttgcgccgacatgtattttcataaacagatctccaggctgaccgcctcctgctcctggcataccctttcccttaagccggatgctttttccatcctctatcccctcagggatgtgtacttccagtgtctgcgtcgtgccgtctcctctttggatccggattttcttgtcacagccaaaagctgcctcctcaaagcttattgatacatcggtatgaagatcctctcccttggtctgatgaggccgcccccgaaatccgctctttgtatatcctccggacccaaaattctgtcctccaaagctgcctctgtggtggaaaaattcaccaaagagatcgccaaacatatcatccatgttgccgccttcaaaatggtattcccggtattcgccatcttgtcggctatcatcgtgaaacctgccaaagccaccgaatcctccaaagccctgcccggttccctgcgctccctgggcactctgatcaaaagctgcttgaccaaactggtcatacagtttcttctttttaggatcactcaacacatcgtaagcttccgtcacctctttgaatttcttctctgcatccgcatttccctgatttgtatctggatgatatttcttcgccagttttctgtacgcttttttaattgctgctgcatctgcgtttctgctaataccaagtacgtcgtaatagtccctttttgccgccatactgttcaccctctcttccatcgattctgatttctatcactttgaaaataccccggagcaatccggggcacatcgtcgtctgttctatttataatataacaactgtattttctaaagtcaatagggtgactacattttataaaaaatatcctgatggtttcaggatttctaccatctggctgtctgtaatcaaaaaagtctgacatggatttcccccgatgacagacggtcagtgctgccatcctcatattgaacaagaaggtgacaatcctcatccactccggtagctaccgcttttcgctcaccttttggcgaaagtatgataatctctcttcctactaccagacttcgcctgcggtactcttccacataatcttcccgtttgattccttgataaatactcagaaaccggttcaaaaattcagccgccagatggttttttccatcattttgtttcttgtcaaaaatcgcgcctgcactctcccggatctcttccgggaagccctcctccggtacatagatattcattccaatcccaagaatcacatattcaacactgcccgtctccatactgacggacgcctctgtgagtatgccgctaattttccggtcatccagatagatatcgttcacccacttgatctgcgcccgtctgttcgataccagttccactgcctcgcaggccgccacagccgctatggtggtaatctttgacgcctgagtgggctccgcctgctcaggccgcaataaaatgctcagataaatgccggtgtctgccggagaatgaaagcttcgaccaaatcttcctctaccttttgtttgtaaattagcgatcacaacacttccttccggttttccagcatccgcccattcccgaagcagtccgtttgtggattccacttccggaagtacattcaaattcagaaaaccgcataaaggaatcagatatttccggatcccctgtgcggaaagaatatctgtctccgccgaaagacagtaacctttattggagactgccgtaatctcatagccatccttacgaagactgttgaccgctttccacacagccgcccttgaaacagacaacttcgccgcaatctcctctccggaaaaaaagacacccttatgctcttcaaacaaagccaggatactttctctggtactcacgttttcacctccttttcttcttgttgctggatatcgagtctcatctacgttccagatatcagtttatatactctgattttcccatcttctcttcaaaagcacgatgctttcgacatgtacggtgccagggaacaaatcgacgcatccggcccgctccggcacataccctctacctttcaaaagctccagatcccgggcaagactggtcggtttacaggagatatagaggattttctccgccccaaatccaatgattttctcaagcgccttcggatgtacgccatccctcggtggatcaaggataatgagatccggtacctcattcagctcatccactactttcagtacgtctcccgcccagaagttacagttgtcaagcttatttaacgccgcattttctctcgccgcttccacggcttctttcacgatctccacaccgactaccttttttgccaccgacgccgcaatctgggcgatggttcccgttccactgtacaagtcgaacacgactttgttctttgtatctccgatataatctctcgcagtctcatagagcacctccgcccccaatgagttcgtttggaaaaaagaaaacggtgtgatcttgaatttcaggcctagaagctcttcgtaaaagtagttttccccgtaaagtgtagttgttccttcatctttcacggcatccgccagactgtcgtttctcgtatgtagaatcccggcaaaggttcctttaagcggaagattaagcagtgccttcttccatccttccagaagcgtctcctccccgatataggaactggtcgtaatcagatctgccaggatctcccctgtctttaccgctttccggacaagcaagtgtcgaagatacccttcatggtgcatccggtgataaaatgggacttcctgctttgcgaagaacgccaaggtacaatccagaattttccgaaaatcctcatccacaatccggcaccccgataccgtcacgatatcgtggaaatttccccgcttgtgcattccaagggcgagcggcccgtctttgtattcatctccaaaggtaaactccatcttatttcggtaagcctcccgcaccggactttctttgatcccctcaaagatctcgtccggaatccggtcttttaacagatcccggacctgattttcctttaattccaactgtttttcgtatggaagactctggtatgcacagcctccacacatcccgaaatgcggacatggggattgtatttccttcggcgatgcttccagcacctccaggatgcggccttcggctttcccttttctgaccttattgaccaaaattttcactttctgtccgggaatggcgtattttacactaacttcctgctctccattctccacgcttacgactcctttattggggaatttcacgcagcggacaataccctcatagatcgttccttttttcatactttctttctcctatcaattctcaaaaaaataaggcaggaagctgctttcctaccctatcttctctttctttttctgtcattattctacttcatcttcatcatcgaagaagtcgtcatcaaagtcatcgtcaaaatcttcttcaaagtcttccagataatccggtgtaaagaatgagtatacggcataagcaatcgccgcgacagccgcaacggctccgataatagccagtacccaaacaatcacctttttcgtatgatcttcatcttttttctgtaataattcgcttaatttggaagctgccataatctcttcgaattttccgctcatgctccctctcctttctgatgttgccatctcaacgcttattctttttcgtaattataccactatcataaacagaataccatctttttatgtgaagttttcctgtttttgtcagaatcccgactcatcaattttctgtagtttggcaaatgcggcaaacatctttttcacaccaaaccggtcaaactccactgtcacttcgtaatcgcgaccaccttccgtaattgcggtgacaagtccctctccaaatttcatgtgccgaacacggtctcccacatcatagcccgggccttctccggaagcgaccttaaactgctgaaccggccttttaatcccaaatgcctgggaatgaaaagctgcctttgccttagcataagtctggttacgggcaatctccatctgcggccgttcccgcaaagtccctgatgcagttccaataaggctctctggtatttcctttaaaaatcgggacgctatattgtactgtgtttctccgcggaccatccgacgcttggcacaggtcaatgtcagctctttcatagcacgtgtgatccccacatagcaaagccgtctctcctcctccaactccatcgggtcatccgccgtaatcgtcatataacttgggaagaggccgtcctccatccctgccaaaaagacatacgaaaattccagtcccttggcactatgcaatgtcataagcaccacataatcgctctcttcgtccagattatcgatatctgccaccagcgccacttcttccagaaatcccgaaagtgtcggctgctctccggcctcttcacagctctcctcgtaagaagcgagcttactctttaattcttcgatattctcaatccggctctcggcatcctccatatcgatctcttctaagtaattttcataatccaatgtctcaatgatatctgtaaggagggcaaggggcgtcagccgtcctgcctcttccttaaaatgctcaatcaatgccacaaaggattccaattttgaaagggcacgtccgatccctggaatcagatccgctgccagaagtgcctcgtaaaaccccgtttctttttgcagggcatattcttgtacccggttgatggaagtcagaccgatcccacgttttggcacattgataatccggcgcaccgccagatcatcccgcccattttctatggtacgaagataagccaacagatccttgatctcccttctggcataaaagtttactccgcctatcaccttatacggaatgttcgtggagacaaagcgctcctcaaacatacgggactgtgcgttagttcgatagagaacagcacaatccttgtaggaagccctctcctccttgacctttttctggatcgctgccgcaatataatccgcctcgtcatatgcattatcaaactgcttacaggcaatcttttccccctccggattttctgtccagagtgtcttgtccttcctccctatattgttatgaatcaccgcattggccgcattcagaatattggaagtagaacgataattctgctccaatttgatgaccgtcgcatctggaaactcactttcaaaattcagaatattcttaatattggctccccggaacttgtagatggactggtcgtcgtcccccacgacacacagattccgatacttggaagacagaatccggatcaaatggaactgtactgtattcgtgtcctgatactcgtccaccataatatagcgaaaccgctcctggtagtaatccagcacatccggctgagtctcaaacagttgtactgcccgcaccagaaggtcatcaaaatccagagcattgttcgcccgaagttgcttttcgtattccagatatacttcagcaatcttctgtttggagaaatcaccctccgcctgcaataaaaactcctgcggactgatcatctcgttcttcgccgaggagatggcactgagaagtgcacgttcccggtaggtcttggtgtcaatctgcaggtacttgcagacttccttcatcaaagacttctgatcgtctgtatcgtaaatcgtaaaattcgtatcgtatccaagccggtcgataaaacgcctcaaaatccgtacgcaggctgaatgaaatgtactcacccagatactctccgaaccgaatccaaccagatggtccaccctctctctcatctcacccgccgccttatttgtaaatgtgatcgcaagaatattccacgggttcacccccttctcttcaatcagatacgcaattcggtgagtcagcactctcgtctttcccgatcctgctcctgccagaatcaggaccggtccctccgtctgaaagaccgctttcttttgcatctcatttaaggaatcgtaaatactcattgtcttggtactcccatctctgctcgtagtttactcagtataccacacatttgttcggtatttcaagagattggaagattcttcttccgcccatttttacaaatagcttgccatctagttttgaaaactatataatgtatctataaagttttgttatgaggggttgtgcatatgacgattgataccaatgatttactgaacagtattttacaaagccttgagcggatcgattatattcatcctgaagagattccgaatatcgacctttatatggatcaggtcactacgtttatggagacacaattaagatctactaagcgttacgagcaggacaagattctcacgaaaacgatgattaacaattacgccaagaatcatctgctcccacctccggtgaagaaaaaatattccaaagaacatcttttggtgctgatctttatctactattttaaaaacctgctctccatccacgatattgagaccctgttaaagccactgacggacacatatttccagacaagcgataatttcgacctgtctgcggtctacaaagaagtctgtcacctggaaaagagccgcatctcctcagtacaggaggatattaaaaagctctggaatgaatcttccaaaagctatcaggatgcgccgtctgaagatcaggaatatttgaagctttttgctttcatctgttctttaagctttgatgtatatattaaaaagaccattatcgagaagatgatcgattcttttgctgagaagacgaacgacaaataacgggaacatagcaggacacaaagtaagacgctgatgtcatcaaagcatcagcgtctttatgattactctttgttttcaattctgtcaaataccatatcgtatccgtcatttccgtagttcagtgaacggttcacacggctgatcgtcgcggtagaagcgcccgtcttctccgcaatctccagatatgtcttctgctcgcgcagcattttcgccacctcaaaccgctgagacaaagataaaagctcattgatcgtacagatatcttcaaagaagatgtaacactcctctttgctcttcaggcttagaatcccttcaaatagattgtccacagcctctgtcttaattttcctactcatatctaccctccatatcgtgttcgtcgggcattctttctgccagctactattttaacacactaaactcataaagtccagtacttgttaacctttctgtctgatcagacgggaaaacttctcataagacgttgtggcaatcagctcttctgggaaatcggcctcctgaatgagcttttcgatgcagctaaatccaccaacatcgatatcaatgtgagcgtcgcttcctgttgtgatatagacgccttcttttttgcagagctccaacattacttttgcgttttcctctgtattgacccggaatccttccggtctctgagaggaattattcagctccaagagagtgtgcgtctcctttgcccctctcaccagcctttcataatctaccggaaaacgtccgtcgtccggatgcccaataatatggatgtacggattcttcatcacattcaggtacgcctgggtattcaaatcccgactccctttttcgataatttcggaattcgtactataacaaggtccgtggatacttgcaatggcaagatccaaggactgtaatacaaagtccggaagatctactgttccgagttcatccagaatattaagctccgcgcccatgaaaatgtgcagtccgtccactgtccttggtaccaccggataattctgaaagtaaaattcatggcatgttcccggcatcttcggtgcgtgttctgtcaaagcgagtgcctctaatccttttgttttggccgcctgaatcatctccatcctcgtactgtaagcatgtccacttacaatcgtatgagagtgtgaatccactaaatatttcaaaaaagatcccttctttcttttcactttcctgctttagtttaacatattctgccacttagaacaacaatacataattcttttgattctgtccatactctttgttgaggtgatccacatggaaaagaattctgtttcaaagaaaaaccgacaggtcatcgattcctacgattacctgggaaattctgcctctgcaaatgactgtaccggactcattccgtccgctccgcagtcagaggcagaacttcagtcctatgaagatgtctatgcatttacctctcctaaaatcagggcgaaaaaggaacaaaaggattcctgacaaagaagccattttgcagggacactgcaaaatggctttcttttccatacgattctctataatatgctaaaatagtgtcatctgtccggtacagtatcgcacctgcttggccatccgaacctcgtcttccggccgcagacgcccaaccagaagcggagattccggatcatgctccctcatattctgccgtaccagttccctattttcattcgcatagcagtaaatacaaccatgaccgcatgtattatacgctccaatatcgctgccaagaagacacccacagccatcccgctgcgtcttcttccctgccggaacccgaatctccattccgatagcgtgttccagaatttccctcgtcatgcatccggagacatcgatcccgaactgacaaagatgagtcccctcgcagcaggaacgaatccggattccatagcttgcccctattcttgcaaactccctgccgatttcaagccgctcactttccggaacgttacacacacctgggaaattccgctttgtcttctcataaagatcaataaaactaatcacacactgatccacatatccacacaacgcctcacacatcttctcaaatgctgctatgtgaaaagaaacgctgtacttctcggacagaaagaccgggtcataccgccagcttaccgcctgccgtccaagggcgtctgacaaggttcgaagtgacgcgatcacgactctcttatccggaacatgtggctcaatctctttcccgtatggtgtaatcgtaacaaaccagaattgatgaaaattccgcaactcctcaagatgccccagcatcggctgtggattctttgtacaaaaggccagacagtccaccacgtcaggagtcagccgaaatcgtgtaacctgccggggaaagtacggattcctgaccagaacatatttttcccgaatccgtcgaatcagccatttactgtagtatgccgggatatcggttctcattccggtgtttacaatcacttacaccacactcccttcccttttacgactacttctgtcttttcctcatccgattaggacagtgtaaatgcctcctctgtgcctgtcgtgtcaatgagggctgtcacaagggcatcaatatcctctgacgggatctcccacacattatcctttttactttcctgaacatggactgtgatcatcgatttttcgccgtactgcggatcctccagcacttgactcagacactcgtaaagcatttcccctgctgcctctgtcatctcctcatccgtcggcgccgcctgattgttcaggatctgctcctgcaccttggcaatgtactcctgaagcttttgctttaattcctcttccacaccaccaatcatcttcactggctccacttcaacgcccacctcaaagtttccatcttcctgctcctttgcttcctgaatagtgtacttcgtcttcttcatcagatccggaatataggaccggaacttttctgtcagctcgtccgaaaatccgagggaatcaaactcctgcatataagaactgatcacagcttcatactgctgccttgcctcctcctcgctggtatcagcgaacccctcatacgcctccgtctctcctcgtgtaatcaaatccagaacagcctgtgtatatccggtagcatcaaatggcttctgacatcctgtcagcactacaactgctgtcgccactagcaaaacaacgacgtttcttacatactttctcattactctctcctttctgcttttactcagtataacatattttagaaatcctgtcatccgcacaatcaggaacaagacagcggcatacatcaagcaccgggagcactaaaagacatattacggaatggtaagtcgtcgccaagttccttggcaagtccggactttggcgcgtcgcacgctacaaaaaaggctgcctgttgcgggcagccttttttgtaatcctattctatggcttttaaatatctaaattaatcaatgaatttatataaataaaaggtacatacaatttcgattataatctggtcacattgacagcctgagggcctttttcgccttctgttacttcaaattcaacagcctgcccttcatccagggtcttaaatccatccatattcagtccggtgtagtgtacaaaaacatcttttccggattcatcgctgataaacccataccccttttgattgttgaaccacttcacagtacccttgttcatagtgctacctccataaaaaataaaacaataagcaaaacatcgtctatacgatgttcctagagcatagcacttttcttatgaaaagtcaacgatttgtcgaggaatacatagaataaaaagtaaattgtccgaatttcaataaaattcagaaaaatcagagacagatgactgagcttttcacacttcatttatcagatgcataccctgaaattataaatgatttgctggaggcaattatgaaaaagaaactgttatcagtacttcttattaccgcccttggggcatcactacttgccggatgctcttctgagaaagactccgtttcagacaaaacagaaaaaaaggtggaagaaaaactgaccaaagttaccttaaacgaagtcgcccattccatcttctatgcacctatgtatgtagcaattgaagaggattattttaaggatgaaggaattgatctggagcttgtgacaggatttggtgctgacaaaacaatgaccgccgttctttccaaccaggcagatatcggattcatgggctctgagtcctccatctacacgtataatgagggcgcaaacgattatgtggtgaatttcgcacagcttacccaacgtgcaggaaacttcctcgtatccagggaaccaatcgaagatttctcgtgggaagacctgaaaggaaaatctgtacttggtggcagaaaaggtgggatgccggagatggtattcgagtatattctgaagcaaaatggaatcgatccgcaaaaagacttagcgattgaccagagtattgactttggttccaccgccgcagctttctccggcgggcaaggagatttcactgtagaatttgagccgggtgccaccaccctggagtcttctggcaaaggctatgtagttgcttcccttgggaaagagagcggttatgtaccttatacagccttttccgcaaagaaaagttatattgagaaacatccggatgtgattcagagttttaccaatgcgcttcaaaaaggaatggactatgtcaacagtcatacaccggaagaaatttctaaggtgattcagccacagtttaaggagaatgatctagatacaatcacgacaatcgtttcccggtattatgagcagaaaacatggaaagaagatctgattttcaatcaggacagttttgaattgttacaggatattctggaggacgcagatgagctggattctaggacaccttacggagaccttgttacaacggaattcgcaaaaaaggccgtgaaataaatttttaatacttttttgatattttgaacacacttttttcacatttcaaaggtatgattaaattacaaagtagaaatactttgtgaataaactttttcataactttttccctcagccagtacattccctgtactggctactaaaatgtaaaaaacaggaaagattcctatatctacgaatctttcctattttctattttcatgcgattcccgttccaggttctgtacaaaataccctgcggcaattcctcctatcacatttccaagtgttacgaacaacagtactttcagaacatctccgatggatgtcccaaaattcaaaacatatacggacagataatacatatctgcaatgatatgttcaaatccacagaaaacaaaagcagtgatgaaaagccaaacataaaagatctgagcaaaagtgccctgcttttggcggatacctcctacaaaaaccgcaaaggctacaaacagtgcacagaagagtccaagtattgtcaggctgaccggagagtctgcaagctttggaattacaatctcttcaatccgacctagtattcctgcttcaaatcgtgtgaagtgaatcagaatggccacaagagctgtgccaatcccattgccgatccacgcaatgaacagatcgccgggacgataagagccgttatatgcaaaaagtgggcagactcttgtgaaaagtctgttgtgtaagttcaaaacgagtaaaattcccgttgcaaaaaaaagactcgccgcaagtttgtctgaaatgcttaaatataccatagcacccatagcgatataaatacctgccatgatactactgatccatttttctttcataggtatttcctgtccttttcctttgtgatatatgatatgccgcaaaaattgtactcgtatttacaataaaaatcaagtcttatttgtctttttataatcagtctccctgtgatgccgggaaagaatatggaaatctgattaaaaaattgaaaatgatacaataagtcattcgattaccaacagctccggtctgatatattctgtaacctgttccattttacctcatccctccccccaaatacgtccggcttctctatcaatttatgcaaagccctggatttagaacaacaagcagcacctctttatcagaaatttcacaaaaaaaaccggttttgtcccatgaattgttgacctttatcacacttttgtgttagcataactataggtattcatataatgtgcagagtatgtacagaagtaccctcccggacagtgcatacggatgcggcagcacctttccggaagaaagtaaagaagaaaaggagacgcaaaaatgaaagaatttacttatgtaatcacagatccagaaggaatccatgcaagaccggcaggactgcttgtaaaggccgcagcaggatttaagagtgacatcaagatcgaaaaagacggaaaagcagccaacgcaaagacaattttcggcgtaatgggacttggcgttaagaaagatatggaaatcaaggtgacagcagatggcgaagatgaagcagaagctgtagaagcactccaaaaattttttaatgaaaatttatagagcaagcagaacgcaaatatagagacttcgcaaggggaacgaaaagcttgagaatccgcaggtttccccttgcattttttctcataagtgatatactatacttgttcgcagatatggttcatcggtagaacgctagcttcccaagctggaaaggcgggttcgactcccgttatctgcttacaaaaagccggaaacatggaaagatcagtgtttccggctttttaaggctacctccatcaggcagcctttttgtgttctttcatattcttttttctctagcggtttgcccggtaagcttcatctgcctcccaaacgccgaatccgctttcgtttaagatgtgtgctgctctttgtggttcattcgtctttaaaacggcagatgcgtcctcgccgtttgcgaaagcgtacatatactctacattgataccaccctgcacaagctggtgcatcgctttacttaaagaccctgtatcgtgcggaacccgcagggcaatcaccggcgtcagcatagccatgataccgatttttttcagttcttctcttcccctttccgggtcggaaacaatcatccgaagcatcccgtactccgtggtgtccgcaagactgagcgccacaatattcactccattgcttcccagtgcatcaagcacctcatccagtcttccttctctgttctccagaaaaacagacaactgttgaattgtactcatcctgattcctccttcctacagattacggttgtcaatcactcgcttggcttttccttcgcttctctcgatagtctttggctccaccagtttgactctgacagaaatgccaagagcctgttttaagacgtcgccgatccggtggcggagtgcatccaactgcctgatttcatcagagaagaatttttcatctacttctaccataacggtcaagacgtccatgttgtcctcccggtcaatgatcagcaggtagtgcggaacgacttccccgattccaaagagcgccgtctctacctgagtcgggaatacattgactccccgaatgactttcatatcgtccgtccggcctttgaacttggagattctcggcgtagtccgaccgcatttacatgtctcgtgtgtcatgcttgtcaggtcttttgtccggtaacggatcagcggtacagcttctttatccaatgttgtaaagacaagctctccggtttcaccgtctttgattggctcatgagtaagaggatctaatacttccggatagaagaaatcggaatggatgtgcagtccttcatggtggatacagtccatggcaacgcccggtccactgatctcacagaggccgtaaatatcaaagcagttgatctttaagatctcctcgatcttatttctcatctctaccgtccacggttccgcaccgcacaccgcagccttgatcttcatcttatctactactcctgcttcctgcatagcttccgcaagatgcatggcgtaggatggagtacaggcaaaggctgtcgcttcaaaatcttccatacacatcaactggcgtttcgtatttcccgctgacatgggaattgccatggcccccaatttctgcgcgccgaaatcaagccccattcctcctgtaaacaggccgtatccataacagacatgaatccgatccttggcggtcagtcctgccattgtcagacaacgtgccacacattctccccagacatccacatccttctgggtgtatgccatcaccgttagtttcccggttgttccggatgtcccctgaactcttacgacctgctcattaggcaccgcaaggaatccaaatggataattgtcccgcagatcgtctttcgtcgtaaatggaagctttgtgatatcctcaatgcttttgatatcccccggttctacaccgagttctttcatcttttccgtgtaaaacgggaccgttccatataccctttttaccagttttcttaatttctctccctggagaattctccgttcctcttcgctcatgcactcagcatgtggatcgcggattctctccttccactttttctctgtgatcattcctgttctcctcctacaactcttcatcagagaccagcctgaccccttcttgcaaaagaatctttccggcccggtccatgtcatccgtcgaaaataccatcacaggggcactcccgtcacggatcacaaaagaatagatataattcagattaatctgtccgtctgccagaatagaaagcattctgttcagattgcctttttcatcttttaactccactccaaccacgtcagtaatgcggacgacaaatccaagatgggtcaaagtctctttggctttctgcggattgtccaccaccatccgaagaatcccaaactccggcgtgtcaaaggaagaaacggcccggatattgatctccgcctccacaagctttgatgtgacctccatcagacttcccggtctgttttctacaaatacggatatctgtttcatcttctccctcctactgtgccgccccggtctcaaatgcctttttattgatttcgattgtctttggcggtacagctttctcaatcacctgataccactgatctctggaaaaatccatgtgacgggacgccattcccaggacgatcatattaaacactcgtggatttcccagttttttagcctcctccgtagcattgatggtatagactttatgagtctgttccagcgtctcgatgatatgctccgggtattgtgccgctccgattaccaccggcattggatcaattctccagtcgtttaaaatcattacaccgtccggtttcagaaaatgagcgtacctaagcgcctccaaccgctcaaacgcaatgatcacatctgccaatccttcttccacaataggctccgccacctgatctccgtaacgtacaaaggtcacaacacttcctcctctttgtgccataccgtgtacttcggacagtttcacgtcatatcctgcatccatcgcaagacctccgagaatacgacttgtgaggagagttccctgtccgcccacgccgacaatcatgatattctttgtcttcattattgctcacctgcctttataagccggattgccccaaatttgcataaggattcgcaaagtccgcatccggtacacatcgtatcgtcaattcggatcgtattgtccgcatttcttgtcatggccggacagcctggtttcatacacataccacatttcttacatttgtttggatcagccagatacaccggcttcggagatttatccaaaagtacgcacggcgtccgtgtaataatgacagagacctcatctttcgccgtctcctcccgaatggctttttccagtgcttcaatatcaaacgcattaatgacctgcacatttgctaccccgatagctttgcacagtcccggaatatcgatagcatatgtcggtttcccctgcaaagtctttcctgtagccgcatgatcctgatgtccggtcattccggtcgtagaattatcaagaatcagcactgtgcccgttgcctggttgtagaccatattcatcagagaattgaccccggtatgcaagaaggtggaatccccgataacggccacccagtttttcatgtaatccctcccctttgccttttccattccatgtagactggaaatgctggctcccatacagatggtcgtatccacaacactaagaggtgcaactgctccgagggtataacatccgatatctcccgccgcgtgcatcttcaacttattgagtacataaaagacgcttctgtgcggacagcccgggcagagaatcggaggccgctgcggaacatccgccgcagagtctatcgcaatctcttctcccaaaatggctttcctgatcatgtttgcgctatattcaccctggatcgtaaagatttccttgccgatagccggaatcccccaggatttcacctgctcctcaatgaccgggtccagttcctccacgatatagagtgtctccacccgggaggcgaaatcccggatcgtctgctccggaagtggatgaaccatgccaagcttcagaacggatgcttctggcaacgcctcccgtacatactgatatggaattccgcttgtaatgacaccaatcttcaaatcccgcaattctacccggttaatagccagggtctccgccgccgctttcagctccctgttccgcttttcaatttccacatgccggtatttggcattccctggcatcattacattcttgcgtatatttttctcatacggcttatccggaatctctatccgttctttcaactccaccagtccttgggaatgtgccagtctggtggtaatacggaagatcaccgggcggtcgtactgctcgctcaactcaaatccgattttcacaaactccttcgcttcctcactgtccgacggctccagtaccggcactttggcagcccttacaatcattcttgtatcctgctcgttctgggagctataaagcccaggatcatccgccaccataaagagtaatcctccattcactcccatataggacaccgtatagagcggatcggatgccacattgagtcccacatgcttcatacacgccatagcacgtacgcccgaaatactggctccgatggccgtctctgccgccactttttcattaggcgcccactctgcgtaaagatcctccttatactggacgaggttttcactgatttctgtgcttggggttcccggatatgcagaagataccttaactcccgcctcataagcacctcttgcgatcgcttcattcccaagcataatgactttctttgtatctgacatcttataatccatcctttcgtaaatcccggattctttttgcctttccttcgaatctctgaagagaataaggcgctaccagccggatttcggttgcaagaccaagctgagatttcagtcccgccttgatctttttttccagctcacttaaccttccatagctgtcaagcagccggtcatcgatcagctctaccgtgatcgtcattacatccagacggttccttctctccacaaggatttcataatgcggtccgatctcctcgatctttaaaagcacttcctcgatctgtgttggaaaaacattgacgcctcggatcacaagcatatcgtccgcccttcctgaaaggttctccatccgtacggttgttctgccacatttgcacggctcataaaaaagtctcgtcatgtctccggtccggtatctcacaatcggaagcgcttccttaccaaggcaggtcaccacaagctctccccgcgctcccgcaggcaatacttcctctgttttcggatcaatgatctccggaatgaaccagtcttcattaacatgcattccacaaagttccctgcactcacctgccacacctggtccgcatagttcactcattccatagttctgggtgcagaaaaactgctcgccccacacatgacgcatttcatcccgcatcggctccgtcattccctcacctccgaaaagtccggtccgaagacacagatcctttgccggatccagtcccatcctgcgaacctcctcccctaagtgcagtgcataggacggagtggccaccagaagtgtcacgcccatatcctttaaaaacatgatctgctttttcgtatttccagatgacattggaattacggcagctccgatcttctccagtcctccgtgcagtcccagcgctccggtgaaggtcccgtatccaaaagagagctgtacgatatcttccccgcaggctccgcccatgcaggcgatccttgccacgttactcagccacatctccaaatcattttttgtatatccgacgacggtcggcttacccgtcgtgccggagcttgcgtggaaccgtatcaattcctttttgtccaccgcaaacagccccatcggatagtgttccctaaagtcctttttacttgtaaatgggagtctccgcagatcatccaatgtacgaatatcttccggtctgactcctgatttttccattttttttcgataaggagatacccgtgcatagatgtaagaaacggtctttttcagtttccgaagctgaagcgcctccagttcatctcttggcaacgtctcctcctttgcccatatcatcttttcttcctcctggtctgattaattccggaagcctttcctcttctgcttcatactttttgtatttgccaaggcctttggcaacccgctctttttctcgtcgcttttgtaaagcaaaaagaggatactcctctcaggcttatcctctttattatatcatagtcctttattcatttaaagcattaatctgcaaaatcgaataaggagagctgattggattccggcagatcagaaagaagtcctaagtccgccatcttgtcgatgaccgtcttacttgccttggtccgctgccggaaatcatccttggacagatattttccgtccctggatgcctgttccaccgcctccgccgccttatctcccataccgtcgatactggaaagaggcggcatgagttttccgtcaataatccgaaatttggttgccttcgcccgataaatatcaataggtgtgaattccagccctcttgcgtacatttcctgcacgatcttcatatctttcatcgtatcctgctcttttttacttaagtgatcctgacgactcttatactcccggtagtaataatttagcgtctctttgccctgacacatgatctcgtaggaaaaagcatccgcgcggatcccaaaataagccgcataataagccagcgggtagttcaccttacagtaagcgatcctgtaagccatcataacataagccgccgcatgggctttcgggaacatgtatttgatcttcttgcaggaccagatgtaccagtccggtaccccggcttccttcatggacttctcaaactccggagtcagtcccttcccttttcgcaccttctccataatagtaaaggaaagctcgctgtccatccctttattaatcagataggtcataatatcatcacgggtacagatggccgtagagatcgtcgctttcccctccagaataagagtctgggcattattcagccacacatcggttccgtgagacagtccggaaatccggatcaggtctgaaagcgtcttcggcttcgtatccaccaccatctgaataacaaaatccgtcccaaattccgggatgccaaggcagccaaccggacatccgtcaatatcctccggcgtaatgccaagagccgatgtattggcaaacagcgacatgacatccgggtcgtccaatggaatatctctggcgtcaaagacatgctcttttccatcgtattcattttccatcgcgtccgaattgatgagctcttcgagcgtcttaatcatggtcgggtcatcgtgtcccagaatatcgagctttaacaggttgtggtcgatggaatgatagtcaaagtgggttgtgataatgtccgtcgtcatatcgttggccggatgctgtaccggagtaaaggagttgatatcctcaccgtggggaagaacaatgattcctcccgggtgctgccccgtacttctgcggattccagtacatccctgcacgatccggtcaatttcgcaattccgctttctgcttccccgttcctcataataattcttcacaaatccaaaggccgtcttatctgccagggttccgatggtcccggcacggaaggtctgcccctttccaaaaataacctcagtatacttatgcgcgttactttgatagtctccggagaaattcaggtcgatatccggctctttgtttcccttaaatccaaggaatgtctcaaacggaatatcaaatccatccttaatcagaggatgtccgcagaccggacagtccttatctttcatgtcccatccacagcccccggcaaaagctctcacttcctccgaatcaaaatcactgtaatggcaatgcggacaatagtaatgcggacttaagggattgacctccgtgatcccagccatagtagcgacaaaggaagaaccgacggatccacgggatcctaccagatagccgtcctcattggatttccataccagcttctgggctataatatacatcacggcaaatccgttggagataatagagtgaagctctctctccaatcgctccgttaccacatccggaaggttctctccgtacatctcatgcgccttcttataacagatatcccgtagctgctggtcggaattgtcgatgaccgggggacacttatccggccgcaccggagaaatcttctcaatcatgtccgcaatcttattcggattttcaatcacgacttcatgagcctttgccgttcccagataagaaaactcctccatcatctcctccgtcgtatggaggtaaagcggtgcctgctcgtcggcatcagtaaatccttttcctgccataataattctccggtacacctcgtcttccggatcgagaaaatgcacatcacaggtcgccaccaccggcttttggaacttctcccccagccggacgatctttcggttcaaatcccgtaagtcttcctcgcttcttacattagacacccggtcgctcgcaatcataaagcggttattcccgattggctgaatctcaagataatcgtaaaaatccacaagcttcgcgatctgctcctcggactttccgtttaatactgcctgaaacagctctcccgcctcacaggcgcttccgatgataagcccgtcccggtaccgcaggaattcgctcttcggaatccttggcatcctggaaaaatactggagatgggacatggaaaccagacgatacagattcacacgtccggtctcgttttttgccagaatcaccgcatgatgagatgggagctttctgatggcatcgggattcatggagccaaactggttaagctcctttaatgtatcgatctcccgttctttcagcatctccacaaaacggacgaagatctctgccgtcgccccggcgtcatccaccgcccgatggtggttttccaaagagatattcagtgcctttgccactacatttaatttatatttagaaagggttggcaacaaaaccctggcaagcgctaccgtatccagggagatgaactcccgctcaatctcctggtatctgcagttctgctcaatgaaactgacatcaaatccggcattatgggctaccaggacagcatcccctataaagtccagaaacttcggcagcacaacatcgatcgtctccgcatccaccaccatatcatcggtgatactcgtaagctgtgtaatcttaaacggaatcggaatcttgggattgacaaaggtactgaaccgctccgtgataacgcctctctccaccttgaccgccccgatctcaatgatcttgtcctggatcgggctgaaccctgtcgtctccagatcaaagaccacataggtgccatcaagggactgactcccggcacccggagcgatctctgtcaaatcatccaccaggtatgcctccaccccgtagataatcttaaacggatcttctttatcaagagactggatgaaatgattggcgtccgggaacgcctgcactactccatgatctgtaatagcaatagccttatgcccccagtcgtgcgccctcttaacaatgtcattcacctctgacactccgtccatgtcgctcatcttcgtatggcagtgaagctccaccctcttttccggataaagatcctttctcgatacggtaaaatcatggatctttcggatccctgtcacggatccaatcgtcaattcaccatcaaatttgtcgatagtggtgattcccttgacctttaaaaaacttcctttcttgatatcgccaagaagatccggaagctgatcgtttctggcaaacatcttcactgtaatcgtatcggtaaaatcagtaacggcaaacatgaggatcgtcttttcattccggatctccctcgtatcgaagctgataacctttccgcggatcgtgatctcacccatctcgcccaccacctgggaaagctctatcggtgtatcgtcaaagtccctcccgtaaatcatattcggatcgtcggactttctgaaatcccgtctcataatcggctttttcatctcttttccaaaccgcttctctttcggcatcttcggaacaggcggagacttctcctttccagaatcatttccaccattctctgattccccggctttcttctgtttctcttttctgagcgcttcattccgctcaatgatctcatccacttctgcctgaagcaaaagatcgttaaattccagcgcgctcttctttttcggcggcagatagcctacctttaccgaaagcggcacatgaaatcgattgttaaacacttccagcagcaaattgacgatggaatcctttttcccttcggctacgatagaattctgaagctttaaattgagcacaccgtcctcaaactcgcagtccgcatgttcaaacatactacgctccactgcgcttctttgctccaactccagaagaatactttcgtaatattcattcatcagattctccggtgtatactgcccggaaagctgatagctctccagaatctctacctgaattgacgagcggtcaaaaagctgatgcttgatcgaatactccagctcataaatcttttttttctgtaataaatgagtagaaaacaaataaatccgaataaaatctctcgttgaatttgtagcaaccttggtaacccgcacatctttcagaagaaacctgacatcttccggaagatttaatgtcggaaatacctcaaaaaagtcttttcccatatactaagcactctcaatctttgttccagtgtaagagctcctcccgaagcgccggtaaaagctcgtcctcttttagcttctttataatctgcccttttttgatgagaagaccttccccgattcctcccgcaattccaatatctgcttcctttgcttctcccggtccgttgaccacgcaccccatgacggccactttcacatcgtcaaggggaatatcctgtaccatatcttccacctggttggcaagtccgatcagatcaatccgcgtccttccgcaggtcggacaggatactacctcgattcctccttttctaagtcccagcgtcctcaaaatgagctttgctgatttgatctcttccaacgggtctccggtcagggacacccgaatcgtattaccgatcccctgatacagaataatcccaagaccgatggaggattttacatttccagaaaggatcgttcccgcctctgtaattcctacatgaagcggatacgcacactgtggcgccaacagctcatgtgccttgacgcacataaggacgtcagatgccttgatgcttacaaccagattgttgtaacccagttcctcgatcatatgtaccttatcaagggcactctccacaagcccctctgcggtcacaccgctgtacttctccacaagatccttctccaaagaaccgctgttgactcccacacggattggcacctggtattcctttgccttgtccacaaccatcttcaccctatcccgaccgccgatgttgcccggattgatccgaatcttatccgctccgttttctatggcagcgatggcaagtcggtagtcaaagtgaatatccgccaccagcggaatgtgaatctgtttcttaatctcactaagcgcctttgcggcctccatcgtcggaaccgcacaccggatgatctcgcatcctgccttttccagagcgagaatctggttaaccgtagcccctacatcttccgtcttcgtatttgtcatggactggatggcaaccggatagctgcctccgatctttatatttccaatctgaattactttcgtctgtcttcgcagcatgatcttcctcctttacatgaataaaatcccctctacccaagtcacacgctatatccgtcttcctgtatagaggggaaatcatctatcttttatcaaatatcatctgttcaccgtactcccggtctgtcagtgtcagcgtctggcgctccatgctgtagtcgaacgacgtcacaaacctggaaagcgctgtctgaagcacactctctgtgagctttccatcgtgcttctttaaaatctcttcgatctcacttggctgaagcccctttatcaccagcgtcttctcggatttatccacctgacagtccatcgttacttcaagtcctgacacttcctggagattctgaaacaaaagcttgactttatcatcattttgaattgtcatagtaatattgtcatcttggtactcccaggtccccgcaatcggatttcttgcaaaagaccggatcaggaaatacgctgcaacaataatgatgagaatagtcgccgtccagatcacaatcctgaacaaaaagcttctctctttttcatcatttttggcaattaacatctggataacctccatctttcttcttccattattctaagtaaattataaaatttttatgcacctctgtcaacacgggattcttttcgtctgttttgtttcttttcggcacttttgtcataatttgtgttgcattacggcacagttcctgttttacccatgcatctattgctaaaatgtagccacactaaagataggaggctatatatggggttttcaaaaaggctaaaattacttcgaaaaaacgcagacgttactcaggatgagctggcacaatatctccaggtatcccgctccaccattgcaggatacgagacgaaaaaccgacagccagactatgataaactatatatgattgcacagttttttcatgtcagtaccgattatctcatttccggcagcgacatccgcccggtggaagtgtcaaccgtcgattcatctatgaatgagcggatgctgaaatatcatcttcggacaatctatgccacgttgtcgctcaaatccaagcaggatcttctggaatatgccagacttctcgccatgcgtgacgagcattagatggccttccctggatatctctcatcagcatgaaaggaggaatcacctgtttgattcctccttttttatgttacgacttcagaatctcctcaagagcctcatagagtgtctccatctcctcttcggtcccgatagtgatccgaagatactcccggatctttgactgattccaatgtctgacatagatctgtctctgtcgcagcgcttgaaacagcacttccccatcgtacttcggatgccgtgcgaaaaggaagtttgcgctggaatccggaaattcaaaaccaagggcagccatccttctctttgtccgctctctcgtggcaataatctgacttgtcgtcttctggaagtatgtctcatcctccactgcttttgtcccacaaagaatagcaagagcagacagggtgtaggaattaaacgaatactttacatccagaagccacctgatgagccgttcgtttccaatagcaaacccaatcctcacacctgccatggatctggattttgagaaagtctgcgtaacaagcagattttcatagcggtcaactaaggaaactgccgatggcttcccagcgaaatcgatgtatgcctcatccacgatcaccaccacacccggattctcttttagtatcttctcaatcacatcaagactctcatacagtcctgtaggtgcgttgggattcgcaaggatgatgccgccgttttctccgcaatagtcttctgctctgatgtgcatggttccatccagagacgggcatgtatacggaaccctgtaaagctcggcccataccttgtaaaaagagtaggtaatatccggaaacaaaaccggctttccggaattgaaaaatgttaaaaaactcatggccagcacatcgtccgacccaacgcccacaaacacctgctccggccgcacctgataacgtctggcaagacattctgtcaacattttgatctccggatcaggatacatccgaagcttctccgggtccatctgatgcagcatctccattgctccaggagccggtgggtatggattttcatttgtattaagtttaatgactttctgacgcggctgctcccccgggacatacggcatcacgtgtctgatatttgcttccagtcccataggcttactccatttcccggtactccgccgccaatttttcaaacttcgggagagaccggacgatggtgtcgtatgcaacgcagtaggcaagccttacaaatcccggacatccaaaagaactccccggcaccagtaaaagattgtactttttggctcttgtgcaaaattctttctcatcttccactggagatttgacgaagaggtagaaagcaccctccggcttaatacaggaaaatcctgcctttttcagtccttcatagagggtctcccggttccggtcataaaatgcaagatccgctttttcgtttaggcatctcgccactgctttttgctgaagggtcggggcattgacaaagcctaaaattctcgtcgccacattggcagccgagatcacttcctcactgtccgtcacttcatctgggataaccagatatccaattcgctctcccggcaaggacagcgacttactgaatgaatatccgataatcgtattgtcatagtattttgtcaaaaacggcactctggccccaccgtacacaagctccctgtatggttcgtctgagatcagatagatatccgttccatactctttctgcttcgcctccaaaatagcagccagccttttgatggtctcttccccgtaaacaacgccggtcggattgtttggattgttgacaatcaccgcctttgttttgggggatattttttcttcaaactccacaagttttggctgaaatgtctccgtatccggggaaatctccaccagcacaccgtcataattattaacatagcttcggtattctccaaaatacggtgcgaacacaatgacctcatccccaggatttataagtgtctttaatatcacgttcagtcctcccgccgctccgactgtcatagtaatattcttcccttcaaaagatgtgccataccgttcgtttaagtttcttgctaccgcctccctgacgtctgcataaccggcgttactgttcgtataaccatgaagctccaccggatcttcttctaaaaggacgtccttcattgcttttgtcagtgcctccggagccggaatattcggatttccgaggctgaaatcatagacattctccggcccgtaaatctgagccagacggtttccttcctcaaacatcgcacggattgccgagctgttcgctaccatctctttcatcttttctgcaatcattctgatacctccagtacttttgttacgattcctttttcaagcagcattgccggcttgtaggagagcttcgcctttctcagcccctcctccccggcatcgtcctctctgttgacatagcggtatcccttacactcatgctccacaaactgctggttgatcatggtgtatgccccgggcacttctgcaaatgccttttcgatatgcacgacaaaggtgtcctcgcttactggttcccctacagtaaacgcgacaatctcaccatggacacgcagaactcctccccttaaatggagttcacggaacagccgcagggaattgagtgttacgcacatctcacagtttttctcctcgtcatcttcacatccgttttcgtttctccacttgagcgccatctgaaaacattcctccagattatcctcttcaagtggttcataagcccagtcttcataggtagctttgaacttattgatatgattgcgctttccatggagctttttcccggaaagcgtgcaaagcttctccgactcgtaaatatagtcagccgcgtccctgtcgtactcaatctgatatcttcccggataccagctatccagaagcgcaaactgcgcttcggaaagtccgtacatcagaaactctccgccatgtttttcacagtacatttccatctgagggatcagctctctgatctcctcctcaggacccgccggccatgcaaatccatagccgcgctcgtcctcctcccggaataagagcgctttcccggtgtcggcaaatttcagattgtaatgtcttccccagagcaacaccccgaaaaatgtccggtcacagcttctttccgggtatttccggaagtactcctcaatgagcttctgatcttctattccgacacgcttaaaattccattcatccatcctgtctctaccttcttttcttttacccaaaatgcaaaagccctacatccgggtcataccggtatagggcatcctgcctgttagttttcctgcatattcgccagcttcgccgcctggtccgcagcgatcagcgaatcgatgatttcatccagatctccgtttaaaatcgtatccagcttgtgaagcgtaagcttaatcctgtggtctgtcacacggccctgcgggaaattgtaagtccggatcttctcggagcggtctccggttccgacctggcttcttctggcctcagtttccgcatcgtgctgcttttcctgctccagctcgtatagtctcgcacgcagtactttcagtgctttatccttattcttgagctgagacttctcatcctgacaggaaataacgattccggtcggaagatgagtcaaacgcacagcagagtccgttgtattgacacactgtcccccattgccggaagcacggaatacgtcgaacttacagtcattcatatcaatctgaacatctacctcttctgcttcaggcatgatggcaacggtaatggttgaagtatggatccgaccgccgctttctgtctccggcacacgctgtacccggtgtacaccactttcgtatttcagtctggagtacgctccctgtccggaaatcataaagaccacttccttgaagcctccgataccattctcgttgagggaaatcatctcacacttccatcttctccgctctgcgtaatgaatatacatccggtaaatctccgccgcaaataaagccgcctcatctcctccggctccggcacggatttcaacaatgacgttcttatcgtcgttcggatcctttggaagaagcagaatcttcatctcatgctccagctcctccaggcgttttctggcgtcggaaagttcctcctttaaaagctcccgcatttcctcatcgctttcatcttccagcatggacagactgtcgtcgatggtctcattgcatgtcttgtattctttatatgcctccacaatcggaaccaagtcgttctgttctttcatcagactgcgaaaccgtgcctgatcgttgacaacatccggttcctgaagctctcccatgatttcttcaaaacgaatcagcaaatcttccagtttgtcaaacatttgttaattcctcctcattttctcttgctttattgtacacgccgcctactacacggtcaagccctgccagatccttttttacccggatctgctcaaaacctgcctccttaaaaagccctgatacctcttctgcctgatcgtacccgatctcaaagagaaggcttcctccctttcgtaaatacagtccggcctcagagatcatacgacggtaaaaatacagcccgtcctcttttccatccagtgcctcgtatggatcatagagcctcacttcttcctgaagcttttcgatctcctctgtccggatataaggcggattggaaacaatcagatcatagtctccctcaatcttttcaaacagatcacttttaaaaaatgtacatcgttctttcgagataccaagcttctcccgattcatctcggcgactttcagagcgtcccctgagagatccgatccgactccccttcttctttcatccatctttagcagacttaaaaggacgcagcctgatccggtacagacgtccagaatccgctctgccttactctgtctcgccacacggtctgcctcctccacaaggatttccgtatcctgccttggaatcaataccgtctcatccacggcaaaaggatatcccatgaattcctggactcctgtaatgtgctgaagtggaatcctctcccctcttcttttgatgtactcttcatatgctttccgtttggcggaatccatctcttcctgatcccttacataatactgggtttttgtcatccctgtgacatactcaagcagaaaccaggcatccagatctgcttccggaataccggcatgtctaagtatttcttttccccagttccagacttcccgatatgtcataccttctccttttcttcctgatctgccggcccggacgggaaattctccatgagataagcccgccagtcaaaaaccgcctccacagaggcgatggccacttcaatcatggagtcgtccggctctttcgtcgtcagtctctgaagcatcagccccggcttactgaggaaattcaccactggatggtcgctgctgcctgccacacggatgatctcataggagatccctgcaatgatcggtaggagcgcgatccggatcaccacacgcagaatgtgggactcggtctttacaaagaacaacaacacaatgcccacgatcataacaaacatcaggaagctggttccgcaccgcttgtgctccttcgaactcacccggacattctctaccgtaagcggcagcccgtgctcaatgcagttgatacatttatgctctgctccgtgatactgatagagccgtctgatatcctccatcctggagatcagccagatatacgccacaaaaatcgctatccggatgactccttccagaataattcgtaccagatacgatggaatcaccttacgaaacaaattggaaatcccgtatggaagaaccataaaaatcgcaatggcaagtacaaaggacactaccatcacaatcccattcatgattctatccgccctctccttttttcctgcttcctgctctgtcagaatgtcttcctcctcttcaaacccggcagaccaggtgagcgtcctcattccaagaaccatagaatcaataaattgaaaaatcccccggacaaacggaatctttagcagactatggtaattcccgactatacttcgatagtcctcccggtcgatctcaatctccccgtcaggctttcgcaccgccacggcatagcggtctttgtgcttcatcatcacaccctccaaaaccgcctgtcctcctatatttgatgacttcataagtaatacctctttctatctggcttcaggcttttaccggaatgaaaaagagctgagatgtaaaaacctcagccctgtacttctgaatcttatttgctttcgattccgtatttcttgttaaacttatcaacacggccacgagcctgagttgctttctgctgtcctgtgtagaatggatggcatttggagcagatttcaacgtggatatcttcctttgtggaacctgttacaaatgtattcccacagttgcatgttacagtagcctgatgatatactggatggattccttctttcatgttttcacctcttcttgcttttattgtctcacacagaattctctgtgactaattgtctcttaaacagcggattcattgtatcacacctgtattgcttttgcaagcattttttaaataaacttcatttttttcactttctgaaccagttcagagttttgcttcgtctgctgaaacagattaagaatcgtatccacagcctcgtcagatttcatgccgtttaaaccacgccgcatgatatagactgcatcctgctcatcctgggtaagaagaagatcttcccgtcttgtcccggatttcggaatatcgatggccgggaacattctcttttcggagagcctgcgatccagaacaagctccatattgccggttcctttgaattcctcatagatgacatcatccatcttgcttccggtatccacaagggctgtcgcaagaattgtcagacttccgccctctctcatatttctggctgctccgaaaaaacgtttcggcatatgcagtgcggccggatccagacctccggagagggtacgtccgctcggcggcacgaccaagttgtatgctcttgccagtctcgtgatactgtccagaaggatgataacgtcctttttgtgctccacaagacgcttcgcgcgctcgataagcatctcggacacccgcttatgatgctccggcagctcgtcaaaagtagagtagatgacttccacattcttaccgcggatcgtctccttgatatccgttacctcttccgggcgttcgtcaatcaaaagcacaagaagatgcatttccggattatttcgcaaaacagagcgcgctacttcctttaataaggtcgtctttccggctttcggcggggaaacgatcattcctctttgtcctttcccgatgggagaaagaagatccacaatccgcatcgatgtactgctgcgctcattttccagtttcagtctttcatttggaaaaatcggcgtcatatcttcaaagttacgtctttttaccgcaatcgccggcggcagtccgttgatctttgttacaaataacagagcgctgaatttctcagactgagtcttgattctggtgtttccggaaacaatgtctcctgtctttaatccgaatttacgaatctgggatggagacacataaacatcattctcccccggaagataattttcacagcggataaatccatagccgtctggaaggacttccagaatcccgtgggcggtgataccgctgtccaagtctgcaagctccagtacagcgcttttctccgttcttccctcatcccgttgcgtatgctcgtgctcacgccgtacttctcttacagattccgttttttcggtctctgtctcttccgtgttttgcgtttttctatcctcttcaaggagccggtcaatcagctctgactttttcagtgttgatgttcctttaagtcccctcgcctttgctacgtctttgagtactgccagtgaaagtgtttcatatttttctttcatatccatcatattctgttttcctttctattccggtctgtggggaaaatagtctgactagacctatgtgacttaatgcatcaagtatacatcacatttttaaaattgaaaagtcttttttcaaaatttaattgcacccccgttttatcaatggtatgatggaagagatgaacaaaaatgacagtacattaaaatagagaagaaaaggggatcgaaatggctgaaaatcatacattggaaaaagcattgaacatgcatgaaatctggaatggtaagatcgagacaacggcaaaggcgcatgtccgctcacgggaggatcttgcggtagcatacaccccgggcgtcgcggagccctgtaaggtcatcgccaaagacccggaggccgcatacaaatatacaatgaaagcaaataccgtggcggttgtctcagacggaagcgcagttcttggacttggcaacatcggtgccctggccgccatgccggtaatggagggaaaggctgtcctcttcaaggaattcggaggggttaacgctgtaccgatctgtcttgacactcaggatacggaggagatcatccgtacggttgtcaatcttgctcctgcttttggcgggatcaacctggaggatatttccgcgccaagatgttttgaggtcgaggagcgtttaaaggagcttcttgacattccggtcttccacgacgaccagcacgggactgctatcgtcgtcctggccggagttatcaatgcactgaaagtcgtaggaaaaacaaaggagaattgccgtgtagtcgtaaacggtgccggctcggccggagttgccatcacaaaacttcttctgacttacggattttcctacattacgatgtgtgatatcaacggtacgatctgccgggattcaaaacatctcaactggatgcagcagaaaatggccgaggtgacaaacccggatcagctccacggcacgctcgctgacgcactaaaaggtgcggatattttcatcggggtatcagctccgaacatcgttaccaaagagatggtggcgtctatgaacagcgacgcgatcctcttcgccatggcaaacccggtaccggagatcatgccggatctggcaaaagaagcaggcgccagagtggtcgggacaggccggagtgacttcccaaaccaggtcaacaatgttatcgctttcccaggtattttccgaggtgctttggaaggacgcgcttctcagatcaccgaggagatgaagctggcagccgccaatgccatcgcgtcacttataggcgagaaccaattaagcgacaccaatatcctgccggaagcttttgacccacgtgtagctgatgctgtaagcgccgccatcaaggccctgatccgttaggatggagagaagaatgtgctggggcgagaaacgctactattctctcgattactatctgaaagagacatttcacgagaagctttataaactctccttaaatgcaggctgtacctgtcccaaccgggacggtacctgcggaagcagaggctgtatcttctgcagccggggcggaagcggcgactttgccgcaagccctttcctttccattgcggaacagcttcgatcagaaaaagcgcggatcgcttccaaataccgaggccacgcctacattgcctattttcaggcttataccaatacatacggttccgtgaacgttctggaacgtacctttttccaggctattgaagatccggaggtgaaggtgctttccatcgccacccggccggactgtctcccacctgagattcttaatcttcttggaagactgaaccggatcaagccagtctggattgagcttggattacagacgattcatgcgtccactgccgcctacattcgacggggctatccgctttctgtatttgaggaggcagtgcgaactcttcgtgccatcggaatttccgtgatcgtccatacgatcttatatctgcctggtgaatcgaaagcccagatgctggagacaatagaatatctgaaccttcaggagatccagggcatcaagctgcagcttctccacgttcttagggataccgatctatataacgattatcaaagatatcctttcccgctcccgtccatggaagaatatctggattttctcgggacatgcctgtgtgcgctgcggcccgacattgtcgtccaccgtctgaccggtgacggccccaagccccttcttatggctccgctctggaccagtaacaagcggctggtgctcaatcaaatgggaaaggtgttcaaagaaaaggatatctggcagggaaaaacctgtcgtactctttagaaaggaagtgtacaccatgtcagaaacatttactctgtataagctgatcatcctgtacatgctcagtaaagtggattttcctcttaccaacgcacagatttccgattttattctcggaaagggatatacgacctacttcactctccagaaggcgctctccgagcttacggagtccggcctgatccgtgaggaaacaacgcacaaccgaacactgtatcatctgacggaggaaggcgacgaatccatctgtttctttgaaaacaagatctccgacgccatcaaaaaggacatcagcgactttttcatcgagaagaaattttccctcaaaaatgaggtttctgtcaaatctgactattatcggaatacaaacggggagttttccgttcactgccaggtaatcgaacacgctatgccgctcatcgatctgaccgtcaccgttccgtcacgtgaggaggccgagaccatggctgccaactggaatgcacgaaaccaggagatttatgcttatattatgacgcatctgctgtaataactgccctaaatacaaaagatgtaaactgggattggaagaagtctccattttaaaaaggagcggctccgacagcgactgacaagctgtggtaccgcccctttttatgttcttttctatgttcgaatatattgaagccactctttgatttctttttctttccccaaatctcccggatgataaaagacagatcccttgatctcgtccggcagatactgctgttttacatagtggttcggataatcatgggcataccggtacccaacgccatgacccagattctcgtgtcctccataatgggcatcctggagatgtgcaggtacagacgtcctttttgtctggacgctctccattgctttggagatcgccattaccgccgcattgctcttcggtgcggacgccacgtagagcactgcctgggagagaataatctgggcctccggcatcccgatccgctccacagcctgggccgcggataccgccaccgtaagtgccatgggatcggcatttcctacatcctcggaggcacagatcataattctgcgggcaataaagcggatatcctcccctgcgtagagcatctttgccagataatagaccgccgcatccggatcagatccccgcatacttttgatgaatgcggaaattgtgtcgtaatgattgtctccatccttatcatagcttacaacccgcttctgaatacattcggagacgacctcaagcgtcaggtgaatcatcccgtctacactcctcttcgtcgtcaatacggcaagttccaccgcattcagagcaagtcttgcgtctcctcccgccatatcagccagaaactgaagggcatccgcttcgatctcggcgtgatagcttcccattccttttttctcatcgtataccgcccgccggatcaacacttcgatttcctccagagaaagtggctttaattcaaagaccgtagatctggaaatcaacgcccggtttacctcaaaatacggattctccgtcgtagctccgatcagaatcaccgtcccatcctccacaaatgggagcaggtaatcctgctgccctttatgaaatctgtgaatctcatcaatgaacaatatcgtcttctgctggtacatcccccgtgtccgcttggcttcctcaacgaccgcttccatatccttcttcccagccaccgtggcattgatctggcagaattttgcgctggtggcatttgcgatcaccttggcgagggtcgtctttcccgttcccgggggaccataaaaaatgacagaggttaatttatccgccttaatcgcccggtaaagcagcttgtccttcccgataatgtgctgctgtcctacgacttcttccagggtctccggtctcagccttgaagccagaggcgactctgtttccttttgcttctctctcgcgtattcaaataaatccatctcttcgtttcctccttatgcacatccactgagatttcgaatcacttctcctgcgatcatcagtcctgctaccggcggcacaaaagagacactcccagggacagaccgcctttcgcccttatcttcctcgctggccgcctcagaaatatcgatgggtttttctttggaataaagaacagtaagaccttcgattcctcgttttttcagctcttttctcatcacacggcagagtgggcagacggatgtattgcggatatcatcaatctcaaagagctccggatggagcttgtttcctgtccccatgctactgatgagagagatcccgtgctccttcgcataacgggccaccgccagcttggctgtcaccgtgtcgatagcgtccacgatataatccggacggatggcaaacacctgcttcagattgtcttctagcacaaactcctcgtacgttgtcaccgaaatttccggtgaaatatcagcaatcttcgcctccataacctttgtcttatattgcccgatggtgctgtgaagggcaatcgactggcggttgatatttgtcagcgacaccgtatcgtgatccacaagcacaaggtgtcctaccccgcttcttgccagcgcctcgatacaatgagatcctaccccgcccacaccaagcacggtaacagtcgcctctttcagcctgtccagtccttcttttcccaataataattctgtccttgaaaactcatacagcatgtttcttcccgttccttcatctatcataaattctatgattcgtccacaattaatccataatcagttcatcgactgtgacgaactgatatccctccttctgtagggcatcaatgatctgaagccctgcttctactgaggtgccgtaacagtcatgtaataagataataccattttcttctgccctcgtcactacctttctgacgatttccccggtacttttcgtacaccagtccagcggatcaatatcccatttgaccggaatcaactccacatcctttagtgtttcttccctcagttccccataaggtggacggatataggtgactttctctcctgtgatcccttcgatcacttcgtttgtctttttgatctcctctttttcagtctccatatccacccttgtcagctccacatggtgatatgtgtggttcccgatgagatgtccctccttatacatccgtaaaatcagctctggatgttcctctgcttcctttccgatcacaaaaaagctcgcctttaccccccgttccttaagtccgtccagaagctgcggggtataggtgccatccgggccgtcgtcaaaggtaatggcgatccttttctcctctttctttgccacatcgctgatactctccatcgtcttcttcgtgttctgccacataccagtcagacagaccgccgcaatcaaaaggatctccccgatcaatttccaccatcttgttttctgtttcactcgatacgccactctccttttctctcctgtaaatgtattccgaagaaaagacagatagaacccggagtactggcgcccttgcctgcactccgggttccggatggatctttattatttctttttcttctttctgacgctgtagccaaatgtgccgatcttctttcccagtcccagatattctccatgggaataggccagaagtcctgttttgttcagctcaaactttccattttcattcatgtacctgctgcttacctgcacacccgtcacatccgctaaaaacatatcatgtgttcccagacgcagaatcttgcgcactttgcactcgatgttgaccgggcactccgcaatggcaggagcatactgaagagagacggccgcttttctcgtcagacgtgtctcctcccacttatccacatctcttccggatcggaccccgcagaaatctgtagctcttgcaagcttctccgtcgtcaggttgacgacaaattctcctgtttcctcgatcatatggtgggaaaaccgtcccggacggaccgaaatgtaaagcatgggcggatccgagcagaccgtcccggtccacgcaaccgtaagaatattgtcctttcctgatttatccgcacagcttaccatgacagccggaagcggataaagcatattccccggtttaaaaatctctttctcactcatttctctctcctctactgctgcatctcgctgaccagcgttgggataagctgcttctttctggatactacaccgtttaaaatgatatcctctgtatcctcggaaagctcaaaggcatccatcacagtctctctagcattcccaccgctgcatagcagttctgtggactgttctacaatatttgtcaacataaaaaataccatatcaagtccgctttccttgagcacttctaccagctttggacagatcttttctttgatctcctccagttcctctttgtccatagaattgatctgacctacaccgaatgtcagctcattgacgtggaattccttaaaatcctgaaagcagatttctgcaacagatttattagcaagattgctgcccgctttaaacatctctttcgcaaactccacaacgtcgatctgcgcgatctttgccagcgtccgtgcagttgcttcgtctatcggcgtacaggtcggcgactggaataaaagcgtatccgaaaggatggcagcgcacagaagtcccgcaatctctttgggcggcttgatctgattttcctggtacatctgataaataatcgtcgctgtacagccaagcggctggttccggaaataaaccggccccatcgtctccaaattgccaattctgtgatgatcgatgatttccaggatctccgcctcctcaataccgtccaccgcctgggttttttcattgtgatccactaaaacgacctgcttgcgctttggctttaacaatctccgtctggagatgaatccggtaaatcttcctttcttgtcaataacaggaaaatcccggtagcgctttttcgtcatcacttccttgacctcttccagatagtcatttacgtggaatgtggtcaggtgatcccgcgtcataaaatgctttaccggaatactctggttaatcaggcgggccgtcgtaaaggtgtcaaacggagtactgatgataacaatatcccgctcagacgccagctttttgatcgtccttgacacctccgctccttggcagatcaccagacagcttgcgtccatctcaatggcgcagagttgggactcatagcggtttcccacaatcaccaaatcatccggttcaataaaattctccatcatatccggggaggacgcggcaatcacgactttccccttaatgaagtaagcgtgctcatttcccgtaatgatctccccgcttaaagtatccttgatactccggtactgtgttctggcttcggacaacagatgactgtcgtggagctccatgtaggaattagcgatatcgccaatcgtgataatcccttccagcttttgatcttttaacaccggaagggtacggatactattctctttcatcatagcccaggcttcctttacagacgcctgactggatactccgtcaattttgcggatgtccacatctttaagctgctggaaaacattctgtaaaagcgccggttcctggacatgaaactgattcagcacaaagagcgtctcctcggagacggttcccgcccgctttgccacataattctttcctgtgacccgccttttcagctccgcataagcgatagcagaacagatcgaatcagtgtccggatttttatgtcctaccacatatacctttctgtctttctgattatctgacatatgatttttatttcctcccacaaaaatctgccgtatcggcagatcatttccttgatataaacttagattatcatttttttgatgccccgccaactgtttttttctgatttcgccaaaataatcctccgctgtgccgcaaactatgatatactggctaaagaaaacacgaaaaaggggtgtatcaccaatgaatgaagaattagaaacaacgacaccggaaatggagacccggacagagtgcatgaaagattatgaagatcaatttgatatggcttatccatggcatattgtacagagatatctggacgaaaagacgaacctcaccctgaaggtggaaggtgttgtcaacggtggagtcatcgtcaaggtagagggccttcgcggattcattccagcctcccgcctgtctctttcatatattgaagacctcgaatcttacctcctcaaggagatcactgtccgcgtcatcgaggtggatccggaagaacaccggcttgtgctttccgcacgggaaatcttaaaggaaaaagaggcaaaagagcgctccgcacgcatcgccagtatccaggttggaactgtgatggacggtgtagtagagtctatccagtcctacggtgctttcgtccgttttgaggatggactctccggtctggttcatgtttcccagatctgtgaaaagcgtatcaagactccggctgacgtcttaaagatcggtgatccggtcaaagtaaaggtcattggaatcaaagatggaaagttgagtctgagcatcaaggcactccatgaagaaaaggacgaggaagacgaaaatctccacgtagagattccgaaatctgaagagatcgggacaaatcttggcgatctgttcaaaaatattcggttataggaaaagaaaaggcggacgccccgggatcttccggatgctgcatccgccttttctttttactgtgctctcctcgcttacgttctaccgctcttctttttctatgcgctccagatcggagatccaaaccgccgcacaggcgtcgcttggcatcctccagtctcctctcggcgagagggcgacggttcctactttcggtccgtccggcagacaggaacgcttaaactgctgggagaaaaatctccagtaaaacttcttcagccacttcagaattgtttcatcgtcataacttccagcaaacgctttcttcgcgatccggtagatcttggatggctcgtacccgaaacgtagcacatagtaaagataaaaatcatgcagttcgtaaggtcccaccagatcctccgtcttctgggcaatctctccctcttttggcggaagcagctccggacttaccggagtgtccagcacatcgagaagtacttcccgaagctcccggtccctgcacgtatccgcataatattgaacaagatgacgcaccagtgtcttcggtacagaagcatttactccatacatggacatatggtcaccgttgtaggttgcccatccaagggcaagctccgacatatccccggttccgatgacgagacctccagatttattggcaagatccatcagcacctgagtacgctccctggcctgtccgttttcgtaggtcacactatgatcctcaaggtcctggccgatatcccggaaatgcactgtcaccgcctcccggatcggaacctccatcaaagtagctccaagcttttcggacatccggcaggcattctggtaggtgcggtcagtcgtcccaaagcacggcatcgtcaccgcatggatattggctcttggaattcctgccatatcgaaggctttcgctgtcactaaaagtgcaagcgtggagtccaacccgccggaaattcctacgatcgcactggtagtctttgtatgaagaagccgctttttcagtcccatggcctgaatcatcaaaatctcctcacatctgtctgctctctcacgctcattttgaggaacaaaaggcgccggcgaaaattctctcgtcaaaacagtcttctcctcctttgcggagaagaacacagccggcagcgtcttgtgcagcgccgagcggaaagtcgtattcttccgacgctccgacaacagccttcgaatatcaatctcactgtagatcgtctcgttgacaaaccgtccggacgattttaaaatcgtcccattttccgcaatcagattgtgtccgccaaaaacgacatccgtggtagactccccttctcccgcattggcatagacgtaacccgcgatcaatcttgccgactgcccggaaatcagtccttcccggtaacggtcctttccgatcgtctcgtcacttgcagaacagtttacaagaatgagcgctccttccagcgccgcccggatacttggcggaaccggtgaccagacgtcctcacagatctctgccgacacaaccagatctttggtctcccgggaaacaaacagaatttgggggccaaacggtactctcttcccgtcaaaagcgatctctcttgtcacatccggtcccggcgtaaactgacgcatctcatagaactctccataatttggcaggaacgtcttggtcgtaaacccaaggatcatgcctttattcagtgccgccgccgtattatacagctctccatccaccgcaatgggacatcctacaaaaacaagcgcctccagatctctcgtcgcttcagtgatcttcaaaagaccgccctttgccgtttccaggagagcatcctgggtaaacaaatccccacaggtgtatccggtcacacacagctctggaaagacgatgatcctggcgccgtttcccgcggcctcccgcattcttttgataatttcttccgtattaaacgctacgtctgccacacggatatcaggcgtagctgccgccactttgataaagccctgtttcatgccctattcctcttttccatttgatttttcagtctgactgatgctcctagtttttctttgcatggtgtaaaagcttttccagctcttccacggtaaaggtatatgccgtattacagaaatgacatttgacctcaatgtccttcccttccgcaatcatctctttgatgtccctctccccgatacttacgatcgctttctcgatcttctcttttgaacagtcgcatgcaaatgctgtcggaagcgtatccgtgatctcaatatccataccttttaatacttcctgaaggagagactccggtgtatgaccctgctctaaaagcgcggtcacagaatgaatcttactgatattttcctctagccggacgagtacctgctcctccacaaacggcatgacctgtacgatgaacccacctgcacagcgtactgtattatccttttccatcaaaacacccagtcccacagaagacggtacctgctcggaattggcgaaatagtatgtcaggtcatccccgatctctccggtctggagaatcgtctgacctatatacggctctttcagtcccatatctttgatgacatttaagataccaagacccaatgctccgcctacatccagcttgccgttctttggtgggagcatcacgtccgggttttctgcgtagcccttgacgttcgctttgctgtccgctgtcacggtaagtccctggatcggcccgtcgcacttgatctggatcgtcagtacgtccgtatcgtttttcatcatacttcccatcataccgcccgcagtcagaagacgtcccagtgccgctgttgccaccgggctcgtattatggtatcttcttgccgtttccaccaattctgtggtggacgcggcaaaagcacggatctgactgcctgccgctgttgctcttacaatataatctttcatcgcttttcctcgtttctttttatttcctgtattgtattctgtccggcatttttatctggacacttcgcagcacttccggcactctcttgctactacgcagacgcgggcgctatcttcccccggttcttctctcgtgaaatcatcatataaggcgaccagttcaagacccgcctccctcagtgcatctgccacctctgaaacagtgtaccccctttgaaagtgtgtctcctcaaacttccggtacagctctccctcccgcacaaaaatcgtcagatcgtattcattgatccgctcttggagatcatagtagttttcccagataaagctgcactcctcgcgattctccgcaatggtcgtatccccgagaagttctctgtacttatactccgtattgaagtcaaacaggaagagtcctcccggatccagataattattcaccagggaaaagactttcacaagatcccccggttttgtcaggtaattcacggaatcgcaggcactgataaccgcccggaccgtgccgtaaagctcgaacttacgcatatcctgaagaagatataggatgtcctgtccggacgcggcgcgcttttccatcgccagatccagcatctcctcggaattgtccaccccgatcatatcatagccctgctccgcaagcaattctgtcatactcccggttccgcatccaagatcgagaacgatcccgtccatgatcccatgctcccgcagaatctccttataatagtccgtccactcttcgtatggaacgttgtccataaaggtgtcatacacctgtgcaaatcctgtatatgcctccatccaatcatctcctgccgactataaatccggcttattatagcacgattttgccagttttaaaaggggcaaaatcctccggactttttgttatccggaggatctgtctgatttccttattcgattacatgaatccagccttttggtgcttcgatgcgtcccatctggattccggtcagtgtatcgtaaagctgctttagtaccggccccatctcatccataccgcttgcaaagcagatctccttgccgtgatccacgatctttcctaccggggaaacgacagcagccgtaccgcaaagaccacattccgaaaattccggtacttcctcaagcggcacttccctctcttctgtctccaatccgagatattcttttgccacatagagcagggagcgccttgtgatagacggaagaatcgaggaggactttggcgttacgatctttttatcctttgtcacaaagacaaagttggctccacctgtctcttctaccttcgtcctggtagctgcgtccagatacatattttccgcatagccttcttcgtgtgccgttacaatagcatgaagactcatagcgtaattgagacccgccttgatgtgtccagtgccattcggcgccgctctgtcaaagtcagataccttgatcgtgatcggctttgccccgcctttaaaatatggtccgaccggagtggtcaaaatacgaaactgatactcttttgccggactgacgccgatcaccggactggacccgagcatgtacggccggacataaagggtagcaccagaaccaaacggaggcacccacgctgcatttgctttgacagtctgtgtgacggcatcgaggaaacgatctttcggaaacgccggcatctccagcctctttgcggaatccatcatacgctcggcatttaagtccggacgaaacgtgacgattcttccatcctctgtcgtgtaggctttcagcccctcaaacacggtctgtgcgtactggaacacacccgcacattcattcagcaccacattggcgtctgatgtcagacttccatcgtcccattttccgtctttatagttggaaacatatctcttatccgtctgaatatattcaaaccccagatttgaccagtctaaatttttcttttccatttcgatccactcccatcttattatcttatttttctagtataaaactgtttgaaagaaaattcaagagtgcgctctgtttttatgtagcgattcagccgtgcaatctgaagcaatctggtctgtagcaagcttgcaaatctgagccgtatggccaaatcgttacctttatcgctcagccatactgatggcttcgattccaacgcttccgccacgcacaacttccacatcccgaaattcctcccgtaaaagcttcaccacagcatcgttttttgtggctatctggagaaactccagaagcatactgtccttaccgtagtcaatcacttctgcccggaaagtctgtgcaatctgaaagagctctgtcttatcctccaatgtacatttacggatcttgacatagagtatctctttcatgcagacggatagatccgtaaaatcaatgaccttaatgacttccaccatgcgatttaactgctttttgatctgttcaaatgtctcctcgtcacagtgagtctctattgtcatcctggagattgtcggatcttctgtccgtcctactgtaaggctctccagattataacactttgccgaaaacagcccggaaatcttagaaagcacaccaatctggttttccacataaagagagatccatctttttttcaacattccattcatctgtccatcctccttatcttagcagtccatcagcatttcctgtaatgttccgtttggctttaccatcgggtatacgacttcttccggatcaatgagaaattcgatcaaggtcggcacctttgtctcggctgctgctgcccgaagcgccgtttccacgtcttcctttttctttacacggatgccctttgctccgtagctctcggcaagctttacaaaatccggcgtatatttcggaagctcctcatcacctctccgaagtgcggcccctgcaagaaggttcgtcatggcgtatcgtttcccgtagaagagcttctgccactgacgcaccatcccaaggtaagtattgttaagaacgcagactatgatcggaagctcctctaacactgctgtcgcaaattcctgaatgttcatctgcatcccgccgtccccggcaatgacaataaccggtttatccggattgccgatcttggctccgataccgcccggaaatccgtatcccatcgttccaagtcctccggacatgaacagacgtttcttttccgtaatctcagaatactgagccgcaaacatttgatgctgtcccacatcggttacgaggataccctcctcgaacacacagttaattccctctataatatcttgaggcaacaaattgttgccttttcttttcatttgcagcgggtgttctttgctccacccgatgatcgcctgcatccattctattgtatccttctcctcggcatactccagcatcttctcaatcgcctctttggcatccgctacgattggtacatccacgtggatatttttagagatagaagctgtatcaatatcaatatggacaatctttgcgtttggagcaaaggcgtgcagctttcctgtaatccggtcattgaacctcgttccgatggagaagaggacatcgcactcttctaccgccatattggccgcgtaggcaccgtgcattccgagatttgccacatagtaaggatgatttgtcggaatggctcctcttcccataaccgtcgtcacaaccgggatcttcgtcttttccactaattttgtaaacgcttcgttggctcctgcgatattgacgccgcctcctgccagaaacagtggctttttcgcatggtttaaaagcttgaccgctctcttaagctgtccgatatgaacgtttgtatttggcttatagcctcggatattgacttctttcggatattccggagatccaagctctcccatcacatcttttggcagatctacaagcactggtcctggcttcccgctgcgtgcaatgtaaaatgcctccttgatgatcctgcccagttcttccctgcggtgtaccgtcaccccatactttgtaatactccttgtgattcctacgatatccacctcctgaaacgcatcgtttccaatcagatgacgcgccacctgcccggtaaagcatacaagaggtacgctgtcataattggccgtggcaagccctgtcaccaggttcgttgctcccggtccgcttgtcaccagacagacgccgacttttccagtggatcttgcataggcatcggcctcgtgtacaagtgcctgctcatgtcttggtaaaataaccttaatgtctccctgtttgtaaagctcgtcgctgatatctattgtacatgcaccgggatagccaaagagcgtatccaccccttcctcttttaaagcctttaccagaagcttatttccactgatctttctcatgccgtttcctccttctacatttctttccccaactccgccatgcttccgagtcagacagcgactctgccttacgtatccgtctgcaatataaaaaatcctgtttggcaggattctccgcctgcggcgggccgcttcagcggcagcttctactccgccgcagtgcgatccgtgcggagcgttttttatttcataggaacgcagttccctatgaaataaaaaagacgccccaagcatatgcttagggcgaataaatccgtgataccacctaacttcagaatctctctgcactcaaccagtacttccatactgtctccgataacgccggaaccacgtcggagcctactcacatcttacttcctctatggaataaaaccctttcagtccgctgctcgtgggccagttcccacccgccttcacggaaacttccaccatccgtctcctctctttgcatccggtcgcgaggtactcctcccagtcactacatttctctgtctcgttaaagtaattactgccattatacgaggtggcaggatcagttgtcaagctttttctcggcctgttttcttctatatctcgtaaaaacatattccaagtcaaaatatgtctgctcctcgctctcatcttccagctcccattctggatccgcatccagatccgggaaataggtatccgccgcatagctgtgacggatccttgtgatatacgcctccttgcagtatggaagcagcatccggtaaatgctctcccctccgatgacatagatggattcctccggaaaagactttaattgctccagaagctcttctaaactgtgaacgacaacggcgtctttcacctgatagctttcatcccttgacaagacaatattcgttctctttttcaaaggctgtccccccggaaaactctccattgtctttcttcccatgacaacaacattgccctttgtcatctcccggaaaaacttcatatcagcaggaatactcaccagaagcttatttcggtttccaatcgcccaattttcatctaccgcaacaatcagattcatctttgtctcctccatttcctaaaccgcaatcggaatatccttgatctgcggacctgtcacgtaatcgtccaggcgtacatcgtccggtgtaaaatcatagaaatctttcacatccggattcagccagaacttcggtgccggatgttgttctctttgaatcaactcctgcacaagcgggatatggcggtcgtaaatatgagcgtccgcaatcacatggacaaacgcccccacctgcatatcgcacacctgtgccaacatatgcatcagcactgagtattggcagacattccagttgttagccgccagcacatcctgggaacgctggtttaaaataccgtttaagacaagtttatcgctttccggctgttttgtcacattaaatgtcatgctgtacgcgcacggatacagattcatctcatgcagatcctggtgtacatagatattggtcagaatccgtctgctgtacggattgtgctttagatcgtagatgacccggtccacctgatccatcatgccctccttgtactggtgctttacctgcatctggtatccgtaagcctttccgatagatccgtccggatccgcccaactgtcccaaatatggggctttaagtcgtgaatattattggacttgcgctgccagatccagagcatctcatcggtacagctcttgatcccggttctcctaagggtcagcgccggaaattctttggagagatcgtatcggtttaccaccgcgaactgtttgattgtgtaggccggggcgccatcctcccatttcgggcgtaccttctctccctccgtactcgtaccgttatcgataatgtttttgcacatacggacaaatatctgatctgcataactcatcttgtttcctccattctgagatgtttattgcgatttcatcaaggcaaaaacttttgccctggctagtgtctttgctacgaggtaaaaaagcactgcctctaccggcaccatcactaattgctttaacagtctggccggaagaagcgccacaaaagaatttccgtacatgacggtaagccagtacgtattcaggcaagtgttgacaaggatagcaaccaccactttcgccgccacgatccgccagacggtaagcggcttcttatacaggatcagcccgtaaagaatacctcctgccactgcactgaccgtaaatccggggaaaaaagcccccacaggcttcaccagatatttcaggatgtcagctactccagctacaattccaccgacagacggtccaaacaacatggccgcaatctcatttggcaggaaagaaaatccgatctttaaaaaatcagtcacctgcaccgtcccaaaaatcgccaaaacaaccgccagcgccagaagcatggcgatcactgccatcgtatggctgtctcttagctccgaaagtgattcccggaacatgtctcgtagtttcttacatttttccataaaaatatacctcctttgcagtagtccttttgccacgcacagcaggtattttgctctctgtctatgtgcagcagcgggatgcaaaatatgtaccgcaagaatactcttttcgtccaccggcaactccccgtccgtatggcacttaacgcacatatttctactctgcctgttcgtttcgtttttgattatagcacgaactctttttatcgtaaagacattttctgacgattttcccgccacctccatatcgctttccgtctttactcactggttttagtattccatggcttcttcccgtgtcatccagaaatggatcccgtgggtagaatctttccagcggtcgtcggtaaaagcatccgcatagacccactctccccttcggtagacgaagttttcatctaccaaagaccatgcctcgtcaaactcctgcctacagtcaaagcttttaatcgtgagaacctttgccttgtcacagcggcaggccgccccggtggcagaacttcttttggcatccgccggaatcaaaagctggacaatccggtcataaacacatttcttgtaggctacaaaggcgcctgtttccgggcagcgcattgcatacccctgcgttgtctcatccatcttggcttgtgtcagatctgcattttccagagcacaaagccgaatatccgcctctctaaaatcagcatagcaaaggatacatcctctaagatccgctccccgcaaattagctccccgaaaatcagctccggtaaagtcacactcccggaaccgggagttcacaagattcgccttcttaaaatccgcgctccgaaaactgattgcagtgaaatctccccactccagattctgtccatgcaaatctgatccgtccatcttcctttttttccacctgatcttctccatcctttttccctctttcttccactctatcctctgttcggctcttccatactcgcatccctgtttcccgaactaatacagaaagccaaaatttttccaaaaaagttgttgacattttctttttcttatagtatcatagtttttgttccgagtgaacagcttttgataagcgacagtggctcagttggtagagtacgaccttgccaaggtcggggtcgcgggttcgagccccgtctgtcgctcttctttttctaatttcatagtgtatgcgacagtggctcagttggtagagtacgaccttgccaaggtcggggtcgcgggttcgagccccgtctgtcgctcttcaacacggttctttggaaccgtgtttttttgtagaaaactggttcctataaaataaaaaacgctccgccgtaggcggagaatcctgcaaagcaggattctatgcttctccctcggatactttgtccgatttcagcacaccgattcccaactcttccagctgcttcacagcaacctcggacggagcttcgagcatcagatccgatgcgtcctttacttttggaaacgcgatgacatcacggatactgtccgcctttgccatcagcataacaagacggtccagcccatatgccagtccggcgtgcggtggcactccgtatttgaacgcattcagcaggaatccgaactgctcttgggcctcctcttttgtaaatcctatgacttcaaacatctttgtctgaatgtcattctggtgaatccggacgcttcctccgccgatttccgtaccgtttaatacgatatcgtaagctttggcgcggactcttcccggatcactgtccaaatactggagatcttcttccatcggcatggtaaacggatgatgcattgccacgaaacgattctcatcctcgttccactccagaagcgggaactccgttacccagagaaagttgtactggctcttgtcaagaagatcaagctgtcttgcaatctccagacgcaggtttccaagcacatcccatacaaccttatttttgtccgccgcaaaaagcagaagatcccccggctgtccatccatagcctgaatgagagcagacagctcctcttctgtcataaatttcgcaaacgaagatttcacacttccatcctcagcaatcgaaaggtaggcaagccctttcgctccatattctttcgcaaagtccacaagtttatcgattttcttacgcggcattgccccctgccctttggcattgattcctctgacgcttccgccctgatccaatgctcctgtaaagacgccgaatccacagccctttaccacttcactgacattgataagttccatgccaaaccgggtatccggcttgtcagaaccaaaacggtccattgcttcctgccaggttattttcggaatcggcagggtaacatctacatccagtacttccttgaacacatgcgcaagaagtctttcattaacatccaggacatcgtctacatccacaaaggaaagctccatatcgatctgggtaaactccggctgacgatctgcccggagatcttcatcacgatagcatctggcaagctggaagtagcgatcgcatccggaacacattaacaactgttttaatgtctgaggggactgtggaagcgcataaaaactgcccgggtggacacggcttggcaccaggtaatctctggctccttccggtgtactcttcaccagagtcggcgtctcaatctccagaaatccttcgtctgccaaaaactgtcttgtcagcgtcgccacctggctcctcataaggagattcctttgcatgtccggtcttctcagatcaaggaaacggtatttcagacgcagttcttctttggtcttactgtcctcttcgaccgggaatggcggggtctcagactcggagagaacccgaatctccctgacacggacctcaatctctccggtaaccaggttttcattgactgctccggaacgtgcttccacagttccgaccgccgcaatgacgaactcacttctaagcttcgcggctttctcaaatccctcctcatcgatgctgccgttctcaaatattaactgcaggatgccggaacggtctcttaaatccacaaaaataatcccgcctttgtttctgttcttctgtacccatcccataacggtgaccgtttccccgatgtttcctttcgtaagctcggcgcaccggtgcgttcttttcaggcccttcattgattctgccatatctcttcctccatctcttttgctctattcctcgccctgcggcgcaaattcccgtacaaaacactctttcacatcggtatatccgtcctgtgcaagctggtctttctggaatctcttatttttcttcatattggaaaccagtacctgatatccctttgcccgctcttccttcgcaagggctaaaatccgggtcacaccttcagaaggcatccctttttcaatcagataggctttcttctctttctttgtcggaatctggtagccgctctctaaaagcagaaggacaatgcgttcaaatccgatggagaatccacaggccggggtatcctgtcccgtaaactttccgatcatcttatcgtaacgtccgccgcctcccacagatccaccgaactcgtccatggaaatttcaaaaatcgtaccggtgtagtaggacattccccgaacaagcgtcggatcgaagcgcatcgcaaagtccgcttccttcgtctcctccacggtggagataatcgtctcaagcccctctgccacttccggctccagatacccggcaagcttttccttcaggtagtggattccctccagatcgttcgtcacttctttaaataaggtcaggtaggtatctacgacgttctccttatatcccgcttcttttaactccatctccaccccttccggaccgatcttatccatcttgtccagaatgatgaaaacctcatcaaagctctccttagcaaacccgctgtaaccagccatagcctttaaaatctgtctgtcattaatacggatcgtaaaatgtctgaaatccagctttccgagcaaagtgctggtagcaaggatcagctcgatctccgcaagattagacggctcgcccagaatatcgatatcgcactgcataaactggcggtatcttcctctctgcgggcggtctgctctccagacatttccaacctggagcgccttaaatggggacggcagctcgtttgcgtggttagcataataacgggacagtggtagtgtcaaatcatagcgcagccctccatctaccagatctgactccgtctttgctgtctccagattcagctttgccccacgctttaagatcttaaagatcaactgctcgttctctcctccctgtttactgagaagattttcgatatgctccacacatggagtctcaatcgcggaaaatccaaaggtacggtatgtatccttaatcatctgtatcacatagtcccggatctccatctcccgtgggagcatgtcattcattccggtgaccggttttttctttaatgccatagccattctccttttcgctctatcatctcatcgatccgggcgatgtactcgtctacctgcttcacattttcaatgcggatcagattcgtcatcttgtgctttttgctacccggcatctcgacggctttggggaggacaatcttcgtagaagcgcccgctccggccgccacaatggactgcttttcctccataattagtatattgtaaattcccgctttgtcaacctctgcatatccgacattctcaaaattccccgccatatttttctgtcggtacagataatacggcacaagccccatctcgcctgcacagcggtaagccgcgtcaatcattgcggtaagatccccggcgcttgctgtatgcccggtaaatccctccccgcttctttgctcctgccgaagcctggaagcacgcttgatggcaagagcatgtaccgtcaggctgtccgggccaagttcctggacctttgtcagggtgtcttccatatcctccggcgtctccccaggaagacctgcaatcagatccatattgatattgtcaaatccaagttctcttgccacacgaaatgtcgtaatcacatcctccactgtatgccgtcttccaaccagatccagtgtcttttgctgcatcgtctgcgggttgacggaaatccgcccaatcccgtgccttttgagcactttaagcttctccctcgtaatactgtccggacggcctgcctccacggtaagctccagaagatgctcataggaaaactgtttttccagatgggtgaaaagtctgtccaactgatcagctctaagagatgttggagtcccaccgccaaggtagatcgtattgagctttttctccctggaaactgcagcaatataggacagttccttacagagggcttccagatacgcatctgtcttctccagatactgactgatcgggtaggatgtaaaagaacaatacgaacaggtcgtcggacagaatggtatcccaatatacaggctgtatccgttctcatagtctaaccgggaaagaagccttttttcccgcttggcaatgtcaagtcctagtttggctttctccccggaaacaaagtgctcctttgtgatccagtccaaaatcctgtcatccggtactccctcttctaatttctgcatcagcatcttagtcgggcgcacaccggtcagactcccccagggcaggctctttttcgtggctctgcacagcttttcataaagcgaacggactgccagatgttttttctctcctctgtccatctgcaaaagctctgttttctcgccggccagcgtgacgcaaaaacaagaatcacagtctgattcaattctgatctgtgactcttgctcctcgtctacctgctgttcgatttcttcgtccggataaaaagctttcaacagatgatacgcatcataagtatataaagtatcattacatgtcagcttcattatgatttctcctacacatgtcttctcagaaatggattgtatttcttctcttcaccgatcgtcgtagcatccatatgtcccggcaggactttcgtctcatccggcagcggcaaaagcttatcctcgatgccccgcacaagatccgacatactgccgccctcaaaatccgtccgtccaaccgaatggtggaacagtgtgtcgccactgaacaaaatcccttccgacgcaacataatagcagactccccccggtgtatgtccaggtgtgaaaaacacctggaaatcgtatcccgcaagccgaagaatcttcccgtcctgtacatagaccgcctcagaaaaagtatagcccttcgtatagatatcggactggttccagtgggcgtcagtaatcaatcccgcttctttctctcccacatagaccggcacatcataaaccttgcggaaaccatcgatccccataatatggtcaaaatggccgtgagtcaggaggactgccttcatggaaagtccctcctcctcaataaagtgcatcaacttctttgtacaggcggccggatccacaagtacggcctcctttgtagtctcattgtacgcaacatatgtgtttgtgccgataatccctgttacaaacgtctctatcttcatttggtcctctttccggcctctagcctgttgtcctttctatatcaatcacattttcaatctgtctgagcttgccgatcagacgtcccatctcttctttgcctcttacaacaaagcccatctccacagtagaaacgcccttcttacttgtgcggacattcatcgtcttaatatcgatctctgtttccgtaaagactctcgagatctccatcagcgtcccgggcttatcctcgacatacatcttgatctccgcaaaatacttgccttcggaagcctcatcagcatctgcctcccactccaccggaatcagtcttgcccgctccctctccgtcaggtgcaggacgttgatacagtccgtccgatggatcgtaagccccctgcctctcgtcacaaaacccacaatctcatctcccggaagtggattacagcacctggaaaaccgtaccgccatgtcgtcaatccctttgacgatgattccgctcttggatttggcaatgtgaactacattctttgatgcctccgctactttttccagaacagcctcatccgtaatctcctgtctgtgatctttattgtactcatccgcaaggcggtttacaatctggccttctttgagtcctccatgtccgatagccgccaggacagaatcccagtccttaaaaccatatttctgctgtacgatctgctgatattttggcttcagcagattgccctgttccaatcctttggacttacagtaggagaccagcatctctttcccacgaatgatattttcttccttaaactgcttcttaaaccattggttgatcttattcttcgcctgggtgctcttgacaatattgagccagtcccggcttggtcctttcgaattctgggaggtcaggatctcgattctgtctccgttctggattttataatccactttcacaagctttccattcactcttgcacctaccatcttattacctaccgcactgtggatggcataggcaaagtcaatcggtgtcgagccgtttggtaaatttttaacgtcgccgtttggcgtgaagcaatagacatcttcagcaaacagatccaggtctcccttgattaggcttaaaaactcccggttatccgacatatctttctgccagtccagaatctggcggagccagttcagcttctcctcctcctgcgccttgatattctttttcccgtcgttggactccttatacttccagtgagccgcgataccatactctgctgtcttgtgcatctctttcgtccggatctggatctcaaacggctgtcctacagtactcatcagtgtggtgtgaagtgactgatacatattgggctttggcatggcaatgtagtccttaaagcgtccaggtaccggcgtatacatctcatggatcactcccagggccgcataacaatccttaactgtattcacgatgatacgcaccgcaaaaagatcgtaaatctgatccacggtcttatcctggtttaccatctttttataaatgctgaagaaatgcttcacacggccattgacttctgcctgaatattggcgttctccatatgctgggagacttcttttacaatctgtgccacaaactcttcccgctcagtctttctctcgttgatctgctgcaccaggtcgtaaaaaacctccgggtgcaaatatttcaacgccagatcatcaagctcggtcttgaccttggaaataccaagtctctgggcaatgggagagtagatatccattgtctcccttgccttttccttttgtttttccggtttcataaactggagtgtccgcatattatgaagccggtccgccagcttgatgataataacccggatatcctttgccatagcaaggaacatcttccttaaattctccgcctgcatctccagcttatccgaggaataagaaagctgtcctaacttggtaacgccatccaccaaaagggccacatcctccccgaaatctctggcaatatcctccttcgtctcttcggtatcctctaccacgtcgtgcaggatgccggcagcgattgtctccttatccatctccaactgtgcaaggataattccaacccacagggggtgaatgatatatgcctccccggattttctgaactgatttgcatgtgccttactcgccagctcatacgctttctctatcatcgaaacatctgccgatggatgatatttacgaatatgcccgatcagatactggtacagttcatccggatcttgataatcttcaggctctttgaccgcatgaccgtctacaatccgcagtccctggcggacttccgtcgtcacttcttccggtctgattttttctgccatatcaatcccctccttttcctgtttttctcccgctttactctcaaatatcatgtcgttttttggaatatattttttagtatatcattatttcaaaaaagtgtaaagcaaagcaagaatccatttttcgtatgacctggccgtatccttctctttttacagtattaccgataatccaaaatggtaatctgcaatgtctttttccccatatattcattgacgcccggataataagtgacatccatgaaaagatcctgtcctcttccggaaagaagctgctctctggcgtctgggccgtatttttctgaaagacaggagaaaaatgactccatctctccgaaaaagacagcttccataatagtatgatcctcgtccatcacttccagcttgagaacgttttgatgtttcccgagcagtctgccccgcaaaagggaaagcttcctctgtgcaaagaccggtttggtattcccttttccaaacggttccagaagcgaaagttccttgataaacgattcagtcacctcacaaagcggaagctgcatatcaatgactatcttctccgtcagctcccgttcggtcaatgttgtctggtcattgagtgcttttcgcaaaaagaaaatgttctcttccggcagagaaagtcccgccgcaagccggtgccccccgaaacgggtgagaagattcctgcacttacacagttcgtcatacatatgatatccctcaatggaacgaccggaaccttttgctccttcctcagcccttgtaaggacgtacaccggcttatagtagcgctccctcagacgacctgccacaatccccgcaatgctctcatgacattccggcagataaacgaccagcaccttttcttctttcagtccggttgtctccacctggatcacagcttctttgaccgcctcctcagtcagatttttccggctgtcatttagggcttttaagtctcccgccagaagatctgcctccttctgcgtaccggcacacagaagttccagcgcccgttttgcggtatcgagacgtccgcccgcattgatgcatggaccgatgacaaagccgatatgataggctgacaggcactccttgttgactccggtacattccatcaacgcacgcagccccagattctttgttcttttcagcatctcgagtccctgcgcgacgaaaatccggttctcatccctcagatccataacatccccgacggtagcgatggctacattctccatcagataatccacatcctccgggtcttttcccatcacgttgtacaaagcctcgatgagcttataggctactgctgctccgcacagccccttgtacggatacaggcagtcctcccgtttgatatccaccaccgcgtctgcgggaggaatctggaactccctcgtcccatcctccttttcttcatagggtacctcgtgatggtcggtaacaatgatggacatccccatgctttttccgtaggcaatctcattcttcgccgcaatcccgttatcacatgtaataatcgtatcgatatcatcatccaaagcccggtcgatcaaatcaatattcagcccgtagccatcccggatccggtctggaatatcataatccacccgggctccaaggccggtaagcccttccagaagaatatatgtggcattgacgccatcaatgtcataatccccgataatgcggatgctctgaccttctgtgagcttctctttcagcaaatcgacagccttgtccatgtctttcatcagcatcccgtcgtacagatccgcaatggttccgttcaggtaccggtccaccgcttcctccccgataatatcccggttgcggatcagcgccgccgtcctcggatgaatatgaaaccgctcccctattttcgtaaaattgccgccctttctgagcagtacccagtttttcatctgtattcctccactgaaaagcaaaaggatgccgcaagatcctggtgatccatcctgccgcatccctttattcgctctatttctttttccctgtttccgtttttacagcctctttcttctttccgactttcgtcttcatcacataccagagcgcacctgtaatgcacaccgaagagtacgcgccacagatgatacccgccatcagaggcagggcgaactctctgaccgaagcaactccaaagaggaacaggaaaaataccatgataaaggtcgtaagagaggtgtagatacttcttgtcagcgtcagtgtaatacatctgtttacaagctcggcaagagattctttcttctttcgtacctttaattcttcacggatacggtcgaaaatcacaatcgtcgcattgatcgagtatccgacgatggtcagcatacaggcgataaaggtgcttcccacggtaattctggatactgcataaaacgcaagtaccaccagtacatcgtgtactaaggccgccaccgcactggttgcaaaccggatatccttaaaccggagccagatgtaaagaagcatacagatggtggaaatcacaaccgcaatcaccgcatcttgtctcatctccgcactgatggtagagctgatactggaataggtaatttccgaatccttgatttcaaacttatctgccagagcctggtttaatgcctctctttgctgaaggctcaaagcctttgttctgatgataatctgattactttcctttactttctgtgtctgtacttccgaatctcctgttgcctcctcgataaccggaacaatctcggactcgatctcggaaatgctgtagtcttcatggaacgctacattcgtggacgtaccaccctgaaactccagactgtagttcagcataccgttccctttgatctggtgatatcccatcacgccaaatccaaccacgatgaccgccagagagatggcaaaacagagcgctttcttgctgaggaaattgaccggctttctctctttccatttctttgcatagaatttctcatcccggattcccactgcatagaaggagtatacaatcatccttgtaattaccagagccgtaaacatcgatatgacgataccgagcgccagtgtctgtgcaaatccacgaactgtaccggaaccacggaaccaaagtactgcagccgcaatcaatgtcgtaacattaccgtccacaatggctgagagcgctttatggaagccgccttttaaggcgtttcgcacactctttcccgcggaaatctcctccttcactctggcgaaaatgatgacgtttgcatccaccgccatgccaatggaaagaatgataccggcaattcccggtaaagacaacgtaatatcaaatgcatttagcagcatcagcacaagccctgtgtaaatcaaaagtgcaagtcccgaagcaagtcccggaagcagatagacgatcatcataaagaggatcacaaccgcaagtccgacggcacccgcatacaagcttgtgctgatcgcctcttcaccgagctgggctccctctacctgggaattcagctcttccagctccagggaaagtccgccgatccggatagaggccgccaggttctctgcttcttcaaaagttgccataccgtcaatatatgctgttcctccggtgatcgcctcattcactcttggggaactgatcgtctccccatcataaataatggaaatctggtttcctatgttctccttcgtagcctcggcaaacttcttggatccctctttatttagctggagctctaccatatactcgttggctcctgtagtatgatcctggccgctttttgcctcagcagtcttgatatcgcttcccgtaagtaccgtttccccgtcagacgtctggaactcaagagttcccggctgaccgagttcttccaggatttcattggcgtccgatacacccggtatggaaatactgatccgtctgtcgccttcctgatatacactcgcctccgtgctgtaggtctccacacgtttttgcagcttgtagactgtatccctcatatcttcatccgacgggttcttctccttcgtctgataggtgatactgaccccgccggccagatccaggccaagtttgatatttttcatagccccactgtgggatccgccccatccgaaactcactgtataggccaagagtgctatcatcagaatcgtcccaagaagtcctgcgatccctctgcttttcttcatatcttacacccccttctctttaagcctgccggctctcttccccgatgtccgccaaagcagcttttatcataatcgcacactctactctttttctctccatctcacatccgatatcataagcatcatgtaaggttccctcgaaatggtaggagtttgccatacagccgccgctgcaataaaatctggcgaagcagttacggcatttctccttggagtatacattgcagcaccggaactcatccgcaatctcaggctttgtaatgccatcgtctacatttcccatcaggaagtcctcatcccctacaaactggtgacatggatagagatctccccacggcgttactgccaggtactctgtgccggacccacatccggaaagacgtttggcaatacaaggacctccttccagatcgatcataaaatgaaagaaattgaatccttttccttccttttctctctggatcatatagcttgcaagcttatcgtattcctcgaaaatctgcggcaaatcttccttgcgaatagcataaggatctgtctcatcccctaccaccggctcaatggacatctgctgaaatcccagatctacgaaatggcgtacgtcctcagaaaagtccagattctgtctggtaaacgttccccggacataatatttctgctggttcctgctctttgcaagcttctggaatttcggaacaatcaaatcatagcttccttttccattgcgaaatggccgcatcctatcattgatctcccgtcttccatccagacttaacaccacattgtccatctcctgattgataaactcctggacctcgtcgttcaaaagcacgccgtttgtggtaacagtaaatcggaaatgcttgtcgtgaatcttctcctgctctcttccgtatgccaccaggtctttgacaacctgccagttcatcagaggctcgccgccaaagaaatctacttccaggtttcttctgctgccggaattggcgatcaggaaatccagtgctttctttccgacctcaaaagacataagcgcccgtcttccgtggtattctccctcttcggcgaaacagtacttgcaagccaggttgcagtcatgcgcgatgtggaggcagagcgccttcactactgtctttcttttcattacgtcctggatgcaggcttcgtgcgtatccggtgcaaaaagctgtccggcctcggtaagctcggcaagatcgtcaagaaccgtgtcaatttcctccggctcatatgtattttcaaactgtgcttttattgcttctctcgttttggccgtctgtattgtgctggccgtctgctccggatggatcgcgtttaaggcggcgattacatcgtatcccatctggtctacgacatgcacgcacccactgttgacatccagaacaatattgtatccgttattctggtactggtgaatcactatcggtacccctttcttttttctttgaacatcaagagacagcgaccaaaaagccgctgtctttgtacccttcgtttataagtcctgactgcctatttcttctgctcgcaggtctggtttcctactgtacaggaagtcttacatgctgactggcaggatgtctggcattctccgcatccgcccttcttcatcgtgttgtttaaggtctgtgtatttaatgttttaatgtgtttcatcctgatttcctccttctgccttttgctagaagatattatagcatagcctccttctttttaaaagcccttttttcgcaatctcacggatgacctttgcaggccgtttgatggcgccgcacatcttttgttctctatgacaacataccgcccaacatcccacctgcggcgcacagtaccaatgtcgtcacgatctgcatcacatctccctgaagggtgtgatatacgccaaaggagaccagtaccagcagaaggaaatacaaaatcccaagcatgagcccccagataaatttgcggactttctgaagctttccgattaaaaatcctccggcaaatgcggagacaacataaattccggtaatccctgccgtcactttgcccttatccagattcagtttataaagcagcactgccagcaccaagagcaggattccggtaatgatataagataccagaagtgcctgaaaaatccgcataacccctgatttttgtccctttactctcatcgcatcctccttgtcctgtttctaagactattgtatgatgcgggcttgcgctttatgactatgcttccatctgacttccgagaaatgtggcagcacactgggcaagcttctgacagatttccttggatgctcccttctcctcttcctgccacaaaaaaacgacagcgccgatcacatcgcctcccgtaagaaccgggcacaccaggctctcaaggtagtccagattcttatatttcagcaaaggaaccatccccttttctctcacccctttttgtaccatccggcgttcctccagaagtcccacgaactcctctgaaatctcctggtccgctacatcctttttccctgccccggacgcagcgatcaccttttccatgtctgtgatacacgtcagcactcccgatgcctgggaaaggctctccgcataattctgtgcaaatgtataaatttctccaagcggggaatattttttcagaatcacttctccatcttttcctgtaaaaatctctaaaggcgtgccctcccgaatccccagtgtccttcggatttcctttggcacgacgactcttccaagatcatcgattcttcttacaattccggttgctttcatatcggtcttgttccctccatttcacaatataaccgttattttccacggttccacataaggctagtatccgcaaaaggaaaaattttattctgtttgcactttttcttaagagatagtaaaatagaaaaaaacacgaggaggtcgagcagacgatgagtaaaattgacgacgtaagaaaagaaatggtcgttgccatgaaagccggcgacaaagcaagaaaagagacgctctcttctcttcttgccgctctcaaaaataaagctatcgacaaacgggaggatctgacagccgaggaagaggtgcaggttgtattaaaggagatcaagcagacgaaagagactctggagatgaccccggcggaccgcgctgagatcatcgccgagtgcagggctcgcatcgcagtcctcgaagagtttgcgccaaagatgatggatgaagaagagatcaaaactgtgatctcctccgtcctctccgatctggagctgacaacgccgactgcaaaagataaaggaaaaataatgaaagagctgatgccgaaggtaaaaggaaaagccgacgggaagctcgtaaatgagctggtcagcacgttctttgtataacgccttcatcagatgataaccataaaagaagcagcctactcggctgcttcctctgcgttatctgtattgtccgtattctcggaatcgtctgtattctcttcatccgtactgtctttactagtagagttatccgtactgtcggagtcatcctccgctttcttcaccgcaaccccttgttcgttaaagtcgatttttttccagacgtccttattttccttaatcttggtatcgtctttccatccctcgacgatctcattgtaacggtcattctcccgttcggagatgatctgctgcttcttattatctgtggctgtctgatcaaatgtggaagtcacctttgccacatagtatccggaatcggtctcgatcacgtctgtcacctgtcctgcatccagcttgtcagccgcagcgatgacttcctcgttcggagacgtcgtctcagaattaaaggtcagatccagcgtggaggtttcctggtcttttgctgcctgctcaaaatccgtgcctcccttaactgcatctaagaatgtatctgcttttgtcttagcctcttcctttgtatcggatgtgctctcagagtcctcgctctttgactcctcggaataagtaaatgccacatactgcatcgctttctgagccgcctcttcatcggaaaccttgcggtctacatcctttaacatctctgtccgcatcttctgctggatcgtaaacaatcgaagaacttcttccaccgtctctttatcccctgagatcacttcccggacattttcgccgttcgcttctacgaaagcatctgctgcctccccgattgcttttttctcgtcctctgtcagggaaacatcataatcccccacgtgttcatttaaaagataaagctcctccagagactgcataattgtctctttcgccgactcttcataagtcgtatcgtcgtcgacttttgtcgtccacatattttctcccagcatggaactgtaataagtctcatacattgcctgctgatatcttgcaaagaaatttgctatattccctttaatctctgttttacctactgtcgcaacaacgtcgctgtccttaatcgtctcttgcccgcagcctgccattgcccccgccgctatcacggcagtcagaaggacaactgccaaacgctttttcataatatcaaaagcctccttcgtatttctaactaccctattatatccggtttcccttttacaatcaatgtttttatgtcatttaacagatttttcacgacttccaggatatcctgatctttctctttgcgatttcgctttttctgctcgtaaaggaaatatggaggtgcgtcatttttgaatagcaattctccttttcttcgctccagaagtttgggaatctcctgaacctgcacttttgccttttcatacatcgtgattttgagcgtgctgcctttttgctcgatggccgtcacatacacggagtgggcaagagccttgatccgtgcaatcaagatgagtttctgtactttcttaggaatatccccgaagcggtcgatgagctcttccatcatatcgtccatctcgtcttctgtactgatgagggcaatccgcttgtaaatatcgagtttttggtactcgtccggaatataggaggccggaataaatgcatccacattcaggtcgatcgtcgtggtaaagctctccacctcatcctgatctataccttgtttcatgcctttaactgcctcgtttaacattttacagtagagatcataccctactgcctccatgtggccatgctgtgcttctccgagaagatttcctgctccccgtatttccagatccctcatggcaatcttaaatcccgatcccagatcggtaaactcccgaatcgccgccagacgtttctccgccacctcccgtaaaagccggtctctccgataaaggagaaaagcataggccatcctgttggaccgtcctacacggccccgaagctggtataactgagaaagccccagtttgtccgcgtcgtggataatcatcgtattgacattagaaatatcaagcccggtctcaataatggttgtagagacgagcacgtcgatatccccattgatgaaatcatacatgatcctttccaactgatgctcccgcatctgcccgtgagcgtaagccacatttgcctccggaatcagactctggatacgggctgtgatctccgcaatgtcttttaccttattataaacataatagacctgcccctgtctggagagttcccgcacgatggcctcccgtaccatctcatcctgatattccatgacatacgtctggatcggcatcctgtccatcggtgcttcctccagcacgctcatatcccgaattccgatgaggctcatgtggagggttcgtggaatcggggtagccgtcagtgtcagaacgtccacattttcccggagcttttttatcttctccttgtgttgaacaccaaaacgctgctcctcgtcaatcaccagaagtcccagatctttaaacgtcacatcccgacttaaaatccggtgggtccccacaagaatatccacctgccctttcatcagatcttccagtgtcttcttctgctgagcaggcgtccggaaacggcacatcagatctaccctgaccggaaaatccttcattctctgcacaagtgtgttgtaatgctgctgtgccagaatggtggtcggcacgagaaatgcaacctgcttattctcctgtacagccttaaaagcggctcggatcgccacctcagtctttccaaatcccacatctccgcagatcagacgatccataatcttatggctttccatatcctttttcgtatcctcgatggccgccaactggtcatccgtctcctcaaagggaaacatctcttcaaactctttttgccatacagtatccggctcgtaggcatagccgtccttttcctgacgcgtcgcataaagctctacgagatctcttgcaatctcctgtacggcttttcgtacccgcgtcttcgtcctctcccagtcctggcctcccagccggttcaacttgggcttctttgcatccgcggaagcgtacttttggatcagatccatctgggtggccggaatataaagattgccgcccccggcgtaggagattttcatataatccttctcaatccggtccacttcaatcttctcgattccctgatagataccaaggccatgattttcgtgtaccacatagtcccccggctttaaatccgtaaaactctggatcttctccccctcatagatctttctgcgcttctttctcttcttttttccgaagatatccgtctcagagataacggtgaatttcagcatcggatattcataacccactgccacgtggccgtaggagacaaaaatctcccccggctttaccaggcggtttggatcttcatcataaaagctgtttaaatcataatcccgcagatcttctgccaatctcctggctcttgtccgggagccactcagaaggatcacccggtatccatttcgcttcagccgcttcaaatcccttgtcaggacttcaaaactgctgttatatgggttgacattctttgccaggatactgtaagtctcccgcacatggaattccttcagttttccttccagcgcggtaaacccaatactatgatagctatttaaaagccccacaatctcacgcaccagaaacatccggatctcatcctcctctgtctttgaggtccgctccgcttcctctcttctttcctgcgcctctttgacctcctcctcgattgtcagccctctctcatataaccttgcaggctcatccaaaaacagaagtgtctcctccggctgaaaatactgcaaaaaagaaactccttgttttccggagactgtatccgatgccgggtagaaagtgatctcctcccggttttccacagaccgctgcgtctccacgtcaaacgtccggatggagtcgatctcgtcatcccagaattcaatccgcaccggcatctcttctgtcagggggtacacgtccaaaatcccacctcgtacagcaaactgccctggtccttcaatctggatttctctgtcgtatcccatcttggaaagtctaacctttaattcctccaggtccgacatgtctcccacgcgcagggtaaagatctgtccattgatgccggacggaggacggacgccgtccatcaaagcatcgattgtcgtcaccaccgtgaccttctcctcctcccgaagcgcccgaatcacttccatcctcttctgagtcagatattttccccggatatccgcacggtaaaacagaaaatcctttgccgggtagaaaaagaccccggcatccagaaactggtattcctccaagatctcctttgccttttcctcatcctgcacaacataaagcacccgtctgtcctccctggcaagggcataggcgaggtgtcctttctgtgatccggtacttccggcaatctgaatcatccccggttcccggtattttgtcttctgaatagtatcaaactccgcaagctccaaaagaggcgccgtaaaagccttcatcgtgtcttactcccttccatcaacctttgcggttaaactgattcatcgcctcacagatgtcaccatgtaaagccatcctcacggcctgtaccgccttttcgtaggcttcctccatcttctctttgtcctctccttcaaaatgtcccagcacataatccgccagatcgtagccccttggcttttctccgactccgatcttgatccgcaaaaacgcgtcatgtcccagatgggagatgatgctcttgataccattatgtccgccggcgcttccttttttgcggatccggagctgtcccacatccaggctgatatcgtcataaatgacaatcagatccgtttcctcgtccaccttataatagtccaccaactcccggatactctctccgctcagattcataaaggtctgaggctttgcgagtatcactctgaagccgtcgatcacacccctgccgatgagcgcccggtgctttctcgtgtccactgctatatggtattcctccgcaattttgtctatgacatcaaaccctacattgtgcctggtcccttcgtattttaatcccggatttcctaatcctacgatgataaacatgactttctacctctcttttttcgtatctttttattttaccgtaaaaaccctcttttggcaacgctgcatacaacgtacacaaaaatcttcgttttcaaacaagtttgaactcagattttttgtgactttgtgcatggctgaactgttactttcatatatagtataaaggcaacatctcactgtactgccagatttgacatcttaccgaaaggagagcttttgacttatgagttccaaaacaaaaatcgtcgtatttcacatgaaggagatcatctacaccgccatttttgccgcccttgggatcctcctcatcctgcttctgctctttatgttcctgcccggacatacaaaaggaaagcagacatccaaagactataagcccggaatctacactgccagcatgacactcaataatacacctctggaagtggaggtgtccgtggacaaaaaccatatcaattcgatccggtttgccaacctggacgaaagcgtggaaacgatgtatccccttgtccagccggccatggaagaaatcgccggacagattatcaagtcccagtcgacagacaagatcaaagccggcgaggatgactcctatacatccaatctcatcttggatacaatccagaaggcactgaaaaaagccgaggcagactgatatgctgccccggcttttcctatccttccacgaccagatactgtcctcccggaagtgcgaacacttcggatgcgtcctcaatctccccaagtgtcataccgtccacatccgctccgtactcatccagataatctcgaacctcttctaaagaatccagtacgactgccatacagtcctccagaaaagcctccgcctcctccggcgtctctgccaccggctcgtcaaatagctgggattgttctcttaagaacacttccaaacattcttcactaaatctctccatgcgtctcctccttgcccttttgtactgtcaccaccgaaatcagctcttccgggtgatcgatcaccacatgggcccctgtctcatacagaagctctttggaacgaaatccccaactgacaccgacagttttaacttttgcattgtttccggtgtgcatatccacatccgaatctccgatgtaaacacactcctcccgtgtgatgcccgcgcgttccagaatggaaagcactgccgccggatccggctttctcggaatcccttccttttgtccctgcacggcatcaaagaaatgatctccaaaaaaggttcgtaccacatccctcgtttggccgtccggcttattggaaagaactgccagaaagaccccttctttctttaatcgctcaagcatctctttgattccatcatatggctttgcgtgataggtgcaatattttgcaaaaacatcgccgtagactgccatggcctcttccatacgggacatctcttcatccccacacgcccgcagggtacactccaaaagctttctagcgccgtttcccacaaacctcctgcactgttccatcgtaattggaggaagtcccatcctttccatggtcagattcacagaataagtaatggattctaatgtatctgtcaatgttccgtccaaatcaaaaatacaagctttatacatctttctcactccattctcttgtttcataccatttacaagtatagcataatataggatctggaaaatttcaacacaaaagaacgcccccagggaaaagttagtcgctgttccctgaaaacgttctgttggtttttctgtctgatcgtttcttttcaatccagatactggcgcatcagacgaagtgcgtttttctccaacctgctcacctgcgcctgggaaatcttcacttcctttgccacctccatctgagtcttcccctcgaagaaccgaaggcggataatatatttctcccgctcatttaggtgctccatcgccgcctgcaaggacagatcctcaatccagcgctcctctttgtttttcttatcgctgatctgatccatcacatagagtgcatccccgctgtcattgtataccggttcgtttagactcaccggagcctgaatggcgtccagagcaaagacaatatcctccttggaaatgccaatttcctcggatatctcctggacagtcggctcccgaagattcttcttgacgtagttttccttggcgtagatcgccttgtacgccgtgtcccgcaacgaacggctgacccggatggaattattgtcccgcatatacctgcggatttcaccgataatcatcggcaccgcataagtagagaaacgaacatccagctctgtattaaaattgttgaccgccttgatcaggccgatacagccaatctgaaacagatcgtccggattttcgctgctccccgcaaaccgcttgattacacttaacacaagtcttaaatttcctttaatgtacttctcttttgcttcctcatcgccctccttaatccgggcgaaaagttcttccttttcttcctctttcagaagcggaagctttgaagtattcactccgcatatttccaccttgttcagtgccatcgtacatcctcctgtcacagcaaatctgcctttctaacagaaatgatgtgcataccggcacactcttatacaatgatggaaaaaataaaaaaacttttagtccttgacatgttgcacgttcggatactctgatcagtcgttccgatcccacttgtctgcaagatttaaaatctgactttccaacttagcaagatctttattagatagcccttcgtttttcattaccacgtcaagcagcctcttcgccgcggataccgcacggccaaatatctgatttgcccggattctggcaggtttttccgcagatttcttcggaatcctgagtccctcgcttaagatctcatccgtcagaagatccacggctcccccagaatacggagcaaaagcctcatatccgagcgtctccttgatggaagccgcaaactcgtcggtcacctgatcctccccgtggacgacaaacacatgacggatcggagtctcaaaggcggacagccagtttaaaagcccgtttttgtccgcatgtccactgataccctccaaggcgcagatcctggcattaacctccacattttcaccgaagagtttcacacattccgcaccttcgatgagttttcgccccaaggtgccggccgcctgataacccacgaacagaaccgtacactccctgcgccacagattgtgtttcagatgatggcggattcgtcccgcctcacacataccggacgccgatatgataatctttggcttctcgtcgaaattgatctgcttggactcttcacttgtagtcgtcagtttcagtcctggaaaacggagcgggttaacgcccttttgtactagttccatggcctcctcgtcaaagcaacccaacatgtttttattaaatacattggtcgcttcgattgccagcggactgtccacatacacttcaaaatccggatattccggcagcaggtttttctccttgatctcccggataaagtagagaacctcctgggtacggcccaccgcaaaggatggaacgaccacatttccaccttttgcaaacgtctcccggatcactttcgtaaagtcgcctacgtagtccggaatgccagcaccatgaatccggtttccgtatgtagactcaatcactacatagtccgcctctttcacggtcatcgggtccttgatgatcggttgattgatattccccacgtcaccggagaaaacaatcttcctcgtctcgccctcctccgtgatccacacctcgatacaggcagaaccaaggaggtggcccacatcgttgaagcgcacctccacaccatcgcagagggagatcttctgtccataatcacacggggcaaaaagcgctgccgcgtccactgcatcctgcattgtataaagaggttcgtaaaacggcgccccgcttcttctggccttgcggtttctccattctgcctcaaattcctggatatgcgcgctgtcacggagcatgatgccacaaagatccgacgttgcaaaggtagatacaatctctccctggaaaccctgtttcacaaggagaggcagattgccggaatgatcgatatgggcatgcgttaacaacacatagtctatctccgaggctgataccgggatctcctgattttcatacagatccggtccctgctccattccacagtctaccaaaatgtgctttccgcatacctccaaaagatggcagcttcctgttacttcatgtgccgcaccgataaatctcaatttcataccatcgcctcttttcttttcgtatcgtatgtagatattgtatcactttttttcagataatagctatatttttattccaattttgcaatttcttttttcaacctcaccatgattttcttttccagtctggagatgtaggactgggaaattccaagtacatccgccacttccttttgcgtcatctcctcaccgtccggagttccaagaccaaaacgcatactgacgattcttcgctccctcacagaaagccttcccaccgcacggatcagcatacttttctccgcctcgctctccatatccttatagatcgtatcttcctccgtccccagaatgtccgagagcagaagttcattcccgtcccaatccacattcagcggctcgtcaatagatacctccagctttgtcttattatttctccgcagatacatcaggatctcattttcgatacaccgtgacgcataggtcgcaagcttaatattcttctctggattaaatgtattaatagctttaataagaccgatggtcccaatggaaatcagatcctccactcctacccctgtattgtcaaacttctttgcaatgtacactaccaacctcaggttatgctcaatgagctgctttctggcatgttcattatgttcgctgcaaagttgttcgattgcccttgcctcttcctccatctccagaggaggaggcaaaatatccgatccccctatataatagacttcctgcttttccggaaataaccatgtccgaaacgcaggcaggatcttttgtctgaacgcacttggcactgtaagactcataatcatgaatatcccctcctaaaaaatatccggattgacaagcatccggtaagttccatctgtcgaaatccgggtatcagaaattccaatccatacatcccggatctgctttttgctctttccccacagggtcagactttccatccgcacaagaagaatcttggcattcgtattccctacggatcgaaaaccgatctgccgctgctccttcgccttctccagaagttccaaaaccgcctctcgttccacgatgcataccggctgcccggagagcggatctttcagcctgtttccggtatcaatcagtccctgaagccggatccgttttcccgctgtttcgatctgcgcctcgcaggtatacccattctgcctgtgaacctgccgaaaaaaggcccacaccgcctccaacacttcatagctgacaacagcaaaaaggaaaaaaaggctccctgtacgaatatattgtccaaaaaagctaaaaatacctccaagcaagaatcctcccccgtagagcatcagcaaagccttcacgagctcccgggcagacttcacaccaagtcctgtcataaccatagctgaattcactatcaaatgacacagaatcagacgcacgatcccgcctgtcgggattataatcacaagacaggtaagaaccgctcccattaaggcccccagaagcacccgccgcctcttaaactccatggacaacatccggcaaaccgccgcaagaagcagataatccatcataaaattgatgaggaaaaatacatcaatatagatttcatagtacatccttcacactcttttctcccgtcgctgctaaatcgattcagtatacgaacaaagagtattataagaaaaaaccacttgaaaatttgtcagaaactgacagagaaatgcgttttctttcgacatgatttgtctattccttcgtggaggtgtgttccgatgcatctggacacatctccctttttatcttaaagaaaaatagtaattttgcacagaaaaaggtatggaggcttttctgtctccatacctttcatttgtcttgtagtctgtatgatatctaaagtgccaaatatcggatctctttgtatgtccgaaccttcgattcctatttcttgaagaagtccggaatcttgatggtctgctctttcacccttcctgtccccgctgtgtaagatggtgtggaaggtgctgtaggagcatttgtctctggagctgctgtagttgttcttgtctgttgtggcatctgagtcactcttcccatatctgtcttgagtgctgtatgtgcctgtgtatcagtagcaaatacagatccggccggctttgtaactccgatcttggattttagtctggatgcagtactctctgtactgttatgtaaacctgtcgcaatgacagtcactgtggcctcgtcggacttggtctcatcgtacattgcaccaaagataatatttgcctcttctcctgcaagctcctgaacgtactctgccgcatcgcttgcgtccatcagagtgatatctccggaaatgttgataatcacgtgggacgcaccggaaatcgtcgtctcaagcagcggacttgccacagcctgttttacagcctcaagcgccttgtcgtctcctcttccatgtccgataccgatgtgagcaatgcccttgtcgatcataacggtctggatatccgcaaaatcaaggttgatcagagacggtacattgatgagatctgtaatgccctggataccctgctgaagaacttcgtccgcctttttcagagcgtccggcatcgttgttcttctgtcaacgatctcaagaagcttatcattcggaatgacaatcagtgtgtctacattttcttttaacttttcaataccagcgagggcattgttcatacgtgccctggattcaaaacggaacggctttgtaacaacgccgactgtcagggaaccctgttcttttgcgatacgtgctactactggtgtcgcacctgtacctgtaccgccgcccatgccgcatgtaacaaataccatatctgcacctttgagtgctgccgcaatctcatccgcgctctcctctgctgccttctcgccaacttccggctttgctcctgctccaagtccttttgtgagcttgtctccgatctgcatcagtgtaggagccttgcagaatgagagagcctgtttgtctgtgttgatggcgataaactctacgcctgcaatctgctcatctatcatgcggttgacagcattgttaccgcctccacctacaccaacgacgataatttttgctgctgcttctgattcatttgtcttaatttctaacaagagtgtctcctcctttgttatgctttattatttatacaccctactagtacatgtattctgccatatatactatataatatagtctttccgggcaaatttcaatagaattttttctatttttcgatttttttagtaacagttcaaccatatacaaagccgcaaaaatctaagttcaaacttgatgaaaatcataaattttttatgtactttgtatatgtggtttatctaagtgggattttcgccacaaaccccaaaagctccttcttcccgcagttcggaagcatttattccttggccgcttcacttttttcaaagcggatcgtctctgtcaactgcccgtaatgctccaagtacaatgtaccgctctggccctccagcttttccagaatcgacggaagctgctcagccttttctttcggatctccacttccaagtttggcgcagatcttcccaaaataaagggtgatattctctccgtctgtgacaatccggtccggacttaccttgtatctggtaagaatctcctgaatctggacaatatattcaaaaatagaggaatcctccaccggaagtttctctccctgctccacctttgagacgtccagtccttcaaccaggctcacaccatcccttggagcgtccgtaatgccaagtaccgtcccctcattgtcaaaataaatatagctctcttggttctgtacatatccggcaggggatttttccttgacgactacacggatcgtccacggattgaccatgtggaacttcatactctgaacagtcgccggctccgggaaatccccaaactttgtactaagtagcaggacaagggaattgccatcccctccctgctcaaggatatactgtctgatctcaccctccgtgagaaaatcagacccctccacccgaatttctctgagctgaaataaaaggagaaacaaaatgatggcagcaagaaccgccgccccgcttcccagtcttttgatgatctgcctgcgcctggtacgttttaattcttttctcttctcatccctttgcacgacctgttcattcatcgatgtgcctcctgtatgttccatcattaacgtttctattttaccaactggccacgctgaatacaagccccatttccacaagaagaaagacaaccgacgtccctccatagctgataaaggggagcgtgataccagtattcggaatcgtattggtcacgaccgcgatatttaagattacctgtatcatcatgtgcgccatggctcctgccgcaatcagcgcgccgaacaaatccgacgcatgggaggcaatcacgaaaaaacgccagatcaaaaggaaaaacaacaaaatcacaaggatagcccccacaagtccgagctcctcacagatgatggaaaaaatcatgtcgttttgtgcctccggcacgaagccgagcttctggatactactgccaagccctttcccgaacaggccgccggagccaatggcaaagagtccctggagcgtctggtaccctttctcatatttctccggattctgccagatggcgatacgctccaaacggtaactctccagtccaagaaagatagccatgaatccaatccctgtcaccgccatccatatgaactgggcatatttcggactggcggtaaagatcaggatcacggcaatgccaagaataatcaccgccgtgcttaagttgctggcccccacaagtcctacaacaggaagggcaaacagcatgatcctgaataatgtggtaagctttccgatttttttgacgttttttgtcaccagccatgcgagaaatacaatcaacgcaactttcacgtattctgacggttgaaaagaaaatggccccaaagacagccatcttttggagccattatattcatcgccgaacaacatgacggcaatgcaaagtacaattgccatcagataccccggcaccgccagcttttcccagatatgataatcggttctggcgaccgcatacatcccggccaatccaagggatgtagcgaagatctgttttttcaaatagtaaaaaggatctccgaactttatctgtccattataggaactggtactgtaaaggattatcagtcctattatcacaagtaaaaaaacaatcaccagaagcaccttatccgtccctctggattccggtttttccgcctgcttcaatctatccctctccttacagcgattttaccaagtctttaaacttctctccccgttcttcgtagcttcggaacatatcccagcttgcacacgccggcgaaagcaatacagcatcccccgctttggcttcttctttcgcacaccgcactgcatcctccaaactatccacaaaggcgtagtcggtaaatccatatttctccgcagtcattgcaattttctccttcgtctccccgagcaggatgagtttctttacttttccctgaaagctttcgatccattcattgtattcagactgcttatcatagccccctccgatcagaatggttggacgattcattgcggtaataccacggattgccgcgtccggattcgtccctttcgaatcgttatagtatgccactccatctttttccatcacgaattcgatcctgtgttccactcctgaaaacccctttatgactttccggattgtctccatcggtacgccatagagcgctgctatcgccaccgccgccatcacattttcataattatgggttccaagcagcatgagctcctccacacggcaaaccggaactacttcctgattccggtagataatctccccgtcttttaagtaaatccccaccggaagttcccttttactactaaaataaaatggtgtcgcttctgtctcttccccgaacacccggagcacgtcatcttcataattcagcacacagtagtcatccttcgtctggtttcttgtaatggcctctttggcgctgatatagttctccatggtgtggtgtctgttcagatgatccggcgtaatatttaagatcgcgctgatcttcggcgcaaacccatgaatcgtctccagctggaaactgctgatctccgcaacagttacactttgctctgtcatcttcatagcctccatggtgtacggattaccgatatttccaactacaaacacctcactttgatgagccttcataatctcaccaagaagtgtcgtggtggtcgtctttccattcgtccccgtaatagccagtacatctcccctgccatagtgatatgcaagctcgatttctccccagatcaggatcccgtccgccttcatcttctccacaaccggaagatccactggaatacccggacttaaaaccgcaagaccgattttttccatctgatcctccggaaacggtccgaatattatttccgccttactgtcctttggcagacgtctccggatttcttccggatcgagtttttcatttccatcatataagatcgtatcaacgccctcgtgctccagaagcatcaccgcaccaatcccactctttccagagccgaacacgagtacctttttcccgttttttaacattactcttccgtcctttcttcttatagtgccaacagcgcaatcagacacagaatcgccgtgataatggaaaagactgccacgatcctcgtctcagaccatccacagagctcaaaatgatgatgaatcggagccatcttaaaaatccgttttccacctgtcttcttaaaataagtaacctgaatcatcaccgacgccacctctatcagataaatcattccgacaatgatgatgaaaatgggcatctgaagcatatatgccgtggacgccacgaatcctccaagagccagagatccggtgtctcccataaacacactggccggatagacattaaacagaaggaatcccataagcgcacctaccaccgcacaggtgaccggctcaatcccactctttgttcctactgccaccaccgtaaagaatgtagcaacaagcacggtcacactggaggcaagcccatcgagtccatctgtaaaattgacgccgttgaccgtaccgatcactgctataaataacagcggaatggcaagccatcctatattccagtatcttccaccagaaaatggaatcagaagggtcaacggtgtatgagtaacatggatcagataataggcaaataccgcagttatcacaatctgaagggcgaacttctgctttggaaagagtccgtccgagcgcttcatcacaaccttgagataatcatccagaaatccgatcagtccaaacccaagcgttacgaacaagatcggaataatcttcggataatcctttacataaaagagggaggtaactacaatagaagccagaatcatcacgcctcccatggtcggcgtccccgccttctgtagatgagactccaccccctccacacgttctgtctgtttcattttcattttccgtaacatcggaatcacaatcggccccataatcacactcagtacaaatgagatcagaaccggtactacgaatgtaaaatccatatctgcacctcttcatcctttggtttctaaacaggcctatatgcctgcgtaccattataacgtatttgtaccatcaatgcaagtcgaccgccatggctcgctctttctttctgccgcaggctgctcttcttttctgtcacggtcactcttccttttcagactttgcgttctcttgtttttcgatgccaaggtacggcagtacgtcatcaaaaatctcccgcacaaccggggctgcgatcgttccgccataatagattcccttagggtcgtagataacacacattcccagaatctgcggattttcggccggagcaaagccaataaaggaagaaatatatttgttggcgcttcttggcagagtctgggacgtggccgtctttcctccgatactgtatccctcgatataggcgtttttcccggatccgactgaaaccacgctctccaggatgttccgcatcgtctctgacgttttctcagatatgacccttctgccctgtttatccgaaaatgtcttaagcgtcttcccgctctcactgtccagcacttctaccccaaaatgaggcgttaccctctttcctccattgatcaaggaactgactgtggcggccatctgtaccggcgtcacctggaacgactgaccgaatgtcatggtagcaagctctacctccccgatatcttccagccggtgcatgatagtagaagcctcccccggaagatccaccccggtcttttccatcagcccgaactgttcgaaatagtcacagaaccgttccgctccaaggcgtagtccaatttccatgaaaaccgggttacaggaattctggacgccctccacaaacgtctcggcaccgtgcccgcctaccttgtggcaccggatcctccgatcctccacgatcttgtatcccggacagacaaacgtatcatccagatcaacgaccccctcctccagacaggcgctggaggtgatgattttaaaggtagaacccggctcataggtgtcgttgatacacccgtttctccacatctggtttaaaagttcctgcttttcatcctccgaatcatatgtcgttccctccggaagttcaaatggttcgttcagattaaactccggccagttcaccatagcatagatctctccgttctgcggattcatcaggatgatcgccaccttctccgcctgcttttcctccattaccttctgcgccatctgctgggcgtacttctgaatgttataatcgatgctgatccgcaaggtattgccggcagtcggctctgcccggtcctctgcgatcccctccagctccacgcctcttgcgtccgtagtggagagaatcattccattttctcctttcagataatcttcgtacttgacctccagtccgataatcccctgattatcaccccctgtgaagccaagcaccttgctggcaagctcttcgtacggataataccgtttgaaatcttcatccaccttgacgcctgccagattcatctcccggatccggtctccaacttctttttccacgttggttttgattcgttccatagaggaaactttctccacctttttccgtacggtttcttcctccatctccagtgtcccggcaagagctttcgtcactgcgtccgcatcctcgatctgactgtgaatcaccgaaacggtacagaccgtcttattggtagcaagtactttaccgttccggtcgataatctctcctcttgccgccttgatctcccgctcccgttcgtggagagcctcggccttcttctgataatattccgcgtcaaaaatcatcagataacaaagtcttgcaatcagccccagtatcattagcgacgccccgataaacacaatgagaatcttccttttattataggttttattcttcataaaaaacctcacagaagtgattgatatagcttattaatccttctgtgaggttattctatttattccgattttgtaatattcaaatatggaaatgcttctttcataatgtccgcagaaagtcttgtcgccagataacttgccgcctgctgtgccagattcggctcgtccacaacaacgtatatcataacttccggattttcctgcggggcatatccaatgaaagagtttaagttctttccttggcttcgaggcagtttctccgcagtaccggtctttccgccaatagcatacccctctacctgggctgattttccacttccctcttctacgactccaagcatatagtctttcagaatctcgcacgtttcctgggatacggtttttcttgccagcaccggagtcttcgtctccacaacgtccccctgagcattgcggatctctttcaccagatacggttcatagtaattacccccattgatcagtgagcaaaaccccgccgcaagctgtgtcatcgacacattaaaattctgtccaaaagcgttggttcctagatcgatgggctgcatgttatcagccgtgtacagaagattggatgtatccccctctccaggcagatcaatgcctgtgtactctccaaaaccaaagatatgctgataccggcagaagtcctccgcgccgagtgtatctgcaatatgcatcattccgacgttgcaggaattttccagcacttgttttaatgtttctgtcccatgtccgtctgtggcgatacaggaaaccggcttggcaactccttcataggaataggaaccgccgcatacatatgtctcatctccagtcagtttgccggtctcaaatccggccgccatcgtaaacggcttcatcgtggatcccggttcaaacgtatcgctgacgcagaagtttctccacagcgcattaagtgtctccagacgctcctcctcagtcatggcctcctgctcctctgtcgtataatatttcgacagatcccttggctgattcagatcaaaattcgggtaacttgcctcagccagaatagctccagtgtttggatccattatgatcacggctgtgtttttcgtaccctcgccctcacggtagttatcccgcagcctttcatttaattccagaatatgcttctccacgatcgcctgcagattcgcgtcaatcgttgtgacaatggaattgccgtccgtcgggcttttcactacgttctctgagctggatccagacgagagataccctgttttttttccatctgttccgttcagttcgttattataatatgcctccagaccgatcgttccgctgtttcctgaggaagtaaatccgatcacatcacttgccatggttccgtaggggtaggttctcgtataggaatcttccagtgtcacactgacaatatttttgctcttatccatcttcgtctgaaaatcttttccggtctcataatccacatcttttttcaagatcacatagcgactgtccgactcgtcctgcaaaatctccctgagatctgactcatccaagtcaaaccctttgacaagtgcttccactgtggcattgatcttcttattctgataggacgtcttcgtctccaggagtcccgccacatcgagaatcacgttgtaggaacgctcgcttgtagccagaactgtatcatttgtatccagaatatcgccacgtttaaagtggatgatctgactcccgcttcgcatctggctcataacctgcttctggtactcctcccctttgacaagatttaaggcaactgcctttcctgccaaaaaaacaaaagccagtacgattgccgtaaacactcctaccagctttattttcattcttttcggaaattttttatgaaaattctgggattctttttgagttctctttctttccatggaattccccttttcactatgctgttatttatccgttgcttctccatcttccggaatgctttcgtactgtctgattttatgatctcctgcgctttggtatttcacaatctgggaatcctccgcatataccataccaagctccgctgccctttgctgaacctcgtccagattgacggaatttgcgatatgattgtattctgatgtatttttctctttcaggctggtgatctctgtccgcagactttcaatttttcttgtcttctgttccaaatccgcctgggctccaagataatgaaagcagacaaatagtgcgaccgccaccgccccggcaaaaaatgtcacataaccaaagccgagcttcattgccctgcgctggttctttttcgtctgcggactcacagtcctggcctcctcttcgtagtatcctgcctcctgatgtatctgcggtcgtctgacccggacaagattatcatacatatatgcttcgttatgtgttcttcgtttctttcctgatgccatacacgttccctcttttctgtgtctggtacttcacacgatgtttcgtatcagatatgctcgaaaatacgaagcttcgcgctctttgatctgctgttttccactgtctctgtttcccccggaagaattggctttctcgtgatcacctttccttttgacttcttcccacatacacacactggaaaatggctcggacaggtgcacggattctcgtttctgcgaaacgcttcctttacaatccgatcttccagtgaatggaatgtaataatgcagatccttccacctttattaagtaagtcaatcatctcatccaaagattcccttaaaactgtcagttcctgattcagctcaatccggatcgcctgaaacgtcctcttggccggatgacccgacattttctgaaatttcattgggatcgatgcttttataatctctgtaagttctaaagtggttgtaataggacctttttcccgttccattacaatgtgctttgcgatgttcttcgcaaatctatcttctccgtaatcacgaatgatgcgaaaaaggtccatctcactgtatccattgacaatatcagcggctgtctttgcctgccgggtgtccatccgcatatcaagcggcgcatcctttgtgtatgagaatccacgctctgccgtatccaactgataagacgatacgcccagatcgaggacaatcccatccactttgtcaatgcctaattcttttagccgcagcttcatatcacaatagttgctccttacgattgtgactttctccccgaaactgcgaagccggattcctgccgcttcaatcgcggcggcgtcctggtctattccgataaaactccccttgtcacttaactgcttacatacttcaaaagcatgtccgcctccaccaagcgttccatctacgtaaatgccgtctggcttgatgttcagaccatttacgacctcttctaataatactgatttgtgttcaaatgccatggtttcctccttcacctgctacacctaaatgcgaaggcccagatcttccatgtcgccggcgatatcatcgatatccgcctccacttcctcattatgtgcatcccaggctttcttgtcccagatttcaatcttatcaaggacacctgccagtaccacttccttttccagtccggcataagctctcagggcagaagagataagtactcgaccttgcttgtcaagttcgccatcgacagcgcttccaagaaagaaccgtttgaagtctctggcttttttgttggtaagtggtaattcccggagcttatcttcaaaggcgctccattcattgtccggatacacaaataaacagccgtccattccctttgttatcacgaaatgttctcccagactttcgcggaacttagaagggatgatgaggcggccttttgtgtcaatgctatgattgaattctccgttcaacatgcaactcaccttcttccaaaacggggatgtcttcccccattttgtaccactactctccactttctaccacttgaaaccattgtaaaccacacaactacctttttcaagtactttttccaaaatgattcttaataatttcttacctcctttgacccttttcgacactcatttcacacaattaccggaagctctgaaagccataccctgggatgatacacagtttccaaggttcttggcatgcccaggctttagctcgccgccattataaaaaacaatcgctttgtaggattctccgcctgcggtgggctgctctagcgacactttccaattcgccggataacgtattattaatttcgcaaaatcaatttcataaaaacagacatggtctatagccgtttggtaaaattaagtcaccacaaccgaatccatcaaaggaggctatagaaccatgtctgaaaagattatacagctaaatgaggacttaataaagcgatcttgttcgtaacagtgtcgaagaaactttaaacgccctgcccgataaggaagccgccaaattagtcaatactgaaaagtatgagcgctcctctgatcgccagggatatcgttccggtcattataagcggaatctccacacaaccgcaggggaagtggaactgaaggttcttaaactgaaagactaactattaaagtcaagtctgaaataaagattttgtgaatgaattgcggaaacacatttcagatatcgttgtaccttaaaaatcgcataataaacagagcatcatataccggtgctcaatgggagtgttatggaacagaaaaaggttttgcttttttatgtaaggcttaccggttttcccatttcataaatcagccgcacgagtttctttgtaacgtgggtgatggcaacattgtagtgtatctcttcagaaatttatttctgaagagatacgccgaatgtttcgcccaatggcagacgcacttggcagcattaatgagagcaaagcgaagtagcgagacccccgcttttccatgtgggaataagaggattccaactgcccggattgataggtagatgcggaagctccggcgtacgccaggatcttatccggtgaatcaaaacgggaaaatccccgatctcgccaaggatcatggcacccatgcggtaaccaatgccgaggatagtcaggattggagaagcgatctgatccatgatccgtttgatctcagattcgatctctgcaatctcggagtccagttcgccgatcagtttgagagtatgtctcagttccaggaatttcgcgggtatgctggagccaatggaggttcttgcggcatcccgtatttcaatcgctgtatctcgatggtaacgacctttcgaatggtgacaagccaggagacagactacttgagctgggagcgttcctgaactttatcgaaacggtaacgagtgagtgactttagctccttgttgtgatatgacgtttctgagtaggacttcaagttcacatcagacaagagcaacatagcaatggttcgggtatcaaccttatccgttttcgtttttctaaggttgagacttttctgcaaagatttgtttggagagaattcttactgtgtggccttatagaaccacttatttgtgcttgaaagatggaacttacactgatttctatgctgtctaaaactgaagaaagtctttacgactcacctgcccgtgttttgttgtgtagcttctttaagaactattttatcaataacgtagaggattgaaagattttcattactatttgtgccaccaactaaaaggcggaggaatggagacttctatgataaaatctaattcataggagggccttttagttatggcaaaacaatagaaacctgtacacagagtacaaatgacagaaggaaaacgcaacattatccatcagctcctggaggaatacgacattcaatcagcagaggatatccaggaagctttgaaagatcttctcggtggaacaatcaaagaaatgatggaagctgaaatggatgatcacctcggatatgaaaaatctgagcgttcagacaatgatgattaccgaaatggctataagaccaaacaagtcaacagcagatatggaagtatggagatcgaagttcctcaggatcggaaatctacttttgaacctcaggttgtaaagaaacgtcagaaagacatttcggatatcgatcaaaaaatcatttccatgtatgcaaaagggatgaccacacgacagatttcagaaaccatcgaagatatttagggctttgaaacttcagagggatttatttctgatgttacagataagattcttcctcagattgaagactggcagaacagaccacttgatgatgtatatccaatcctctttattgatgcgatccattattctgtgcgcgataatggagttatccgtaagctggccgcatatgtgatccttggcatcaatacgaaaggcaaaaaggaagtacttaccatccaggttggagacaacgagagttcaaaatactggctttctttattaaatgaactaaaaaatcgaggtgtaaaggatatcctgatcctttgtgcggatggacttacgggaataaaagaagccattgctgcggcatttccccaaacagaatatcagagatgtatcgttcatcaggtgagaaacacgctaaaatatgttccggataaagatagaaaagtattcgccacagatttaaaaacaatctatcaggctgcggatgagaaaaatgctttagcagccttggaacgtgtgactgaaaaatggactacaaagtatccgaattctatgaaacgctggaaagataactgggatgcccttgctccaatctttaaattttcagcagtcgtcagaaaggtgatatacacgacaaatgcgatagaatccttgaattctacctatcggaagcttaatcgccagagaagcgtatttcccagtgatacatcccttttgaaggctttgtatctggccacatttgaagccacgaaaaaatggacatctacgcttcggaactgggctcaggtatatggagaattgagtattttgtacgaaggaatgctgccggaataatattaagaatcgctaaaaaacaggcggaaaaaccgcctgctcttgacagatagtgtcaatagtttttcgcaaaatcagaacctagccgtttggcagccggtagtcagccggctatgatatcagacagcagatcctcttctgatttgaaaagatgatccatattcatatagcgtctggctccccaactggttgctgctacatgacgcagtctggcacataccagcatcaaggcactctgcccgtcgggaaaagcgccgattgcttttgtacggcgtttaatctcacggttaaggcgctcaatcgcattattggtccgaatccgggtccaatgctgcgtaggaaaatccatataggtcaaggtttcttcgattccatcgtccaccttcctggcagctttggcaagcttcatggcccggagcttctccgctacctggattgctttttcacgggcagcttccttgctttcctgcgcatggatcgccttgagcataagagctaccgttttcatcttgttccggggtgtacagaaaatatatttctgtaaaaataaacggtacagcgctgatatctggcatccggaaagacttccggaatggtttccagcatgccgaggttcttatcaccgatgatcaggtgtacaccagtaaacccccgttctttcagccatacgaagatagaacgccagctttcacgatcctctttcatgccttccgcagcgccaaggatctcccggcagccatcctggctgacgccaatggcaacgagaacagaaacgttttggatctcgccgccccagctgcgtttcaggtaaacaccatctacgtaaacatacggatatttcccggaaagcggacgggtactccaggtctcgatatgctcataagcctttttattcaggttgctgatggttccgggggatactttcgttccccataaagtctcggtgatatcctccacacgccggacagaaacaccggccagatacatctcgataagagcttcttccacggaagattccctgcggcgatatctttcgatgatggctgtctcgaaagggacccctttcagtttaggaaccttccgttcgacttcccctgcggtagtatggagatttcgcttgtaatagccggagcggtatccctggcggtcagaggagcgctcatatttttcagcgttgactaattcatcggcttccttatcgagcagggcatttaaggtttcttccacactgctgcggacaagatcctttaaatcgtgctttattaaatcttcatttagctgtataatcttatcagacatggttctatagcctcctttgatgggttttgttgtggtgacttaattctaccaaacggctatagacgatgtccattttatgaaattgattttgcgaaattaattatacgtcatctcttgacatgcctttttgcaactgttatatataaagcaagggtgaaaagctgatttttcaagcctttcacccattcttatcatagaagaagcttatttacagacttttcttcatagtctccttttctcaaaagacttcaatattagttactacaatttgaagaaaaatagtttgtcaacagatccttttcttcataccctcgagaattctggctttgaaaaagtccgaattctctgggattgcctcttcctttcctataagggttaaaaatcggtattaactgccccctatatattattatacaagcgaagaacaaattaaatttattgtttcaactacttgccttattgactcgttaaataaataaaaatgatctccgtcaaatttatagtatcgacattgttttttggtataactattccatagagaaattttcttcagaatcacttcatcttccctactaccgtaaaatacagataaatcacattctaaaattggcaactctgtagcttgaaacgtttcaaggattttatagtctgctcgtatgattggtatgaaaatagatgctaaatcagtattatcaaatacttctcttggtgtacctcctagttttagaacttcccttcttagaactgatatgtctgcgtcatggattgttttgcatcttgcttcgcactttggtggtactacactggataaaactatatgtttaggttcgttatattgttgactaataatcatctgtgcaacactatatacgatacaacttcccatgctgtgaccgaataatatatatcttccatttttaataataggccttatttgttcaaatatatcaactattgcctcatccatcgtctggtataatggttcacccagtcgccttcctctccctcttaactcaatcggaataagatttatgttatcttctaaatatttctgccatttataaaaacatgatgagtttcctccagcatggggtatacaaattaagtttatcctattttccatctctcttcggttcctctctctaccaaaacattaaatggtgcattttcaggaattacctcccccagcccttacaatagctgcacggacaaggcaaagactgggatcaatcaaattaccttttatgtgatatagactcactgctataggcagttctgtacagcctagaataaatgcctgctccccctctagtgactgtttgataattaaattctgaaatgcagttccatcatactcataatttccttccttatataccattataaattacatctgtaacgattctctgttcttcatcatccgatacacgtaactttaaattgccttcccatatccacctcccctttcaaaatagacacatctcataaatcttaactacatcttctaattttagtggttcataggcaaatgctaacattccatttgtaaccgctctcttagccataatttcaaacttttcatcattgattccaacttccggtaatgaagcaggtagcctcaatttcctaaagaattcagcagtcatattgatagcgttcctagccatttcatattcgtcaccttccgatatgtcaaatacatttcttgcatattcagcaaactttgctactgttgtgtcattaagcacgtattccatccactttggtagcagaatcgccatgcctacaccatgggtaatgtcataacaggcactcaattcatgctctaacggatgacaagaccacgctgttgcctttcctgcaccaagaataccattcaatccaagagaactagcccataacaagttcgcccttgcttcgtaattatcactttgctcaattgcaatcgggccatatttaatacatgctttgagcataatttctgccatatggttttgtatgaacgtatcttcatcttttgtaaaatagctttctattatatgtgacatagtatctgcaactcctgctgctgttaattctgcaggtactgtgtacgtatatactggatcaagaatagaaacttttggctgcatgtaaaccgaggttgctcctaatttttcctctatctcttcatttgtaataacagcacttccattcatttcggagcctgtaccagcacaggtaacaactgtaatgataggcaatgcctttttgatttcaccagggcaaagcactagatcccatgaatcatcatcatagtaatatccagctgctatcagttttgcagcatcgataacacttccaccacctacagctagtattacttgcacattattctttcttgctaatctaactccttttcgtacatcttcaatccttgggttgggggttacccccgctaattctgaaacatcgtattctgacagcagttccatcaagatctgatacacttcatttttcttaatgcttcccccaccatatacgagcagaatattgctcccgtatgtacttaactcttttggaagattcttaaccattccctttccaaataatactttcgtcgaaatattcaaagtaaagtttctcatctattcctcctaagttttattcttgtctcatactttacgataaaaatcttctgagtttgttggatattcattgatatatggtacgccaatattccatgaacctttcctttcgtcatgaatattaatggagtaccatttgtttatattagcagatccaaaacaaaccttaatctgcatggtagttaaatctgctactatcgaatacaacgttcctaatccatctttatagtagtggcaacatacaccttcaggcatttttttttgtaaaatgtcgcgaattacactttcatttacgtttggaatatgttcttttatggactggtttgctgcttgaaatctcataaccgactgattcattcggtttacattaaacgactccatctctggcagattataatgattggttgaaaccacatagtctactacctgtcttgtaaataacgatctgatatttcccagaccggagctttccgctaaaactgcattgccttgtttatccgctattataaaattcgtatttgctgaaagtggcatatgctttaacagataaactgcttcatcggttgtacgacaattttctatcatacatcgtattgccgtccaaaagcgaagtccacttaattctgtatctgtaccaggtgttgctgcagaaatggtgatagacagtccatgctcatttatcccttcatacctcccaaataggtatactgaaaatccaatatgagctggttttccgttaatcttgcaacacgtgaaccttgtatcatcatctaaagaatactcatagcttcttcctactaaaacatgatgattttctgtcacttttggtaatgctaccatatggcagcatcccccctttactgcatataagttagtatgaaaaataactccatctgatgaaacatgtaatgcatctgaaaagccttcaatttcttcatttaatcctggacaaaattcatcatataatgctctgatttcttttattttgtttttcgtcaatgttgctttatcgcaatagaatggcttggtgtagtactgcatatcggatggatatttctttaggtattcccctctttgccttccaacttcgtagctatcgccttccaaaaatacatattcataattgagtgttcctctttccataaatgcaatcaatatctccttcttaattttatacatacattagtaagcgtcgaatcaatgcttcatccatctcttgggcattctgtaaactcaattttatcctgtctaacatacgattattctgtctaaatatatactttaaattcatattcactactctcttcgctagttcgtaaagtctattagcaattccactcacttctttatattgttcctgattcagaaaaaccttttctagaaagtaatcgacacgcattttcattatctctttatgttcacagtataagaacataatacgtacatctaacaactaagtaatctactaattctgaagagtaatttagctgtatatagtttgtaaaaaacaagtctttaaaagagttctttcgtggctctaggtaatacccaatataataagataacatgtggattacgaaaggaatacgtatcacatcgttccattcaattccatcaactgaacagcatcattcaattccttcctcaagcacctcaatcctcagccacttactattaggcaccacatcataaaatgcttcttactttggattcgttccaacacatgcacagactaacaccgtacccattggtaaaaaagcaaattataggtatactcttgcttcatctaaactatccatcgtgataataatacctttctgcgtcagatgatcattttccttaaaatcttcaacacagacagtaaaacttcctgtcccggaaacggtctgatacaagactacgctcttcttatcttcgttttccggcttaattagtgctaagcttaataaatcatcttccttccactgtttcagtttacagtagtttccagaacgtgatactgagaactgttagcacctttaaaattccaaatcccccttataattgcatcttgtccatcctttaaatggcttgcagtcacaattgccatgaaatcggcatcatgtgtatatgatttaagaataagtctcattaatatccaatatcatccttataacctcctatatagccgcggaatattcgcaatacttttaagcactttttcatgtctactgcattaggatttaccacatctaatcgatttgacataccacatatccttcttctgttgcttcctagtgtaacccatctgttgtttggacatctgcaaagccgttctggaatatgatcgcagaaccattggaacagttccttatcctttccttcaagatagctagccatggccgatatattctcatgtttattaaagtaaatgcatactaaataactgctcctgtctgcatagaaccccaagcagctttttcctttcactgtaaactccaccttccattggaatcctgatgtgatatttctaagaggttttactttcaccttgtatttctcatcttgcagtgcattgataagacgattaatgttcccgttcatttcttctgtaagagtttccataatgtcttctatctctggtataggttgacgtattctcttataatccagacgcagataattcatatatttatacttactgtctggtgcattacacagttccactaatccaataaacattttaggatatttttcgcatgtcataatgtagctattcccacattcccgtagtcccaatcctgtattaagaagaatcattatcctctctttctggtcttttcgaatcttagccatcgatgtatttgcacacgcaattcgataactatcttttgaaatctccagactaaaatcttccattcttatcctagaaacacaaccaagttcataaagaaatttaaaataaaagctgattgattgctgaaattgattacgcaaactggactctttggaatcctgaaaatgctgcttttctacaaggaattttcccttcttctcttttcgctcattactagccatatattcatcgtacttttcagaatcaattttatatactttagggttcttgtataggttaacataaagtcctgtaatatactgatagaactgtaactccccttctttataatcctgtgacgatatatctttcgtatccgctggaataactgattgaaaacctgctaacatctcaactgcatgacgtatggagtactgtgcagaactttcattagcacatttctcctgttcgataaaaagcatatcacccctccttagttaactgttcagcaaacatacttttacagctgttcttgaatataatcaacaatatccttcgctgtgaaaaatttcatgatatagtcatcatctattataacagaaaattcatcttcaaagctcgtcatgatagaaataaactccaacgagttgattcctgctatcccttttaagtctgtttgcagtgtaatattgatatcttcatctttatcttttacaatatcgcgaattatcgataagactctttcttctattttacttcgttccatcataaactcctcctgtttttcaatatattcttaatatctttttatttttttggtagacgttttctcaaattccttatctctaaattcaatacttgttatctgcatgtaggaaggcaatgttcgattcaattcagtaacctgctcatctacatacttcttaatatccgatatttgatgttcctgtacaacctgctcatcgcagaaaattgttgccagtatatgttctgaaccattgatttttctactgcttacaacaacttccttaataacgtcaattttattcagtctagattctaaattctctggtgatacattttttccattggcaagtatgatcagatttttcactcttcctgttataaacaggtaattatcttcatctatatagccaatatcacccgttttgaaccactcacctttcataacttctcgtgtcccctgcgtatcattatagtatcctagcatgatattatcgcctttggccatgatctctcctacttcatgcccattgtaacagccatagttttggctgttatccacttttacttgacagcaagacacaacaggacctacggaatacctctttttacagcaatctggattcgctgacagtaatggtgaacattccgtaattccatatccatgcactacattgattcctatgttatcgaagaaatcaatataatcctgatccaaattggaacctccacatacgattaactttaagttaccaccaaactgctctcggacatttgcaaatagtttcttatagcaggaaaatcccatttttcttagaatgcttgatactttaatcattacttcaaacaatttttcttttttttggtccttgactgctaatataatattctgatacatctgttcgacaaccatcggcacagaaaatagaacagaaggtttcatcaattttaagttgctgcttagatactttaaactgtcatttaaggaaactgatgcgccgaaatagagcatcagaagtatgtcacatgtcatttcataggtatgatacagcggtaaaatggataatgaggaatccttttcatctaatcctagaatcctcttagcactcataacatctgtaataatgtttttatggcttaacataacacctttcgattttcccgtagttccagatgtaaaaacaattacagcaagtagctctgggtctatctcctcttctgtaccaatacattgtacctccttacgtagcttatccatactaagaaaatcttcttttccttctctgcgttccctactttcattgattataatattaatagtattggaatcagacacaagttcttggacattttttacatacctttcttctcctaaaatacaatctacatcagctcgtatcatcagttctgcaagctccgcatcattaagttgtgtgtctaaaggaactgcaactaatcctccatagacaatccctaagtaggatacaatccagtcataagaggttcttcctagaattgctacatgccccgtttgtaaatcaaagttttttaatacttttgctgttttctgcacatcacaaagtaactctttatacgtcttttcaataacctcatttttctctttatatctgattgcgacattatctgaatactgatatcctgtataggtaaccaattcctttatcgaatgtagttttatcccccaatcataaaatggattactatatgtttttctcatccttaattctcctttccatatcttttatgctgcagttaagtaattccactttattcaaaaatactatctaattcctgcgtagatatatttactgtattaaagtccatcgaagtaaaacagtatggattttcctctcttaaaaatgtggttatctgttctatatgattaggtattttctggcagatttcctgcattttttgctctgagcaaaggctgtagctatagtaaatggtaatctgcaatttagaatcgataataatcgcgtttatctccagctggttttccatataattattcatacttacgtcatcccctgtgtcatatgaagcatagcaaaacaattcacgttttagcacagagctgtaatttcctaaataattgagctttataattggctgtattttcttccggttttttgcataccaaccagtaaatactgggtcaacgctaagctgttttgctttttgcatttcttcctttatagtccttagcctttctttctcatctctatccaaattggtaatatgaattggtataatacttgtaaaccagccaatcgttcttgacagatccaattcctggtactccgtatttcttccatgccactccgtatctattaagaaatcctgtccaagcaacggttcaagtgctgtcaaaacagcatctgcaagcacatacaattcacttattgttttattttttcctatctcttctatgaatttttctgtagtctcttttgaaagcatacactctatcttgccattctttagataactttcatccacttttgtatttcttttataaaatttcttgaattcttcgattgcggttaaatcatacttttgagtattgagttcttctctttttacatactctgaccactttctaaaggatgaggtttttaatggaagctttaactgctgcccattgttcttctgtaaaagcagactttccaaatcctcaagcagaattccccatgacagtccatcaatgataagatgatgcatgacaataagtaagagattcttatccttagaaaatcgaatgaaactaacacgaaacagataattatcttcaatgaaaatactagatttttcatagattccgatttttcttactgtttcctctttttcattgtctggcttatctaaaaggtcgtaataaatgatcttgaattctttgcctatgctttgatatttgagcttttgggactcccgatccagatgcattcttaagatatcgtgatgttttattagcatttggaatacattctccagatctgcaacacctacacgttggtctaattctaacaaaaggctctgatggtagtagttcctgtctggatgattcctatcaaaaaactgtgcaatgataggggtcggttctatccaatccgttatctcctcttctttatctggtactgccttcgttatatatctaaccatatcagatatgattggactaaacaggatattagatgccttcagatgaaacccatactctaacatttgggaagatatcctaattgcctgaatagaatccccacccaactgataaaaatcgctttgcatctctatatgttcattagggaaaactgagtgcaatacttcgattaatgttttgcatttctcatcgaggtaatctgtgctactctcatttttctccgccgtttcctcaatctctggcaaagccgatatatttagtttacgatttgttgtaacaggaatttcgtttagttcatagtaaagatgtggaaccatataacctggtaattctcctgtcagatattctacaagctcttgcttcgtaaccgattctcgttttacataatagcagcaaagatattcttttccactagcgtttttcttatgaataacaactgcgtccttgatctgcctcatcttctgtaaacagtttttgatttcatccagctcaatacggtaaccgtgcagcttaatctgctgatctgctcttccacagtattcaatacaatctggggcaatgaacttagcaaggtctcctgtggcatacattctttctcctttggtaaaaggacttttaatgaacttctccttggttaattctggtttatttaaatatcctcttgataatcctggactggagataaacatttcgcctattccgtttaatggcattggcttcttagatggatctaaaataaaaactttcacattatccgctggcttgcctactggtactgcaaaccctttatctttctccttgtcatactggtatatcatgcaaccaacaactgcttcacttggaccatattcattatatatctcaatcttatgactaaatttctctgtaatagtcttacataactctgcggtcaattgctctccaccaactataatccgctcaatctttgactttgagcagtccatatcaaccaataacgacaaatgtgttggcgtcatcttaataatacttaccagattatccagaataattcgattaagaacatacacttcctgatcgtcgcgataaactaccaccttatttccactaattaggggcgtaaaaatagacgtaatcgttaagtcaaaggatagggaagtaaagaaagggaaagccatctcatctcccctgacatacaccttatttgcccagtaaatatagttaacaaggcctttatgttcaatcataactccttttggctcacctgttgtacccgaagtatataggatatatgctaaatcacctggttctggtcttatttgattttgctggctttcttccttatctaactctgaaagttgcatttgacaagattgataataaagtacctcaactccgtacttctctatctgctctttttccccatcacagatgatgatatgtaaagatgcatcctttatcatgaactgaatacgagaactgggataacttatatcaataggaacaaatgtacaattcgctttcatgatacctagtatgaaaatcagtgtttcaattgaatgcttggtcattaatcctatatttcttctttcatttccacatctttttcttaattccgaagctataaaatctgactttctattcagttcttcatacgttaacagctttgttccatcctctacggcaatatgatttggtgtcaacctaacctgctgctcaaacaaatcaattattgtttccgtagaaggatatctagaggaagtattgttaaaatcacataccaacatcttatattcctcttctgacaacatagttatgtcacacactagtatatcccttttctctgcaactgctgatatgatatttcgatactgggagaagaattgtacaatatcttcttcttgataaactgaagttttatagtccacatcaatctctaattgatttccatcagcccaatctctgacgattagttgtaagacataatcctgctcaccattataaaactcttttgcaactgcctccattccggctatctcagttttcaacgtcacattataataattaaaacagttttcataaagtccatcttgtccctgctctcttaattttaactcttttaccagtctattatatgaaaaacgatggttcttaaagcatatcataagttccttctgcaacctacctaccatttgcatgaaggattctcccatatccacgtggaaacggaacggaagggaacttacgaacatgcctactgtatgcctactcatcgccatatttcttcctgaaaacggaatacctacaacaatatcatttgattgaagacttttacttagatagattatatatgctgccaaaagtactgcattcagggtaaaatgagtatccttagcatagtttcgaattctactcgtatcttcctcactccatatccattcttttctcttaccctgattttgcatagagaatgtttttctaattatcggtaaatctgtaagcttatttacccagtattccctatacttttcatattgtttagattgtaaatactccttttccttttcaatataggttacataatcatactcagactcctcgtccgttccttgcttttcttctcctttaaccagtttttcatactcctcactgatttcatctgttatcagctggaacgaccatgcatctgaaattacgtgatgcagttttacaagatagccatagagatattcctcctttttaaaggtaatgaactgatacaagaatccattctctaacggaaatgcagttctcgcctgttgctcaatccattcaaggaaatctttctcatccgctttcttctcgcaaaaatcaatatgttcgatttccttttttgagtctgtagtatagtattgaaaatactcatccgccttcttcacaatatgcgtctgaaaaaccttatttttttgaatgacatgattgatgcttgtctgtagcttttctatctcaacagctccctttatcaacatgtaaccacctatcgtaaacatggacgattctggattaagcatttgtgtaacccatattctttgctgagcttcactcaatggatataattctttctctatcatctgctcctccatttttctacaatcaaaaatatgttctagctctctactatctttccacaatctaatttaataatctgatctgcagtattaaagtagttatcatcatgagtgattacaataacgccttttcctttctttttcagcataggtaaaagctgcatataaaaataatctcgaaataccggatcctgctccgcagcccactcatcgaaaatcatcattggcttatcatcaagacagcttatcacaaatgccagcctctttttctgtcctgttgaaagggataaggattcaaatgctccattatcctttatatgtactttatcctctatcttcaataattctagataagatgcaacttcctcttttctttcttgataaggaataccatataacttttgaaatagatgaaaatcggaatacaccgcagtaaaacatcctagtaatgtaagctgttccacagatttcccatttactagtatctcgccatcttctttacaatataaaccagatactaattttccaagtgtcgatttaccacttccgtttcctccgatgataaatgtaatctgtcctgtctgaaactctgcattgattggtcctagcataaattttctgtcatctttaacttcgtccttgataatgtagtgatatataacatctttcagctgaatagttaatttcttatctggttctattgctggccgttccatcacttcttgtgattcaacagaagattgttctaattcttctaacagtttattaattctcttcatatttacaccaatctgggcatactttgagattgctgttgccaaagcttcgaaaggtcctatcagataaaatacaataaacagattttctcttaatgtattaacgctgatacctttaataagtaatggaaatataaacacaacgaccccaaatactaggttatacataagaacattgtacatattaaagtttaataactttaaggaagctgctttactaaagtcagctgactttcttgtatactgttccatttcctgtttgaaatcctttttccgaaaacagttgaagcataattccttaaatccatacactaaatctcgcatctgcccaaagaaggtttcctgaatgtctctgttcttttcccagtattttgttgcaatcctattggtaataatactaattagtccattaagaagtactatagcagtcgatgctaagaacgcatacgtgcttttcaccgtcaggtaaaggagacaaaatactatggtaagcatatttgagactagatttacaaccacattaggcatctctgaaacggcacttgtatcattatttaatccagaataaattctctcctgccctaaactttcaatcttctggtatggtgcttgtaatatcttttcaatcatttgaattctcttgttatagattaactcattagttatgtaaatcatttttccctgtaggagcttaatggaatatacaaatactacaatagaaaagataaaatatagtagcaattcctttgaatactgaagattcctattaaatgtttcattaattgtaaatataatcaatgcacttgcaacaccatttacaacacttattgggattaatgccatatagttcttttctccatctttagtgaagttaaaggtaagcgaaatatatagcataaaaactacaatcgctatatatactaagatgcaaccccaaattactgtttttgatgcccatactcccactgcactccatggcagacgctcaaagagaatcttcggtaaattataagtacaaagtcctgtaaagattagcagaggaattacaaaaaatatactggcaagcttcatatcctttgcctttacatgaatccttttctttttgaaaatatctatcaatgcttttaataagacaactgcatacagcaaaattactacaatacttactataatgataatagagaaaaacatatcacttgatttataaaagtctgctttgtacttagcgacactttcgccattgtatattttaataatgctatctgcaatatactctgctgcatttgaatcaatattggtcaatatacagaccccaaactgatctttcccctgcatctcaagcatggaagaaaaggtaggatttgacccaccatgttttatgatatctccattcatatctatcagccagcctgatccgtaaaacttatccccttctgctactacctttgtatttccctggtgagacttcataattaattgagtaagttcctctgggatctctactattcccatttgaatctgcatccatcttgccatatcctgtatacttgatacgatatatcctgcagcagtatttccacggtatgctggtggattagaagctacttcccttaagaactgaaacttatatccttgtgctattctgtcttccacttcctcatcatagcgatacatgtgagtgtcagacagcccaagcttatcaaggatctcctgctccataaacgtttcatataattcacctgtaaccgactgaatgatatatgctagaatatcgtagttcacagttgcatactgatacttttctcctgggtaaaaatcaagtttcactccatttaccatcttaactgttttctcaagggaatcttctgcagttccttctggaatataaccaattgtctgaaatgggattccacttgtatgatatagcagattggcaattgtcatgtcgttatcgagattcgtatcaccgtcataactaaatgacaaccaaggaatatattcttttactggatcatcaatggataattttccttcctgttcaagaaggaggattcctaaacccgtaaaagccttactcatggacccaagttcaaataacgtatcctcccctatttgttcctgcatttctcgatcctcataaccatacgtacggtagataacttcatcacctcgtactaaagctaaagaagcacccggcacttttgctttccgcaaagtttttttcactaaatcgtcaaccttttggataaattccttatccacagaagtagaagtcgcagtcttagatgtctcatccgtcacctgatctgcatataccaaactacgacagttcatgaacagaagaatggttatgacagcacacacaatgaaactccttattttcttcatttattatttacttaccttcctaatcattttgtattagcttttctacataattaactatttccataactgtctcaaatttttcataatctaattgatcatctgaaaattcaaatccgaactcatcttcaagtgcaactacaatacgaagatagtaataggagtttgctcccaaatcctgtagttttgcttccagattaatgttttctggctgtatttccagtgtttgtgcaatcacttttttaaatctctcacgtatatcattaaccatatgcctttcacctccttacacccattgacttatgacagactggctattagattttgtgtaaatgacttctcaacctcacaaagttcttttaacttaacggtagtagtgcttagcgaatcctttcgatatcggcctgtcagactatatttttcaataatattcttggcatatctccaaccacggactagctcttcaagtgtttttctatcaataaaatcctctgggaagattctagtcaggcgaaacaatgcggctgtctgtatttttaatatgttaccaaaagaatacaaataaccacttgaagcttttttaaaagtctcctcatcttgtattaccttgtcaaagttttcaataaactttgataaaatatcgaatccttgcattttctcgttctgatgcttcaaaaggttccgtttgataatttccacatattcagttttactgctttcttttactttcttagacgctaactggatatccatataagatgggtattctttatcgataataaaattctctttgatacctacataggcatctataatttcacaatagtttattttcctttcggagaaatccagcgtatttttatcactctgatcaagcacgtacaccgcttcattcttatcgtcgtatccatatacaagcagggtatgaggccaatgctccttgttataagtatcttctcttgttgaaataaaataacaatccactctgataattacaagttttttctccgagattgctcccttaatgttggtaataatatcattgctatgtacaatacgatttatctttaaccctgatttacttaggacattaagcattttctctgataagatatattctgcatcaatattctgagaatcgtcctgcgttgtatacacaaacatgtcattagctagaatacttctaatatccttttggtaatactgaaatactggaaacagggcattatagaaacaatccttatagattaagtcattaaatggtttaatcccctcgatgtactgataactctcatactgcacctccaaatccgtcctcttgttttgctctgctataaattcccgtatactatttctgaatatctcgtcaaacagcttcaaattttcgatctttgtaagtgattctatataatttaagttaatacgaagtttattttctattatgatgctgttaatatcaaacaaaaaatcaactggataatcaggatctacggtatacccaaaatcaaagttagaaattgacataaactcactgtttagattctgatcgaattctcccagataattaaaacgaatgtctgctgcaatatctaatgattctcctagcccatctttcgataaatattttaagacaccataactcagtccaccgcttggaactgcagataaagtttctgctatcttttcaatataggaattgatattatcctctgttatatcgataagaacaggataaactgaagtgaaccagcctacggttctagtaatgtttagattttcgctaacatctcctcttccatgcccttccatttctaccaccaaatgttccttatgcagaagctttcgtaatgccatgacaacacagccaagcataatatgttccatactaacaaactgctcgcttgcttttaaacaaacctgctgtgtctcttcctctgataaaacaatggcaaagtcttttcttgttgtggtcaagcatttttgtaacacttatggctaataaaatcggtggattgcagtttggaatctatcggaactgtaggtagatagggcagaggtggaagtgtggcaacacatggagctgactgttactaataggtcgagggcataaccaaagcaagagcacttagcgaggaggagcgaagcgaaggcagagcttagtacgatgcttgttcgaggaacttagcgaggttctttcgagcatagtgagtcgaacgtccttaaagtggaaagcacagtggtggataggaaagcaggatggaatgtggacttatatgtggttttgaaggtacagagtcttagaaatttggcccggtggctcagttggttagagcgccgccctgtcacggcggaggtcgtgggttcgagtcccatccgggtcgttttgggatcttagctcagctgggagagcatctgccttacaagcagagggtcataggttcgagccctataggtcccattgccaatcggcatttgcctgcgtggcttaatcaaatatatgccaacgtggctcaattggcagagcagctgatttgtaatcagcaggttatcggttcgagtccgatcgttggctctaccagttttattggtattatggatggattcccgagtggccaaagggggcagactgtaaatctgttagcaacgctttcggtggttcgaatccacctccatccacttgcatattttctgagaaatgtgctataatatattataactttataatgacgcggggtggagcagtctggaagctcgtcgggctcataacccgaaggtcgtaggttcaaatcctgcccccgcaattttttttgtccttttttattttagaggataagcccagatagctcagttggtagagcagaggactgaaaatcctcgtgtcgctggttcgattccggctttgggcatttattggtattatggagcattagctcagtcggtagagcacttgacttttaatcaagttgtccggggttcgaatccccgatgcttcatgctctatgacctcatatgagtcgtatgattcatatgaggtctttttcatagatttttctgattgatttcagaacagacggctgattagttacaaattttggcgaaaaagctcaaataaatttgacaaggcaactttctgacgataaactgggattagggaaagaaggagagaggatatgaggagaatctacagaaagatgagggttgcacttctgagtttctgcgttttgactgcggttctgtcaacagggtgttctgcagaggaaacagggcagagcgagatttcagaggaagtctaccagttggggaatcaggaaatacagattgatttgtcagataggttcgagtgtacgaagcagagtgccagtgagattgttctggatggaaaagtgggagaaatcaagatggaatatttgggggaagggatttcttcagaaagttttccaaaatcagagcaggaatgtgcggcgctttatgaagatgttattggcggcacatcctatcagatcgaagaatttcagtcctatgataatgagggactttactatgcgacaatccgttatgatcttgagaatgagatccgctacttgatcgcttccggtaaattcggggcagattacggatgccagatttttgctgttttaaatacgggaaacagagagacggcggaagaaatacagaatgctatttacaatgtaaaggtattctcagaatagagtgtgggagaaatccaagacaaggaataaaacagagataagacacaagaatggctgcccttactaaggggcagcattttttaacaatggtgacgagctaaagcccgatttgtcagtaatattggtgctcgtttacaattccggaatgtgtctgggcattttccggtaaatgcaggaggttcgtatgacactatatgaaaaattaagcggttatgcacaatcagattactacggctttcatatgccgggacacaagagaaataaaatgattatggaagaggagtttccatttcatatagatattacagaaattgagggatttgatgatctacatcattgcgaaggaatacttatggaagcgcagcagagggcggcagccgtctatggtacggaagagacaagatttcttatcaatggaagcactgtagggattctgagcgctctggcgggatgcactagaagaggagatgaagttctgattgccaggaactgtcataaatctgtctaccatgctgctgaaatgtttggactcaagccggtctacatttacccaaggaaagaagacggagattcggtgctaagtgttcagatcagagcgggggatgtagaggagatgatcacggaacacccgggaatccgggcggttatgatagtttctccgtcctatgacggagtagtctcggacatccgggcgattgctgagatagcgcaccaccatgagattccgttgattgtggacgaggctcatggagcacatttcggatttgacgactattttccggaaaatgcgaatagactaggagcagatattgttatacacagtgtacacaagacacttccggcgctgacacagaccgctcttcttcatatgaacggaacactggcggatcggaagcgggtgagacactaccttcacatgttacagtcaagcagtccttcttatgttttgatggcaggcattgacgcttgtgttcatcttctggagacaagggcgcaggaaatttttacgcagtatgtggacaatctggggctgctcagaaaaagtcttaaaaggatggaacatttgcgcctatgtgagccaaagcaaatacgaagttatgacagatcgaagattgtgattgccacagatgggacgagtctgtcaagtagagaactttccagaagactgcttacggattatcatttgcagatggaaatgacgtcgggaagctacgtcttggcgatgacgtccgtggcagataccaaggagggatttcagagattggaaaaagcccttctggagattgacaaacagattgaaacctgtcaggatagtaaaaagattcagacgcagcttccgccagtggagcaaaattatcttccatgcgagatgggggacattcctgaagaacagaagaaaagtgtaagttttgaggactgtgcgggcctggttgctctggaatatgcatatctttatcctccggggagcccgatacttgttccgggtgagcggatctcaatggaggcggctcggattctttgtcaatatcgtgatatgggcttctctattgaagggacgattgaggaaaacagaataggagtgtggataaatgggtaagattttctatttgatggggaaaagttcatcgggaaaagataccatatttaaagaactgaagaaaaggatgacatttcttcatacagttacgatttatacgacgagacccatgcgggagcgggaaagggatggagaagagtacttttttgtgggggaggaaacgcttgagaattttcagagggcgggcagagtgattgagcttagggagtatgatactgtacacggaatctggaaatattttacggcggatgacggaagaatccgcttaaacgaagaggattacctgatgatcggtacgctggagtcttatgaaaagctgtgtggatattttggacagaaacggattgtacctatttatgtggaggtagaggatggagagcggctgtctcgggcacttatgagggagcggcttcaggaggaaccaaagtatgcggaaatgtgcagaagatttctggcagatacaatagatttcagcgaagtgaatctaaaacgatttgggatagacagacgttttcaaaatgtggtgctggaagagtgcattcaagaaataatgctatatattcagaattatttgtgatataattatattggattagatttaccagaatcggggattgacatagaataaagaaggtgaaaataatgacgggatttaaagatgttgttggacgtaaggatttagtatcctatattcagaaagccgttactcagaaacagatttctcacgcctatattttaaatggggagcgcggatccgggaaaaagatgtttgcacaattatttgcgatgacgcttcagtgcgaacgcggaggggcggagccttgtaatgaatgtcattcctgccgtcaggcgctttctggcaatcatccggatatcatccgggtggtgcatgagaagacgaatacaatcagcatagaagaggtgcgtgtgcagatcaataatgatattatgatccggccgtacaatggaaaatataagatctacattgtaccggatgcggacatgatgacggtacaggcacagaatgcattgctcaagacgattgaggaaccgccggagtatgcggtgatttttcttcttacggaaaatgcagaaagtcttttgcctacgattttgtccagatgtgtaatgctaaagatcaaaaatgtaaaagatgcgctcataaagaagtatctgatggagcagatgcagataccggattacaaagcggatgtctgcaccgcctttgcccagggtaatatgggaagggcaattatgctggctacatcggagcattttaatgagatcaaggaagagacgctccagatgatgaagtatatcaaggacatggagcttccggagcttttaaaggcgctcaagagtctttcctcttataaagtggaagtggatgatattctggacctgatcagtgtatggtaccgggacgttttgctttataaggcaacgaaggatatcaatggcgtgattttctcggatcagatgaaatatatcaaagaaagtgccaatacaagctcttacgaggggatcgagacaatccttaaggcactggaaaaggcgaagacaaggctgaaagcaaatgtcaactttgagctggtgatggagcttttgctattgacgataaaggagaactagaatatgacaagaattataggagtccggttccgaccggccggaaagatttattactttgctcctggtaaatttcatataaagaagggacagcaggtgattgtcgaaacggcgcgggggattgagtttggacatgtagtgatgggtccgaaagaagtggaggaagaccagatcacgcagccgttaaagtcagtgatccgccttgcgaataacgaggacagaaagatcgaagaacgtaaccgtgaaaaagagaaagaagcgttccaaatctgcctggagaagattcgcaaacataagctggagatgaaattgattgatgcggaatatacatttgacaataataaagtactgttttattttacggcagacggaagaattgactttcgggagcttgtaaaagatctggcagcggtgttcaggacaaggattgagctcaggcagatcggagttcgtgatgaaacgaaactgcgggggggcatcggtatctgcggaagggagctctgttgccacacctatctttcggagtttgcgccagtttccatcaagatggcgaaagagcagaatctgtctctaaatccgaccaagatttccggtgtgtgtggaagactgatgtgttgtctgacaaatgagcaggagacatatgagaagcttaacagcaggctgccgtccacaggcgatacggtgacaacaccagaaggactgcggggagaagtgcagagtttaagtgtattgaggcagctagtcaaggtagttgtgacactggaaaacgacgagaaagagatacgcgagtataaggcttctgagctgaaattcaagtcacgcagaaagaaaaatgatatgcgcctttccaaagaggaaatgaaagagcttgtagcacttgagaaaaatgaaggagcgtcgaaattggacaatgtgtaagttaaaagatggggagcgcctggatgatctgcagactcatgggtatgagattattcagcatccgggaaagttctgttttggaatggatgctgtgcttttagccagctacgcaaaggtcaaaaggggtgagcgtgctctggacatcggcaccgggacagggatcattcccattttgatgacagtcaagacggacggagaggaatttacaggtttggaaatccaggaggaaagcgcggatatggccagaagaagtgtcgttcacaaccatctggaagacaaaattacgataaagacaggtgatattaaagaagcggcagactactttccggctgcttcttttgacgtcatcacaacaaatccaccctatatgatcgggcagcatgggattcagaatgtcaacagtgccaagacgatcgccagacatgaggtactctgtactttggatgatattttgcgagagagcgcaagacttctgacattccatgggagattctatatggtacatagaccgtttcgtctggcggagatttttacaaagatgacaagttatgggattgagccgaagagaatccgctttgtccatccttatgtggataaggagcccaatatggttctgatcgaggggagtaataagggcagatcacggatgcaggtggatcctccactgattgtctatgaaaaggatggaagttataccggggagcttctcaccaactatgggatgggaagggcaggagaaaagtaaaggaggaactatggcaggaacattatatttgtgtgcgactccgatagggaatctggaagatatgacgttccgtgtgatccggatcttaaaagaagtggatctgattgcggcggaagatacgagaaacagtattaaattgttgaatcactttgagatccgtacacccatgacaagttaccatgaatacaataaaattgaaaaagggagaaaattggtggaaaaattgcaggagggcaaggatgttgcgctcataacagatgccggcactccagggatatcagatccgggagaagagctggtacgcatgtgtaaggaagcaggcatcgctgtcacatcgcttccgggggcgtgtgcctgcattacggcgctgactttgtccggaatgtcgaccagacgatttgcttttgaggcatttttgccacaagataagaaggaacgccgccgtatactggatgaggtgtgtacggagactaggacaatgattttctatgaagcgccgcacagactggtaaagacattaagagaactggagaacactcttggcagccaccggagaatcacggtgtgccgggagcttacaaagaagtacgagactgtatacagcgatagtcttggaggagccgtcaggtattatgaggaagtgccgccaaaaggagaatgtgtactcgtcctggagggaaagagtcaggaggaagtggaggaggaacaaaagaaagggtggatgccactttctgtggaagagcatctgcagatttatttaaaccagggaatggataaaaaggaggctatgaaacggaccgcaaaagacagaggggtaagtaagcgggatatctaccaggaaatgatcgggaaaaaaggtgaaatatgacccaaaagagttcggcaccttgtacagaatccccaaaaatgtttgtgcaatcatgcactagcgtttttgaccatttttttttatactaattacatcgaataaaaacggttaaaatttaggaggaagcaccgatggcaagtttatcattgaaacatattaataaagtttatccaaacggtttcgaggctgttaaagatttcaaccttgaaattgctgataaagaatttatcattttcgtaggaccttcaggatgcggaaaatctacaacccttcgtatggttgccggactggaagagatcacatccggagaactgaaaattggcgacaaagtagtaaacgatgttgagccgaaagacagagatattgcgatggtattccagaactacgctctgtatccacatatgacagtttatgacaacatggcattcggactgaaattaagaaaagttccgaaaccggagattgacaagatggttcgtgaagcagcaaagatccttgatcttgagaaactgcttgaccgtaagccgaaagctctttctggtggacagagacagcgtgttgccatgggacgtgcgatcgttcgtaatccgaaggtattccttatggacgagcctctttccaacttggatgcgaaattaagaggacagatgcgtattgagatctccaaattacatcagagacttggtacaacaatcatctacgtaacacatgaccagacagaggctatgacactcggtacaagaatcgtagttatgaatgctggtgttgttcagcaggtagatactccaagaaaactgtacgatgagccatgcaacctgtttgttgctggattcattggatctcctcagatgaacttcctggatgcaaaatgtgaagtaaatggagacaaagttttattaaatgtaggtccggctaagatcgaacttccgcctgcaaaagcaaagaagcttatcgatggtggatatgctggaaagacggttgtacttggtattcgtccggaagacgtgcacgatgagccaatgttcatcgcatcttctccgaacacagtgatcgaagctacaattcgtgtatatgaaatgcttggtgcagaagtttacttacactttgattacgaaggagctactatgacagctcgtgttgatccaagaacaacagcaagaaacggagatacagtgaaattcgcatttgatgctgaaaagattcacgtatttgacaaagagacggagatgacaatcacaaactaatctgttttaaacataggatagtagatagtatgatggctgccgcgtgggaatatacggcagccattttataccaatgctacttgtttatggaaaatttacagagataaaggttgacattttaagaaaaaatcgttatattaatatctgataaaagggagtaactggcgcttatattaagcgttacaggttcgtcagtacggcagtgattctgcccggatcgagtatgaaacggtgagacttttattgcatgagcgtggtgcagtaaaagtctctttttttatactttacttttctgtatgaatcgcaaatgaaaaaatggtgaaccctataagaaagtggaggaggaaaaaatgaaacagtattatcagatgggatctgatgagaccaggatgcagattaacggctctttggagtcgctttccagtgagcaggtgcgggaacatcagaagaagtacggaccaaatgagcttcaggaagagaagaagaaaagcatcgggatgatttttctggagcagtacaaggatttccttgttatcattctgattatctcggcaatcatctcaggttttctcggggatgcagaaagcgcggcggtaatcctgattgtcatcacaatcaatgcaattcttggaacggtgcagactgtgaaggcggaaaaatctctgaacagtctaaagaagctctccggaccagaggccaaagtagagcgtgatggaactgtcatgcagatcccgtccagggaagtaacagtcggtgatattgtcattctggaagcaggagatcaggttccggcggatggaaggattatcgaacaggcaagtctcaaagtagatgagagcgcactgacaggagaaagcattccggtagagaagagcatagacttgattgagggggaggtgccgcttggcgaccgggtgaacatggtattttccggaagcttcgtcacatacgggagaggaaaatttgttgttactggtattggtatggagacggaagttggaaagattgcatccctcttaaagacgacgtctgagaagagaacaccgctccaggtcaatttggatcagtttggtcagaaactttctatccttattctgattctctgtgcaatcctcatgggaatcaacgtgtggagaggagaatccttcggagatgcatttatgtttgcggttgcgcttgcggttgcggcaattccggaggcattgagttctattgtaacaatcgtactttcttttggtacgcagaagatggcaagagaacatgcgatcatcagaaaactccaggctgtagaaggtctgggcagtgtgtctgttatctgttctgataagacaggaacgctgacacagaataagatgacagtggaagattattacattgcagggcatagaatgtcaaaggaggaagtctccacagagcaggacgaggtcagaaggctgatgcttgcaagtattttatgcaacgatgcaaagaatgtaaacgggcaggagattggggatccgacagagacagctctagtcacctttgcaggaaactgtggaatggatgtggaagagatccggcaaaaatatggaagaatctcggaagtgccatttgacagtgacagaaagctcatgtctaccgtacatgagacgagtgagggtgttatcatgtttgtcaaaggcgctgtggatgttctttctggaagaatgtgcaaagtacgcagaaatggtgaggaagagccgatcacagatgaggaccggaagcacattgccagtgtcaatcaggatttctccagacagggacttagagttctcggatttgcatataagagactggagacaaagacagagattgtagaagatgatgaagatgacctgacattcctcggtctaatctctatgatggatccgccaagagaagagtccaaagctgcggtagcagaatgtatccgggccggaatcaagccggtgatgattacaggagaccacaaggttacggcagcggccattgcaaagaggattggaatccttaaagatgaatccgaggcgtgtgagggtgcggatattgagaccatgtctgacgctgaactgaaagattttgtagaacatatttctgtgtatgcccgtgtttcaccggagcataagattcgaatcgtaaaagcatggcaggagaaaggcaatatcgtatctatgaccggggacggcgtcaacgatgcaccggcactgaagcaggcagatgtaggtgttgccatgggtattacaggaaccgaggtagcaaaggatgctgcatccatggttctgacggatgataactttgccacgattgtcaaggcagtggagaacggaagaaatgtatatagaaatatcaagagttcgattcagtttctgttatccggaaacttcggagcaatccttgcggttctgtacgcatccatcgctggtcttccggttccgttcgctccggttcacctgttgtttatcaatctgttgacagatagtcttccggcgattgcccttggactggagccgcatagaaaagacgttatggatgaaaagccaagacagaaagatgaatccattctgaccagagattttttggctaagattgtgacagaaggactttctattggcgtaatgactatgattgcttttatgattgggtatacaagcgaaggagcactgctcggaagtacgatggcgtttggaacactctgtacatccagacttttccatggatataactgtaaggcagacaggccggtgttgtttaagaaagggttctttaataatatttatctccagggagctttcctgatcgggtttgttctgattacaggagtattgacaattccggcattgcatggcatatttagtgttacaactctcaatataacacagcttttcacggtttatggacttgcgatattaaatattccggtgattcagtgtttaaaagcaatccgttttaaactcagataaaggggactttatatggaattaaacaacgagaatatgaaaaaaataaggcatctgatcgtatttactgcactgattattttgtgtttctggaaatatacgattgtatttcaggcggtcaaatttgtgatcggggttgtgtttcctttcattctcggaggggcgattgcgtttgtattcaatgtgccgatgcatttcatcgaaaacaggctgatccaggaaaagtggaaagaaaaatataaaatagtcaggaaaacggcaagaccggtcagccttgtccttaccattatttttgtgatcggaattgtgggaggcgtcctctttggtgttcttccacaattaacaggtacgattgccaaattaggatacagtattcaaacctttattcctaaagtacaggagtgggcaaacgactggttccacaataataaggaagtgatggcttacgtcaatcaattagagtttaattgggataaggtcattgaagttgcggtagactgggtgtccaacggtgcaggaaatattgtcgagtccggtgtgaccgcggcggtaaatattgtaagtgggtttgcgacgttttttattgcttttgtatttgcctgctatattctacttcagaaggagaaacttggggtgcaggcgaaaaaggttctgtttgcttttgtacagaagggcagggcagaggcggctatcgaggtttgttctctgacataccggacattttccaattttctgacaggacaatgtatggaggcagtaattcttggaacaatgtttgtaattgccatgagtatatttaagatgccgtatgcatggctgatcggaattctgattgcctttactgctctgatcccgatttttggggcgtttattgggtgcgctgtcggtacgtttctgatctttatgattcatccgattcaggcgctatggtttatcgtattgtttctggtattgcagcagattgaaggaaacctgatctatccgcatgtggtaggcaattcggtgggacttccttctatttgggtgctggccgcagtcagcattggcggcagtctgatgggagttgtcggaatgttgattttcattccgatcgtatcggttttatatgcattgtttcgggaaatcgtatatctgaaattaaagaaaaacaatataaaaatcaaagatattcttcaaagcgagaaataatccgcgggattttcacatataatgtggaaaacaaagtgtaggagtcgaagcgatgttgaattctttatgggcggggatgattctgattgggatcatcttcgctgcatttacgggcagaataccggagattacggacgctgccctggactcatccaaggaggcggtgacactttgcattacgatgatcggcgtcatggcattctggatgggattgatggaaattgcgtcgaaggccgggatgattgagaaaggggcgaagatgctcaaaccatttgtgagatttttgtttccggaagttccggaagggcataaagcgggcgaacatattactacaaacattatcgccaacttcctcggccttggatgggccgcgacgcccgcaggtctgaaagctatggaggagcttggaaaactcaatcatggaagccctgtggcgagtaacgccatgtgcaactttctcattttaaatatttcttccctccaattaatcccggtgaatgtcattgcctttcggagccagtacggaagtgtaaatccgactgcgattgtgggagccggaattgtagcgacagcaatcagcaccggaacagcgattgtattttgtaaaattatggatcggaagaagacccggaaaagttaaaacatagagaccattcctagcctttatcttactctcctcatttatttttttataatatgatataattcttcaggaaagtatcagattcagagcgagaaaaagagcagttctgaggaaagttgaactgttctgaatgtgattctttccaattgtaccaagccgccgcgccagcggcttggtacaatatatgtatatggagaaaatcgcattgaaatccaatggaaaattcgggatttttgcaatggatagttcacattacgttttagcctattatttatagaaggtattaaaaaatatgaaaggattgggatgtgtgtatatactgatttagccgaaaaaggttaactaattattacgaacagagatggcactaatattataaaggaagtcttttgcgttacggaatttaaacattcaaaaaaactttgaaaaaaattgggaaaaccgaaagattttttgttttcgttcgtctatataatagagagatataaaagaaagaaacaggcaaaactagaacaccatgggagaaaatagtgtgaaagaaaataaattgagccaaaatcgtggaatagacacaaaaaacaggctcacatagtgaaccaattaaaaggatattcccacctgagtagagaggcgcacctgcacatcaataagcaaacgggtgggtgcatctgatactgatgccgggatgcctttataatcaagtctattgtaacacgaaaacttgaaggtatgaaacactttaattactatttgtgccgccaactgaaaggcggcggaatggagattaagatgaaaaaaatagtcattaatgtggcgaagaagagtgtaggaaagagtattccgtttagcatgttcaaagtcaaaaagcctgataatttcgaagaaatcataaagagagtagaagaagaaagaattaaacaacgtgttaaaaaattttttacaaaatcaaagcaatttaaaaataatattataagttttatgaaaatgctattttggtcgatatttttggaaaatatcttacgccatatatacttagtaattaataaaagttgaaaagtcctttaagtcaaaaaataaatcaaaggacttccatatgaaaatgtcatatattgacaaaactaaaaaaatagtatttagtactcattctatgtgtattgaattcagaatattaagggaagaggttgtcttgcgtacgatccagattaggattttgttttatagtagttttacctttagtaatagatggaattattatgcttttcaaaagcataattgaatgtattaggagaggggcatattaactatacttgcaacactaataccattgcttaagcgaagaggttggaagaagcggttttgaagatcataagaaaatattttagttttagtatttctgttgaatatgaagaggaatggataacagcaaatcaaataaaggaaaaattgcggaaaataaaagaaaatactggaaacgaaaaaccaattttaaaagtggaagaatctactattaaaatgaaaggcgatgataaataaaaatgagatataaaataaaaacaaatccagaggaatttttggtttctgaaattagtaatattcagactactttatcgcaggataaatataaaatttttttattggaaaagaaagggtattcaacatttgatgccattgcttccttgtctagttacttatctatagatcaagctgaggtggggtatgcaggattaaaagatgaggatgggataacgaagcaaaagattagtattccttctaatttaattaatgaaaaacatgtcgaggcttttaataggaagtttatagacagagataaatatatgcatataacatatataggttttactaggaaaaagattgcgataaataatcttttggggaacagttttaaaattcgtataagaaatatggagaagagagaagttgattatcttttaaaagtcagaaaaattaatttaaactatgtcaactattatggcatacaacgatttggtctaccggataaagagaaaaaaacacatttaatagggaaatttttattacaaggagactatgaagaagcatttaaattggcatgtacagttgaggataattttgataaaagcataaattcgtcatattattttgaaaaaatggattttcgaaaaagaagtttttattacaatgcatatagttcctatgtttttaacgaatctctttcaaatttagtgaaagagtatagccaaaatgttcttaatgaggaagaaaatataagcttttactttcctataaatgagaatggaatattaaatatttgggcacataaaaaaatgctacccataaaaaggtattactatgatgaaagtaataatttaactgagaaaaggtctagcagattttgtataagtaattcggtcgttaaaataatacaagttcaagaagatgaaatatatcataagtggagtgcagatatcgaattcatgttgccatcgggaaattatgcaacagttgctattatgcaactggaaaatattatgtcaaatcttttggagaaaagtcatgaaaaatttattgatttctgattttgatggaacattatatcataataatattaatatttataaagaaaatttattatttataaaaaggtgggcaagctctcctgataattatttttcaatagcaacaggtagacttgctagagagatatataatatatgcactaaagaaaacattttatacgagtttattgtatgtaacgaagggagtagcattatatataataaatttgataaaaatgatatatttacatttacagcaagttcatgtttgcaaatttatagatcattaataaaacttgttgaatcgaaacaactcaagtactttttagaaacggatggagagtatggatttattgattgttataatttagatgataaatgtagaaatattgttagagaaaagaaaaaaacaaaatataattatttaaccttcaaagataaaaattcagatataaaaactagtatttttatattaaagattttagatatttcttatgttgatttagtaaaaaaaatattagagaaagagttgggtaatatttgtagtatttcacaagcttatacatatatggcactgatacctaaaaaagcgagtaaagtagaggggattgcaaaggcgttaaaagataataaaaggaaatttgataggatattaatggttggagatagccgaaatgatattgaaagtttaagaaagtatatggggtttacaatcaaaggatctgaagctgaaaagattcttccagaattaccttcggttcaatacctaaatgagatagagaattatttgtaataggttagaaaatcaaagagggggaataatataatggaaaaatatttagccttttcaaaacttacattatcatcgaaggcaatttatagaaaagctgtgctttttgatattttcggcattgctttgtcaatattgctatatttttttttgtggtcaaaagtttatgctggacatgacacaatagcagatttttcgtattatgaaatggttttttatattataatttcgcaaacattggcatcacagttttatggaagtagtggtattaataacaccttatctgagtggatatatgaaggaaatattagtatagaaattttaagaccagtttctttaattgctaatttgttcgctcgtaaactgggagatgtgaaattttttctcatgactaaagcaggtccaattataataatagttatgtttggattttatggattaagaaaagtggacatgccaggtattataaatatatcgttttctgttttgtgtttggtgatatctttaataatagtctttttcttcgaatgtatggtaggttttatttctttttttaccatgaatagtcatggaataagtattgtaaaaaatgctttaatgttactaatgtctggtagcgcaattccatattttatccttggaaatagaattggactatggttaaacttattgccatttagtgggacaatttctatacctatacaaatattattagggaaatacagcgtaatactctctttaagatatatttgtgtgcaactactttggagtttggtgtttggagttataacattattatcttatcaaaaagttatcaaaagagtagttgttcagggaggatgatttttgttgaaaagaaaaggctttttttatttgagcttagggaaagcatatattcgtattggatttcagattttgaaacagtatccattagatatgattctgtcctcattatcgatgctgcttagggactccgtcaatttcgctgctattataacggctataagcattatgggagacatggggaaatggaaggtgtacgaaattgtatttttatatagttttagtatgatgatcgaagcatcgagtcaaatcttttttgatgccatctggtatttggggtctatgataagaaaggggaaattggatattattcttattcgaccggcaggaagcttgtttcagttttttggaagcaaaatacaattgcaggcaagtttaagctttttagtgtcattttttgtatttgtacttagcattgcaaaaatggattatataattaccggaaaaagtataatttgttttatatttttcttgcttttttgtactcttttaaattcttctattttaggaatttttaactgtgcgaatttttggctgataaatgcaggagaaatatctagtatagtttacaaactgcgagatttttccaaatatccgttatttttattccctgtttgggtaattaatataataacctatgtgattccgtttgcgaccacaagttattatcctacgacattcttgctttttggagaaaacaataatattatcggattgataattggtgaaacaatattttttttcagtgtttttgttcttatttggagaagagggataggaacctattcaagtacaggtacttgaaatggcaatgaattttaataaaaaggggactcataacatggtagaagtaaaagatttgtataaagaatatagtataaaaaaaagaggagcaacccattattttttgaaaaggtcagagagaactataattaaagcggttgaccatgtgagttttattgtgaatcaaggtgaagctgttggctatgtcggtccgaatggaagtgggaaatcgactactataaaaatgttaacaggtgtattgcaaccaacttctggagaaatccgagtaaacggcattgatcccagtaagaatagaatagaaaacaataggaatattggagtcgtgtttggaaatcgttcgcagctatggtgggatgtaccaattattgagtcttttggatttttacaaaaactatatcaaattcctgattcgatttacaaaaataatttggagtattttgttgataaattagaattacaaaatattattaatcgaccagaaagacagttatcgtttggacagcgtattagatgtaatatagtggcagcttttttgcataatccggcagttgtgtatttggatgaacctacgattggattagatcttgaatcaaaagagcggatgagaaacattattaataaaataaataaagagagggaaacaacgatatttattacttcgcatgatttgttggatatagaattgctttgtaatagattgttaattattgataatggaaagatcattactgatactgatttcgataatatgttaaaaatttataataggaagcaaatttttaaatgtagagtaattgataaattaatagatatcccgatgaatttgaaaaaagatatcaaagtaaggagattagaggggaatcatctagaagttgagtttgataatcaaaaaatagatataaaagaattacttgaagaactttcaaggtatgtttctttctcggatgtttctatagaaagtatgtctatagaagatattgtaaaaaaaatattgataagaaaggaacagtagatatgcattttatagtactaatgatgtcaatttttctattaattggaatcataagaggcatattaagaataaaagatacgaaaacgtcgctgaaaaattatactgataaactaaaaggcaatatcgtaagagagttttctgatattgatattattattccagtttataacgaacaaaaaattattaaacagtcaataaacaattttttgccattaatagaaaaaggtgtacgtgttacatacgttacgactcaaaaagaagagagttctcctacgactaaggaactattgagaaaatatatagcggaatatcatctcgtggggaagtgcatgattgttgattatcctagtaaaaaaggtgtgatgtcacaccaattaaatttcgcaataaaacaaataaaagagaataggattatttgtatatataatgttgactcaaggattgatataagaactattgagtacatattggaaaataaggatatattatctgaaggagtatttcaacaatatagtttcttctcacataaaaaagaaaatggagtattaataaattcagcaattgcatggcaaaacagatggacaatcggatatgaatatccaaaggcgttgaaggaaaagaatgggaaaaaatggtacaattttaactatgtaattggtcatggcttaatttttacaagaagaatgtacgataaatttggtggattttcagaagaagaaattaatgaagataatgtgctggggtataagttacacttgaaaaatataagaatcaccccggttcctatctttgaaaatgctgattttgcttcgagtttgggaatctatctaaagcaacagtcaacatggtttaacgggccggcatatgcttttaaatacgcgtataaatattatcaaaatgaaaaaaacgatttaggcaatataacattagtgtcaatttccaactttaaaaacgctttaaattgggctcttttacctattggattggatatatgtttaatatatttagttgttaatagtcaaatacttacttttatattattcctattgctagttgtgatatatgctacagtattggattttcttagtgaaaaagttttggtatcgcatggatatctaaaaaagcaaaataaagcttcttactttttcgatacttgtttccttttagggatacattttgttggtcctttaattacaattacaaaaattttatttagaaagaattctatatctaacaagtataaaacagaaaaatcataaggactaaaaggttttgaataaattaggagagaaaatatgaaaaataaaaagaaaagcattttattttttaatgcaagaagaagagtaaatatggcaaaaaaaatgattgagtatttaaagaatcggtatacggaataccaattaattagttcagatacagattatttggatcccattagctatgtaacagatgactttgtagtattgccttcaatagaaagccaagaatttgaaagtgtatttttggaagtcataaagaaaaaaaatatagttggtataataatgtggaatgataaagacttcgcagctatagaaaaaatgcgtttgaaaatcgagaaattgggatgtaaaattcttatgcctaaagagaaaaaatacgaaatatgcaataacaaaatgttaacagataagtttttacggacacatgctctttacactccacaaatttatgagaatccagataagattaagaaatatccagtaattataaaacctaagaatggggctggatgtgtggatgtttataaagcggataatctagaagaagcaatagtcttttataaaaaagtgccaaatcccattattcaagagtatattgaaggagttcattatacagtagacacgtattttgatcggtgcgatggtgtgttatgtagtgtgccaaggaaaagaataaaagttcgtgaggcagaagtgatgattgccaaaatagaaatgcaagaagaggtaatgaatgtagcacaacaactaacgaaattcttttcggaagaaggcccaatgaatatacaggtaattttatctgttgatgatggaaaaccatatataatagatattcattgtagaattggtggaggaagcgaattgtcaatagaaggtggagttccattacatgaatggataattgatgatattattggaggggaaaaaagaatacaatatattgttaatgacggattgattatgacaagatactttgatgccttttttataaatgaaaatagtagtataaaaaataatattaaaagataataaggagtaagtatggataagagtaaattgattttaaaagttaaaagttatttaaataacttgccagaggaaatttttgataagaattatttaacaacagcatctgtgtttttgtcgggttcaacaggttggggaattaaagaaggatttgatgagatagcagattgggatttacatattattttagacaatattagttatgaacattataagaaaaagtacggggagcatcatgttatagatgatcaacaacatcaaccaaaagtttttgctcagattagaagtataagctggctcgatataagattacaaaatattcaaaatgctgattgtacatacttatggatatataataacgctttgctaatacaagacaatttacatattgaagagaaaattgacgaatggaatagtttctttaaaaataatattgaagaaattttaaaatatcattttgttacatttgctgttagacgattagatgcggtatctgctataaagagaaatactgttattggaactaatatttctaaaatagaaatgataaaggaagcattgattatcatatctttacttcatcagtctccgtatccatataataaatggatggaaaagtatgttttgcaattgggtgaagacggagaaaagtgtgtggagctatgtaagagatgtattttcgaaataaattttgaaagtaatgcacgtgttctaaaaaattttcttgtggcagaaataaaaaagcaagttggcaatctaccttggcttgatgaatggtggaaatataatgaaaacccaccagtggtgtatatcagataataggaggagatcatgggatattgggcatcttttattgctttggatttagaaaaaatagaagccaataaaatagtaagggaaatgaaggataagttaaaaaaatataataatattatttcatggcataatccaaattatttgcatttaacactaaattattttgattggcttgaggaaacacaaataggaataattgaaaaactgttgacagaagtacaaaataaaattccagataagattttaattaaggatgagattatttgtattggtggaaacgaaaataaatatgtagctttagaaatagataaaaaaaatttgattccgttaaaaaaagacatggatactttattgattaaacaccgaattgattataaaattcaggaatttaggccgcatatatcattgggaagaattaagaaaggaagtctaattaagctaaaaaatatagaacaagctataggggttaaaggaatttctctatatgaaagtaaggaatatagtatttcaattatgagtagatgtaagcagtataataaaaagtaaagtaatttaagaaatgaaagatatatgttatgggaaaaattgttgttacaacaggcggaaatggcactttgggtaaaagtgttgtaaagaaattaataaaagaggggtattttgttatttctttagtgcatacacttagtgatgagaaaaaagtaaatatattagaagtagaaactgatctttcagatattaacgccatacaaagaagtatagagagagtaaagctaattattagtaaaatagaaatagaaagtttaagtattatacatatggctggtatttacgagaagcaaaagtttcctgtaaagataggtgatatgcaaaaatggaatgaaattttttgggttaatacgttttctttttatttcatagtttctgaattggttgatttatttaaattaataagaagaggtaatataattgcagtatctagtaatctgacgaaacttgttaacaatgatactgcagcatatataggggctaaagcagcattagaaaaaattactgttcaattagcatatcaattgggagaatataatatatgctgtaatattatttgtccaggctttttcttcagtgctatgagtaataatattccattaaaggttttagaagaaattaaaaagaatacaccgctaaatcaagtggtaacagaagaaacaattgctacagtcattttagatattttatgcagtaagaatttagggatgactggacagatcattacggtggatggagggaatacaattgggtttgcaaagaattaaatttcctaaaattatagagtttcaaactcagacattatgtaacgggcgatgcacaatttgtccttatgaacaggtaaaaaaaataatcccatattttagaatgtcagatgaaaaagtgaacttgttaataaaagaattagcagaacataaagaagatatagaaagagttgtaccgtatctaaataacgaaccatttttagataaaagatgtatatctatattgcgaagactaaagaagaatcactttatagagttatcaacaaatgcatcattattaagtaaagaagttgcagaaactattgtaaatgaaaagctagttgatgattttagaattagtttttttggagggacgaaagaaagctattcgaggctaatgcggggattgcaatttgaaaaggttgttgagaatatacagtactttttagcaattaatcgcagaaatatcaatacacagattactatgatattattgccttggttagatatgaagaagagtattgaggaagtaaaaaatttatttccgaatgaaaatattgttacctttggttatcttgatagggcggggaataacaaaatattcagaaataatttatgtatgtatgaaaaagataagattaaattgtgcgggtgtaatctggagcgtccatttgaaagaatgtgtattatgtctaatggaaatgtaattttatgttctcaggactggaaaaatgaaatcgttcaagggaatatattcgaaacttccatatcagaagtatggaatagcaatgaatcaattaatataaaaaaaatggtaaagggagaggttgaaagctccgacaattttttgtgtaaacgttgtaaattggcaaaaataaaagtagaagatagaatggttttgaattttgcgggcgataaatatatggatgaatgggatagaaaaagatatgaatacaaagattaatattttaatgcttacgcctgattatactcctgtatatagtggggtagggacacatgttgtcaatttatgtaaaaatttgtataaaagtaaacaatgcaatatttatgtagtagttatacgtatggctacaatagaagaagcaaaaataaaaaatagtacaaagagattaaaaaaaatagtaaaagaaggaataacaatatttgaagtttttattggtgattttactaaaagatattataaacgttttggaaaacaggctaatataagggaattagactacattttgccagacggaatgctactagaagaaattgttgagtgtttaagaaaagaaaaattacatatagatattatacataatcatagttttcataattcggtattttgcaagctattagcacaatatctagattgtcctcttatatttacaatacatacaaattataataacaaaaagcatcaaaaatcattaaaaaaatatctatgggaacacagtattaaaagctccaattgctgtattttgttgagtaatattatgaaagaagagattggaaatatattaggagacataccatgtgaagttatttataattctatagatatagatgctcaaaacagttatattgaaggcgattatgaaagaagaaacgatttattatactgtggacgattaagtcgagggaaaaatgttctacaattatttgaagctataaaagaactaattactattgaagaatttaaagatataaaattgtatgtggcaggggaaggtggacagcgtggaaatttagaaaagtatattaaagaaaatcaattatcaaaaaatattattatgctaggaagaattacacaaaaagaattaaatgagtactatagacaagtccgtctaacaattattccgagtaaaagagaagtttttaacacggtcgctttagaggcaagtagtaagggatgttcgcttcttttatctccgttagattcttttaaagaaatgtttggtgaaaataggatcattttttttgataaattcaatgcacagagtatttacgaaaaaataaaaaaatactattttgatatagaaactttagactatttcgccaagaaagcttttcgacatgtaaaaaaatgctatgcttgggaaaagaattgcatgaaaattatgagtttatatcaaagggtaattagtgaatatcaaagagaggttgatattgaatcaagggaacaaaaggtaattgtgtggctagatgactaaaaggtaaagaggaaagtgatgaggtgtatagcgagacgcgaattctttgtaataaatatagaatgtgaatataaacaatatcatcaaataaaaaaggaactgattccgtattttgaattaactatagaaaaagaaaataaatgtaattggtgcatttcattagaaaatccaaagaagagttatgatgatttatatagaatcagagaaaaaaaaggaataggaataaaaaaaatagaatttgcaattagcaataagcgaaagacaatatatataacagaacctaatgatatattaatgaaaatatataccgtttctagaataattagagatatgtttagagctgaattggtaaggagagggggaattccaattcatggggggctggtaaagaatgggcaatatggaattggagtaattggggaaagaaaatcgggaaaaacaactacaatattggcattattagcaggaggatttgaatatatcacgaatgatgatgctatcatatgttgtgataataatgctataataggatatggttctaaccgttctatttctattaggagagacacaatattgtttttagatagaaagatacaagatgtggtagctttacgacattctaactatttaaataatactgaacttgcaaatgaagctgttttcataaaaccacgagagctaaataatatgagggtatgtggtaaagtagagaatttaatttttatttttccgagttttgatgatttacaagaaaaaccgatattattaccgatctctaattatatgataagagaatttttaattaagaatttagaagatactactatgaattattttcctcaattattaaatggacttgggtataaaagaatagataaaaatcaatatcttgaacgattacgtatgctaccaattgatcaaaataaaggttttatgctaaaacaaaatttatcgaatcatacagatgcagtgccgataataaaagaagttatgcactagagaatattttaatagaaaaagttataaaaaacggtaaaaactttttagtcctaacttgacaccagccaatttcctcggtcttggatgggccgcgacgtccgcaggtctgaaagctatggaggagcttggaaaactcaatcatggaagccctgtggcgagtaacgccatgtgcaactttctcattttaaatatttcttccctccaattaatcccggtgaatgtcattgcctttcggagccagtacggaagtgtaaatccgactgtgattgtaggggcggggattgtggcgacggctatcagtacaggagtagcgattatattctgtaagatcatggatcgaaaaaatacccggagagcgtaaagttctccgggattttacttttctttctttgaatttgtcagtgtaataacagtagagaaaacatgactttgatcatcgtaggaaaattcatagtttccctcatattttttcactacacggagaacacttttcagtccggtaccgtgaatgccatttggaaatttttgcgtttttaaacggccttttgtatttatggatggtttctgcatacacgaatttttcacggaaagtagaagcagattatgagactttgaaaaatcagcatatatttcgataaaagcattcggatagccagtggcagcttctactgcattgtcaagaaggttacaaaaaagagaagtcatgtcatatttatccataaatgacaaggcctgctttcgtatatcgatattcaatgtaatatgaaaatgttcacatctttgcagataacggttgaaaacagcgttcagaagtcattctcgcaaacgcgcatagaaactttgagttgagaagaatgagtaagactttctatgtagtcgctgattttttgattttcatgttcatgattcaataaagaaattgcataaaggtgtttcttgatatcgtgaatcacaagtttttgggcatctgtttgttcggccatcatctgataaaattggaccagatcggattccttttgcatttgtagatgcatttgtgtaaactcctcgtttttcctcaatgtgtaggagaagagaaagtagacaaatatatttactattaaaagcaaaaggccaaagcattaagaagaatattttgggcaaaggagagtagaaataaaatcatataaagcaggaaaaaaacattccattgttttgctgccgaacgccttggaacaaataatgtgtcacaatattgcttcaaaatgaaagcttctatacagtaaatgagaaaatagaatagagaaatcaacatcgtagtttcggtcctttattttgtgctatctaagtataataaataagtatttttaaataaggtatattttcttcgggttaagtaagcttgaaatcgattatcatataaataaactgtgtcgtgagtaaaatgacacacatatttaagattgatgagaaaacttttatgtgtttggaagaacgataatctggctaatttatcaacccaataattcatagagtgaatagaaatataagagccattagttgtataaacagttatcttacggtcacgagcttcaacaaaaataatatcattagtataaacagtataaacttcagacttggtttcaattgttatatggagagattgagcattagaaaaagataataacatgtggatttaattcctttaatttagcaacggtggtaattccactcatcccagacaattcaatatcgagaaacacaatatcaggatgatgctgacttaaaaggagaatttcgcctgagtagcaaggaataagagtgggacattttaatttgtttttttgaaatattcttgaataaaggaaatatatattgtattctaggagaaaatggatctggaaaaacaacactaatagatattcttatcggtctgttcatagatgagtatgaaggggaaattttatacaaccatataaatatcaaagatattgatatggtaaagcagcgagcttgtaatatttcaatcttagaacaggatccatatgtattagaagggagcgttgaagataatatttattcgaccgtatatcacaatgtaaaaaaataccgccaaagaattcttgataaagagcttggaaatatctacagtaatggtataggaatttcgggtggcaaaaaaaaataggtattttgagaatactttctaaggatagtgatgttatgatacttgacgaaccaacatcagcacttgaacaagaaagtcaatatgctgtttggaggttattaaaagaaattaaaaaggaaaaaattataattgttattagtcatgatcaaaacattagtcaatttgcaaaccaaattataaatttggataaaaataatttggtaagaaagcttcaagcatgatttaatttaaagggatgatgaaagaaatatctcaggtatatttggattattgctaactggggtatttgtaaaatctaaaaatatttgagatgcctgaaatgaataggtgagcaaaaagaaagataatcaaatcaattttattagtattctgggaaaattttggaacaggtgtacattttcgtcgtaatattcaaattttgcgattaatatgtgaacagaagtagataatcgataaagagaattgtgttccggctgagaagaacgcttataattatattagtaacgaggcccatccttcggggatgggcgattcggtggaaaaggattatgttttgacgaaatttgttaaaatataaccagcagtaaacagtactttctagcgtgataataactgttgtggcttaaagaaaaagctccggattctataagccggggccagagggaataaagtgaaaaaatgccgtgaatttgagtctaacttgcagaaaggcaatgttgtagtatgaaaataaataagaaaaatagtatttctttattattggtagtttttacaacgattattataggtcttacagcataccagtcatccaattattccggtcagatttatttatatggcgaaggccatgctgtgccttctattcttgataaggaatttgaattatggaatcaatattataatgaaaatggaatgcgttatttatttgtggagtttccattttattgttcggaatttttgaatctttggatgcaggaagataatgatgatatattagacgaaatgtgggaagagatagctggaactttaggtgcaacaggagcaaataaagagttttataaaaaaataaagaaagcatgtccggaaacaattttttacggaacggatgttggacataagtatgatactttgggtgaacaatatcttagttatctcagagaacacgggcaagaaaactcagataactataaacgggcacaggaaattataaatcaaggaaaaatttacagtgaaaaaaatcaggaaaatgcttttacctatcgagaaaatatgatggttgagaattttatatggtcacttaatcaactaaaacatgaagatattatggggatctatggagctgcgcatatcacaatgaatgaggaagatgactactcaaatctaatcagtgttcctaatatggcaacacaacttactgacaaattctcccgaaaaatatatacggaagatttatcagcaaaagctgatacttccaacccatggaaaacaggggcgcttatgattaacggaaaagagtaccaggttattttatggaatgaaatatggttaaatagaaagagtaattcttatgattctgttgaggtatgggagctgaaagaaggtactgaagattttaataatatacccgtaggagatcggacgataccggattcatcctttttgtttccgacggagataaaatatggaaaaatatatgtattagattattatactgatgatgagtttaaagaaaggcaaatttttcgcagtgacaataaatctatggatgacggaagcatcatagcaagagaattattgtataaatgaaatttgcggagaagaatatgatagaaaatttaatgatccagaaatttaagaagtgatgatcaaaatatatatgatattttataaagatttttagtcctaacttgacaccagccaatttcctcggtcttggatgggccgcgacgcccgcaggtctgaaagctatggaggagcttggaaaactcaatcatggaagccctgtggcgagtaacgccatgtgcaactttctcattttaaatatttcttccctccaattaatcccggtgaatgtcattgcttttcgcagccagtacgggagtgtggatccaacggcgatcgtgggggcggggattgtagcgacggctatcagcacgggaacggcaattatattttgcaagatcatggatcgaaaaaatacccggagagcgtaaagttctccgggtatttatgttaattcagcaatacaaaaagccaacatttggacatatttatccaacatcttgaactggaataaaagagaagaatgattataatagaggtaaatgaaaaacgaaataacgatccgaaaatcaaaggagaaggaggaaaacagatggcaatttgttttcgtgaaacggcaaaagagttccatctttacaatgaaaaaatcagttacattttgaccgtgttggagaatgggcagctcggacatctgtattttgggaaaaggttaaaagacagagaaagctttgcgcatatgttgaatttccgggcaagaccaatgtcggtctgcgcttttgaacataatctggatttttccatggagcatatcaaacaggaatatccagtttacggagcaggagatatgagatatccggctattgaagtgcagcaggaaaatggcagcaggatatctgagtttatctatcagggacatcgcatttacaaagggaagccggaactggagggccttccggcaacctatgtggaacaggatgacgaggcggatacactggaactttatttaaaagatcagcttacgggaaccgaaatgatactgttttatacgatttttgtcaatgtcccggctattgcgagaagtgctaaaatcatgcagactggagaagaggaaattgttttgaaccgggtgatgagtgtaagcgtagattttccggacaaagaatttgaaatgatagaactgaccggggcatggtcaagagagagatctgtgaaaataaggaagcttgagcacggtacgcagtctgtctatagtatgaggggatgcagtagtcatcattataatccgtttttagctttaaaacgtcgtgagaccacagagggaaatggagaagtgtatgggttcagcctcgtttacagtgggaatttcctggcgcaggcagatgtggatacttatgatacaacaagaatcacgatgggaatccacccggataccttttcctggacgttgaaaaaaggggagagttttcagacgccggaggcggtgttggtgtattcggaccagggattaaatggaatgagtcaggcatatcatactctttacagaagccgccttgcgaaaggatactggagagataaggaacggccgattctgatcaataattgggaagcaacatattttgattttgatgaagagaaaattatgagtattgttaaaacagcaaagagtcttggagtggagctgtttgtgttggatgacggttggtttggcgaaagaaatgacgatactcgttcccttggagactggtatccgaatctggagaaacttccggatggaatcacgggaattgcgaaaagagtggaagcagaaggaatgaagttcggtctgtggttcgagccggagatggtgaataagaacagccgtctttacagggaacacccggactggatcctgggagataaagggaggagactgtcccatggaagaaatcagtatgtgcttgacttctcgcgggatgaagtggtggatgccatatttggacaaatgtacaaggttttaagcgaagcgccgatttcctatgttaaatgggatatgaatcggagtatgtctgaggtctactctgcgggcgtcggatcgggagatcaggggaaagtgctccatcggtatattttaggtgtataccggctttatgacatgctgacaaaggcatttccgaagatcttgtttgagtcttgtgcaagcggaggcggacggtttgatccgggccttttgtattatgcgccacagtgttggacatcggacgatacggatgcggtggagcgctgtaagatccagtatgggacttcactggtctacccggtaagtagtatgggatctcatgtgtctgccgtgccaaatcatcagcttcttaggaatacatcgctggagatgcgggctaatgtggcgtatttcgggacttttgggtatgaactggatccgaacagactgacagaggaagagaaagaagaggtcaaagagcagattggatttatgaaaaaatatcggcgtctgatccaattcggtactttttaccgacttgtcagtccttttgaagggaatgaaatggcatggatggtcgtgtcagaggatcaaaggaatgcgattgtaggatattaccggatattgcagacagttaatggaccgtacagaaagatccgtcttcagggcctggatccggataaaatatatcatgtctccagaattgaagaagatctttacggtgacgaacttttgtggtacggactggatgtatccgatgcttcctccggggagaaccgggaggaatataatggaagaaacggggattatcaatccaaattgtttcttttgagctcgatcgaataggggttcactttcttaaactgacggtagccggagggactgataccgttgaccttgcgaaaggctttggaaaaagagaatgtgctgcaatacccgcaggaatatgcgatatgttcaatggggaggctggtattctgcagcagttcacaggcctttgtcattcgatacttgacgagaaattgctgtggagacaaatgcactgttttcaaaaaaagttctgtcaggtaactgcggtttagggagagaaagtctgcgatttcttggacggatatcggattctgataatttttgtaaatataagagatggcctgactgacatagacgtccgcaatctttttccggctcttagtcttgtaatcggagccctcaatcagaagagccagaaactgaagcaaaactccctggatgtaaatttcattctgtaagctcatcttatggtgagcaatcatatccaggacatatttttttgctttttccggatcagggcaggtaaagaccgggtgatccggagatgttccgatgagctggaaatatcgttcgatatcggagccgtcaatggcgacccagacgtagctccacggctctgtctcatcggcctggtagaaggtgagtctgtcgggccgaatcaaaaagccctgccctgtttcgatagcataactgctttcaccggagtaaaaagttccctttccttttgtgcatacgtgaaatatgtaagaatcccggatggcaggtccataggaatagaggggttggcagtcttgtattccgcagaaaagcatatagatttcctggaataggtttgtattatattccgtgtaagttcgcaattcatccacagcctttacctcctacgtttttcttgagtgtatcacgggaaaatatgattgtaaacaaaaaaggattgcataaagacagacaagccagtagaatagaaaaatatgagcacatgagaaaaaaagggagaaacagccatggaaaacaatatgacaacaggaaacccgggaaaactgatagttcgatttacgttaccggtttttattggaaatgtgtttcaacaattttatagtatggtagatgcggtgattgtcggaaaatttgtcggtacgaaggctttggccggcgttggagctacagggacaatcaattttcttattattggatttttgcttggactgacggcgggttttactgttttgacagctcagaaatatggtgcgggtgatctgggggccatgagaaagacggtagcgtccgctgctattttgtcactggttgtatcggtagtgatgacagccgcgagtgttatatttatgaagaatctcctgcgtttgatgaatacgccggaagatatttttgactatgcttatgaatatattgtcatcatctgcgccgggatttttgcccaggtactctacaatttgctgtccagtgtgctgcgtgctcttggcaacagccggactccgttgtattttctgattttagccgcccttttgaatgtggttctggacctggtatttattgtctgcttccacatgggaccggcaggggcggcgtatgcgactgtgattgcacaagggatatccggagcagcatgtttgctttacatctggaaagcagttccacagcttcatcttcataagggagactggaaggtggaaggcagcctgttaaaaacccagatgcggattggatttcccatggcgctgcaatattctataacagcgattggaaccatgatggtacagtctgctttgaacctgctcggatccatttcagtggcggcctttacggcggcaagtaagatcgaacagattgtgacccaggcgtatgtggcgcttggaacggcgatggcaacttactgtgcccagaatatgggggcgggtgatgttcaaagaatccggcatggatttcgttcagcgacaattcttggctcagtgtactcggttgtggctgcggtactgatggtcagtgtgggccactatctgacctatcttttcgtggaggcggctgatgtgccgaaagtgattggagaggtacggacgtatctgatttgtgtatcggtcttcttcattccacttacagttgtcaacctgtaccggaacggaatacaggggatgggatatggatttctgccgatgacggccggaattgccgagctggtcggaagaggagttgtggcggtgattgcgtcctggcagagaagttatgtcggtgtatgtctcgcaagtccgatggcctgggtgcttgcgggggcccttctgttatggatgtactttagaattatgaggaatctggatcaaaatccgtcggcctgattcataaaaaaagagccggagtgcgtataataaagggacgatatgcaaaggagaacggaacatgggttttgtattattcctctctcagtacatcgtcccttttttgattttttcgattctggtaaccggcatactggagcgggtacaagtctatgagacttttatcaagggggcgaaggacggattttatacggtgctgaaaatcatgccgacgctgatcggactcatggtggcggtgggggtgctgcgggcttccggctttctggagttcttgtccgggcttctcggacagtggacgcagagaatcggatttccaggagaattggtgccgctttctgtcgtaaagatgttttcttcgtccgcagcgaccgggcttctgacagatctctacaaagagtttggcacagattcttatatcgggcgcatcgcatccatctcaatggcatgtacagagacaattttctacacgatgtctgtttattttatgacagcaaaagtcaagaaatccagatacacgctggcaggggcgttgcttgctacagtggccggacttgcagctagtgtgtggcttgccggaaaaatgtaaattatttattaaaaaatagatttagggatagatttttcggaaaatatcgattatactattcacaaataaaaatagtaattcttactatttgtacaggaagaaaggagaatataaaatgcagaaatatgtttgtgaaccatgcggatatgtatatgacccggaggtgggtgatccggacaacggaatcgcaccgggaacagcatttgaagatcttccggaagactgggtttgcccaatctgtggtatgggaaaagaagtgtttgtggcagagtaatagagaatgggagatgccgtacagtggatgtgcggcatctcttttttgaagtgtcgatgagccaaagtcctggactgacaagagacttggaggccgtttacaattcccaaattcgcagtttgattcttccggcgattccattgggattatgaggtctgtttcagctcatcccttaacaaatcaaatggcgcagggccgatatccagtacgaatttgtgaaaacgtttttgggagaaatcttctccccatttggcaatagctgcctttttcaattcaagaaattccagataaccgaagtaatattttgcataattgccgggatcacccaggatgagctggtagatctctgagatactcttctcatctccgattccatactgggagaaaaaggagagggtatcttctttggtccagcctttttcatggataccaatatctgccagagcatagagtcccaggatgatggaggcgtttttctgctggatcgtggctacctctttcgacaccggagcgagatagtaagacagcatctcggtataagtagcccagccttccacataacctccgaaatccaggatggtgcgtacaggatccgggtcctgtgcgagaaagtaggtcgtctggtagagatggccgggatagccttcatgcgccagggtggtgaaaaggtttaagccctccatggaatgtctgggattaatgtaaattgtgttttccgtactgttatcgaggggcggaatcagataaaaggcagggcttaaatattcctgagtggacttaggaacctgtttgacggtaaaggtgacgtcaggaatgtcgggaaaggagtctgccattttctgctttagttccagaagaattgattccggtgaggattcctggagaacgacgtcttctgccatctgggaggcaggcaatgcgtttttcatctctttcatgtctgagatgatctgggaggtcgcaagctgctctagttcgtccacggagcggtctgtaccaatggattttttcaaaaaggcctcgtaacattgtttaccatccggcagggtacaaagtccctggtcagaggttccggtgccttttaaggagccaagtccatcgatcagaagctggtaggccgggaaaacctgggttgtgagcagatctttattttttgcggtgtagagcgcatgttcgctttccgagagcgtgcccatttcatcgaggcgttcctcaaaggaggagagtagataatgatcgtcccccatggagatgaaatctgcacattcctgaatgacagcgtccgctctctcgtccgacataaagagtccctcgtccgatttggtccgttcaaagtcgagaagagattgataatactcctgcatggtggacagaagagaaaggtatgtatcgacatcctccgctgttttgaaggaaaactcggataaaagcacgggaagctgggactggattccggtgagagggcttagtggctcttcatataaaagatatccggcgcagtcaagggcagtctgaagataggattccaaaatcttccaggtcagccgattgtcggcggaaagcttttcgggggcaaagcgttttaatgctgccagcgtattttccagggagacagcaggaagttccggggtggatacaaatgtcccaaaagtcacgggagcgtctaaaattccgtaagattccgggtgttccagtgtaaagtgcagactgatggaatccccggatacctcgcgacagaacagagtttttgtaaaagtttcaaactgttcgtctatattgttcgtggtaagcgaccgggaaaagaacgcgtccggatccggggaaggcggaagaaaggagtagagtattaggaccgttgtcagaagtactgccacaatcagagtaatcctcgccttttttgatcgaaaaaaagcacaatctgggaatgataatttcataatagaactccagatagaatttgtcacattatatgaaggagttttaataactattcagccatatgtcggggaacaccgaaaaccatctgcaagcaatgttgcgctgaatttttgacactcccggcaacatgattgaatagttactaaacttttaaaataagcattgcattttgtcacaaaagttgtatgataaaagataatttcaatttatacaaaaagggggctttttatggactctgtaatagacaaattgacggaaattgaacagactgcatcggcgattgtagctcatgcagaggaggaaaaagcggagattgacagagagtacgacgagcgtagaaagaaattcgatcagaagctggaggaagagaccatggtcaggattgaacggatccgggaggggcttgagagcgataagaagcacctgctgaccggacaggaggagtccagcagggaactgatcgcatcccttcaggaggagtatactaaaaatcatacagtatatgcagaaaatattttaaagcggatcacagaggtgtagtctatgggaaatttacttgcctacagcgggattgtcacgaagatccggggaatggaggcaaagctccttacggaaacacagtttgatgagatcaaggccatgaaaagtgtgccggaagccgttacttatctgatccagaacacggtgtaccgggagattctggagacgttggaaccgactctggtacaccggggaaatatagagaagcttttgattgtatccctataccaggactatacccggatctatctgtttgccacactggaacagagaaagtttttgaaattgtacctgaaacgttatgaggtggagctgattaattactgtctgaggattgtcattaaccattatcaggagccgtttgacctgaaccacaagcgggcgttttttgaccggtattcgcagatttccatcgagaagctcattcattccaggacgacggacgagctgatcgaaaacctgaaagggacggaatactacaataccttgaagaagctgcgggattcgggcaaggcgacattatttgactacgacctggctctgaatctctactattttgtttccatgtggaaacaacgaaagaaaatattaaaaccaaaagaactggaacttttcacaagggattatggggcgcagatcaatatgttgaatattcagtggatttacagggcgaagaagtattttaacttgtctccggcggatatttatgcgctgctcatccccatccagtacaagatcagcaccgtgcttatcaaggagatggtggaggcgtcggatctggatacgttccagaaggccgtcgaaaagacgtcgtacgcaaaacactttgacttcagccaaaatcttacggtggagaagctgtatacggattatctgtattatttgtaccggtctgaccgaaggaaggatccgtattctattgcttcaatcaacacctatctgtttctaaaagaggaggagatcaagaagctgacaaccgtaatcgaatgtgtacgttatggcatacctcctgaggaaatcagggggtatacaggagggcagaaactatgattgtaaaaatgcaatttgtcaatatctcaggacctcgcagcgatattgaccgtgtgatggatctgtacctgtcgcggtatgagatccagttggaatcagctctctcagagctgaagacagtggataatttaaggccctttgtggagatgaatccatacaaggacgccttggtaaaagcagtacagtttgtggggttcctggaaaatccggaggagacagagccggatacgagcttggggcttaacgatatcttcgaactgatccgaactatgaatgaagaatacctgaagctgcaggcaaagcaggaagaatggaaaaagaagaaagaggagattgcctccaagcaaaaaatcattgaaccgtttcgcccgatgggcggggatttaagccaggtgctgcattataaatacatttcgtaccggtttggtaagatgccgcaggagcagtatcagaaactggagaaatatcttttgggagaactggacgccgtctttgtaaagggtgtgcaggatgaacagtttgtctatggcgcatattttgccgcgccagatcatcttcagaaaacggacgcagtgtttcgttccctgcattttgagcgggtagagatccctgcacaatatgagggatccccggaggaggcaagccagaagcttttgaaagagatgtacgatattcaaaagaagatagaagagatcgataaagaggctgcggaaatgtttaaaaagaaagcgccgcagcttatatgggcaaagcagaggctggaagaactggcccacaactttgacgtacgcaagatggcggccagggtagaggacaagaaggaggattactatattctttgcggatggatggcggaggacgatgtgaaaaagttcatggcagaggctgaacaggacgataaagtctttgttgtggtggaagacgatcacgacagttatttcggagagccacctacaaagttggaaaatcccaagctgtttaagccgtttgagatgtttgtcggaatgtacggtctgccggctcacaatgaaatggacccgaccttgtttgtaggactcacatactcgttcatttttggtgtcatgttcggggatgtggggcaggggcttttgctggtgattgtaggagcgcttgtttaccatttcaagaagtctcctttggccggaatcattgctacggcgggggtgttttccacgattttcggtttcatgttcggaagtgtgtttggatttgaagacgtgattcagccactgtggcttcggccgattgaccatatgacgacacttccgtttgtcggaaaactcaatacagtctttatcgtatcgattgcctttggaatggggctgattgtaatagccatggtgctgcacattatcaacgcgttccgggaacacgatacacagtccacatggtttgatcctaacggtgtcgcgggacttgtgttctatggttcggtagcggcagtggtcatcctgtttatgagcggccgcccgaccccgggaggtatcgtccttgcagtgatgtttggagtaccgcttctgctgattttgtttaaggaacctttgactaacaggctcaaaaagaagaaagagaagataaaagaagggaaagtcatgttcttcgtggagggtttcttcgaactgtttgaaatgctgttaagctatttctccaatacactttcttttgtgcgtatcggtgcctttgccgtcagccatgcggctatgatggaagtagtactgatgctggccggagtggaaagcggaaataccaactgggttgttgttgtgcttggaaacctgtttgtctgtctgatggaagggcttgtcgtggggattcaggtacttcgtctggaatattatgagatgttcagccggttttataaaggaagcggaagaaaatttgaaccatataacaaaaacaggagaatggaaaaataaaggaggagcaaattatgactttaacagtaagattgatcttaatcgtggcactggtattcagtattattatcccatttggatattatctgatcggggaaaagaacagaggacgctataaatgtgctctcgcagcaaatgtatttttcttttttggggcctgccttgtggcgtcaattatgatgttcgcaggaccgaatgtgcaggcagcggatgcagcggcatccgcttcaacagcaacaggacttggctatatcgcggccgctctggttaccggtttatcctgtatcggcggtggtattgccgtggcaagtgcggcgagcgcggcgcttggggccatcagtgaggattccagcgtccttggtaagtcgcttatttttgtaggacttgcagaaggagtctgcctgtatgggctgattatctcctttatgatcctgggacagttataagagatgaagatgtatctgatcagtgataatgtcgacacatatacgggaatgagacttgcaggcgtggacggggtgattgtccacgaacgggaggagctctacgccgcactgcagaatgttttgaaagatgaaagcgttgggatcgtgcttctgacagagaagtttgggaaagagtttccggatcttatcgatgaatttcgtttagagcgtaagatgcctctgcttgtggagattcccgacagacacggaaccggacggagcaaggactttatcacatcgtatattaccgatgcaatcggactgaaactataaaaggagggagtccttttgaccttagaagaaaaaatcgcagagattcgttcttcctctatggaagcggcaagagcggagggaaatgatattatagaaagctaccgcagagcccttgaaaaagtattcgaagatcataagcaggaggctgtgcgtcagatggagactcgtgtgaaggcagagaccgtcaatgcaaagcagcagaaaaatcaggcaatggcaaaggcacagctcgacctgaaacggcaggaaggacgggtgcagaaagaactgaaagacaaggtgttccgggaagttatggaaatggtggaaagctttatgaagacggaggagtaccgggactttctgctttgctgtatccggaaatcattggagtttgcgggaggagaggggctgacgatttatatgaatccgtcggatgtagaactcaaagaggaattggaattacggtccggcgctatgctgactatcagtgaggaggactttattggaggaatccgggcggtcatccggacacggaatattctgattgatcactcctttaaaacggctttgagagcagagtatgatgaattcgtgttcctgggaggtgatggggttgcttaagacaggaaaaatttatggaatcaacggacccgtcatttatttaaatggtaataccggattcgggatgtcagagatggtctatgtaggtaaggatcaactggtgggagaggtgattgcccttgagaaggaccggacaacggttcaggtctatgaggagacgtctggcctgcggccaggtgaggtggtgacagccactggaaatgccgtgtctgtgacgcttgcgccgggaatcctcaacaatatctttgatggaattgagaggccgctggagaaaatctccgagacaggaggcgcatttattacaaagggcgtttcggtagattctctggatcgtgagaaacgttggaacacccattttaccgtgagggagggggattatgtgaacggtggcgatatttttgcggaagtacctgagacaagggctattgttcataaatgtatgattccgccgcacttacatgggaaagtcgttgcggtaaaacctgacggggcgtatacgatcgaggaatcgctgattacgctggataccgggaccggggagacagtagaaattcagatggcacaaaggtggccgattaggactccccgcccggtaaaccagagattttcagcttccgttcctcttgtgacaggacagagaattattgatacgatgttcccgattgcaaaaggtgggacggctgcaattcccggaggatttggaacaggaaagacaatgactcagcatcagatcgccaaatggtctgatgcagacatcattatctatatcggctgtggtgagcggggaaatgagatgacgcaggtattggaagagttcggagaactgacagacccccggaccggcaatcctttgatggaccggacgacattgatcgctaatacatccaatatgccggtggcagccagagaggccagcatctataccggactgaccctggcagaatactaccgggatatggggtatgatgtggcgatcatggcggattcgacttccaggtgggcggaagcccttagggagctttccggacgtcttgaggagatgcctgcagaagagggctttccggcctacttagcttcccgtttatctgctttttatgagcgggcaggtatgatgcagaacttaaatggtacaaaaggctccgtcagcatcatcggggcggtttcccctcagggtggagatttttcggagcctgtcacccagaatacgaagcggtttgtgcgctgcttctggggtctggataagagccttgcttactcaagacatttccctgcgatccactggctgtccagttacagcgaatatctgcaggatctttcccactggtaccaggacaatgtgtctccgaagtttgtggattaccggaaccggctcatggcgattctgaaccaggagagcagcctgctggagattgttaagctgatcggaagcgatgttttgccggacgatcagaagttgatcctggagatcgccagagtgatccgtcttggatttttacaacagaacgccttccacaaggacgatacctgcgtatccatggagaagcagtttttcatgatggagacaattttatatctgtataaacaggcacgtgcccttgtaactatggggcacccaatgtctgtgctgaaatcggaaaatatttttgaacgtgtcattgccatcaaatacgatgtgccaaacgaccagttggagttgtttgcacagtaccaccgggatattgatacgttctaccagaatgtattagaaaagaacgcatagtaaaggagggaatcgaacattatgccaatcgaatatctcggactgagcagcatcaatggtcccctcatcgttctggaaggggtgcaggatgcgttttatgatgaaattgtagagtttatcgtagggggaaaccagaagcggatcgggaggatcattgagctttacgaggataaggctgtgattcaggtctttgaaggatccgagggcatgtcgcttgtcaatactcatacgagacttaccggacatccgatggaaatcggactttccagggagatgcttgggagaacctttaatggcatcggacagcccattgatgatctggggccgatcgtgccgagaaaaaagcaagacgtcaatggtctgccgctgaatccggtgagaagagagtatccgagaaactatatccgtaccgggatctctgccatcgacggactgacaacgttgatccggggacagaagctcccgattttctctggaaacgggcttcctcacgaccagcttgcggcccagatcgtcaaacaggcgtcccttggggaagattcgggagaagagtttgccatcgtgtttgcggctatgggtgtcaagcatgacgttgctgacttcttccgcaggacgtttgaagagagcggggtggctgatcatgtagccatgtttctgaacctggcaaacgatccggtagtggagcgtctgattacccccaaggtagcactcaccgtagccgagtacctggcttttgagcaaaatatgcatattcttgttattttgacagacatgacgtcttttgcggaggccatgcgggaagtgtcctcttccaaaggagagattccaagtcggaaaggatttccgggctatctttacagtgagcttgccgctatttatgagcgtgcaggcatcgtagaggggacaggcggatcggtgacacagattccgattctgaccatgccaaatgatgatatcacccatccgattccggatctgaccggatatatcacagagggacagatcgtgcttgaccggaacttaaacggacagtccatctacccaccgatcagcgttctgccgtctctttcccgtttgatgaaagatggcattggagagggctatacaagggaagatcatcaggatctggcaaaccagcttttctccgcctatgcaaaggtgggagacgcaagaaatctggcgtctgtcatcggagaggatgagctgtccccgattgataaggagtacctggcttttggaaaagagtttgaagaaaagtatatcggacagggcgcggaagaaaaccgcacgatcgaagagacgctggatcttggatgggagcttcttggaaggctgccaagagaagaactcgaccgtgtgaatacaaagattctcgataaatattaccatcagacaaagcgggaagatggcgtcacgacgagtgccactcccggatcggtagccaataaagaactgtaaaagaggtgagatgattggatccacgaacatttccgacaaaaggaaacctgatgcttgcgaaaaattctcttacgcttgcgaagcaggggtatgaactgatggacaagaaacggaatatcctgatccgggagctgatggagctgatcgatcaggcccggacgatccaggaggaaatcgatagtactttcacttatgcctatcagtgtctgcaaaaggcgaatatagagaatggaatcaatacgatctcccagattgcgtatacggttcccattgaggattccatcgtcattcagacaagaagtatcatgggaacggagattccacatgtgaaatacacgcctaagactccggttccgacctatgcgttcagcacgacgaaggagtcggctgaccgggcggcggaagcatttcgaaaggtaaaagatctgacggtcaagctatccatggtggaaaacgcggcatatcggctggcctcgaatatcaagaaaacacaaaaacgggcaaatgcactgcagaatattacaattccgatgtataccggcctggtaaccagtatcagtaatgcgctggaggaaaaggacagggaagagtttacgaggctgaaggtaattaaacgaagaaaacaaggttaaaaaagagagaaaagtaaaatatgaggagtaaaacaatggactatatcattacgacagattccaattcggatgtgccgtcagaagtactgaatcaatatggaatcccggtgattccacaatattacgcatttggtgacgtcgtctacggggacgaaaaaaacatgacgccaaaagaattttatgagactatgcgaaagggtgatctgccgaaatccatggccaataatccggcagtgatccgggaaaaatttgaaacgattttaaagaaagggaaggatatcctccatattgccttttccagtgcgttaagcggaagttgtaacaatgtgcgtatgacggcgaaagagctgctggaggaatatccggagcggaagattaccatctttgattcactgaacgcttcgcttggagagggagtatccgtttatcgggcggctgaactcagagaggcagggaagtgcatggacgaggtctgcgaagtactgaaggaggagcgagatcatgtcaatgtctggtttaccgtagatgatcttcaccatctccagaggggaggccgtgtatcaaagacaacggcgattgtcggaagtatgattaatatcaagccgctgctgcgggtgacagcgtccggggagctcaaatccgatggaaccgtccgtggacgaaagaaggcgctcaagactttggtgacaaatatggaaaagagtctggaacttggcgaatatggaaaggatcgccttgtctgtatcctgcatggcgactgtatggacgatgcactggcagtcaaacgtatggtaaacgatcttgggtttgagaggatcgtcattaatgatgtcagcccaagtatcggcacgcatgcaggaccgggtgtggtaggacttgtatactatggaagaaagcgggagtagagccagagctatgaagctgcgtccgggtacagccatgatttcacgccggagggttcttgactttccattttttctatgctaccatttcaactatatgagaaaacgcagagatgaagagagtacatgttctggaatcttacagagaattcccggatggcctgatcgggccggatgctgagagggatagaagatggggcatggaagatggcttcggagcggcatggatgaacacgaagtggtgataatccgtgatgggtccgcccgttacagcgggggtgtcagaggacactcgctgagatctgttctgtgagggacagatgaatggaagtggtaacgcgaattcgccttccggggatttccctggagggcatttttatttcgtgaaaaagagttccggaaaggaatcaggaaaaggagagaaaatgtatgtgcagtaactgtaaagaaaagcaaaagtattatattaccactgcgattgcctacacatcaggcaagccgcatatcggtaacacatatgagttcgtgcttgcggatgcgatcgcaagatacaaaagaagcagaggatatgacgtctatttccagacgggaaccgatgaacatggtcagaaaatcgagttgaaagctgaggaggcagggatcacaccgaaggaatatgtggataaggtagctgcccaggtaaaagagattgcggatttaatgaatacgtcttacgaccattttatccggacgacagacgattaccatgaaaagcaggtacagaagatttttaaaaagctgtacgacaaaggggacatttataaaggatattacgagggaatgtactgtactccatgcgaatcattctttacagagtcccaacttgtggatggtaaatgcccggactgcggtcgcccgtgtacgccggctaaggaagaggcgtatttcttcaagatgagcaaatacgcagaccgcctgatccagtatatcaatgagcacccggagtttattcagccggttgccagaaaaaatgagatgatgaacaattttcttcttccggggcttcaggatctctgtgtttccagaacttctttcaagtggggaattccggttgactttgatccgaaacatgtcgtctatgtatggctggacgcactgacaaattatattaccggaatcggatacgatgttgacgggaacagcacggaactgtttcataaaaactggccggcagatcttcatctgattggaaaagatattattcgttttcatacgatttactggccgattttcctgatggcactggatctgccgcttccaaaacaagtcttcgggcatccgtggctcttgcagggggacggtaagatgagcaaatccaagggaaacgtcatctatgctgatgagctggttcatctgtttggtgtggacgctgtgcgttatttcgttctgcatgagatgccgtttgacaacgacggcgtcatcacctgggagttgatggtagagagaatgaattcagatcttgccaatacacttggaaatttggtcaaccggactgtttccatgacgaataaatattttggtggtacagtgacagacaaaggcatagcagaggaggttgacagcgatctgaagcgtgtaacaaaggaaacgtccgggaaagtagacgcaaagatggaagatctcagagtggcggacgccattacagaaatatttaatctgttcaagcgctgcaataaatatattgatgagacaatgccgtgggcgctggcaaaagaagaagataaaaaaggccgtctggagacggtacttttcaacctgatttccagcatttccgagggggcaagactacttactccatatatgccgaagacgtccgggaagattcttgcacagcttggcggcggtcatgtaacggataagccggagatcctctttgccagaagagacttaaaagaagtgatggaagaggtagaaaaacttcacccggcgcagccggaagaggagccggaggaagaaggcccggtgatcgatattgaggcaaaaccggagattgcttatgacgattttatgaagatgcagtttcaggtaggagaaatcatcaagtgtgaggaggtcccaaagtccaaaaagcttctctgctctcaggtgaagatcggaagccaggtacgccagattgtttctggtattaaaaaatggtattcaccggaagagatggtaggtaaaaaagtaatggttcttgtgaatttgaagccagcaaagcttgcaggagtgctctctgagggaatgatcctctgcgccgaagatgagaacggaaatattgtactcatgaagccggaaaaagatgttccggcaggagcggaaatctgctaggaaaaggatgattcttttgatcgtttgtggtagaatgttattagactaaagtacaaatgcataaggagggaaacgatcaatggaaccacaattttacaagggaaacagggacgcgtttatggagaagcttgcgccgggaagtctggccctctttttcagcggcgttcctgtccgtaaaacagcggacgaggattatgcctattttgcgaaccgcaattttgtctatctgactggaatggagcaaaaagacacaatcctgatgttggaaaaggatgcgtccgggtatcgggagaccctgtttattctgcctccgaatctgatcgaagagagatggaccggagcgagaatgaagccggaggagattgaagccgcatctatgatttccaactttgcttaccgtgacacgtttgaggaagagctcaaaaaagtgctggcatccgggagaattgaaaaagtctacctggatatcgatcggatggacggacaggtcgtagtcagcggagcagacagcatggagacattcttgaaacaggaatatccaaatcttctgattgaaaattcgctcccgattttgaagaagctgcgtcttatcaagaagccttgcgagattcgggcgatggaaaaagcgcaggagatcacaaaggccggaattctggcgatgatgacacattcaaagccgggaatgtacgaataccagtataaggcagagtacgactacgctctggcgcagcacggagtactggaagcgggatttccttccattatcagtgccggaaagaataatttctgcatccactattatggttaccggggacaggctatggatggggatatcgtactgaatgacgttggagtacgctgggacaatgagctgacggacgtatccagagggtggccatgcaacggaaaatattcctcgagacagaagctgctctttgagtgccagtacaagacttcggagcatatgttttcaacgctgaaaccgggagtaccgatgatggaagtagatgcggagatccgccgctattgttttgagcagctcaaagaagcgggagtatgcaagagctttgacgatatcggaacgtatatgtggcatggcggcgcgcaccatgtaggatttgacacccatgacgtcgtgtcggccagggacgagcttctccgtccgggaatgacattctgcgtggatatcggaatttaccatgaggagtggggaatcggattccgactggaagacaactgcctgatcacagaggacggatgccgcaatttatccaaagatatcccaagaacagtggaagacattgaagcggtgatgaattaaaaaaggaacggtaaaggagcatacactggagattctggtgtatgcttctgttgcttttatcaccggaagagaaatagaaaaaaataagaccgcaaagcatacggcgcaccgcaaggggagatccctttgaggtgcgccattgtgttagctgagttctactttttctgcttcttctggtttaaattcatttctcaggtcgtagatgttatgtcctgtggattcgcttaatacgcgtccttctagagaatagcaccgtataaaacgtcttccgtctacgctggaccagtgctctacgtcccacgtcatatatccgtcttcatcgctttttttctctttcagatataaatcgacctgtcgtccgcccggagccatgagcttgataagctcgtccgtatcagcggtaagttcggtcttatttaccttgtcatatacctgcattgaaaagtccctcctattgatattctatttgaattatagtatgttttaaattataatacaaccatcttgcggaaaattaaataactattcagccatgcggccggagagatcgaatatccggcgcaagcttgcttgcagccgattttcgatctctccggacatatggcgtttagccataagcgaagatttagctgcgacagccgcgaatctgagctggatggctggatagttacaaaagtgaggagtgaaaaaatgatttttgatacacatgcacactatagcgacgagcagtttgacaaagaccgggatgagcttttatgggggatggaagatgaaggcgtaggaactattgtggagatcggagcgtccatggagtccagccgggaggccattcgtctggcagagcagtatcctttcgtctatgcgtcagtgggtgtccatccggatcatgtaggggaactgaatgaggagacttttggagaacttggccggatgtgcagtcatgggaaagtcagggctgtcggggaaatcggactggactatcactgggatacggaaccaagagagattcagaaacattggtttatccggcagcttgagctggcggccggaaaaaacctgccggtcaatattcacagccgggacgcggcggaagatacaatggagattatgaaaacctacggcaaaggaacgagaggcattattcattgtttttcttactctaaggagatggcattggaatatgtgaagatgggattttatatcggcatcggcggtgtggtaacatttaaaaatggcaggaagctaaaggagatcgcaacagaaattccgttggagcggatcgtactggagacggactgtccatatcttgccccggagccgaaccggggcaggagaaatgattccaggaatattcattatgtagcggagcagatcgcacagctcaaagggatatctaaggaaacagtaataaagcagactgaaaacaatgcaaaattaatatacttttcataatattttaaccatttaaagaagcaaagtgtgttatactaaataaagcggtaaagtgaggaagatttatgacagatccttttttaggaaatccgcagaatacgattgcggtattacagaaatatcatttcaatttccagaagaagttcggacagaattttttgattgacacccacgttctggacaagattatccgggcagccgagattacaaaagacgatttcgtgctggagatcgggccggggatcgggacaatgacacagtatcttgcacaggcggcaagagaagtggtagcagtagagattgacaaagcactgattcccattctacaggacaccctttctggattccccaatgcagaagtcatacaggatgatatcctgaaggtagatattgcagagctggcagccgagcgaaatggtggcaggccgattaaagtcgttgcaaatctgccttattacattactactccgatcattatgagccttttcgagcatgatgtgccgttggctttagtgactgtaatggttcaaaaagaggtggcggagcggatgcaggcgggaccggggagcaaggattacggagcgctgtcccttgcggttcaatactatgccgatccatacatagtggcgaatgtgcctccgaactgttttatgccaaggccaaatgtgggatcggcagtgatccgtctgacaaggcataaggtgccaccggtgcaggtagaggatgaaaagctgatgttccagatgatccgggcttcattcaaccagagaaggaagacacttgtaaacgggctgaatcattccccggaaatgactcttacaaaagaacagatcaccaaggcggtagaaggcctcgggaaaggcgccggcgtaagaggggaagcactgacgcttgaggagttcgcaaagctaagtaacacgatatatcagatgaagttgtcataaatattcagggaaaaggaggcaggaagatgcggtatgagattaaaggagagacgttgccggtagtaatctgtcacctggaagatggagagcagatggtgacggagaagggtgcgatgagctggatgtcgccgaatatgaagatggagtccggtgcacgtggtggacttgggaaagcatttggcagaatgttttccggagattcgatttttcagaacatttatactgcggaacggggaaatgggatgattgcctttgcgtccagtttcccgggctctataaaggtatttgaagtagggccaggacaggaatatgtgcttcagaagagcgcgtttcttgcctctgaggcgagtgtggagctgagcatccattttcagaagaaaattgcttccgggttgttcggaggcgagggattcattatgcagaaagtatctgggcagggaaccgtctttgctgagtttgatggtcatgtggtggagtatgagctgcgggcagatcagcagattgtcgttgatactggatatctggcagctatgtctgcctcatgcggtattgagatccagagtgtgccgggtatcaagaatatggtatttggaggggagggcctttttaacaccgtgattacaggcccgggacatgtgtggcttcagacgatgccgctcagcaatgtggcaggcgtactgagaccgtatttcccatcgtcaaaataaagtagtctcgcttgtgaaaacaggcgattgacgagaaccaagacataaaggaggaacagcttatggccaaaacagttgatgaagcattatttaagattacaccacagattcagaagctctcggagatttgtgaagagaacaatgcaatcgacaaagagctctttacaaaatacgaagtaaagagaggattgcgtgatttgaacggaaaaggtgtgcttgccggtctgaccaatgtttctgatgttcatgcgaaagaaatcattgacggcaaggaagttccctgtccgggaagcctttattaccggggctataatatcaaagacctggtcaatggctttttgtccgcacatcattttggatttgaagagattgcgtatttgcttttatttggtgaactcccgacaaaaaaacagttggaagagttccacgatcttttggtggagcgtagaacattgccgccgaatttcgtgcgggatgtaattatgaaagcatccagtccggacatgatgaacagtatttcaagaagcattcttcaactgtactcctatgatgagaaagcggacgatacgagtattccgaatgttctgcggcaatgcctgaatctcatcagtcagtttccgatgctgatggtgtacggatatcatgcatacaattacaagatgggagaggatctttttatatacgcaccgaagccggagctgtccacagcagagaatattctgatgatgttaagagaagaccggaaatatacagagctcgaggcaaagattctcgacatggcgctggtacttcatatggatcacggcggcggtaacaattccacctttacgactcacgttgtcacctcctccggtaccgacacatactccacgatggcggctgccatggcgtctttaaagggaccgaagcatggcggagccaatatcaaagttgtaaagatgtttgaggatatgaaagctcagttaaacgactgggcagatgaagatgaagtaaaagattatctgtcccggcttcttgataagcaggcattcgataagaaagggctgatttacggaatgggacatgcggtatattccatctccgatccgagagcagagatctttaaagtctttgtagagaagcttgctaaagaaaaaggttacgaaaaagaatatgcgctttatgagcttgtggagcgtttaggcccgcaggttattggagagaaaagaaagatatacaaaggagtcaatgccaatgtcgacttctacagcggcctggtatacagtatgctgggactgcccccggctctttacacgccgatctttgcggcggcgcgtgtggtcggttggagtgcacaccgtctggaagagctgaagaacgtggacaagatcatccgtccggcgtacaaggctctggcaggacataaagaatatgtcaagctggaggacaggtaggaggcagcatgaaacgagagggattctatctttcctgtgaccataaaacaaaaatccatgcagtagcatggataccggaaaatagagagatacgggctgtgatacagctttgtcacgggatgacagaatatgtgaatcgatatgatgaatttgcaaggtggcttgctgagaagggatattatgttaccgggcatgatcacctggggcatgggcaatctgttctatcagaggaggattatggatactttccggagaaacgaggcaatgaatgtgtgattggggatatacgtaagttgttcttggcgacaaaaaagcggtatccagactgtccgtattttatgctgggacacagtatggggtcttttttgctcagacagtatatccagaactatgggaaagagcttactggtgccattgtgatgggaaccgggtataagccgtatccgctgcttgtggcaggaggattactttgtagtgcgatcggtaagttgcggggtggccattaccggagccgtcttgtagataacatggcgtttggaggctataataagtcgtttgagcccgggaagaccggaagagagtggctgtcagcaaatcccgaaaatgttgtacattacgaggaagacccgctctgtggatttttgtttactgtgactgcgtacagacagatgtttcgcggaatgaagacactgacgaaaaagggagtcgcgaatattcccaaggatcttgcggtactctttgtgtcgggagacaaagacccggtaggagactttggagccggagtatggagagtctatgagcagtaccgaaaagctggaatgaaggatgtggagatccaactgtattccggggatcggcatgagattttaaatgagaaagatcggaagagagtctttgagaagatcgcagactggatggcaaagcgtgaataaactttagctgatgaacgcaaaaaagggatggtctggaacaatgcttgcaatagtgttccgggactatcccttttccttgtggcttcaaagcggatcgctttttttagctattattcattctggcttgcctgaagtgcttttgcaaactgatccgggcaggatgtagcttttgcgccacatttaattccggaaagacggtggatggcgtcttcgacttccatcccttctacaaggcttgcgataccctggagatttccgttgcagccgccgagaaaacggacattgtggatgcggttttgatcatccagatcaaactggatctctttggaacaaacgcctgttggtctgtatttcatgataattcctccatttctgattcccttccgagacagaattatagcaaacaggaaaaaaagatgctaggtataaatgaaaaaatttgttatactgtgggaaaaagggttactatttacagccgattcaagattccgtactgtgaagcagtcaccccacccacataagcagtcttagctccgtggggagcgggactggagcactgtgagtgcgacgagtgtgcatgcgggcggggtgctgtaaatagtaacaaaaaaggaggtcgaaaccatgataggaattatcggggcaatggaagatgaagttgcacagttgaaaaagaatatggaaatagaagaaacaaccgaggttgcctccctttctttttgtagagggaaactttccggcagagaggttgttgttgtaaggagtggcatcggcaaggtcaatgcggcgatctgtacacagatccttgtagatcaatttcatgtggatgtgattatcaacacggggattgcaggctcgctggatgcggaaattgatattggtgatattgtgatttccacagatgcggtggaacatgatatggacgccagtatatttggtgatccgatcggtcagattcctcagatggatacattctctttcccggcagacgaaagtctggtcaaattagcaaaggaagtcaacgagaaagccaatccagatgtccatacctggatcggaagggtcgtaagtggcgatcagtttgtatcttccggggagaagaaagagcagcttattcgggtctttgacgcaaagtgtacagaaatggagggtgcggccatcgctcatgcggcctatctcaacaaaatttcgtgcgtcatcattcgtgccatttcggataaagccgacaacagtgctgttgtggactatccggctttcgaagcggcggcaatccggcatagtgtccggctgatcgaggcgctggtttcggagatctaggagaggaacactttcgagtcggcaaaaaacgcctgcttttgcagggctttataaaaattatgtagaacggttattgagcctttttctgttattatcagttatacttaaaaacaaacaaaataacggaggaggctctttttatgttggaagcagtatggaaacacggagtgttattttacgcggtcggggtgatgtgtgttctgggagtcatcagtaagatcactgtcagcctgacactgaggcgtctggtaaaagaggcgggcaaaatggggaaaagcctgcatcctttgatgaagcttgtccgggcaaaatttgaacatgcctgtatggtgagcgataaggtgcaaaatatccgggcgtttgtggataagtatatgtatgaatacaaagtactgtggataaagcttcatagctggaggcagatggagaaggcggccgcatggtgctgcctggtgtttggagccgcaggggcagccgccgcatatgtgggggaggcaccgctggaaactgtaggacagtacgcggctgccggtctggcaggatcgctgcttttgtttgcccttcggatggtgacggacgagggctatcagttagaagcagccaaaaactatatgattgagttcttggaaaatacatatgcccgcaggtatgaaaaaatgagtcagacggcggaagtggaagaagaaatccagttagtggagaaaaaggcggttttggaagaagggccgacagagaatgagaaagagacgattgcagccttccaagcggaggcagagtctcaggagatggaagaagaagcagctccggcggtggcggcaagcgctaaagtgagggcaggagcattcgcttttgaccgggagcaggacacatattccagagagccggaacacgagaagattgagtcagaacttgttactttgatgaaagaagaacaggagaagggaaaagacgaagaagaacacagggagaagagaagaagagatgaacagatgatccgtgagatccttgctgagtttttaacttgataattaaaaggccttttgctaaaatatacctgtaataactacctataatgatgatagaaaggatgggtaatgtgatggcaaaggtaacatttgactattcaaaggcaaatctgtttatcagggaacatgagatggagtccatgaaagatatcgtactggcagcaaaggacaagttgttggcacgcacaggagcaggaaatgatttccttggatggatcgaccttccggaagattatgataaagatgagtttgagagaattcagaaagcggcagataagatcaaggcagattccgacgtacttcttgtaatcggaataggaggttcctatctcggagccagagctgcgattgagttcttaagacacagtttctacaatatgatttccaaagaggcacgtaagacgccagagatctactttgtaggaaatagtatcagcagtacctatcttcacgacctgattgatgtgatcggagagagagatttttctgtaaatattatttccaagtccggtacgacgacagagccggccatcgcattccgcatctttaaagaaatgctggagaagaagtacgggaaagaagaggcggcaaagagaatctacgccaccacagataaggaaagaggagcgcttaaaaatctggcgacagaggaaggatatgaatcttttgttgttcctgatgatgtaggaggacgtttttccgttctgacagcagtcggacttcttccgatcgcggcaagtggagcggatattacgaaactgatggaaggtgcggcatccgccagaaaagcagcgctggagctttcctttgaggaaaatgacgcactgaaatacgcggcagtcagaaatattcttcatgcgaagggaaaatcagtggaagtactggcaaactatgagccaagccttcactatgtatccgagtggtggaaacagctctacggtgaaagcgaaggaaaagatcagaagggtattttcccggcgtctgtggatttaacaacagaccttcattctatgggacagttcatccaggacggaagcaggattatgtatgagacagtcctcaatgtagagaaatccagagaggaagttatgatcggcgaagagccggtagatctcgatggactgaactacctggcaggacagacggtggacttcgtcaacaagagtgccatgaacggaactgttcttgcccacacagatgggaatgtgccgaatttgatggtgaacattccggaacagaatgaattctaccttggagaactattctatttctttgaatttgcctgtggtgtcagcggctatattcttggggtcaacccattcaaccagccgggtgtagaggcatacaagaaaaatatgtttgcgctcctgggcaaacctggatatgaaaaggaacgcgaagaactgatgaagagattataagacattgtaaatatcaaaaagagatcagaaaaagagccgtagttttataaaaatgcggctcttttatactggttttttatttgtcatattcaggtctttacaaaaatggtcaacgggaagaaaatagattcagatggagtcatataaaaaccggagggaataagaatggagaacattataaatattcagaatctcacaaagtattatggaaagcacagaggaattgaagacctttccctcagtgtcagaaagggagagattttcgggtttatcgggcctaatggagccggaaaaagtacgacgattcgagcaatgatggggcttttgattccaacggcaggaaaggtggaaatattcgggctttcggtgcgggaacataaaacggacattttaagaagaatcggttatatgccgtcggagacaacattctacagtggaatgagagtcagtgaggttatccggttttctgccggactgtatgggaaggactgccgtgaagaagcaggatgtttgtgtgagcggctgaagctggatatgaaaaagaaagtagaggagctgtcccttggaaaccgaaaaaaggtggggatcatatgtgcctttcagcatgaagcggatctctatattttggatgaacctacgagcggactcgatccactaatgcagaaagaattcttcagtcttgtgcgggagaaaagcgggggcggggctgcagtgttcttatcctcccacattttgagtgaaatccggcggtactgtcatcgggcagccattgtccgggacgggcatctgatagtggaggatgatgtgaagaccatttgccattcttccgcaaagagagttacgattcaaggcatcgaagaagtgccggggattcaggcaaaggatgtgatacggggagagggttctgtgagttttctgtacaatggtaccatgtcggaactgattcgggcgcttcaagggcttgctgtagaggacctgacgattaccgagccggatctggaagagacatttttgcatttctatgaaggaggaaaaaggtgatgggaatctatctgcatgagatgaagcgcggaaggatgggacttttggcgtgggggtgtgtgattggcgggatgattgcgctatgtctgctgttatatccggaactgaccaaagaaggagcgtccattcaggccgccattgaaagcatggggacttttacagccgcttttggggcagaccggctcaactatgcggaactgatgggattttatggaatttacggcgggtgtatgctggggataggaggcatcttttatgccgcggtacttggaaccggaatgttggagaaagaagagtgggaacacacggcagagtttctgctgacgcatccggtcagccggagccaggttgtaacagaaaagcttctggcgatgatcagccagatgctcctgcttaatgggatggtgatcctgttgtcagtggtatctttctgcatcatcggggagaaaccggactggcatgatttcttcttattccacggggcgcagattgtgatgcagtttgaaattctctgcatttgctttggtatttctgctttcctgaaaaaaggcgctaccagcgcagggatcggtatagcagcggcactgtatttcctgggtgtatttggaaatatcacggaaaaggcagagtttgtaacttatattactccatatacttatgcggacggggccaatgtgatcccggcaggggaattagacataaagctggttatgctggggatggtctatgcagtgatcggcctaattgccgcttacggaaagtataccagaaaggatatttgctgatatgactggaaatgtcgtaaactttcataaacctaatggtgaaaatatacaaaaaagggaagttttgtcacagattattgtgggatcggatattgacttttcaattattgaggagtaaagtaaacacgatatgaataaagagaaggagggagcaaaacgggtaatttatcagagaagttaatggaagagctgaactgtaaagtcgtgttcacaataccggtcggaaaaggacttccgatctatgaatccgtcgttgtgacatggattattatggcggttcttgtattactttctatcatcttagtgcggaacctgaaagtagaaaatccggggaaaaagcagcttgcgctggaggccggatacctgtttttccgcaatttctttcataatctgctgggtgagcgtggagcacgctacataccttatatgacgatgatcgtcctctttattggactttctaacatcatgggggtattcgggtttgtaccgccgacaaaggatatcggtgtgacgatcggactggcgattatgagcattatcctgatcgagtattccgggattcaccagaaagggacaaaggggtggctgaaaagctttgccgagcctattcccattatgcttcccatcaatatactggagcttggaatccgaccgctgtctttgtgtatgcggttgttcgggaatgtactgggatcttatgtggtaatgaagctgatcgaaattatttgtccgattttgcttccgataccatttaatctgtattttgacttttttgacggattcattcaggcatatgtatttgtatttttaacatccctgtttatcggtgaggccatcgagtaggcggggcattgacacaaagagtataaggaggaaacaaaacgatgacatctttaattgcaatcggagcggcagtagcagtgttcacaggtatcggtgcaggtattggtatcggtcttgcaacaggaaaggcggctgagtctatcgcgagacagcctgaggcggaaggaaagatcagaagtactcttctgttaggttgtgcgcttgccgaggcaacagcgatctacggtttcgtaatcggtctgttaatcatcatcttattaggataacagaaaggcaggtagaggcagatgctgacgttaagtccggtaacgatcatcggtaccatcataaatctgcttgttctgtatttcctgctgcagcatttcttatttaagccgatccagaaaatcatggatcagagagaggaactgatccgtggacagttgaaggatgcccaggatcagaaggaatccgccgggaggctcaaagaccagtatgaggcggccgttgcttcggcaaaagaggagtccgggcaaatcgtagagcgagccagaaaagaggcatcacttcaggcggaggcaatcgtgaagaatgcaaatgagcaggctggccagattgtggataaggcaagaaagaccatggaagtggagagagagcagacgatgcgggagatgaaatcccagatcgcggatattgctttaacggccgcttctaaaattatgggtgagaaaacaagcagcgaaagagatttggcactttatgaccggtttttagaagaagcaggtgattctgatgacacagacagctaaaaattatgcacaggctttatttgaactgcatgtggatgcggaatctgtgaaaacgacagaagagattttaaagactgtcccggaagtagggagaagccttacaaacccgacgatctcgtttcgggtgaaggaacagatcattgggaggatcttccctggcgagatgagaaattttatcaaggttgtgtgcaggaatcagaaagcggatatgttggaagagatttttcaggcataccgggaaatagagagaaagcagagcaaggcactggaagctactttgctttatgtgacggctccgacgaaggagcagcaggaaaagatcagacagttcctgtgtcagaagtttcatgtaaaggaagcagtgctttccttaacaaaagacgaaagcctgatcggaggatttattctccgggcgggcggtcgggagtttgactggagctttagagggcgattccaggcattatcccgtgttttacagcattaacagcggaggtgaactaattgagcacaatcaattcagacgaaataatctccatattaaaagaagaaatcgcgaattatgacgagatcagcaaggacaaggaagtcggaactgtcgtcagcgtcggagacggaattgctacgatctacggcatcgaccatgcagcttacggtgagatcgtgacctttgagaacggactgaaaggtatggtgcaggatatccgtcagaacagcatcggatgtattctgttcggggatgaccgtgagatcggggaaggtacacgggtgttccgtaccggaaagagcgcaggtgttccggcaggcgagggatatatcggacgtgttgtcaatgcccttggcgcgccgatcgacggcaagggtgagatcgaggctaaggaataccggccgatcgagtatccggctccgtctatcgtagacagaaaatctgttaccgtaccgcttgagacgggaatcctttctatcgattccatgttcccgatcgggcgcggacagcgtgagctgattatcggagaccgtcagacaggaaagacgtctatcgccacagacacgatcctcaaccagaagggtaaggatgtgatctgcatttatgttgcaatcggacagaaggcgtctacgattgcgaagctggtttccacttttgaaaaatatggagctatggattatacaaccgtgtttgccgcaacagccagcgactgcgcgccgcttcagtatattgcgccatatgcgggtacggcccttgcggagtatttcatgtacaaaggaaaggatgtattgatcgtatatgacgatctgtccaagcacgccgtagcgtaccgggcactgtccctccttttggagagaccaccaggacgtgaggcgtatccgggagatgtattctatcttcactccagacttctggagcgttccagccgcttaagtgacgaggctggcggcggatcgatcacagcgcttccgatcattgagacccaggcgggagacgtgtcggcatacattccgacgaacgtgatttccatcacggacggacagatctttctggagagcgatttgttcttctccggtatgcgtccggcggtcaacgtcggtctttccgtatcccgtgtcggtggtgcggcacagacaaaggcgatgaagaaagcggcaggaagtgtgcgtatcgatctcgcacagtaccgtgagatgcaggtgttcacccagttctcctcagacctggatgattccaccaaagcccaactcgaatatggggcctgcctgatggagcttttaaaacagccactttgcagtcctctttccatgccggaacaggtgatcacactttgtgcggcgacccataagaagatgattggaattccgttaaaagggttgaaagaataccagaaagagcttctggaatacatcggcaatctgtacccggaaattattcgcaagctttccgaacagaaggttctgacagaagagctggaagataaaattgtaaaggcagcggaagaattcagagacaagagcaggtgttagtatggcaaatgcaaaagaaattcaggcgcggatgaaaagtatccaggatacgatgaagatcaccaatgccatgtatatgatttcttcttctaagatgaaacgtgccaagcaggttcttgcggatacggagccgtacttttacaatatgcagaatgcggtttcccgaatcctgcgtcatatgccggatgtggatcatgtcttttttgacacgaggccacacatcgagatacaggacagaaagatcggctgtattgtcgtgacagcggataagggactggccggagcctacaaccacaatgtcatcaagatgacagaggagatggttcaggaggaaggccatcacaagctgtatgtgctcggtattgtggggcagcagtatttccggaagaaggatgtggacatggatgagcagttccattatacggttcagaagcctaccatgcacagagcgagggtgatagccagagaagttgtggagaagtttctggagggcgatctggacgaggtggacatcatctatacagagatggagaatgccgtgaccatggaaacaaagcgggtgcagcttctcccgttaaaaaaggcggctttcataccgcaggttccggtggacgtgcagcaggagatcattcatatgattccatcaacgaaagaggttctggatcaggtcataccgaactacattacaggaaatatatacggatgtctggtagaatcctatgccagtgagaacaatgccagaatgactgcgatgcagtcttcgacggacaatgcaaaggagatgctccgggatttgtccatacagtataaccgtgcaagacaggccgcgattacgcaggagatcactgaggtaatcgccggcgcgaaggcacaaaaaaggaagtgataacgatgaataaaggtaagattatacaggtcatggggcctgttgtagatgttgtgtttgaaaacggtgagcttccaagtatcaaagatgcgctggtcgtggataatgacgggaaaaaatgcgtgatggaggtatcccagcacgttggaaatgatacggttcgttgcatcatgctttccgcaagtgagggacttagtcgtgacatggaagtgaccgctacaggagccggaatcaaggttccagtcggagataagacactcggacgcctctttaatgtcctgggcgatacgattgacaacggagaatcgctggaaggggaggagcattgggagattcacagagatccgccgtcttttgaagagcagagcccggtagtggagatcctggagacaggaattaaggttatcgacctgcttgctccttatgccaagggtggaaagatcggattattcggaggagccggggtcggaaagaccgtgctcatccaggagttaatccagaatatcgctactgaacacggtggatattcgatctttactggcgttggtgagcgttcccgtgagggaaatgacctttggaccgagatgaaagagtccggggtattaaataagacggctctggtgtttggacagatgaacgaaccaccgggatctcgtatgcgtgtggcggagactggacttactatggctgagtacttccgtgacagggagcatcagaacgtacttctctttattgataatattttccgtttcgtgcaggcaggttctgaggtgtccgctctgctcgggcgtatgccgtcggcggtaggataccagccgactcttgccaatgagatgggggctcttcaggagcggattgcctcgacgaagaacggttccgtcacttctgttcaggcggtttacgttcctgcggacgacctgacagacccggctccggcaacgacattcgcccatctggacgcgcagactgtcctttccagaaagattgtagagcaggggatttatccggcggtggatccgctggaatccagctcacgtattctggaagcggacgtagtcggagaagagcattatgaagtagccagaaaagtgcaggaaatcctgcagaaatataaagagctccaggacattattgcgatccttggtatggaagagctatcagaagaggataagaagaccgttttccgggcgagaaagatacagagattcctctcccagccgttccacgtggcggaaaactttaccggaattccgggaaaatacgttccgctcaaagagacgatccgtggatttaagatgattgtaaatggcgagatggacgagtacccggaaaatgcgttctttaatgtcggaacgattgacgatgtcatagagaagtcaaaaaaggaagcagactcagaggagtaaaggagtgtgcatatgaaccagcagcatacatttggactggagatttatgcaagtaatcgacagttctatgtcgggagaggcgaaagcattacattcccggtggaagacggtcagatgcaggtattgccgcaccacgaagatatgattgcggcgattgtaccaggagaaatggattttgtagacgcgaacggagaaaagattaccgttgcggtgagcgcaggattcatcgaagtatttaacaaccggatcaaggtttttgcgctgactgtggagcgcccggaggagatcgatatccgtcgtgccgaggaggcaaaagagcgggcggaagagcagctcaggcagaaaaagagtctggaagaatacaacgcaaatcagatggcgctcgcaagagccatgtcaaggcttagagtaacatccagaaaaagaatataaaagcttataaaaggcatatcccagaggagtatcatgggatatgctttttttctggaaatgggagtaacagcacaactgagcaatcttgtcggaaatgctttcctgtgataaactgatagagaaaaaacagagggagtttaccgcaatgaaagaacaaaagaaaaagcatttgtttaccaacaggcagttggctgcgctgctgattccactggctctggatcagcttttgaattcgtttatggggacggtggacacgctgatcgtcagcaatatcgggtcggcggctatttcggcggtatccctggtggacgcaatcaatatcctggttgtggaagcgtttctggccttggcggctggaggtacggtcgtctgttctcagtatcttggaaacaaagacgtggagaaggcaaataaagctgcgggtcagcttgtgtttgtcactttttttctgtctcttttgatggcagtgatctgtattgcattccatgaaccgattttgagggccattttcggcaaggtggaaaaagaggtgatggacaacgccaaaatttactttctgttttctgcagtagcgtttccgtttattgccctgtatgatgacggggcgtccattttgcgtgcccaggagaacagcaggctcccgatgcagatatctatcattgcgaatgttctgaatatcgttttgaatctcctgtttgtatggggatttcatcttggagtgggcggctcagcgtgtgcgactatgctggcgagagcctttgccatggcagcggttctctacgagctgcggaaaccaaagtggacggtacatctgaaaagctacttttctatccgcccggattgggatcagattcggcgaatcttaaaaatcggaattccctcaggcattgaaaacagtatgttccagtttggaaagctggcaatccagtccacggtctctatgatggggacggcggcgattgcggctcagggtatgacaaacacattggaaaacctgaatgggatcatggccatcggtgttgggatcgggctgatgacggtcgttggggaatgtatgggagccgggagaaaggacgaagcaatctactatgtgaagaagctttccatcatcggggaggttgtggtgatagcgtcttgtcttttcatttttgccctggtgcgtccaatcacatattttggagggatggaacagggaagtgcgtctatgtgcattttcatgctcacctgcatcacgattgtcaagccgattgtctggacgttggcatttattccggcgtatggattcagagcggccggggatgtgaggttctctatggttgtgtcgatcctctctatgtggatcttccgggtgtccttggtgatggttcttgtaagagtttttaagatggggccaattgctgtctggatcggtatgtttacagactggactgttcgggcgattgtatttagtgtgagagtgaaaaaccggaaatggctggaacaccaggtgatctgaaaaagtgttaaaaagagctagcaccacatgaaaacagatagaacggggaaaagcagccgaagaaattgactttcacatttcactgtgataaaattcgattaagtttttatctcgtaggtgaaaaaatcataagtaactttaaaaataggttcatgggaggtgtcatcttggggaaactgaaaataagagaacatatgacgaccaaagagaagaggatggctctggaagctgctctgcttctgggattccaggcggaagcgtcagtatttccggttgcaggatcaaagggggagatcccggttccggaaaatgaggaggagttaaaagtcctataccatatttccggctcagatttgccggaaggatacgagccggcaaaagggcatccggagccgatgtttgatctggattttcggaaagagaaggggctggagacggttttttgcaaaggtccgtttttaaaggatgaagattttgacctgcttccggataagctggacgtgaagatcattcttccggaaaatgcggacgtatctaccatgattgcagcgtgcaatatcgcatttcgtcttggtatggagacgaccggatatgagggaggtattctggcggatgcggattactgtggaaacgcaatcgtactagaggacggagaccgtgcggagatgacactggaggagacggatgaagcagtccgtgttcatctgaaaggaagaggagcagatcttgagacgctttcggctctgatttgcgagaaattcccggggacgggcgggtttcggcagttccgggacgtcatgatggagatgagcgacgatgcggtgctgcgaaatgcgaatggtcagattgcggcgttgaaagcgtggaagcagaaagaagagggagcatacacggtttatggatctccggagctttccgacaaacagaaagcactttttgagaacgtcacatttgaaaattataaagcaggtcggaaagcatatgaaaaagtgtacgagcttccgtgggaagtggagacgtttgaagcgctcctggaagaacatgtttttccgattttgaaggcgggggatactctccgtgtggaaggcgccgtcagcgaggaccaggagattcgccgctgcatggcagagaagatcgaagagagagcaaagggtcttggaatttctacagtggagacagagctgatctgtgcgtataagcaggggttctcatgggtgaatgagattgtgatcccggcagtgaaagagcagaagccggacaaggttgagatttatttcaagccatttctcccggagggtgagacgagatggctggacgagaatggtgcgacaccgtcctaccacaatcttcaggcggataatccggataaatggtatgatctgccgattcgttatttacaggaactttatccgattgaggatgtgcttataagagaacttggaattccaagggacgcagtcgtatttcttccatatgagggtgaggagcggctgacatatctgtgcagagtttatcaaggacaagcgatctgctatgagaatacatacgaagcacgttgttcggagcggccatatctggatgagtatccgcaaatgggaaaagttcatccggcgacgggttatattcgtgcctggattaatggggaggaagttcttcacaagaatatccggacggatctggaggcagtctgggatacttatcaggctgaagtattgccggattgtaagcggtatattgaggaaaagaatggaggagtcattacaccggaacagcagccgtttttccaggagctcctactggatgtgacagtcagcgaaccggatttccgggtgggctgccgggaagatttgatttcttctctggatgcgctgcatgaggatatgtactttactggcagtgattatttcaaaaactatggtgtacagaatatcggagttatgctggacgcaccgggactgatcctgccgtccatccaccagagggaaggcagaccggcactgaaagtgacagtatttgagaaattaaaagaaaagccatgcatcaccaaagacggaaccgtgatagaaagtatgaggaaacgggaggatgtttcctttaaagtgaccagactttgggagaagaatggaaagcttggtgtggagatttccgctaagggtgtcacagaggaatatttaaaagcatatgcaggacttttagagcagggagtgttggaaattctggagggatggcagcagattggagaaatccattttgtcagtgagagcggaagtgtagcaggagcaatgatccgggccacagagactaagacctgtctgaaagcgattacggatattgatctttctgagaaggaactgatcggttacgaggaatatctgactattattgaggaattaaagcacgttccgggaattgaagttttccgaaccgcgagatcttacacaggaagagagctttacgcgatctggctgaagccaaagcgggagggctatctctccatgacgaagcgtctgacgaactgcccgtccgagattatcaatgcgagacaccatgcaaacgaggtgtccagcacgaatgcatcgttcattcttctgaagaaactgctcacggaggagacgtacaaagagcttccggagaagctgaatctgatccttgttccgatggagaatgtagacggcgcggcgattcattacgggcttcagaaagagcacccgtactggaaattccatgtagcaagattcaatgcccttggaaaagagttcttccatgagcatttccgccaggatacgatccacggtgaggctatggggctgagcagactctatgagcggtatgcgccggatatgatcgttgacaatcacggagtgccaagccatgagtgggagcagcagttctccggttatacatccccatcctacaagggattctggctgccaagatcgcttttgtacggatatttctggtatgtgactgatgaggaatataaggataattatccggtcaacaagaagatggaagatgtcattgcggacaaaattgccgaagatccggagatgacggcgcttaataaggagtggagcgcacagtttgagaaatacgcccacgcctggatgccaaagctttttccggcaaattattataagaatatgattaactattggattccgtatacggcagatccggcccacaagtatccgtcgatccgattcccttggatcacgacagtatcttatacaagcgaggtggcggatgaaactgctcagggtgattatctgaatttgtgcgcgagggcgcatgtagcacatgatgaggcgaccctacagatgctgatgcaggcgacccacctaaaagaaagcagcataagctgcaaagaaggagaggtatccgcgtcataccggagacttcgcccgatgatcgtatagactccgcggttctggacaacaaaagaaaaagagaaggaggaagagaaaaaagagaaggacaaatccggaaagccagagaagcggaagatatataaactatgagtgaatactcacagaaggaggaaaatctatggaatatataaaattgatcggtgtcctgattgttgtgctcggatttgcgctgaagctggactccattctgattatctttttggcggcagttacgaccgcgcttgcaggaggtctcggaatcgacggtcttctggaggcacttggaaccaactttgtagcaaatcgaagcatggcgattttcataatgatcctgcttgtaacaggcgttctcgaggccaatggtctgcgtgaagcggcggcggatctgatgaaaaaggtaaagagcgctacggccggccgacttgtgtgtgcatatggtatcctcagaggattttttggtgcgtttaacgtaggttttggtggagtggcaggttttgtccgtccagtacttcttccaatggcggaaggcgccatcgaaagtcatgggcacgagccggacgaaaaacatatggaggatattaaaggtatggcctccagcatggaaaatattacctggttcttcttccaggtacttttcgtcggcggagccggaggcatccttgtacagacaactctgaaatctctcggatatgaagtagagttgattgagctggctgccgcggaaattccgattgcaattatcgctcttgttgtggcaagcgtctactacattacaaaagataaaaagctgatgaaaaaatattatggatccgattccgtaaaatcgggcaaaaagaaggaataagagggggacggatatatggatcttaaatttatacagattggggctggccctgcaaatatcttaggcgaagcagtgtggatcattatcggtctgatcacgattttcgcaggtatcaagaatctgcttgataaagaaaacccatccagaatcgggacggcggtattttggtgctcttttggcgttgtatgtgcgttcggtacctggcttccggcaaaagtgtccggtgcgctcgttattgttatgtgtatgccgccgattttcaagcgtgtaaaagtcggaaaaacaaatgctccgacaaaagaatatacaaaatcccagtatgcaaagattggtatgaaaatctttatcccggcgctgacagtagcggtatgttctctgttattcgcgttgtttacgaatatcagctctatggtaggcgttacggttggtgttattatttccatgctgatcctgagagcttattccccggacaacaagccgaaggtatttctggaaggttccgaacggttcctttctatgatgggtcctctgtgtatgcttcctcagctccttggggcgctgggtggaattttcacagcagcaggtgttggtgaagtcattgctggtatcgtggaaaatgtggtcccgaagggaaatgtcaaccttggtattatcgtctttgcgattggtatggtactctttaccatgattatgggaaatgcgtttgcggcgatcaccgttatcaccgtaggtatcggtggaccattcgtacttgcttacggtgcggatccggttgttatcggtatgctcgcgctgacatgtggatactgcggtacgctctgtacaccgatggcagcgaacttcaatatcgttccagtggcgatcttgaacatgaaagaccgctggggcgtaatcaaaaatcaggtcgttgttgcaggaatcatgctcgtagtgcagatctgctacatgatcatctttaaataggagcagaaggacggcacagacagaatgtgtgagatggagtggggagcccgcattattatcaaagactgggtaagaataaagccatgggacagactgttgattgtaacaagcaaggaatatcgggctgaagccagagagcttaggaaacaggcgtttggaagggccagatccgtcaatgtccttctggtggagaataaaggacgacatgtggggatgttttttgacgataacgaaacagtatttgacccgtacactgccatcattgcggccacagagtattcccttgtgacaacgagggcagctaaaagggcaatcagccagcataagaagtttttgtcgttgccgctgtctacaaacaatggcagatccatgctggaattcgattttctgatgatggatacgaagaaaagccggctgatggcaaaggtgattatgaagtatcttcgacattcttccggtctccatgtcacgacacaggcgggcacggatctttacatgggaaagcggggaagaaatccgggattctttaacggtgtgatcaaagacggaaaaggctattcttccgcaagtattgaagtgtatgtgccgattgaggagacaaagacagaaggcattatgatgctggacggttctcttgggtatatcgggcgcgccgaagaggtaacgaggattgaattccgggaaggccgtattgtaaagatcgaagagacgccgactggcatccgtttaaaagagtatatgaaagcatacaaggacagcaggatttacattggtggggaatttggcattggcctgaattcctactcgcggtgtgtgggagactgttatattgaggatgagtccgcctatggaacatttcatatcggacttggacgcaatcttgcacttgggggcgtacaaaatgccaaagggcattttgacctcgtatgcctggagcccgatatttatgcggacaacaggatgttgatgcaggaaggaaagattatccttccggagccgaatatatattagaaagacacaacaaaaaaggaggctacagtacaatgaaagttttggttacaggatttgatccgtttgggggagaaaaagttaatccggcttacgaagcagtgaagctgcttccggataccattgcgggggcagagatcatcaagattgagattccgaccgtattcacaagaagcgcggaagtattagaggaagcgattcagagataccggccagacgttgtgctggatgtaggacaggctggcggacgctcctgtgtgacagtggaaaaagtagcgatcaatttaaaagaagcaagaattccggacaatgatggagagcagccatttgatgagccgatccgagaggacggtgagacggcatatttttccacgcttcctgtaaaagcaatggtagagaatatgagagcacatggaattccggctcatatctcttacacagcaggaacatatgtatgtaactgtatcatgtacaatgcactatatctggcagcaaagaaatatttaggtgtacgtgcaggatttatacatgtaccatttgagaacggtcaggtagtcgataaagccaacggtacaccatttatgtctctggaaatgatcgcaaaaggactggaatacggaattgaagcggcagttacaactacagatgatgttcaaaaagcaatgggagagacccattaacgttctttagaattaagggggcgtgtcccaatgtattggaacacgccctaaaaataagaaaaaacttagaacatattatagacaaatttaggcgctgtagacagatttgcatacataagatacaaatagattgccaggatcatacaatagaagatggctgtccaagccgcaaaccgaacgtatttattctttttcatgtccttgataaaagtgataaaggtcttcattaattactgcccatcctttctttccaatgtgaacgccgtcctcaaaaaagtatttggtgtactcctgatcagaataatccagcagcgatgcgtgatactttttggcgattgtgcgtatttttttgtaatagtcagctctggcttctttaggaaaaccggtgtagtcgtaccagtagccgttgaccgggagcatgactagcatcggacgtatgccgagatcctcacaaacgtcgaggaagcagctcagatcttcgtactctggtgaagtgctataacttccgtttacactttggtttttctttttcttaagagacggacggatcaaacgcttgtagacgttgtcatccatatagaaaggattgccttggttatgtttgtccccgtctttgatggactgatcgatcaaggaaacgaaatctggagtatcggatgttttcgagccagaggattttcgcacgatccggtctttgataagctgcatcatcgtagtctgaagttccttttcttccataaaccgggtgaagatcctgtaatttacacggtcgaacagggaagcgtctcctgtatagagaattcggttatactgagcaatgcgattttgcatagacggatctacagacagcagctcctgggaacgccggatcatatagtccttgactttgggactcaggtgtttatttttcagcattgcaatatagtgggagtcagagaaccgggacgcaaaagcttcaggctgaacaccacttttgcgaaaccactgaggtgacagaaacaggatcgcctcttttttctgtacctcatcccccagagacgccagtgtgatggcgtgactgagggactgatagaagccggctccgatcagcatcatctggaacttcgtgttttgaaagactttggcagggtggtagggtgtcttaacgccatgttgaaactccgaagaaccaaaagtcaggatagtgtcctcggtcagattctgaaggattgcttctctggcctgaaatttgccgtccccggaccaggaggcaaaggcgttgctgtctacatgaatccgactctctgccagaaaatgaagtcccaccgctgaggtaagggcaagcaggagcgccaggaagaaagcaagaagccgtttcatgacgcactccttgtttccaggtaagccacaatgcggttcggcgtgttgaatgtgctacgatctacttcggacggcgcgaccagaataccaaggtcgtcttcaatgtctgcaagaagttccgcaaaaccaagtgaatccatcaaatcagactcaaacaagtcgatgtctggattactccttacaatatcatcctcgcaaatcttttccaaaatatcaaaaatctgttctctcataagtattttcctcctaaaaattatgataatccgagaagccacaagaactgtcccgaaaagatataaaacccgaagattacaagctgtagtgtaatcagccaggataagaaacgataccaccgtttttgacggtattttttataaaaacttgattttttcttataccattctgtgatggcaagtagtaccccgtggtaaagtccatagagaatatacgaaggggtcactccatgccagagtcccatgacgagcatattgacaagaaatcctgcacaggctgcattcagccgggttttaaaccgctttttccggatagactgaatcataaaccgggaaaaaagaaagtcccggaaccagtgagacaaggtgatgtgccaacgatcccaaaattcctgaatatcaacgcttaaaaatggttttcggaagttctcaggcgtccggattcccagaagataactggtaccaatggccataaggctgtatccggcaaagtcgaaaaacaggtaaaatccatagcagtacgcgtagaagataacgaagtaccattcccgtgcaccctgtaccattcccatccccttgaagaagatagaagccagaatcagcttataaatcagccccagcaggattttgaacacaccctccccggcaagagtcaaataatcctgacgggaaggaatattgttcagatcctgtaaaaaccgcctgctccggtcgatgggaccggaacttatggacggaaaaaagagcacaaaggctgcaaaatccaggacgggcatttccgtaatgagaccgtcgtatgtctcaataatgatctgtacacatctaaacgtcagataggaaataccaaggaaggcaaaggtggagccgtcccagaaaccggccagcttacttagaatcaggggcaggatactcaagaacagcacaagtcggtaaacagcgggacttctcccgcgagacacccggaaggccagatatccctcaaccaaaaacagctcggttacaaaaaagagagccagccaagccgcctgctgcggcttggaaaggaaggctagagccgtaaacaaaaaggttgcggcggtggaataccattttagcggctgctccaaaataccgagcagcattgcgggcatgaggataaaaatcagcacgcagaaaaactggtagttatcatagaaactcacgacagcatccctcccagagccttcctgtcggccttgccgttggatgtcatcggcagctggtcgaggaagatcagtttcttgggaatcatataatccggaagatattctttgagcgcccgcttgatccgcagagattcggcaaaggcatctcctgggacggtttccatcacaagaaatgcggtaatgctttttgccttcccatctctcatattagcaacggcggctgcatttttaatacctgaaagcttcaaaaggtggctttcaatatcgccaagctcaattcggtatccgtgcagcttgatctgtaaatcaattcggccgcagtaaaaaagttcgccgtcgtttaagtatccttcatccccggtccggtagccccggacagttatgccgtccttcaaggtactaaaaaagacaggggccgaaaggtccggtcgccggtagtatcccgtgcttaccgtatttccgagaatgacgatctcacctttctctccgtccggaagcgactctccattcggagaatggatttcaatccaggtccctggctttggacgtccgaccgggagagggtttacattctggatcagttctggtgttatcttcacctccgtcacggccacagtggactcggtcggcccgtaggtgttcataatgatcgcatccggaaacctccccgaaagtttttctgccgtccggtttgtcagcgtctccccgcagaataaaaacagacggagctgcggaagcagatcgctgtcaaagttcggatcccgcaggcacatgtcggcaaaggatggggttgaaacccagacagatgcgccggagtttgccagcgctgggagaagcagactgaagtcggcctgctctgttttcgtaagcgggaaaagcgttcctccgcaggcaaggcaggtgtataaatccatcacggacagatcaaaggaaaatggcgcctgatttaagaagatgcggccctccttctcatcccgtgtgttcccaaggcccacagaccagtccagatagtgattcagacagtctgatgtgatctgtacgccttttgggtttccggtgcttcccgaagtgaagatcatataaaacagatcatcaccggaaaccggggtaagagcctctgtctcagcgggatcagtctcctcgatcaggttgagaatgtcatccttttttataaaggaaacagaagcatctgcactttcggtttcttccggatcctcacatgccaatacaaacggcggctgaatgttctttatgatctgcatagtgcgtgaccatggtacagagacgtcaatcgggcaatagccccttcctgattttacacatgcaagaaaacagatgagcatcaggggactcttgtgtccgtagaccggaattggcgtccggttttctttacagagtctctggatggcagccgccaggagatcggtacagcgggccagatccccgtagtttagccggccttctttgcatatcataacagtgcggtcaggaaagcgcgcggctgtctggctgatttcgtataaaatattcataacttttcctcctgtagtgctttaccagtatcataaaaaaagaaaatgaaaagtcaatacgatttcgagaacagtaagaaaacattcaacaaatcttaataatcctcattttacttttcagctttttttgttataatgaatccaatgaatggaggaaatcatcatgttgtcaaatcaggtactacaaagaacaatatcagaaatagagaatattgcagggggatcttgctctgtatgggcgttggacggacaccgtattgtacaggcgggaacagagagtccgggtgccggtgagaggattcaggcgtttttggaggagataaaaaaagaggagattattcagggaatggaggaggtacgagcaggatacgcgctctttcttgtgtgcgacgaagagaagccggcctatattttaaatattgaaaatatgggaggtgagaaggcagagcttgtaggccgtctgggcgcaaagcagatggaagggctgatccgtgcttacaaggaaaagatcgataagaatcgttttctccagaatcttcttctcgataatatgcttcttgtggacgtctacaatcaggcgaagaagctgcacatcgagaatgatcagaaacggatcgtctttctggtggaggcaaagtccaaggacaaccagatgctgctggagacgatgaaagggatgtatgcttccggtatgaaggatttcgtgacggcggtagacgagagcagtgtgattctcgtcaaggcgctggaggagacggacggttatcgggaggtgtacgagagtgcaaagagtattgcggacaccgtatccgcggaggccatggttaatatccgtgtttcctatgggacgattatccacgaattaaaggatgtatccaaatcttacaaggaggcggggatggctctggatgtaggtaggatcttctatccgggacacaatattctggcgtacaatgagcttggtatcggacggctcatccatcagcttcctctttccctttgcgacatgtttctgaaagaagtatttggggaacgggatgtatcagagtttgaggaggagacgctttccaccgtatataagttctttgaaaacaatctgaatatttccgagacagcacggcagctttatattcatcgtaatacccttgtttaccggctggagaagattcagaagctcaccgggcttgatgtccgggtatttgaggatgccctgacatttaagattgcgatgatggtatcggagcacatgaaatatatgaatcaatagatggaaaaccgcagagacaggcgttatagcttgtctctgttgttttaatgtgctaaaatgaggaaagcagaaaagaaggaggcgattgtccatatggtgaaattatatgaaaatggagtttacttactgcatggaagagatatcatagaagacggtccggaggcggcagagaagctgcaggcaaagaacgggcacaaggttttgaagacggaggcagcggagcagaccatttcctaccggattttgaaaaaacacaatgtttcagacaatatggaggatctgaacatcaagtttgacaagctcacctctcatgatattacatttgtggggatcattcagacggcgagagcgtccggcctcgagcggttcccgattccgtatgtgctgaccaactgccataacagcctttgcgcggtgggcggaaccatcaatgaagatgaccacatgtttgggctgacctgtgcgaaaaaatatggcggtgtctatgtgccgccccaccaggcagtcatacaccagtacgcaagagagatgctggcaggatgcgggaagatgattcttggatcagacagccatactcgttatggggcgcttggcaccatggcgatgggagagggcggaccggagcttgtcaagcagcttctgaataagacctacgatattcggatgcctggtgtcattgccgtctatctggatggcaggccggtaaagggcgtgggcccccaggacgtcgcccttgccattattaaggcggtattccagaacggctatgtgaataataaagtcatggagttcgtaggaccaggcgttgcgaagttgagtgcggatttccggattggtatcgatgtgatgacaacggagacgacttgcttgtcctccatctgggagacggatgaagtaatcagggaattctacgagatccacggacgagagggtgagtatgaggagcttgcaccgggagatgtggcatactatgatggcatggtctatgtggatctgagcaaggtgcgtccgatgatcgcgatgccgttccacccaagcaatgcatataccatcgaggaggtaaacgccaacttgacagatattctccatgatgtagaggagaaggcaagagtgagccttgataatgcggtaccttattccctccaggataagatccgggatggaaaactctatgtagagcaggggattattgccggatgtgccggcggcggctttgaaaatatctgtgcggcagcggacattatccggggcagaaatatcggggcggatgcctttacgttcagtgtctatccggcaagtacgccgatttatatggagcttgtaaagaatggagccgttgcagaccttctggcggcaggaacgattgtaaagacggcgttttgcggaccgtgttttggcgcgggtgatacaccggccaatcatgcgtttagtatccgtcatacgacaaggaatttcccgaatcgggagggctccaagctgcagagcggacagatttcatccgtggcgctgatggatgcgcgttcgatcgcggcaacagcagcaaacaagggatatctgactccggcgacagatttggacgtggaatacagcagtccgaagtatcattttgacagttccatttatgcaaaccgtgtttttgacagccacggaaaggcagaaccggaagtggaaattcagttcgggccgaacatcaaggactggccgaagatggcggagcttccacagaatcttctgttaaaggtcgtttctgagatccatgatccggtgacgacgaccgatgagttgattccatccggtgagacatcttcctaccgctccaacccgctgggactggcagagtttgcgctttccagaaaggatccggcgtatgttggacgtgccaaggaagtacagaaagcggagaaagctattgaagaggggatctgtccgttagaagtgcttgatgagttgaaactggtgatggcggaggtaaagaagcgttttgctaatgtaggtgaaggaaatcttggaatcggaagtacgatttttgcggtgaagcccggggacggttctgcaagggagcaggctgcctcttgccaaaaagtacttggaggatgggcaaatattgcctgtgagtatgcaaccaagcgttatcgctctaatctgatcaactggggtatgctgccgtttattacaaaggaagatcacaccgcactttcttttaagaacggagattacatttttgtgccggatattcgaagggcggtggaggacaaagcagatgaagtcaaagcctatgttgtggacagcggtctcagagagatgacactgtatcttggagcattgacggatacagaaagagacatcattctgaaaggctgcctcattaattattatcgagggtaaattcagaaatagacgtaagaaatatcaaaactcatcaaaaataaaaaccctgcagggaaaagcaccatggtatagcgccgcagtccctgcggggttttacaaaaagttaaatttattcttctccgttgaagcagtaagtgcaaagcttacaggagtcgattccaatggattcgatcaggtcatccaggcgatgataacgaagggaagtgaaattctgctgtctgcagatttcatccagcattttctggtagcggtcactgttcggatctgcatattctgcaagaatctcaggagaagcgtctccttcccagtctcggatgatccgacgggtaatcagatccagctcggatttggagcgggagaagttgaggtacttacatccgtacaaaagcggaggacatgcaggcctcacatgcacttctttcgcaccgctctgatagagaaactcggtcgtctcacggagctgtgttccacgtacaatagaatcgtcgatcagaaggagcttgcgatcctcgatcagcgcctgtaccggaattaacttcatgcgggcgataagattccgctggctctgtgtcgtaggcatgaaagagcgcggccaggtcggtgtatatttaataaatgggcgggcatatggaattccggattcgttcgcatatccgatcgcatgtgctacaccggagtccggaacacctgccacaatgtcaggagataccgttcccgcatccctcttggcaagcaggcttccacatttgtagcgcatttcttctacattgactccctcgtaggaagaagttgggtagccatagtatacccaaaggaaagaacagatcttcatcttttcgaaaggctgtccgactgtctccacactttccggggtgatgtagacgatctctcccggtcccagctccttgtagtcggagtagccaagattgatatatgcaaagctttcaaaggaaacgcagtatgcgtcctctttcctcccaatgacaacaggggtacgcccataacggtcacgcgcggcataaagcccctcctggttcatcacgagaagtgtcatggagccgtctacaatcgactgtacgtaacggattccctccacgatggaatctttcttacagatcagggaagcgatcagttctgttgcattgatctgtccggtactcatttcctggaaatgagagtgcccgtcctggaaaatcatctttaaaagagaatccagattgttaatcttgccaaccgtcgtgattgcgaagctgccaagatgtgactgaatcaggagtggctgtggttcaaagtcggagatacagccaatgccaagatttcctttcagctcattcagatccttgtcgaatttggtacgaaacggggagttctcaatattgtgaatggcacggctgaaaccggactctccatgagtcgccataccgcctcttcttgttccgaggtgagaatgatagtctaccccataaaataaatcaagtacacattcgccttttgatgctacaccaaaaaatccacccatagtatatggttctcctttcccattctaaaacaaatcttgcgttgacaatactaatttagtttagcacggatggcctggtaaatgaagagggaaataaaatatagataaatgaataaaaattcaaaataaaacagataatttagacaattaaaaattaaaaatgaaataaaataaaaaataattcaaaaaagtattgacaaataaagaggcaagtgctatagtttaatcaatccaaaagaaaagaaacctgacgagaaaggggttcttggaactggaagttgtttcactttcagaattggaaatttagaaaaaggagggcttttaccattggacagcacggagttcaaaattcaatatgttagtggtattacagatgaaggttcccatgatgaaagcctttatcaataaataaatccagtaaatagttgagtatacaaagtatatcggagatgtaacaagctggaatatgagattgaaaattctgtaagacatattgaatatgataccacatcagtcaatagttcaaagaattagaagatgtgtaaagaaacatcgcctaaggatcagaaattttatttaaccgtttatcttatatttaatatgagttgatgaaaaatgatttggtatgcggataatacaggggaagaagccaaggtgcagaacccataagtacattagatacattagaataaaaaggagaggagttctctaaattataaaattgaatatatcggcagaagatttgaaaagtcaacaaaattaaatatattataaaaggaagtagaaaatctgagatcaaagattacattagcggaaaattaatcagagactttgagttatatatcgaatataaaataaaaaaggcttttgggaaccggtaaatcgaaatgaaagattcctccggtaagagaattaaaaatatgataaaattgaataaataaaacagccattataagaaaaatatataatggctgtttttctgttggtgataagtaaacatccggaggtgaccgagacgttggcaactatcttcaataccggaatgtgtcatctgacacttacaatgattgatgtaatagttttgtaataattaagaaaaaaacggctccaattttttgacattgacaagttggtatgatacactaagaaaatgaaaagatatatgatccttgcgaataaaagaacgatttgaagctgctatgatgagcaagtaattaatgaggtgagcgacattggataaatacgagtatcgtgaaaaaacggaacaaataatgaagtacgtccagacaaagtcctacgataaggcaaaagagattgcagagacgattgactggaagcgtgtgaaaaatgcatccatgctttgtacagtaagtgagatttatgaatataccggggagtatcagaaaagcagagagattctttttatcgcatatgacagaagtccggggagcaggaagattgtataccgactgggaacgctggcgctccggctgggggagacggaagaggcgctggattgctacgaggagtttgtgagtatggccccgaaagatccaaatcagtacatattaaaatataagattctaaaagcgcagaatgcaccgcttaaagagcagatccgtgtgttggaagagtttaagaaggcagagtatattgaaaagtgggcatacgagctggcagagctctatgacaaagcggggatgacaacggaatgtctcgaagagtgtgatgatctgattctgtggttcagtgatggagtcttcgtacagaaggcgatggagctgaagataaaatacaagccgcttacaccacagcagcagcagaaatacaggactccggaaaccgaggagaagtcccaggcggggaagccggctgcagtggaaacggcacaggaggaagagctggagaagaaaggtgagatcttggaagggcaggcatcacaaggacagacagccaaagaggagccagatcagagccaggaaatacagccagagccggaaaaactggttgatgtcggccaggtgatttccatgcttcaggatgatgataagagagatgctctgatcaggaaattggatatgtccagggcgctgacaggagtttttttgcttggaatggctgtcgggggaaatcagacaatagaagaagtaacgcatatgttgggaaaaggagagggagacgtgtacgagacaggacagatgagaatagaggagatcctccgtcaatgggaagaaagacagagaaaaaatgcagccgccattgaggaaaagaaaaaagaagcagaggaaaaggcagccaaagagcgggctaaggccgagaaggtctccaaagatacagcaacaattctttcggaagatatccagagacttctgaatgaaatggaatcagaagaaaaaggaagccaggaagaaatgggcggtacgacagaatctattgcaagactttctgagtctatgaaagagcagccagaggaaacagtgtctcaggaagagcctgctgaagaagagattatggaggagacagtcggagaaacagaagaagctggagaggaagaagaagagtacgaagaagaagagtacgaagaggacgagtacgacgaagacgagtacgaagaggaagagtacgacgaagacgaatacgaggacgagtacgaagacgtctccgaggatgaatttgaggaggagtatgacgagggggaatacgacgacgaagaatctgattttgaagaggatgattttggctatgatgacgaagaaatagaagatgaggaaacagaggaggaagaacctacaaagctggagacagaagaagtacttgagattgaagagccagatgaggatgatagttccggatcttctggcggctcgtcctttgataccgggtttattgtacagggccgttatgatttaagcgcaacaagtgagatcggtctgaagcttggtctgactgaggagcagaagaaactgttttcctactttgtaccgattcgtggcatgagtgaacagcttgtagatgttttggagcaggataaagtctgcaagaagcgttacggtacatccagaacaggaaatattcttgtaattggtcataagggttccggtaagacggtgcttgcggtagatatcgtaaaggcaattcagaagcaacgcagaatgaaacagggtaaagtggcaattattacgggtgatgccctgaataagaaaaatctcatcagcattatccaaaagctgagtggtggggcgctgattattgagaaagccagcaagatgaatgataagaccattgatgatctgacaggtctgatggaagagcagaccggcgagatgctttttatcctggaagatgagagacgtccgatggaaaaaatgctctctgagtatccggatttccgcagaaagtttacttcaagagtagagcttccaatctttatcaacgatgagctcgttacatttgggcagacctatgcgaaggaaaatggttaccggattgatgagatggggattctggcactttacagtagaattgatgtccttcagaaagaagatcattttgtgacggtagctgaagtgaaggatatcatggatgatgcgatagaacattcacagaaagccaatgtgaaacatctgatgaagcgtgtgtttggaaagagcacagatgagacagaccggattatcttaaaagaggatgatttcaaacattaagtaatagttttcggcggctaagtcgagctgtgatggcggaactgttacaacatgaaagataatcgacaataattgtacaaaatgacgaaaagagttttaataaagttaaaaactttgttaaaactctttctttttgtccgacgctcaagtataataaacgtagactttttgtgagaaggtgaatagcatggcgagaacaaaaaagaagaaaccatatgaaatcggtgagctggatcagtacttatttggacagggcacgcattatgatttatataaaaaaatgggatcacatcttgtcacggacggaaagaagaagggcacttactttgcggtatgggctccgaatgcaaagtctgtctcggtggttggtgattttaataactgggatagggacaagaatccgatggtgcgggaagatccgcttggaatttatacctgctttattcagggggttgaagcggatatgatctataagtactgcattgaaacaaagacgggtgacttgctctacaaggcagatccatttgccaactatgcggagatgagaccgggcacagcctccaaggtgcatgatatttccaacctgaaatggagtgacagtgcttggatggagggcagggccacctggaatatggacgagagtcctatctctatctatgaggcgcatatcggctcctggaggcagcatcctggcgaggaggacgagaggttttataattatcgagaattcgctgtagaagcggtcaaatatatgaaagagatggggtatacccatattgaactgattgggattgctgagcatccatttgatgggtcttggggataccaggtgacaggatactttgcgccgacgtcacggtatggtacgccggaagattttgcttatatgattaactatttccatagaaataagatcggagtaattttggattgggtaccggctcatttcccaagagacgcgcatggccttgcggatttcgacgggacggcggtctatgagtatgcagatccgagaaagggagagcatcctgactggggtaccaagatttttgactatggcaagtcagaggttaagaatttcctcatcagcaatgcgctgttctggatggagcattttcatgtggatggtctgagggtggatgcggtagcatccatgttgtacctggattatggcaagcaggatggccagtgggtggccaacaaatatggaggaaatcagaacctggaggccatcgaattcttcaagcacctgaattctgttgtgcttggacggaatcctggtgcgctgatgattgcggaggaatcaacggcgtggccgaaggtgaccggaaagccggaggacgatggacttggattcagcctgaaatggaacatgggctggatgcatgattttctcgaatacatgaagctggatccatatttcagaaaagagcatcataatcagatgacttttgcgatgacctatgcttacagtgagaagtacattctggtactctcccatgatgaggttgtgcatttgaagtgttcgatgttaaataaaatgccggggcttggttttgacaagtatgcgaatctgaaagtcggctatgcgtttatgatgggacatccgggcaagaagctgctctttatggggcaggatttcgcacaacttcgggagtggagcgaggcaagggagctcgattggtatctgcttgaggagccggagcatcagtatctgcaggcgtttacaagagatcttctgaagctctacaggaagaataaggcgatgtatgagcaggatacggaaggatacggatttgagtgggtgaatgcaaatgatggataccggagtattttcagctttatccggcactccaaacataataaaaagaacctgctttttgtctgcaactttaccccaatggagtggacggattatagagtgggtgtgccgcgcagaaagcagtataagctgattctaaacagcgatgacaagcagtatggcggaaagggagaggagcgtccgcagatatataaggctgtgaagcaggaatgtgatggaagaccgtattcctttgcgtacaagcttccgccatatggtgtggcagtttttgaattttaattctgcatgaattattgcatgctacagaagtatgaatcgggcccgtctggaaagtctcagtggctttgtggatgagcctgattttcttgtcccatgggaaaccttcttgtaaggtacacgtggaagagaacggaggaaaaaatggagaattatcagattacacagtggtgtcattattttatcagagagcaagtacatgagggggatttctgtattgacgcaacctgcggtaacggacatgatacccttctactgtgcgagctggtgggggacagtgggctggtagccggatttgatatccagaaagaagcggtggaaaagacagaaacacgactcgccgaaactggaatgaacggacggggccgaatattctgctgcggacatgaaaaaatgaaggaacagcttttgcagcatgaggattgtaggaaaatgctggagcagacggcggacgggtatggtaaggtttcttgtattgtatttaactttggatatttgccgggaggcttgcatgagcttgctacaaaggcagaaacgagtgtggtggcgttggaggaaagtcttactattctgaaacgaggagggattatcagtctctgcatctacagcggaaaggacagtgggtttgaggagagggacgccctcctggaatatctgaaaaatcttgacagaaaaaaatatctggttataatgagctcatattataatcgtccgaatcatccgccgattccgggtctgattatccggatttgaggtggcagaacaggaatgatagcatataataacagacaggagggatgaagatatgcagcttgcagtaggattgttattaccgtttctcgggacgacactgggtgccgcctgtgttttttttatgaaagggcagatgaagccgcttgttcagaagatgcttctgggatttgcgtcgggagtgatggtggcggcatcggtgtggtcgcttctgattccggcaatggatatgtcggaggagatggggaaatatgcatttatcccggcggcagccggatttttacttggaattttgtttttgcttggaatggaccgggcagtaccgcatctccatatgggagcagaatgtgcggaggggcctaagtgctctttaaaaaaaacaaccatgcttgtccttgccgtgacgcttcacaatattccagagggaatggcggttggtgtggtgtttgcaggtatgctttcgcaaaatacagagattacggtggcaggagcttttgccctgtccgtggggattgctatccagaatttcccggagggggcgattatttccatgccgttaaaaagtgagggcacaggaaagggaaaagcctttctctatggaatgttgtccggagcggtggagccggtggcggcagtgattaccattctgctggcaggatttatcacgccggtgcttccgtacctgttgtcctttgcagcaggggccatgctttatgtggtcgtagaggaactgattccggaagcgagcgagggagagcatagcaatatcggaaccatcggttttgcggcaggttttgtgttaatgatgatcctggacgttgcactgggataatgagtacatcaaataagtagacaaggagaggagaaaaaggatgagacttcggaatataccgggggcaagggacgtgattgcaggacatgaggctgtgattaaagaagaaaagcaatggaaggggcgctgggatcaggtttttgaaaatgatcaccccatccgcctggagatcggaatggggaaaggacagtttttgatgcagatggcgctgcagaatccagatatcaattatattgggatcgagcgttattccagtgttcttctacgtgcactggagcggatgaacgcattggaggaggcaccgtccaatctccggtttgtgtgtatggacgcgtccgggatcggtgaggtgtttgaaaaaggagaggcagaccggatctatctcaacttttcggatccgtggccgaaggcccgccacgctaagagaaggctcacttccaccgcatactgggagcgatatgatgggatcctgaaggaggatggtacggttgagtttaagaccgacaaccgggagctctttgatttttccctggaacaggtggtggaggcaggatgggaggtgaaagcctgtacctttgatcttcacaatgacgaaaagatgaatcagaacaatattatgacagaatatgaggagaaattttcttcaaaggggaatccaatctgcaagcttattgcagaaagaaaaagatagtgagaaccagtaacggtatctggatttttgcatatgctgttaaaaaagcgggcagggtagaagatggagagaagaggcagaagaaaacttcgttgtacctgcggtagattatgttatgacaatgcatggtggaataaaaaaatgcggattctgcaaagatcttgtgcggagctttataaggcgcttaatcctggctgcaggccggggcggtgtgattcatgcaagaattgacagaaaaaaatttccgcagagaggtgttagaggcgaagaaaccagtgctggtagagttttatgccttgtggtgcgggaaatgcgctatgatggaggatgtattcgaactcgtagcagaagaatttgatggacagatggggacaggaagggtagaaacggagcggaatccgcttctgacagcgcgctaccggataagcaggctcccctcatttctcctgtttgttggcggggaagttgttctgcggatgacgggcgtcatggagccagaggagatggccaaaagactggagagcaaaaaaatataaaaaatttaaaatagggcttgcatttttccgagaggtataatataatattccttgcgttaagcaaaacggtaaaatgcaaaagcgccattagctcagttggtagagcacctgactcttaatcagggtgtccagggttcgagcccctgatggcgcactttaaatcactgtttttggagagggagatctctggggacggtgatttttttgtgtatgtgagggaatgaatggaagtgacatgtttacttttagagaaaggggtttctatatgaaggaaaagatacaaaagagagccaaacgaatccggatcaggtggaagaaaaggaaagtaaaaataacagtcgcccttcttttattggtctggcttgcggttattattgtgctgttgaagcattggaggctgtttgggagaagtgcaaatgggggatctgtaaaaggaattgttcaatgggcgtttctttggatcattggaatagcaggagcaatattatggcaattttatgccttgtttttaagaaagcaaaggacaatcagaagaatcggaattggtggtatgattccattggctattgcgatgggaacaggcatgttctgggttatggaatggatttataatccacagatgtttacaattccttatcagtatgttgctcttagtatttgtgtatctgcgatagttttcctgattcttttattgctgtgtaattcgttatggcttgcggtgcttttgtgtagttgtctgtattttgcgtggacagtcgccagccattttacttacatgtttcgagggctccctttacagattgtggatttgctggatttaaggacggcagccacagtagccggggattatgaatatacaatcacattgcatatgctcattgtaggagctgtgattaccagcattgttacttcgctgtttgtagccaatcgatatcaagttgcaaagagtaaaaaaacaaagattttgatcaggatcattggtctcgtggtattggtgggaggaatccggtatctgggatggtcggaacaaccagagcgttggggtatagaattaaatgggaatcggccgggagacagtttttatagctacggaatgcaaatgtgtgttattcgaagtgcaagagatgctattgtaaaagagccggcaggatatgaggtagaagaacttcagcagatggcggatgatactaaaattcagaatactagaaaacaggaaagacccaatattatcgcaattatggatgagaccttttcagatttgacgtggattcgggatttccctgtatctgatgagattattccgttttataacagtctgaaagaaaataccatcaagggcaaagtattggttccagcccttggaggaggtaccggaaaaacagaatttgaattcttgacaggtacttctatgagaatgctttcttcgactccttatgttgcgctggggaagaagctggatgtgtctcttgtgaaaccgctggaggagcagggctatactacggtggcaatgcatccttatgttcctacaaattataacagagaagttgtatacgaaacgatggggtttgaccgctttttaagtctggaggattttgaaggagatcaaacaatccgcggttttatttcagatgaagcatgttttgataaaattgtgggaatgattgaagaagaggagaatccactcttcactttttgtgtgacgatgcaaaaccattccccatatacgaaatcctacgatgcgtctgttaaattgacggaatataaagatgaacgggtggatcagtatttgtctctggtccatgagtcggatcgggcgttacaaaatctgattgaacatttgaaggaatctgacgagcccacggtagtagtcttttttggagaccatcttccatcgttatcagaagagttttatcagtatctgttcggaataccacgggcggaagttccgtttgaagagtatcagaactattatcttactccttttctgatttgggcaaactatgatattgaagaacaggaaaatgtgatgacaagttctaattatctgggagcgatgacagtggaagctgcaggagtagagttgacgaaataccaacaatatttattgaatctcagagaagaagtgcctgctttcggcgcctcatcttaccttggacaagatggaaaattccacgagtacggagcggcggtcaggaggagaactatctgaatctggacgattctgtaaattataataaaatttttgacagaaaaaacaggattaacgacctttttttcctggattcaaaagagtaaaaaagaatggaaaatgcactttttcctatacaatcgatgggaattgcctgaaagtctggaatgtacctgaaatagtacatgaaacgcattgacacatatttcacgaatcgctataatagccccatgaaacggttgtttcgtaacagtatagggtttatttttgaaggaggattatcaacatgagaaaagaatgggaatcttttcgcggaggcatctgggagaaagaaatcaacgtcagagatttcatccagaaaaactacacaccatatttaggtgacgacagctttcttgcagggccgacagaggacacaaaggagctgtgggcgcaggtaatggatttgtccgagcaggagagagcaaaaggcggagtgcttgatatggacacgaagattatctctacgattacgtcccacggaccagggtacctgaacaaaggtaaggaaaagattgtcggctttcagacagacaagccgtttaagcgttctctgcagccttacggtggtatccgtatggcgatcaaagcctgtgaggacaatggctaccatgtagatccggctatcgttgaattcttcacaaaacatagaaagacacacaatgacggtgtatttgatgcttatacaccggagatgagggcctgccgttccagccatatcatcacaggtcttccggatgcttatggacgtggacgtattatcggtgactacagaagggtagcactatacggggtagacaggctgatcgaggataagcagcatcagaaagatacaacaagaacgattatgtactctgatgttacaagagagagagaagagctctccgagcagatcaaagcattaaaggagttaaaagagctggggcagatttatggatttgatatctccagaccggcagaaaacgtacaggaagcgatccagtggctttactttggatatcttgcggcaatcaaagagcagaatggtgcggcaatgtccctgggacgtacttccactttccttgatatctatgctgagcgtgatcttgcaaacggaacctttacagaagagcagattcaggagtttatcgaccactttattatgaagctgcgtcttgttaaatttgcgagaacgccggaatacaacgccctgttctcgggagatccgacctgggtaacagaatctatcggtggtatggggattgacggacgtccgatggtaacgaagatgtcttaccgttatctgcatacactgcagaaccttggaaccgcaccggagccgaacctgaccgtactttggtctacaagacttccggaaaacttcaagcgtttctgtgcgaagacttccattgagtcctcctctattcagtatgaaaatgacgatctgatgagagtgacacacggagacgactacgcaatcgcatgttgtgtatcctccatgcgtgtaggtaaagaaatgcagttctttggtgcacgggcaaaccttgcgaaatgtctgctctacgcaatcaacggtggtgtggatgagatttctaaaaagcaggttgggccaaagtaccgtccgatcacatcagagtatctggattacgacgaagtaatggacaagttcaaagacatgatgaaatggcttgcacaggtttatgttaatgcactaaacatcatccattatatgcacgataagtactgctatgagagattacagatggcgttgcatgataagaaggtgacacgttggtttgcaacaggtatcgccggactttccgtagtagcagactctttgtcagcgatcaaatacgcaaaggtaaagacaatccgcgatgagaatgggatcgttgtggattacgaagtagagggagatttcccgaaatatggaaatgacgatgaccgtgcggacgagattgcatacgatatcgtgcatcagtttatggcttatgtgaaaggaaaccacacataccgtgggggtatcccgaccacgtctatcctgaccatcacatccaatgtcgtatacggaaagaatacaggttccacaccggatggaagaaaaggcggagaaccttttgcgccgggagcaaacccgatgcaccacagagacagccatggtgctgttgcatctttaagctctgtatccaagctgccgttcaaggatgcacaggatggtatttccaacactttctccattattccgggagcacttggaaaagacgatgcggttctgtttgatgatattgcgtttgaacttgaaccggactgcgcttgctgtgaaccaaacgcatcattagacgaagaatagaaataatataaagaaaacccatataaggaggatcatcatatgaaaatcagtgaagctcagattgataatcttgtaggtttattagatggatacgctgagaaaggcggacatcatctgaatgtaaatgtatttacaaaagatacgcttctggacgctcaggcacatccggaaaagtatccgcagcttacggtgcgtgtgtccggatacgcggtcaacttcaacaagctgacaaaagagcagcaggatgaagtcatttccagaacattccatgatgaaatgtaatcaaggctatattcattcgacagagagtttcgggaccgtagacggtcccggaattcgttttgtcatttttttccaggggtgtccgatgcgctgtaaatactgtcataatccggacacctggcagccaaaccagggaaaacttatgacagtagaggaacttttggaattataccgacacaatgagaaattttataagaaaggcggaatcacggcgacaggcggggagccgctgatgcagctttcatttctgacagagctttttagacaggcgaaggaagcaggtattcatacatgcctcgatacatccgggattatataccgggagtcgaaaaaagatgagtttgaagcattgttttgcgtgacggatctggtgcttcttgatatgaaacacagtgctccagacggccaccgggaactgaccggacaggagcaggctccggtgctggagtttgcgagagctttggaaacggccggtgtccctatgattatccgtcatgtcgtagtgccggggattactgacggcgaggaagagctcacggcgttgggccatctgatttccggttatcgaaatctgaagggattagaagtgcttccataccatacgatggggacgaagaaatatgaacaactcggaatgaaatatccgttggatggagtggaggccatggataagtctaaagcccatgaggcaagagaattgctgctgagaattataatggaagacagaaagaaaagtattgtaaaatagtttctttacgcataaagcgccagttccggtatttaatggaactggcgctttatgatccctttttctgctctgtcttgtcaaggagagaggaaatgaggctgtacgcttccgtttcggtataaaacagatccttatccagatgttcacagaagtcacagaagccgtgcagcaatccgggttcagtaatgtccaggcagatgagctgatccggctcagaggaggggaacatgaggtagccgttgcgtggattaacatacataaacaattcattgtccagatccccaatggtgcattttagcatacacaatccgtttggagggcaaaattttaaaaattgacggatcagtacgatacggtcagatagctcaaaggggcggtaaacggcaggaggatattctgggatccgtcctgtctccagaaaacgttgcaggccgtcctcagaaaaaataaaccgcaccggatgttgggtaaagcgtttacggatgctgtgcacataatccataagcatggcgatgagcttatcacgacctggaatctccggataaatatacttgtcaaagaaataatccggaattccaaaggtaagacatggaagcatttggaaacagtaattctgttccatatctgcccggatattatggaaataggaaagttgtgtcggcagattgttcatcacaacgccaaacgaggaaacctgttcgagataacgctcatacatttgatgaaaaaatttcagggtatcttgtttttcaaagacaataccggattgcatgtctttggagaggagaagagcgtacccggacgtcagtacaaggtaaggaaacaaaaggagatcggccgatgaatgaatcagatccccataatagtaatagacatgatatctgcacgcagagcagtaaactggcagaatctttttgagacatgccagattataatctttcttatcgtttgtcagttcatcgctcttatgaaaacagatgatctgggtgatggacagattctgattctcataaccgagggtcggaagcaaattcatcagaaaatctgtatctggctgaatcagcaggcggatttggggatcacttttacgtgtctccagaaacaggatgtgaaacagcaggtggttaatctcattttgtcctgatactgttgacatatcggagatgtcatgatagcttactagtggttggtggtcaggggcggtatagatctcagaatatttcctgaaattctcgaaaagctccaggatatttttacgacggtaatagttttcaaaaccgtccatagaaattttgtaagactccacaaaatcggtccgctcggatggagtgagccgcagaaactcagcgatcaaaagtacggtgtccatactggttacgggtctcgtccctttaataattttatacatcagagagcgctcgattccacagtactgagctatctcataggacttgatcccttttgcggcgatatgatgtcctaacaaatctgaaaaaactgacatagatcattctcctccggatgatagttctattatgtgatagatctattataaagaataccgggtgaagaacacaagcggaaaatgcagaaacattgtccatttttttgtccactgaggaaaccgatagaaagcagggcagaaatatgataaaataaatttgtctaagggaatcgagggagttagtgattcataatagcgtataccatagaaatatggtatgataaaaacgaatctgggcgacgagattcgttttttgttgccttaaaatcaaggaggccatgtatggaggttttaataagaaacgcaaaaaaggaagaagcggctttgttggcgcagatcgaagcggagtgttttccggcggcggaggcagccggcaagcaggatattgaggccagaatggacgtatttgaggactgcttttttgtggctgagacaaatggaaagatcgtgggatttatcaacggagctgtggcaaaagaggcgtctttgccggatcagatgtaccacgacgcatccttacatgatccgaacggagcatatcagacagtcttcgggttggatgttcttccggcatatcggagaaacggcattgcaggaaggctcctggagaggatgattcatcatgccagagagtgccaaagaaagggtgttgtgctgacatgcaaagatcatctggtacattattatgccggatttgggtttaaacattgcggtgtggcggactctacccacggaggggccaagtggaatgaaatgaaactgttgttttaaatcgggtgatgccctggggcttttcgtgcttccagggcatttcaagtatcagggaagtgtgctataatcagggtatcggattgatataggatgtcaaaagagaggagaacgagatgatctatacatgggcagcggatgtggctccgcttctggatccaattatatatgaagcgtattatcgcgaggttccgcagtggagacaggaaaaggcagaccggattcgtttttcggaggatcgggcattgagtattggagcctatgtgctctatcagaaagcactcagggagagcgggctttctacggagatgtgctttaatctttctcattcgggacattatgtcctgtgttcgattgcagatgaaaaagaaaagaggacgggatgtgatttggaaaagattgggacgccgggtatgaaggtggccagaagatttttttgctcgtccgaatggcaatatattcgggaacaggaatccggggaagagcaaacggaagcgttttaccgctactgggttctcaaagaaagttttatgaaagcgacaagatttgggatgaagcttcctctggattcctttgaaatccggttaaaggatgaaggggccccggtacttgtgcgtatgccggaacatatcaggggggaattttatttccacgaatacccacagaaagagaaaggattttttgccgctgtatgttcggaagacccggaaattgatgatatgctgcggtggatgaccttatgacagatgagcttgtggcataggtaagcagaaaggacagaagaatgaaaaaacagacaaaagaaaagtggtgcagactggagctgctggcgaggtatcggattcggaagatgcagcatccaggaagggtgtttgctgtatcctgcgtatctatccttgtggccggatttcttggtggagtggcgcttggccggcatgtggaggggcggaaggcggaggagacgatgcaaaaggagacggacaggtatgaatcgctccagaaagaatatgatgttgtaaaggaacagaccgaggcgcaggacaaagacacaaggccgtggtatctgatgcttgtaaaccaatcccatccgatggaggaagggtatgtgccggagctggccaatattgacgcgtcccaccaggtagacaaaagagttctggaaccgttgcagcagatgctaaaagcagcaagcgatgagggatacggactttatgtctgctcggcgtaccggtcggtagacaggcagaaagagctgtttaatgagtccatggtcggctatgtcaatcagggaatgaactactatgaggctgccattgagacggcgaaatccattgcgtggccaggggagagcgagcacgcaaccgggcttgcgatggacattgtatctacggagtacgcggggctggatgaaaagcagggtgagactgacgaccagaagtggctgatggagcactgctatgaatatggatttattctaagatatccgcaggacaaatccgatgataccgggattatctatgaaccatggcattaccggtacgtggggactgaagcagcgcttgctatccgggatcagggtgtgacactggaagagtatctgaatgaggagtattaaagaacggtcgagtatatttggaaagtgtcagaaagcagaagtggtgagatttggtcggacaggagggatgctggatgaaatggagcaggctgttgtcccccaagagggagcggacaggacgaaaacataaggagaagaaccggacggatttaaggacaagttttgagaaagattaccatcgcattattggaagcgcatcatttcggcggcttcaggataagacccaggtatttccgctggatcaaagcgactttgtgagaaccaggttgacccattctttggaggtttcttcctttgccaagtcgcttggtcagaatattggagagtatattcttgcttatgggaaggatccggaatttacgccacagatgaaagaggatatttgtaatatattgctctgtgcagggctcatccatgatattgggaatccaccgtttgggcatttcggagagacgacgatccgggaatggtttgaggaacatctggatcacatcttctttcaagggaaaccattgagcgaagtactgaccccgagaatgaaagcggatctctattattttgaaggaaacgcgcaggccttccgtcttgtgacgaagcttcattatcttgtagatgagacggggatgaacttgacctatgccttattaaacacaattatcaaatatccggtggactctctgcatgttgatccgtgcgcaggggtaattgagaaaaaaaagctaggttattatctggctgacgaagagctgttccagaaaatcagccgggagacaggagctgaagatcatcggcatcctctgacctttatgctggaggctgcagatgatattgcatatcggacggcagacattgaggatgcttttgtcaagggatttctgccgttttctgccctggaaagagagctaaggcaagtggatacgggggagaattttcaggcgtatgcctgtcttgcggatctgtaccagggtgccgtggaacgaggcgaagaggagccggaagcatatgcggtaaagaactggattgtccgggcacagtcttttctgattgcctgtgcgacagaaggattcacggaaaactatgagatgattatgtacggaaaatatcacaaggatctttttgcggggacaaaagcggaagagctcatggagatgctcggacatatagcggagacctatgtgtttatgacagatgagatttacaagatggaggtggcggagtcgcggattctttcatttttgatggagaagttcgtggcagcggcggttcgtgtgggagatcctgagcaaaagatggactccatagacagaaggatgctggcgtttgtttcagacaattataagaaagcttacgtcagacagtctgagggaaaagacatggtggagaagctatacctgcggatccttcttgtgaccgactacatctgtggtatgacagacagctacgcaaaaagactgtatcaggaattgactgcaagagtgtagcgtagagaaaacggataaaggcgaaaacccgctgatcataaagaccagcgggttttcgtgtttatagtttctaaaggaatgagagtaaagtggcacttggagatatctctccgaagtgcttactttatgaggggggagatagtgattgttcatcaactatctggttcttagtatagccagaaaatgtgtcaaaaatgtgttgaaactataaaagaaatacaaagattattaagaaaaacagaagacggagccttatgatggctccacctttgtcgatttttaacgcacttttatgcccttactgatcttacatcatcccggctttcatcttaacgggctatgatatcatatcttcagtctccagaccctcaaactgcatcttataatagtgagcatagatgccgccccgcttgagcagatcatggtgtgtaccacgctcggcaataccattttcggtgatgacaataatctcatcagcgttgcggattgtagaaagacggtgggcaatagtaatcgtcgtccggttttttgctaattcttccagactcttctggatgtggcgttcactttcattatccagggcgcttgtcgcctcgtcaaggatcagaattgggggattcttcaaaaatactctggcaatggaaattcgctgtttctgtccgccggagagtcttgttccacgttcgcctacataggtgtcgtaaccgtcaggcagggacataatgaaatcatgaatgttggcacgccttgctgcgtctatgatttcttccatgagagctcccggctttccgtaggagatattttccttgatggttccacagaacagataaacgtcctgctggacaattccgatattatcccggagggattttaaggtcagtttccgtacattcttaccatctatggtgatgcggccttctgttacgtcgtagaaacgtggcagaagattacagattgttgtcttaccgccgccggacggaccgacgagagcaacagaacgtccggccggaatctggaaggagacatttttcagtaccggggtgtcatcgtcatcgtagcagaaagacacatcttcataggatacaagtccgtgcacatcgctgaggggttgagcacccggttcatccttgatagtcggcctcgtatccatgacgtcgagaaatcggcggaatccggagaagcccttctgaatcatctctacaagttcgacgagaatctgaatcgggctaataaagattccgatatagagagcgtacatagcaagatctgccggatccatctgaccgtgggcaataagataaccgccgaatatcagtgtaacgagatacatcatgccttgaaagaacagattccaacccatgaaactgcccatgcaactgtagtttgcatccttggaaagcaagaatgcatgattgcttttggaaaactttttcttttcaatttcttcattggcaaaggactgtaccacgcggattccgccgagcgtatcctgaaggcttgcgttgacgtctccgattttcctacggttctccatgaaagtttcctgcatccggctgttctgacgcatcgaaaacacaaacatgataattacaatgattacgagtggaatggcaagccgccagttgatgaagaacaaaaagataaaggagccgacaaccttgatcagagagataaacaggttctctggtccgtggtgggcaaattccgcaatatcaaataaatctgatacaagcttactcatcatctgtccggaattgtgactgttgtaataggaaaaggacagcgtctcgtagtgttcaaagagctgctgacgcatatcccgctccatataggctcccatcatgtggccctggtagctgacataatacttacagaggctctgaattgtatacatgacaaagagtcccaacgcgattggcacaagcatttttaaaatggctccgctgtcctttgtaaacagggaattggtcgctgtccgtaaaatttgcggataaacaaggtcaatcacactgatggttgccgcacagatcagatcgaggaaaaagaccgtgcggtatggtttataatagtgaataaatcgttttaacgtatccatagactacctctctttccatttgaaatttctcctgctactaatttaccatacttcatttccacctgcaatggagaaaagggcgtaaatacgtagatcaggattcatcaagaattaagaatttatgctttggctcttaaagaatatctggtattatttaatatagaaaatgaagaagaggtgggagaagatgtatacagtattagtctgtgatgatgataaagaaattgtagaagcgattgaaatctatttgtcgcaggaggggtatcagattttaaaggcttatgacggagagcaggcactcaaggtgcttagtgaagaaaaggtggatcttctagtaatcgatgtgatgatgccgcggcttgacggtatccgggcgacattgaagatccgggagaaactgagccttccgattattattctttcagctaagtctgaggattcggataaaattctgggcttaaatattggcgctgatgattatgtgacgaagccgttcaatccgctggagcttgtagcgagagtaaagtcccagcttcgccgttacaccaagcttggcagtacggtaagcgccggggagcaggaggaggtgtacacggtgggcggtctttctatcaacgatgatttaaaagaagtgactgttgatggcgagctcgttaagttgacgccgaccgagtacgatatcctgcttttacttgtgaaaaatcagggaaaggtattttctatcgatcagatttacgagaacatctggaatgaggaggccatcggggcggacaatactgtagcggtacatatccgccatatccgagagaagattgagattaatccgaaggatccgcgttacctgaaagtcgtatggggagtcggatataaaatagaaaagatctaggaaagagcagaggaagaacaagatgaacaaatggttttattctgcaacatgcaaggggcttttgattcttctggcccatatctgtattgtcgtgagtgtggtgagttttgtctgggtcggttcctcagcaggacttcgttatctggttccattcgagaaggtcccgggggaatatgaggcgactgcccagtttgagaatcggatgaaagagttgtcgatggacgttctggatcagcttgacgttaaagcgaaatatgagacaaatggaagctataatccagataagctgatcgatgtggttcgttatgccaatggagatcttgaccaggatgggaagaaccattccgggattgcgtaccggctcaaagatttggagcgctggagcagaacgtatgaaaatgcatacgagtcggaggagagttgggagcagtttctgcatgattatgtgacaacggtcatcgtatgtctgaaacaggatggaagctattactattattatggagatgacttccgcaataagatggcatcgggggagctgggctttgccgccaatggagaatttgtttccaaggaggaaaagctgaactccattttggagaatgacaatagtacggcgggttatggtgaggtgttggatcaagaaggacagaagctctacacagattgctggaacctgggtcttggtccggaggttctgaaggagtcatatccactggatggagcagccaacctggtagaactggccaatacgaatgagagatggaatggaaaactggccgatgcgtatcatgcgctgtccggcacgcttagtgtgatttccagcgatctgaaagactacaaagaggcgccgggaggatgggaagaaggaaatacgaattacagctatctctatgtagattatgatgatgggcagatttattccaaccgccaggagtttcaggatatcaaagagatcgatcattaccaggaaaaaatcaaaaaggcgggagcctatgtcattgtaactcctaaacttgcaggctttaagtcttcatttaacaacccggctcagagtgctcaggagtggaagaacagtattgtggaatcccacaaaattattggccgtgataccaattacgtcttcatggcctcggtagatacgacctattctgtgcctgacgcgtttgagagtgatcgggagtattaccaggaggttgtgccatatattacgatcgcctgcgagctggcatgggggacgctgatcttgttttttattctgcttgtctgtctgacagtttcttccggacacagcctccgatcggaaagaaatgaaattgtattgtctggatttgaccgttggaagacggagattgcggccatatttgtgatcctgctttggggcgcttccatgtatctactgtccgaatggggatccggctatgcgaccgcctatgattactattattattcggatatctggcaggagggtggacttccaatctataatatggttatggccggcgctatcaccttcattagctgtctgttttttttctggttctacctgagcatggtacgccggatcaaagcacatacgctgtggaagaacagtatggccaaatctgtggcggatattgtggcccggggatggaagcagaaaaagacgacgtcaaaggtggtgatagcctatattttattcctgctcattgagtttgtcacctggggaagcactccgctgatggtgatcggaattctggtcaatatcggggtgggaattttccttgtgcgatacgcactgtcaaggcagaagattaaaaagggtctggtggagatcgcaaaaggcaatgtcaactacaagattcctctggatgacctaaggggcgagatgctggagatcgcgcagacaatcaatcgtctgggcgaggggctgaatcgtgcgttggagaagagtgtccgggatgagcggcttaataccgatctgattaccaatgtatcccacgatattaagacgccgctgacgtcgattatcaattacgtggacattttaaagagagagaatttccaggatcccaaaattcagaactacctgaacattctggagatgaaggcgcagcggctcaagacgctcaccgaggacgtggtggaggcgtccaaagtcagcagcggaaacgttaagctggagtttatgacgctgaatctggtggagttgatctaccaggtggagggtgagtatgaagagaaattcgaggcacgtaacatcaaggtgatactgaacatgccggatgagcctgtgacggtacgggtagacggcagacggatgtggagggtctttgccaatatcttcaacaatgcggcaaaatatgccatggagggcagccgggtctatgcggatttgatgctccagccggggacggctaagtttattttgaaaaatgtttcagaccagcagttgaatatttcggcagatgagctcaccgaacgctttatccgaggtgacgtgtcccgaagtacagagggaagcggacttggattatctattgccaagaatcttacagaactccagggaggtacttttgagctgtatctggacggagatctgtttaaggtactgattaccttcccgagagtgagacggttgaccaaagaaaaagagataaaaaaggaaaggacagaaagagtgccacaggcaggcggcacagaagtgaccggagaacctcagaagaacatgaagacagaaggtatgccggaggcgccgtcgcagaccatgaatcagacatcggaatcaggtataaaataaggaaatctttagatttgggagagggtatttcgatatcctctccttgcgttttgacggaattcgcattacaataatacaagaaaaaagtagaaaggaaatgaaaatggacgaattggcagtgtacctgaaagaggtattttgtatagaacttctgtccgcgattctaagtaacccaagggacagggaaaaggcatggaaagtccggatacgtccggtgctgaaaaaggaggagcttgtgttccagttcgaggtctttatagggaagcaggtttttcacgagaatctgagtgtggaagaggcagttcaaagggcctgcgaatggctggaacagttccggcagatgcagattgacatgaagagtgagcgggccacagtgctggtcagcaaaaagggaaaagtaacggtgaagagaaaaaaagtcagccgtccggataccggggaacagaatctttcccacaaccgggagaagcagtatcttctccgggaggggatggatattccgtttttaaaggatctgggcgtgatgacacaggatggcaagattgttcattcccggtttgacaagtttcggcagatcaaccgttacctggagtttatcgatgatgttctgccaagacttccaaaggatagggagatcacaattcttgattttgggtgtggtaaatcttacctgacgtttgccatgtattattttctccatgaaatgcgggcatatgaagtacggatggtgggactcgatctgaaagaggacgttatccagcactgcaacgtacttgtggaaaaatatgggtacaatcatttgcactttttaaccggggatattgcacagtacgaggaaatgacgaaagtggacatggtggtgacgcttcatgcctgtgatacggcgacagattatgcgcttgcgaaggcggtatcctggggagcagatgtgattttatccgtaccgtgttgtcagcatgagctgaatggccagatggaaaacgaggtgttaagtcctgttttaaattacgggctgttaaaagagcggatggcggcgcttgtcacagatgggcttcgggctgagtatctgaaaagagaggggtatgatacgcagattttggagttcattgatatggaacacacaccaaaaaatattttaattcgagctgtgaaaacggggaaaaaagtggaaaatcagcgcataatagatgcatgtgaggattttcttcatgtgaaaccaacgataggaaagcttttataaaaggggagttattcaatgagaaaaaaagcgatacatgcgggtatcctggccagtgtattcgtagtggcgatgattctgttcggctatgcggtgaacagaaatcatatagatttgacagcagatatcggtaatgcgtctcttccgagagtgtcgttcgtatacaattcctataagatcaatactttggttggatatacgagtgagttggagatggccacgctgcgggatcagattacgcctatgatagatggaaaggtacagatgcagatccaggaaaacgacaaggaagttcgatctgtggcctacgaggtctattctatcgatggaaagaaaaaactgtatttacaggatctggaactgtcggaggataaggcgcagatcgagattccgcggaagttgctggaggagggcgaacggtttctgaaggtgacgctccgttttgatgatggacgtgccagctactatacgaggatagcggatgcctcgaaatggaatctggatcgctgtatggcctatgttaaaaattttttcgataaggagaggaataaggaagcggcggcggaattgcagccagctctggagccgaacagccagagtgataatcagacttaccagacagttacaattcattcggattttgagcacgtgacatgggggagtcttcaaccagaggtaatcggtgatgtacagtggcagattaaggaagctaattccatgtatatgtctgtcatgctgacgtaccaggtggactgtgtcggggaagaaaaggatacgaaggatcgttacaatgtcaatgaattcttccgtgtgcggtattcggagaacaagcagatgtatcttctggattacaaccgcacgatgaaccagttatttgacggtggagcaggagatgtggatgaaaatggtgtgcttctgggagtgacggactctgatgtggattatcttgttaataaggaggggacagttgtctcatttgtgcaggaacggcagctttggaattataataaggaaagcgacgagctttctcttgtgtttagttatgcggatggagaaaatccgcaaaatggttatgatcagcataaagtccagcttgtgtcgattgataaggacggtagcacgacatttacagtgtcgggatatgtcaaccggggaagccatgagggagaggttggagtgagtgtttatttttatgacatcaacaaaaattcagtggaggaaaaggtctttataccaagtaccaaatcctatccggtgttggcaaatgatccgggcaagcttctttactacagccattccagcggaaaactttatgtgatgcaggaaggaaccctctacgaggtagatcttgtccataatacccggacgactctggtgacaaatctagaggaaggacagtatgtaagctcggaggatggacatcttctggcataccagaaggagggcagcatcaatcaggctacccggatcgaagtactcaatctctcaacgggaaaggggtaccaggtggatgcaggcgccgaagagagtatccggccgctcggatttatccgcaatgattttgtgtttggaaccgcaaggagcggggactccggtacgacagcgtccggggagactgttcttccgatgtatcgtctggagatccgcaaccaaaacaatgagactgtcaaagaatatcagaccgagaacgtgtttattctggacgtggtttttgaacatgatatggcaacattgaagagggctgtgaaaaacggagatttctacgcctacactagctcggactatatcacaaacaatgaagagcgagaagagagcagtattacgctggaaacgtacaccagtgagctgaaaggccgtgagatgcggattacctgtgaggacggggtggacgacagctcaccgaagcttctgaagccgcagcttacgattgcacaggatcagatgacgctctcatttgattctgtatctaggaaaggcacctattatgtctacggatatggaaaattgcagggcatttaccagaatgcgggctatgccgttaagcgggcggccgaatttaacggagtggcagtgacggcccgtcttgcaaatgtttatgaaagtggcaaccgtccatacgcttatgaaatttcggatcttaaggatacgaccgtgcgggagggtgagagtacactggaagcctgcatgagaatgattcttgctacagcgggaaatgaaatcgattttcgggaagagcttgcggaaggggaatctatccttgatttcgtgaacggtgaagtggccggggaagctctggagcttacggactgcaagacggaggatgttctctacctgataggacagggcactcctgtggcggccctcacgggcaatggaaataccctgcttctgacggggtatggccggacaagtgtgcgatatcttaatcctgcaagtggagaggaggatactgtgacgttcgaggagatggatcggatggtaagtgcaagcgggaatacgtttgtgggatatacacaatagtgaggtcatgctataatgatacaaagtcaaaagactggaggaaagtgaagatggaattagtgacagtgaaagaattatacaggaaaacagacgactacctggataaggaggtaatgatcggaggatgggtcagaagtattcgggattctaaggcgtttggatttatcgtagtcaacgacggctctttttttgaaccggttcaggtcgtgtaccatgatacaatggagaactttaaagagatttccaaattaaatgtcggtgcggcgattcttgtaaagggaatactcgttgccacaccacaggcaaagcagccgtttgagatccaggcagaggagattacgattgaaggagcttccgctccggactatccgcttcagaagaagcgtcatacactggaatatctgcggacgatgacacaccttcgtccgcggaccaataccttccaggcggtgttccgggtacgttccctggcagcgtacgctattcacaagttctttcaggagagggggtttgtgtatgtacacacaccgctgattacaggaagcgactgcgaaggtgcgggagagatgttccaggttacaacaatggatctgttaaatcctccgaagacggaggatggagacatcgattacagcagggatttcttccataaacatacgagcctgactgtaagtggacagctcaatgctgaaacgttcgcccaggctttccgggatgtttacactttcggaccgacattccgcgcggagaattccaacacgacacgtcatgcggccgagttctggatgattgagccggagatcgcttttgcggatctggaagatgatatggatctggcagaggctatgctgaaatatgtgatccgctatgtaatggaagaggctccggaggagatgaaattcttcaattccttcgttgataaagggctgatcgatcgtctgaaaaatgtagtagagtctgagtttgccagagtgacctacacggacgccattgagatcttaaagaagaacaatgataactttgaatacaaggtagagtggggatgcgatctccagaccgagcatgagcggttcctgacggaggagatttataagaaaccggtattcgtgacagattatccgaaggagatcaaagccttttatatgaagctgaatgaggatggaaagacggttgctgccatggactgccttgttccgggaatcggggagatcattggaggaagccagagggaagacaactatgagaaactccgtgcacggatggcagagcttgacatggatctggatgagtatggattctatctggatctgagaaagttcggttccacgcgccattcaggatacggactgggatttgaacggtgcattatgtatctcaccggaatgtccaatatccgtgatgtattgccgttcccaagaacggtcaacaactgtgaactgtagataagatcagaaaaggggagaaacaatgaatcatattctggttgtggatgatgagagggagatcgcggacgttattgagctgtatttgaaaaatgaccagtatgaggtattaaagttctatacgggtgaggaggccctcgcctgtatagaatcaacaaagattgatctggcgcttctggatgtgatgctgccggatattgatggatttacgattctcaagaaaatccgggaaaaatatcattttcccgttattatgctgacggcaaagaccgagtatattgacaagattacgggacttacgttgggggcggatgattatattgcaaaaccgttcaatccgctggaactggtagccagagtcaaggcacagatccggcgttatacgaagtacaacgacggtggacgaacagagaatgacgtcattgattttgggagcttgtttcttgaccgtaattcgcacgaatgtgtgttcaatgagaaggagctgacattgacgccgatcgagtttgacatcttatggctgctttgcgagaaccggggcaaggtcatcagttcggaagagctcttcgagaacgtttggcacgagaagtactataagaacagcaacaataccgtgatggtacatatcagacaccttcgggagaagatgagcggtcctatgggaaaatcagattttatcaagacggtctggggagtgggatataaggttgaagaatagactgaaaagattagagaaaagcaaatacaggaaactgaaaatcagcctgctcttacagacagtgctgattaccgcgctgacagttctggtcggtggatttctgctggaatatattatcgatggcatttataacgatgatgtgtccgagattttcatcggatttttgaaattctttcatgtaaaagagtcggatgccatcagactttactggcggattcttggaaacaataagacgttctttatgatgatcggatttttggcactgtttgcgctttttttctatattgctctttccaagatgattacctatttggaggacgtggaaaaggagattggaaagctggtctcacgttccacagagccgattcatctcatcacggagctggagccgatcgagacaaaactgaataatatcaaatatacactggaacggcaggagcgggaagtgcaggaaagtgagcagcgtaaaaatgatctggttgtctttctggcacatgatttaaagaccccgctcacttctattgtggcttatttaagtatgctgcagtctcatccggagctctcagaggcggagcggagcaagtataccgggatttccctggagaaagcgatccgtctggggaagttgatcgaggagttttttgagattaccaagtttaacgcccaggatatcgttctggaaaaaacggagttgaatttgagccgcatgttggagcagattgccgacgagatgtatggcgttctccaagaaaagaggctcgagtgccaagtggaggccgcggaagatgtaatcgtacctgccgatccggacaagctggccagggtgtttgacaatctgatgcgaaatgctgtcgcctactgtgacagggaaacgacgatacatattcaggtctcccaggataaggacaatgcaaagatcgtttttatcaatgaggggcctaagattgccaatgacaaattacagcatatttttgagaagtttttccgggcggataattcccgttccagcgagacggggggagccggacttggactcgctattgcaagggagatcgtagagcttcacgggggtcaaatccaggctcagagtgatgaccatgagacccggtttatcgtaagcctgccaaagaaagagaagggggaactttaggatgagatttatacatacggcggatctgcatttgggcgtgaagccggatgcgggaagcgcatatacaaagggccgtccggaagagatttgggaaagtctgagggggcttcttgcaagatgtgagaaggagcagattgatttgctgttgatcgcgggagatttgtttcaccgtcagcctctcctgcgcgagctcaaagagctgaattctatgtttgaggcgcttacccatacgaaggttgtctttactaccgggaatcacgattatctgaaaccgaattccatgtaccggaacttcaggtgggcgggaaacgtgacgccgcttttaggagcccgtttgatgaaagtagaatttccggagtttgggacagcggtgtccggattcagctatcaggagagggagctcccaggtgggatccgggtagagtggaaatgtgtccggagcatggagaatgagatccttcttcttcacggtggggatgaaaggcacctgccttttggcagagccgaggtggatctgcttggatacgattatacggcgcttggtcatatccacaaaccagacttggagatgaaaggaaaatgccgttacagcggttctctggagccaacggatccgaacgatatcggaaaacatggttatgtcatcggtacgatagaacatggtgtggtggagaccgagtttgttccagcggcaaggagagaatatctgaacttggacatccgggtggatcaggagatgaccgggcgccgccttctggagaagttaagagctgaggtgctggaacacggtgaggaaaatctgtaccgctttactttggtaggattccgggatccggatatccgttttgatacggtccacatggatgtgggaggcggcgtccttgagatccgggatttgacaaaaccttcatatgattttgagaagcttttatctgccaacaggcggaatctcctgggtagatttattgagagctttcagggggaagaacagaatgaagtagggcagatggcgctctatgagggagttcaggctatcttgcagacgaggaaagagtaatcgtgaaacaaaagagagaagaaggggacgtaaaaagagatgaagttagagagactggaattatggagctttgggaaattccaaaacagaagtattgagctttccgacggaatcaatctgttctgtgcagagaatgaggcaggaaaaaccaccatttatgcatttatcaaaggtatgctgttcaatgtggaacggggccgggggagaggtgctgccaaagatgcgtttcatcaatatgagccgtggagaaatcccacccagtactgcgggatgatccggtttgaaagcggaggacggcatttccaactggagcgggattttaccaaaaaaggaaggaaaacgcggctcttctgtctggatgacggggaagagctttccgaggaaaagggggatcttcaggcgctattgatggatctggacagtgcaggatttgaaaacaccgtggcggtcgggcagttaaaggcacagccgggagaggaactctcaacagcactcaaaaattatgcggccaattattacacctccggggcaggaaatatggatttggaagcagcgcttctgggtttacagaagcggaaaaaagaagtagaagggcttctcaggcaagcagctcaaaaacggcttgccaagcgcgaagaagcggagcgcgcggcggaatatacggcaaaggagattgaccggatccagagggaggcggcatccggagaggaagagattcgccaagggaagcgtctcctggacacttacgagcaggcgagagaggagcaggtgaagaagaaatttccggtcaaggcaggaatcctttggatggctatactgcttgtatcacttgttgtcctgccgtctccgttccgatattatttggctgtgattttgactgtggcaggaattctggcggtgtttttactgatgagaccggaaccggagcagggacagactgaggaagaacagacggtgagaagaaggatggagaagctcaagtggaaccgggagaaacttcgttccgagcggagagataaacaggtggagtatgacaacatccaggagcagattgcggaggcctgtaccatatcagtggaagagaaagaactggaaaagagacgagaggcactgattttggcagaggagcggatgcaagaagtctccgtggatgtgagaaaagagacgggattacggctggcagaacgtgcggctgaaatttttggtgagattaccgggggacgttatccgaagatttttatagaagaagaactggaaatcagtatatttgacggtgtgagaaagataccccttcatatgatgagccgtggaacgatcgagcagatttattttgcgatccggatggcagcgtccgaaatcctttatgaagagagttggccaatcctgcttgacgataccttttcatactatgatgacaagaggatggaggcagtgcttcggtggattgccgcacagaaaaaacaagtgctccttttctcctgtcagaacagggagaaagaagcacttgacaagatgcattttacataccgcaatggatgggactaaatctcctgtccgttgcggtatttgtttaatacatgctgtatacgctcgctcgggcttaagatactgctgatcgagccatcatggttcagcgtatcgatcagcagagcaatgtatttgctcatatcgcagttgatatagtatggacggctcagaagctccggtgtctggtagatcaggttggttgtgaggatgttggtgatgatgccttcctcgtacgctttgtcgaacttctccagaccgtttgtaaatagaccaaaggttgcggccgcaaagatgcggtttgcttttctctcttttaactgctttgcaacatcgatcatactgtctccggaggagatcatatcatccaggataataacatcttttccttctacggaatctccaaggaactcgtgggcaacgatcgggttccgtccgtccacaatgcgggtgtagtcacggcgcttatagaacatgcccatattcagaccgagcacattggcaaggtagattgcacgtccggtcgcaccctcatccgggctgatcgccatcatgtggtcgctgtcgattttcagatccttgacatttctaagaagaccctttacaaattgataggtagggcggactgtctcaaatccactcagagggatcgcattctgtacacgcggatcgtgagcgtcgaaggtaataatattatctacgcccatctttacaagctcttgtaatgctaaagcacaatcgagggattcccggctgctgcgcttgtgctgacggctttcatagaggaacggcatgatgacattgacacggcgtgcctttccgccaatggcagcaataatacgtttcagattctgaaaatgatcatcaggggacatatggttggtacgtccgttcagggagtaagtcaggctgtaattgcagacatcaaccatcaaataaatatcttttcctcggatggactccgtgaggactcccttggcctctcctgagccgaaacgcggggtagaagcatgaatcaggtaattatccttctcatagcctgtaaagacaacgtcatctttaaagacgtgtccgtcttccttccgccatttgacaatgtaatcattcactctctttcccatctcctcacatccggtcagagagatgatccccagagcgcctacagggatgttttccaggtttcgttctgtacgatgcagcattggtttgcctcctatttcattagtttctttttgattctgatgtcgtcccccacaagccggagcagacggtaattgctgctgatgcgggagaaagttctttcactatatattgattttatctcatttaatgataaattggtagagataatcgtggatttcttctgcaaaatacggtcattcaggcagataaagagctgtgaaaccgtaaaggagttggtaagctccgttcccagatcgtcaataatgagaagctcacagtcatccagcagggcaccggcctgacggtcctgctggtttgttccgaactcccggtttccgagcagatcaaaaagctgtgaggacgtcacatagatgacggaatggatccgatccatcagctctctggcgatacagtgggtcaaaaatgtcttgccgaccccggtactgccgtagatcagaagattctgaaactcgctgccgaagtgatctgaaaaagagcggcatacagtaaacgcctcctttgccatatcaagagagctcttgtgacttacagcgtcaatatagtccgaagaatagtaatccatccgaaaggtggagaaattctcactcttcaggatatcggtcagattagattgggtgtagagcagatcgatctctgctttttggaaacaacgacacttgcgcccgtctacatatccggtgtcctggcagtccggacactcatagtcaggctccagatagtcagcagggtagccggaagcaagaagcagcgcctccttttcaacggtgagcgcatggagctgccggcgaaactgtgcgggagcgtccgtattgccgtcgatcagtgctcgggcatttgcgacgcccagatgggaaatctcattatcgatttcatgaatccgcggaagcttttcatatatttcgctgtagcggcgggtaagcaggtcgtgcgttcgcagacgcttttgctcatatatccgcataatcgtgtcgtactgggaattcgtcagtgccatgctgcttctcctttacttaactttgtaaaagctgtctctccaggtcgtccatgttgtagttacgctcctcaaaattgctgaatttcgtcttctttacggaaggctgggaagaaaccgatttctctgagcgcttcttcatataggcggcatcgatggcagcgatatctgccaggtgatgtacgcctttctgatgccagtttgtcaggatcttgtccgcatattcaaagctcgcctgatgggtggcagatacggtgcggctgcatgcctcgacgataatgtcgattgtaaaaccgaattccccggtccatttctttacaagttccttctctacaggggcggccatgcgtccggtaagaccaaaggctttcataacggcagaacagtcccggctataaaaagtggatgagcgcttcgcctcggaaacagttttaatccccgcgtccgcccaggcgagggcaacggatttgatataatgcatactccggtgtccgttttccacgcagtactcgatgagatactccgtcaaatccaccgagaactgtaagctatcgtagaaatatgtaagtgtctccacatcggaaggggacagggtgcgtccgatatattgttcggcaataaataagagttgcttaaattcccgacggctcttgtattcgctgatatcaccgatagaaggcctggaagcacaggatgtcggagatatgtcatccgaagacggctcctcggtaagggctgtattctcagtggctgcttccgcagaggagtacgccacggacttgtccgtaggaacagaaggaatggcaggagataatctttcctccttccgggacagtgaatcgatctggagccctgtcatctccccatccggaccgtactcaatcgtcagcagccctctctttgcccagtatttcagagcacggatgatatctccttctgtattttcgagaatctcagcgaactcagatacggagaaaggagacgtccctcccatacggcgcagtaaaaggagatacaccttgacgtattctccgttcgcctccgccatgtaggaatcgatgaacgcattatcaatgctcgtatagtgatggcctgtacaatctgtgatctttaacatacccattccttgaaacctctgtctttctattattaatgtctatttttcctagaagtaagcgtattatagcactttccggctacaagaaaaagggttatttttcccacactttgtggataaaacggtgtggattctgtggaaaactagcagttaaggagagattctccaatgtttacaacatctcccgcccccatagttatcaacagatcatctttcttacatttttttaaaataaaagtttcgatctcttcaaagctcggaaagtagtgtgcgtcgcagccttttgcggacaattcgtcaacaagaagccgggaggacattcccagggtgtcagtctctctggcggcatagatgtctgccagaacaacatgatccgcaagagacagtgcatctacaaactcgtggaagaatgccttcgttcgactgtaagtgtgaggctggaagatacaccaggtctccttatgcgggtaagactttgcggcttccagcgtggcacggatctccgttggatggtgggcataatcgtccacgatatggaatccgttgacatctcctttgtactggaaccggcggtctgtgccctcaaaggaaagcagcccctcctggatcttttccatcgggacgtccagaagcgatgcggcagcaatggcagccagcgcattggacacattgtgaagcccattgactgagagccggatgtgccctgccttgcggcctttcaccagaagttcgaaagaaacgttgcccttgtcatcgtgccggatatcggctgcgctgaaatcagcgtctgcattgtggaggtcatagatgagcacgtggcagttaagatctgtcagaatctcattgagatggctaatctctccattgataatcagagtaccgtccggaggcagaagtttggcaaaggtgtggaaagatttccgaatgtcgtcaatgtctttaaaaaagtccatgtgatcttcctcgacgttcagaatcaggctgatcttcgggaaaaaatggtgatagctgtttgtgtactcgcacgcttcggtaacaaaaatctcggagccgccaacccggatattaccgtggatagcctttaaaattccgccaacggagatggtcggatccttctcccccgccagcagaatatgggagagcatggaggtcgttgttgttttcccgtgggttccggccacggcgattggcgtctcatagtttgtcatcaactggcctagaagctcggcacggcttaacattggaaggttccggcggacggcttcctggtattcttcattgtccttgtggatagccgctgtgtagaccacaacctgcacgtcatcttcgatgttggaggctctctgtccgataaagactttggcaccaagcccctgcaggtgactggtcagagaggactctttattgtcagaaccgctgatggtgaaacattcgtcaagtaagatttcggcaagcccgctcatgctgatgccgccgataccgataaaatgaacgtgaactggtttctgaaaattaattttatacataatcatacacttccgtttctggatttttcaaaggaccgtatacggtgcaaaagcccgtcggcccgctgttcccgtccattgtagcatatcaaaatgaaagatacaacgcttcaggcacagaagatccgctttggaatagacaaaaaagtggttctgaaaaagggcatgtctgcatagtaattatataaagcggactagaagaattatacaaaatcacaataaaaacaacactgtgttgagaaattaatattaagattatgtaaaatgcataaaaaatagtagaaaaagaacaaaaatatataaaaattactcgatctttataaaaagtatgttataataatgacattaaattactgacaaggggtgaggacatgataaagaaagagatgatagcaatgctgctggccggaggacagggaagcaggctcggggttctgaccgctaaagtggcgaagcctgctgttgcgttcggaggtaagtacaggattatcgattttccgcttagcaactgcattaattcggggatcgatacagtcggggtcctgacacagtatcagccgcttcgtctgaattctcatatcggtattgggattccgtgggatctggaccgtaatgtgggaggagttacgattcttccgccatatgagaagagtacaaatagtgaatggtacactggaacggcaaatgcgatctatcaaaatctgaattatatggagtcatttaatccggattatgtgttaattttgtcgggcgatcatatttataagatggattatgaagtgatgctggattatcacaaagaacacaatgcagacgttaccattgcggctatgcctgtgcctttggaggaggcaagccggttcggtattgtcgttgcggatgaggagggacgtatcaatgatttccaggagaagccaaaagagccaaggagcaatctggcttccatgggaatttatattttcagttggccggtgctcaaagacgcgcttgtaaaaatgtcagatgaaccgtcttgtgattttggaaagcatgtgattccgtactgccatgagaatggtaaacggctttttgcatacgagtataatggctattggaaagacgtgggaactcttggttcgtactgggaagccaatatggagctgatcgacctgattccggaattcaatctttacgaagagttctggaagatctatacgaacagttcggctttgccaccgcagtatatttctgaacaggcagttgtggagcgcagcattatcagtaatggttccgaaatttacggagaagtccgaaattccgtgatcggtgccggagttgtgattggaaaaggcacagtggtgcgggattccatcattatgcaggataccgtcatcggagaaaacggtgtgatcgataaatcgatcatcgcagaaaatgtacggattggcgatcatgtgacgcttggcatcggaagtgatgtaccaaataaagaaaaaccagcggtttattcgttcggactagtgacgataggggagaactccgtgatcccgtctagtgtgcagatcggcaagaatacagctatcagcggcattacagaggcagaggattatccgaacggcgtactggagagcggcgagacattgataaaggcaggtgaacgcgtatgagagcagtagggatcattctggcaggcggcaataatcataaaatgcgtgaactgacatataagcgggctgtagcggcaatgccggtggcgggcagttatcggtgcattgattttgcgctcagcaatatgaccaattcccacattcagaaggtggcagtactgacacagtacaatgccaggtctttaaatgagcatttaagttcatccaagtggtgggatttcggaagaaagcaggggggactttttgtattcaccccaaccattacattggaaaatggtaactggtacaggggaaccgcggatgcgatttatcaaaatctcgatttcctgaagaagtgccatgagccgtacgtcattatcacatccggtgatgcggtgtacaagatggattacaatgacgtcttggaataccacattaagaaaaaggcggatattactgttgtgtgcaaggaacttgcaccgggagaggatgctacgagatttgggacgatcaagatggacgactccatgcggattcaggagtttgaagaaaagccgatggtggcaaattctaacacgatctccactggaatctatgtaattcgcagaagacagctcatcgacctgatcgaacatgcggcacaggaagacaggtatgattttgtaaacgatatcctgatccggtataagaatctcaaaaagatttacggatataagatctctgggtactggagcaatatctcgacagcggaggcctactatcatacaaatatggattttttgaaaccggaagtgcggaatcacttcttcaaagagtatcctccggtatattccaaggtcagcgaccttccgccggccaaatataatccgggctcttatgtgaagaacagtctcgtttccagcggatgcattgtcaatggaacagtggagaattccatcttgttcaagaaagcatttgtcggaaacaactgcgtgattagaaattccattattatgaatgatgtttatcttggtgataatacatatattgaaaactgtatcgtggagagtcgcgatacgatccgtgccaatacaagacacgtcggggaaaacggcatcaaaatcgttgtcgaaaagaatgagagatatgcgctttagcgaacatatatagatacgtaagaaaggggcaggtactatgcagattacagatgtgcgcgtaaggaaagtagcaaaagaggggaaattaaaagcagttgtgtcaatcacgatggacgaggaattcgtggtgcatgacattaaagtgattgaaggggaaaaagggctgttcatcgcaatgccgagtaaaaaggctttggacggagagtacagagatatcgctcacccaatcaactctgatacaagaaaccgtatccagagcatgatcctcgaaaaatatgagcaggctttgacggaagagaacggagaagaccaggaataaaggaagagttttggttattgtaaaggacaaaaaagggggatgttacggcatccctcttttttcgcgtatgacgggcatgccgtcagtctgtggtgaaagtccacaaggggcgtagttgccgacgaaccccatagcgactcccaaatattatccggaaatggagtctaagtatattaaaaatggtagaattactaaagccgggattatctatgaagaagatgtttgcaattagcctgcgtccaattaagtatctggaagaagtattattttttaaaaaagggatggatatggaaacggggaaatgggatcattcatgcgtttgtcgtgtttcttatctgcttttctgatgacaaaaaggcagacttcctgtacaataggaaaagactgtagaacaaggagttttattgtatgagtattttaactgtagaacatctgacacacggttttggtgaccgtgcgatcttttcggacgtttctttccgccttctccggggcgagcacatcgggcttgtcggagcaaacggtgagggaaagtccaccttttttaatatgattaccggccatttgacaccggatgagggtaagattgagtgggcaaaacacgtccgtgccggctacctcgatcagcataccgttctggaaaaagggatgaccatccgggacgtgctgaaatccgctttttcctggctctttgatctggaagaacagatgaaccaaatctgtgatcgtcttggaagcgtatctgaggaagagatgacttccatgatggaagagcttgggacgatccaggacatgctgaccatgcacgatttctacaccatcgacagcaaagtggaggaagtcgcaagagcacttggtcttctggatatcggcctggagcgggacgtaacagatttaagcggaggccagcggaccaagattctgcttggaaagcttctgctggagaaaccggacatccttttgctggacgagccgaccaactacctggatgaggagcatatttcctggctgaagcgctatctccaggaatacgaaagtgcctttattctgatttcccatgacattccgtttttaaacgatgttgtcaacatcatctaccatatggaaaatcaggaactgaaccggtatgtgggaaactatagtcactttgaggaagtgtacgcggttaaaaaagcgcagcttgaggcggcctaccgtcgtcaacaacaggaaatcaatgaactcaaagacttcgtggcccgcaataaggcccgtgtctccacacgaaacatggcgatgtcccgccaaaaaaagttggacaagatggagaagattgagctgggaacagagcggccaaaaccggaatttcatttccgttacggaaggactccgggacgtatcctctttgagacaagggatctggtaatcgggtacaccgagcctctctccaaagcactgtccatttccatggaacgtggacagaaaattgcattgaccggggcaaacggaatcggaaagacgacacttttaaagagtattttaggattgatcccgtcgcttagcgggtcatgtgaactgggtgaaaatcttcagatcggctattttgaacaggaagtaaagggtgaaaattctgctacctgtattgatgaaatctgggccgaattcccatcctttacccaatatgaggtacggtctgctctcgccaaatgcggattgacaaccaaacatatcgaaagccagatccgggtattaagcggaggggagcaggctaaagtccgtctgtgcaaactcgtaaaccgtgataccaatcttctgcttctggatgagccgaccaaccatctggatacggacgcaaaagattccttgaaaaaagcgctcctggaataccggggaagtcttcttctgatctgccacgaaccggagttttaccgggacgttgtatcggaagtctgggactgtaccaaatggacgacgaaaatcatataaaaaggcataaaatctccccgcaggactccgggtcaaacggccagtttgatgttccctgcggggagaatctttcaggattttccgattcgcccgggctattcccgatttacaatccgcaaaatgtggattgcaagaaatccgatctcttcgatcctgacttcctttttcagttcttgttctatccaggcacagattttctctgccgccgcaaattctttcggatattttacctgaacaaaatcattcaaatccgcctttacctgctcaccttttctcgtccgcacaagcatatagtagatgtggctcatcatccggttataccctaaagaatcctgctccagatcaatctggaaatattcttcaatcatgcggatcccctcgttgataagccttgtattatccagtgtctcggagactttctcatcagatcgtgccgaatggatgtgcagggaaataaatcctacctcatcgtccgaaatctcagcccctgtcatctcccggatgatttctctgcccttaagggcgactttatattctttctcaaataatactttgatatccggggtgaacggattcggaatctgcattttctcctctgcccgtttcgccgcaagggcgatatggtctgccagtggaagcagggaatcatggctgactttctcaaataccctctccgcttcctccagaattctgcctgtggcctccaggtataccggcttgatcccattgacgactttcaaggcagacgtctgcttcttctttgtcaccagcgtatagatcttcgcactttgtatcatcttgatctcttcgcccggatgcttgccaaagccgattccgtttccaagcagaatgatttcccgcttcttttcctgatccagtgccaggattgcattattatttaacactttgattattcgatacatctgacataagctcctttacaatcagcagcttacgatttccgctatctcctcctgcgcgtttacatggccggatcttttcatcacaacttcttcctcttctgtcaatcccgtgaataccgcaatgcaggcttcggatttcgcatgctcttttatatattgtatatcaaaagccatcagtttgtctccctttttcacaaaatccccgtcttttacaaacatttcaaagccttttccttccagcttcactgtatccaccccgatatgaagcagatactctactccgtcaaccgttgtcagaccaatcgcatgattcgtcgggaatacaaatgttacattgctgtcctccggagcatagaccacaccttccaccggcttcaccatatatccgtctcccatcatcttgccggcaaacgcctcatccggcgtatcagcaatcggatgcacctctccggtaaatggagaacataatacttttttcgttgtctttgcttctgtattttggggcgttgtttcccgcacctctttttcctctacgttttcttcatccggcgcaagatactcttcatccggtgcgtttacaagatagtcttccagattagatttgactaccgttacggacgggccataaattatctgaatcccctgtcccttctttacaattccggacggacccgtttgttttagaatttggtcgttcaccagctccggtttcacaacagtacaccgcagtcttgtagcgcagcagtccacatcggaaatatttttctttccgccaagtccctgcgtgatcagaatacttctctcatcgcctgccggatccccgctttttgtctgctctccctgtcttgccttataatcggcctttgtatagagttttgtctcgccgtctccatcttcccgtcccggagttttgaactgaaacttctgaatcaggaaacggaatattacatagtacaggataaaataaataacacctgccggaataatgagcatccagttcgtcttcgcattaccctgcagaattccaaaaataaacagatcgatcaatccaccggaaaatgtcagtcccacggcaatatttaacatgtgtgcgatcatgtacgccgagcctgccagcacgacctggacgccaaacaacaatggcgctacaaacaggaacgaaaattccaaaggttctgtaattcctgtcagcatacaggtcagtgccgcggagagcagaagcccgcccgcctgttttttcttttccggtttcgcacagtgatacatggcaagagccgcccccggaagtccgaaaatcataaaaataaattcacccgagaaatatctcgttgcgtccgcactgaaatgtacggtgcttggatctgccagttgggcaaagaaaatattctgtcctccctgtacaagctgtcctgctacttccattgttccgcccacagcagtctgccagaacggaagataaaatacatgatgcaggccaaatggaatcagagcacgcttgataataccgaagatcaatgttccgaaatatccggttcccgtcaccagtcctcccagtgcgtaaattccattctgtacaaacggccatacaaaaaacagaagaattccgactccaacatataccagagtggaaataatcggtacaaaccgggagccaccgaagaaggacagcgcattcggcagcgtgattttgtaatacttattgtgaagcgccgccacgccaagtccgacgataatcccgccgaacacacccatctgcaatgtctggataccaagtacacttgcgaccgtaccacttaacacatcttcagagatggttccgtctgccagcacggttccgtcgatctggagcagtgcattgatcgtaacattcattacaagaaatgcaatcattgcggaaagcgccgcaacttctttctctttttttgccataccgattgcgactcctacagcaaaaatgatcggcagattatcaaaaatcgcattccccgccttcgtcataatggtaaatagcgcatttaaaatcgttccttctcccaggatgcccgtcagattgtaggtctcgatcgtcgttgcgtttgtcagcgaacttccgattccaagcaaaaggcccgcaaccgggagaatcgcgatcgggagcataaagcttcgcccgattctctgaagcacaccaaaaattttgtctttcatgttggtctcctttcccttcctgtgacagcatgtttttccctgctttgtacccaaactcaggaaactccccattcccccatcccttttctgagaacaaaaaaagcatgaactgccctttttacacttcgtcttctaaacgaaatacaaaggatagttcatgcctgaaattcagtaacacgctatcttattttctttactgttgccagtataacgtacacctgtagttctgtcaatctttttttaatttttctttaattctataaccgtatttgcaattctacgtttttaccgggtactgcctaatgcttaacaagctttcgccctgaatggcatcagcgcctgcataaaatattctaaataaaatggtagctcgctgattattagacagagacattttattttctattcccttttcttactgctcacggatgtgttccagcagcgtttccatcaactgaatcgtatccacgacctcctcaccaagtgtctgcaatttcgtctgtacaaggcaatctgtaactgggttatcaaaagcaaaatccgcaaatgtcaggaaactgcttacttccatcttgagctccgccgggatctccacgcctcgcagagtcttctgaaaatccgtcagtttcattctggactgctcaatcaatccctccacttcgttgattttagaatgtttcacataagaactgatcagatttccaccaaagatgtccagaattccccatttcttcgcactatttaactttgctcttactgcgtatagactcgcaagtgcctgctctcctgactcctctgcacaccttaaatcctcttttaaacgaacttctcccatatcgttttcctctcctacatttaatctgctggcttctgccatgaaaaatgcccatatgaaataatcatcggaagcgctgaaagatacctttcgaaattgtaaacagtccccaatacaaaaaagacttctatcatgacatctgtcacaataaaagtcttgctatctcatttgctacgggtacctctcggtaccggctgacgattacaaatcgaccttccgaagaaggcttaagctactccctttccattgcttggaacgactataacacatttgcatttacttgtcaatccggttttctgctttcttcccgcatcgtacctgatttctttgtcttcttccgcttcgactatccgcctccacctcatctgtatattcctttaggactggcagtttgcggcatcaatcgccagtaccagcatcagagccatcatttcatctgcagaattagcaatatctatcacataagtgtctccccagtggaaaatctctttcgatatatgcatgaccggaaccccgccagcataagcatcgtactcccatcccattatattgccctctacttcccatccattgtaatccactatgtatttgggccgtaagaatgttatttttctggaaacttttccgtaaaactgaccacctacataaacctcaaaggtcgggagcaggtgaagcagcttttcctgaatcagaccgatctcgttctgagaactatcaaacactctcaatctgtgtccgatagagaaaaaatctccctttacaaagtaacggacattttcatcctcatcgtaaatatcataggtatccgtccatgaaaataccctttgtttgattaacaatttcatactttttctcctttacttttttcttttgcacataacatagtttctcagagtgactccactccgctttacttcctgttcccgtatcacctcgtacccccttgattcaaaaaacggccgcgctgtgatggaagcgtaagtttcgaaccgatgcactccagattgtctttccagttcatcgcagatcgccgtggcgatatgtcgtccctggaagtcccggtggacatacagccgatccagatacccggttttgtccatatccccaaatcccacaatctgtccgcctagttctgccaccaccgtccggtgacgtaaaaaagacgcgttccatgctttcaaatctctctttttgggcgcccagacatcaagctgaatcttggtataatcagccacattgacagtatgtacagtctggtagaaaagctttgccaataccgggccatcctccttgcgatactcccgaatcctgagactatcgccttccttttctcctcctataagcatctcttactcctcccgatggatatacatccttgacatcttctcttctccgtcaccttgagccatacaatagaatttccatccataacgctcatagaatgtatcgtgatctgtgatgagataaagagtggagataccccgtgctttcatatccccacatacataagccagcatgtttccggcaattccccggcgcctgtatggctcttctacatacacggcacagacgttaggcgccagatctttccgatcgtgaaaatcattttcaatcacaccaagcccaccgatgatctcctttcccctgattgtcagataccactggggaactgccgcctcccccgtaaggcttttctccatacttttctcatattcctccagaggtaccttccacttttgatgaaaccagtctgccgcctcctgttttctctctggggattctctcagattgatgatccgaaatccatttatcataacactttgctctcctttttatcttcgctgttatattcaacttctactgcttaaaattatagaaaaaatgctcttgatcttccggtaaaatcaaggatcgcttactgtctgcttccgtaattggacgaatcggtctgcacggatttccaaatgccaagtaatgtgccgggatatctttcgtcactacacttcccgcaccgatcacagccccatcccctatatggactccgccaagaacaaccgtgttgcatgcaatccacacttgattcccaatcacgatctccggagcatattctgccattgtagttttcccttcctgattcagtcccatcctttcctgggaaatcaatggatgagaggtcgccatcaaagaaacatttggtccaaagcaaacatgatctccaattataattttcccgtcatccatcactgttaaattaaaattggcaaaaaaattttctccaataaaagtatgcgaaccgtaattaaactgaacaggaccctgaaaataaaacacctgtcctacctttcccagcatacccctgagaatctcctcccgccgcgggtcatattcatccaaaacattatactgccgacatgcttcatgcgctttatgcttgatttcacttagctcctgttttctcggatcaaacatataacctgcaaaaattttttcttcctctttcataagcctctcctctttactactaactatccatttacatctgtttcctcacaattcggtactcgtctccattatggtaatacggacaagagtaatgaggctctagctgaagtctcatataatcatcttcgtccatggcaacgtcacagatatattcgccatattcctcgtcaaaaatataataagcacaactattgcagctttgcgtcgatcctttccgcatgattttactcccttctccctatcttattatcatcagtgtatcatataccgtattccaagaaaagtatttgatttcccctgaaaatggtgtaaaatgaaaaaaaccggataaaaggagaatcttatggaaatcaaagaattttttcgatcgaaggaccggacacactggcttgcaaagattcaaacatgcgactggcccgccggacaatttctgtatgaactgctgaccacgaaccagatacataaattttgcggagaacatgtgagactgtttcttttgacagatggcacaaaacttgcggcattttgtaccttatcggatgtagatgatatcaaaaagacggacaagtctccatggattggatttgtctatacctatcctgcttacagagggcgccattacatgagaacgctattaaattttgcatgtgaaactgcccgaaatgatggggctgaagaagtgttcgttgccaccggggaaaccggactttatgaaaaatatggcttttccttttacgacatgatggaaaatgccgtaggtgtgcaatctaaggtatatcggaaagagctgtcttgatccaaaaatcattggtctctcaagcttatctgtttgcctttgattttactcttacaaaccaaaacaagggcaacttttcattgataataatttccttcctttttcccgatcttcataatccatcgttgatgaaaatatatttctccatctttttgataaaaatgaaaacctgttaatccattgcctttcatttcatctgtaagccgtttggatatgtctgcgcatatctccgcaggtgtatttgtgagatttagccaagcggataacgaaacaggaagttccgtgcactccaatgtcataatggacaaacagttctttcggaacatttctgtaaattcctccttgctcaatttacgcacatgcgagggaccacgcaatgtttctatctcattttctgtattacgcaatgcttcttcggccgcttccatatcaatggcaaccagcttaccacctgttttcaaaacccttgccatttctgaaaaacaacattttggattgggaaaatgatgaaaagcaaggcgagagattacaatgtcaaagctgttcctttcttcggtacgaaaaataaggacatatctgttttttctaatgttaacaactgcacttttttctcaatgccgccggcatatcctgtcaggcttccgttcgtaccgacaacacgatgacagggaataatgagagaaatagaattatgtcccacagcaccgccgacagcttgtgcagacattttagatagccctctttgttgtgctattcttttcgcaatttcaccgtaagtcattgtctttccaaatggaatagtcaacatcacttcccataccgctttacgaaacggcgttgtctgcatagatagcggcggcgtgaaatcgggcgctttaccactaaaataaatattcagccaacgggcagactgctcaaatatcggcaaagacttttcttcatagtgtttcggaagtgtatcgccaaaatatttttgtccgtcaaaccaaaggcctgtaagttctgttccattactggaaagtgtgatacctcctaaaggtgaatcatagtgatttgtataggtcataagcttatacctccatatattcatcagagtccgcacggacttttattctatcagacatggtataggtgtggtctatccctgttttggattgctcgtaatttttcgtgttcgttcacttttcttatttcctgttttgggagcgtaatctttcatcatccgttttctcccaaatgccctgtaaatcaaaaccaccacttcgtactctcaccgcaaaatccatgatatactccgcttttttgaaagccattccaaaggcctgtaaacgttcaatccccgcagtaagaatggtatcgtcatttactacgccaagattttctttcattctcttccatattgttgcttgtgcctttgtagaaatttgctgaccaataatatgatgaataaccgaagaaaacaaatcgccgtcaacctcacgctcgacttttccgattttatcgatcacttccgcaaggcatttatctttttgttttaagtatgtaatttctttttcaccatactggaaaaacatacccgcttaacccccgacttggctctactcttattaaacaatataatagtatcataatttaagacaatgcaataccaaaatttcgtccaatactatcataatatatccaaacaaggacacaacaaaataacacacacataaaaacgctacagcaactctatttatatcgcaacatttcgttgcatttcatcattaagatacgttttgttacatcctctgaatttacagcaaaaaactgatatactgctaagaaactggaggtatgttatggcaaatgtacagcttgcaaaaaatttaaaaacacttcgcaaaaaatacaactatacccagcaagacgtaagtacttttttgaatattaccagacaggcatactctcactacgagcaggcacttcgggagccggatctgaatacactggttcatctctcccgattttatcaggtcactttggacgaacttattgcaggcaacattcatgccgaccagatccgggaatctatgcccatctataaataccgtcatagcgaaactgtcgatcacatccacacgctatatcttacggatcaggaagtaaacctgatcgaaaatttccgtgatgcaagtgaaaatgacaggcagatgctcctgatctttctgaacagaaaaccataaccatctgcactacccttgcaaccgattacatcctttcggacatatagattcatcacgtaaaaaacctgacagttccttatcctaaaccgccaggtttttccattttcacccgtcatatcttattttcttttaaacaatcaacatcgcgtccccaaagctgaagaatcgatactgctcttttaccgcctcttcataagcatggagcacatgctctcttcccgccaaagcgctgaccagcataatcagcgtggattccggcagatggaagtttgtcaaaaggcagtccagtactttgaactgatatcccggatagatgaagatctctgtccatccgctgcactccgatagcgtcccatctggctttgccgcagactcaatggtcctacagctcgtcgtacccacacagatgatacggtgtccttcccgtttggcccggttgatcttttccgcctcggatgcctcgatatgataaaattctgaatgcatatggtgttcctgaatattttccaccttgaccggacggaatgtaccaagtcccacatggagagtgacatgggcgatatccacaccactttctttgatctctttcagaagctctggtgtaaaatgtaatcctgctgtcggcgccgccgcagatccgctgtgttttgcatacacggtttgataacggttcttatcctcaagctgatgggtaatgtacggtgggagaggcatctgtccaagctgatccaaaatctcctcaaaaatcccctgataagaaaactgaatcagacggtttccctcttctacgacgtcgatcacctcaccgataagaaggccttctccaaaactgatttttgtacccggttttgcctttttccccggcttgacaagagtctcccagatatcattttcctttctctttaaaagtaaaatttcgatcttagcatcggttccgattttggatccgatcaaccttgccggaatgactttcgtgtcattaatcaccaggcaatccccgggctttagatatgctttgatatcccggaacattctatgttcgatcttcccggactccttgtcaaggacaaggagcctggaagcggatcggtcttccagcggatcttgagcgatcaattcttcgggaagtttaaaataaaaatcttcttttttcatcatggcccgattccctctttactgtctcagctcgattcccatactttccagaccgttcaggattttcttcatagcctttgtcacgtcagcatcctcaagcgttctgtcttttgcacggaatacgatggaatatgcaacggacttatgtccttctttaatctgagccccttcgtacaggtcaaacagatggtagctttccagaatggaaccacctctctgctcaatcatttcctcgatttgtcctaccagaatttcctttggtacaaccatactgatatctctggtcacagccgggaatttggcgattcctgtgtactttctgtcaaaggttgcacgtactatgatctccggcatatcgagaaccgcgacataggcgcgtccgccgattccgtagttttccgccacgaccggatggacttctccaagataacctaccacggttccgtcataaagaatgttcgcttgtcgtcccggatggaggaacggctttcctgcatttggatcgtatacttcctttttgtgcataccgattttttcaaaaaattcttctacaacgcctttcatactgaagaagtctccctctccgtacataccaagggtaaactgcattctctcttccggaagttctgtgagtggaagagtcttcggcagatagatattaccaagctcatacaatctgacgtctttatttcgccgattaaagtttgttgcaagagaagtcaacattccatttaaagaaatcgtacgcataatactatagtcttctcccagaggattggagatctcgattgcctgacgttccggcgcgtcctctggaagcaaaagcttatcaaatactttcggactttcaaaagagtagctcataccctggctgaatccacagaattccgcaatatttcttgctgccgcctcaatgcgctgtttaaacgacagttttccgatcgtcgcctctcctcttggaagggtggtcggaatattgtcgtatccataaaatcttgctacttcttctgccagatccgcaaggcggaaaatgtcctggcggaaagttggcgctacgatctcatttgttgcttcatcgtatgcaagctctaccttctccagataagcaatcatgtcttctttggaaatatcagttcccaaaagctgattgacggcgttttcgtcaaacggcacccgtacaggctcctttaccttgctgtaaacatccacaatcccgcctaccacttctccatctcccatctcttctaagagctggcatgcacggtcgatagctgcttttgcattattcgggtccagtcccttttcaaactttccggatgcgtccgtacgcagtcccacacgtttgctggatttccggatgttggttccatcaaaacatgccgcctcaaacaaaacggtgtgaacatgatctgtaatcatggaattctcccctcccatgattccagcgattccgatggatttttctccgtcgcagatcatcaggacatcccggtcaagctgtctttcctgtccatccagtgtggtaaatgtctcaccgtcttctgcatttctgacaatgatctgatgtcccgcaatcgtatccaggtcatatgcgtgcatcggctgtccgtattcttccatcacataattggtaatatcaaccagattattgatcggacggataccaacggaagcaagtcttctctgcatccattccggtgacgggccgattttgatattttttgccactctcgcacaataacgcgagcaaagttcctgattccttacttctaccttgacataatcggaagcatcctcgtcgtttccagtctctggtacaatcggaggataaaaactttttccaaaagttgctgccgcctctcttgcgattcctatgacgctgaaacagtctacacggtttgacgtcacttcatattcaaataccgcatcgtgcagtcccaatacttccactgcgtccgctcccacttccacgtcgtccgggaagatatagattccgttttccggcgcttccgggtacatgtctcttgtagagcccaattcctcgatagagcacatcatgccacagctctccacgcctcttaatttcccttttttgatctcaataccgccttttgtcaggcttccgtcgtggccgcctgccactcttccgccgtccagaacaaccgggactttctgtccctcttctacgttcggggcacctgtcacaatctgaatcttttcacttccgatattaacctggcagacgacgagcttatccgcatccggatgccgttcgatcttttcgatctgaccgactacgatcttatcaagatccgcgtccatcttttcatatccttctactttcgttccggacagcgtcatcgcatctgtatattcctgctctgtcacattcaaatccggaacatatgcttttatccatgataatgatgtattcatgttgtctgttctcccttcctcttagaactgctttaagaatctgatgtcgttttcgtacagcagtctcatgtcgtcgatttcgtatttcaaaagggcgattcgctcaagccctactccaaacgcaaatccggtatactcattcgggtcgataccacacatttcaagaacgtgtggatgtaccatcccgcagcccaggatctcgatccacccagatcctttacagaaacggcagcctttgcctccgcacttaaaacaggtcacgtccacctcggcgcttggctctgtgaacgggaaatgatgtggacggaattttgtctttgtctccgggccgaacagctcttttgcaaacacttccagcgtcccctttaagtcagcgaaagaaatatttttatcgataaccagtccttcaatctgatggaaagatggggaatgggtcgcgtccacctcgtcagagcggaacacacgtcccggagaaatcatacgaatcggaagtttaccctgttccatgacacgggcctgtaccggggaggtctgggttctgaggacgatatccttgttaatatagaacgtatcctgttcatcctttgccggatgatctgccggaatattgagtttttcaaaattatacaggtcgtactcaatttccggtccctcgatgacttcatatcccattcccacgaagattctctccacctcttcctgggcgatcgtgttcggatgacggtgtccgactacatttttcttagacggaagggtgacgtcgatcacttctgcttttaacttttcctcccggatcttctcatccatctttttcttcgtctcatccagaatactttcgatctcctggcgaacttcattgaccatctgtccaaccttaggacgctcttcagcggcaacatccttcattcctttaagaacggccgtaagctctcccttttttcctaaaaatctgactcttacatcatttaatttttccggcatatcagcagaatggatctgctttaacgcctcttctctgatgctttgaagcttttctttcatgttgttcctcctttaactaccaatatctgtttcacagggacttctgatatattatctgattttcagtaaaataaaaaactccgccccaaaaagggacggagaatcaatccgcggtaccaccctgattcctgcgtaaaaagacaggctctcttcctatgcgtaacgtgcacgttgacgtcatttcttactacttgttcggaaatgcggctcctgcgggaaattcagtatatctgtcgaatagaaaggagcttccagcctccggccccttctctctggcaatgatcagataccctactgacacattcacagcctttactatatcttctttattttaaacatccctttcccctttgtcaagaccggatccgccaaatctcactgtaaaagtcaaagtccagcccaaatgtgactttgtacatgactgaactattacctctaaattcccgtaccggacgcttcgtccagataccggatttcagttgcagtgcggcttgtaaagacactgtcatgctccacaaagaccattgtcggctggcgggaaagaatcagctcctctatctgaatcctcgtaaaaatgtcgatataattgagcggttcgtcccagatatacagatgggatggttcacagaggctttttgccaaaagaatctttttgcgttgtccctcgctatactcctccagccgtttgtcaaactgatctctggaaagatccagctttctaagcaccgcccgaaacagtgcccggtccagccctgccctctcttccatctcctccaaagttcctttcaaaccggaagaatcctggctgacaacggaaatcttcaatctgctgccaatacggatctgccccgcgtccggctcttccacccccgcgatcagcttcaggagggtagatttcccacagccgtttcttcccttcagggcgatccggtcgccactgcggatttccagagagaattcccgaaaaatctgtcgttctcctctggcaaaggagatttgatccaccgtcaccagacgctctttgtcatagacaagcggaaacattttcaactcttctgtttcctcgatatttttcaacagtccggccttttcccttgccgcccgctccatccgatgctccagtaccttggaacgcttcatcatcttggccgctttgtgtccgatcgcgccacggtccggctttaagcctcctatcctgtgtccggtcttttccttctccttttttccggcccatcgtaccgcttctctggcagcgtcctcatagtgccggatttctttctttaatttctcgttttttcccaactccatctgatcccgcagcttcttttcccgctgccacgtactgaaatttccccgatagatccggatgccggagcgctcaagcgccattgtatgatctgtacaggaatcaagaagtttcctgtcatgggagacaaggagaaatccctgtttcttctttaagtaggaggcaagcatctctcttcctccttcgtccagatgattggtcggctcgtcgattaacaaaaaggcatgctccttggcaaacagtaccgcaagctgcatccggatctgctctcccggactgagcgtcccgtatcgcctctccagtatccccgcgtccatacccatccattccatctctcttaataccttccagaattcatactccggatcaatctcttccagaacttccattgctgctctgtctttctcccggatcacggtcggaaaatactctgccgtctctgccatctgaatgttacctctgtacgggtattcccccttgagaagctttaaaaatgttgtctttcccgtcccatttctgccaatcagaccggtcttccagcttgtgtccagaagggcattgacatgatcaaaaatcatctcataatgggtgtcataggaaaatgtaagatctgtaacctgaatctgtgacatgatatcatcctcctttacggcacacacgcagaaagctgcatacctccggaccgctgccataaaaagaagccatgaaaagctcctcttttcatggccactgcctgttcttcatcaaatatagaaaaaagaatgtcgcttcctgcaatgcgtacacacagaatctgcctctcgcatcttccgtgtacttatctgtttcattgtcttaaaatttgcagaaagtatcgatcatcctttcacctcatttctgtaactttgcgcttttagtatactgtccgagatgtcttctgtcaagtcttatcctgatcattgcaaaagattaccaaaatcccgcacatcaggatcatgtggaaggtctttatccagattgtcacgaaagaccgtgatattaatcacgccgccaagcaaaatcatatacatgcagaaatacagccaaagcataactaaaataatcgttgtcaggctaccgtacatggtggaaaacccttcaaaaatatccagatagacggagaaaatcagggaaatcacctgccatccgacagcactgaataccgatcccggaatctgatgtttccacttcgtcttgatcttcacatccggaagaaaccggtacaacaacatacagaacaacatcatcactccgattgtcagggtcgtccggattcggatcaaaaactccaccgctttttccagaaccggtacattcatctctacaaacacactgattttattcccgaataccgccagcagcaggcaggagataatcaccagaagaaagagcaccgtataaacggaagctctgagacgcagataaaaataattcctggtctccttgctctggtaaatacagttaagccctgatgttatggcaagtacgccccgtcccgcagaccacagcgccaccaggatcgtcacagggatcatcgccttagactggctgtaaacctcattgatgatggaaatcagaaacggcgtgactgtttttggaaaaacttctgtcaccgctttcatcacatctgtcctggttaccggcgtgtactgtaccatcgtcagaagcagtaaaataatcggaatcagtgacagcacaaagaaaaaagcggactgagacgcatatgcgcccacatgatttagcacagcccggtctaaaattttctttatccatctccactgttttctgatcataacgttcctcattccagttcatttccagttatcataccatcaattcgcagcaatttccactccattgtaaaacatttttaatatcgctttataatctttccctcttttcgccatttcattcgccccattctgactcattccgatcccatgtccataacctcctccttcaagatgaaaggaggccccgttcttctcaatcgtaaaaaaagcacttggcaaaagtgcggcggatgccgccacagagccgtcctgctttttaatctcgtatccgcttcccccaagggcggaccgaatcttattttccgtctgaatggtggaggttcctttgtctccggtgactttcatctccaacgccacttcgccctctccccgtctggtgatctcgatttgagagatagttcccacatcctgtccggtattcagtccaaagagattggaaagcgtatccaccgggatatcacagttccaggaaaaccacggcaggtcctgttcataacagaccccttcttcctccacttttacagcttttaaataagagttggcatcggacaccttcgtcccccaagcctccacattcgttgtcctgccgcatgacgtggagaaatagtacgccttgacaactttgccctggtagagaagcttctccccgcgcgttgcatccaccgccgcgatggttttctcctgttccttcgaattcccatagacctgataagcggtactgtcatctacattagccctgtactctggataagcctgcccctccatatgacagtaagcatagctccttgcacagactgcctgggcttttaacgcctcttcttcataggaagctggcatctcgctcggcaccacggcatagagatacgattccaacggcagttcgttgattaccgcaattccctgcgccgtctgatagagctccagctctccccggtaagacggaattccagagccccgcttcagactggaaattgtgatcttttccccctcctttttcggacggacccggatcgtcccaccctgaaagagcgtatcgtccggagcaatcgtcacagactcaccttcctttgtctcccgcttttcctttgtcccctccaaagtgagtcctcctgccgccgaaagcgaaacattgggatgtacctctccagcataaccgttcgtccgaaggagcacccggatcacagtcttgtccgccttcccatctgtttccttctctttctggttttctttctccttttccccgggctgttccccggacttcttctcttgactgctctcggccagttctgtcttctcgtcccggctttctcctcctgttatcatatgtacgagccccacgcataaaaaaaggctcaagataataccgccgaaataatacagaaatttcccatcccaacgctttttcatcttccgcaccttgtccgatcacatttatcttaatgtatgtctctgctgatttttatatgtatctttctgtcctttacccggacagaacgtaaaaagcagccgtaaaacgactgctctttctctttgatgtgtatccccccaaaatgccggctcctgtattttgactcctagcagtccgctaggtgggcaaccgcatctgcttttctgtcttccactgattaaatgaggcctgacatattacagagataataggaatcccgtttaaagtattgtaggttcaaaattacaagagttatcgtacatttcaggttagatttattataccgtatccgccttcatctttcaatatttatttagaatcctttcccaaagaggaacagaaatttctggaaaagtccttttttctccagaatcttcacccgcacctgacggcagagtattttcaattctctatacgcagtcttttcggtcctccctttcccaaacgctgtcttcagcacctgacggattaccggttccgtttggcttcgttcaatctggtacttcgtttctaaaactgtacagaatgcttcctgttcttccggaagcgctttattaccgtcaaattccagcatcccatagagaatccggtacatacgcagatacttttcctcctttgtgcgagacgtgcggatctttttccactgtctgccataagcgaagaacagccctgacaccatcacgaacgccgacacaggaactacccagaggaagaccggtatcgctccttcttttccagagcttcccctgacgccctccttcccggacctggcgtcattttccggctgctttggctcatctgaaacttccggtatattttgctgtctgtcaggttccggggatgaatcggtctgcggatcctggacctgcacatcttctccttccggatccttatccaggatgatcttctccagtccctctaactgattctcataatatcccggtgtcatctctgccggaaaccatccgaatccgggcagataaatttctgcccaggcgtgagcggcatgatccgtaatctctgccttgtatgttccatcctccgtctcgtgaaaatccgacggtcttgcaacatatccagacacaaacctagccggaattccattcatccgcagaaacattacgcctgcggaagcaaagtgtacgcagtacccctctctgctttcatccaggaaatacataatgaagtcctcgcccgcaggtgtccgccccggactttttgtataactggctctcacatcgagataacttgccatagcctggaccgtcccccgaaccgtacgcccgcttaatgcagtcgcagtactctcccattttgcgcgaagctcttctggcacttccaggtacctgtcatatacaaactcctcatattcctgcgctgcatcggatggctcatatgcaatccccgagatattcttctccatcgctcccacgtcaccggcaaggatcgcttccaccgtgtaagtacgtccctggcctttactgaaggtgtcgccatacatctgctctgtctgatcgtgtttatatggaagatacccgtattttcgactggctcctcttcttataatctccgccttcacaggcaaaaagtcaagtctgtcccggttagcgtatgccgtttcatactccctttcccgaaccgtcttgatttcccgttcggaaagggagccggtatccccggattttacccagctattcttgcggtagtccgttccgatatatccttggaaataaacggtactctccgggcgcccggaaagcgtgacctcaagctggacttccccgctttctttcatctcatcgaccgtccccattctcccatctgttacaccgccgatggcagtccgggtaaaaaaatcggcaatccggccctgccagacaatcggattagaaaagaatgactccatctcccccttcggtatcacagtcccaatcaaaagtgcggatgccgctgccaacataaggggccttccggcactgtccgggcttgccagaagcaggcacagtactgcgcatccaaagaacgccgcacctttcatctggattgtcagaccgtgaagaaatggaaaggaaaacgccgccgcatacagaatcatcgtgatgatccgcagtttccggacagagccagccagcatacagactgtcagaaagattccacaaattccaagcagtccccatgtcagagcctccccttccagggaaatctgaatcctgctttcctctcctttcatatatgctaggactgcccaaacagatcgttcaagcatttccttgccatccccggccgcctcgcttttcacaagaaaaaagcagattaccgggaagattcccacaagcctccctactacagaatcgttttccagccagacatatggtagccagaaaactccaaaagacacaatccctgccgcaagcaccggcatgagaaagacatccccaaacaccggcacaaaggcaaagatcagtcccgatcctgccaacgatgctgataacagaagccagaagcgttcccctctattcttacccatcgtttttgtgtccatactccctcatcaccttatatttccaataccgtgccgcttagttcctgtacaaacgtgttctcgtgaaaccacagcgtatcctcctctccacaacggatggagagatccccgctgattctcactgctttccggtaaggttcaaaaaattcgtaccgatacatcgcctcatccagcacatccagatcagatacccgcgtcgaggaaagcgctaaaagccagtcataaaacgtctcttcatcctttacaagaaatctgcggaaaatctggctttcccgctctttccacactgcatagaatcgacaggattcctccacaagggcatgtccgactgatgccgccagattcagaaaaaccgtattctttgcgggaaacctgtcttcctctttccgggaaagcagcaccaccaccgccgccccaagcggaaagctgaattcctttaagtaaagctcctccgtacgggcactcagtttccagtggatctgtgcgattctgtccccgggcttgtactcatggacgtcaaatacctccgatgcatcgtcccctccccggtcttttgcatactcctccccctccgttacggagagacggacggccttactgatctcggcaaataccggataggccttcggcacgacatgaatctccaccggctcagagacaaagcgacgaatccgaatatagaacatcccggaagcatcccttgtcaccgcttttttgatttcccacacctgcttcccgcagaccgtggcatgatacgggaaaatcaacgtctgtcgcccgccttttttcagatcccgcacaaccttcctgttctttcccatccagagccacaaaaccggaatccgaaacgctccgcaattttccaccacaaaggggatatgcaaagtctccccctcttctgccatctgtaaatctccctgaggacgaatcttgatacgaacgctcatcaacttggcttccagataaagtactgccggaaataccagttccaccacaagaatcgttctgccttccggccagtcatagacaagattcagataacatgtggcgagcagtgccgccaggtacaaccattttttcattctattctcccttttcctgccttcggctttttcgtccctgtcaggatttcctcaatcacctgggtcgaatccattctggccgcccgcgccttggcgctcaaaaacagtcggtgcaccgtcacatccgggaagacactctccacatcatgtgggatgcaaaacgttcttccctccagataggcataagcctttgctgctttagcaagagcaatcgtccctcttgggctgacgccaagccgtaccatctggtgatttctggtcgcctccacaagatttccaatatattggtagactgcatcgtgaatataaacctcctccacctctttttgcattgcaagcagaaggtccttgtccatgacagagcggaccgcatccgccggactacctttctgatttcccttaacgatctcgatctctgactgaatatccggatatcccatggagatacagatcataaaccgatcaagctgggactcaggaagcatctgagttcccgcagagccgaaaggattctccgtagcaatcacaataaacggctccggaacctcgtacgtcctctgatctaccgtcacctgccgttcctccatgacttccagaagcgccgactgggtcttcggagacgtccggttgatctcgtccgccagaagcaggttacacattgcagctcccggctgatagacaaactgctgcgtcttcttgtcatagagggaaaaaccgacaatatccgcaggaagcacatccggggtaaactggacacggtgccgcaaaagtcccatactttttgaaaacgccactgccatggtcgtcttgccaacgcccggaatatcctcgatcaggatatgacctccagctaaaatcgcagccatcaccttttttatacaatcctgttttccaatgaccgcctttttcacttcctctatcaccgaggcggcaaccatcattccatatgttttttccatagcctgtccccttttcttttttcttattgtatcatatcaagataagaagaacactctatataaaaaatttaacttgttccggccagatcgaatctcttgtcatcatctcagtcctaaaatttcccgcactgtctgctccatctgcgcaccgtcacattctctcgtatgacagattttcgcatgccggatctcctccacagccaatgggatctctgtccccgaaatacggctcagttcatcggcaagatcgatctcctcctgttgctcatatgcacccggatgaatcgcatccagcacgctttttgcgaacttgtacggactcgccgttgatgcgatgaccgtcttcgtctgatcgccgcaatcttttttatatgcatcgtacaccgccgccgcaaccgccgtatgtgtatccatcacatacccggtattttcaaaggtgtccctgatcgcctgtttcatctcttgtgcggaagcatagccggctgcaaaatccgaaagctttgccttcatctcttccgtgatgccgtagctccctttcgttctaagctcctccatcaactcacagttcttatcggcgtttcttccggaaatcagatagatcagacgctccaggttactggaaatcaggatatccatagatggggattccgtcaggacaaactcacgattcctgtcataggtacctgtacagaagaaatcaaaaagcaccttattttcgttggaagcacagatcagttttgcaatcggaatccccatctcctttgcaaagtaagctgccaaaatatttccaaaatttccggtcggtacgactacattgaccggatctccttcctggatttctccatttttcaggagaccaccataagcgtaaacatagtaaacaatctgcggcaccagacggccgatattgatagaattggcggaagagaaccgaaatcccgcttcacgtagctcttctctgagcttcggatcctcaaacatccgctttactccgctttgtgcctcgtcaaaattaccgtgaatggcgacaaccgctgtattctttcctttctgtgtcaccatttgaagcctttgcacctcgctgactccacctttcggataaaagacgatgattctcgtcccttccacatccgcaaaacccgaaagcgctgcttttccggtatctccggaggtggcggtcaaaatcacaatctcgtccgtgaccccttgctttttcgccgccgtcgtcatcagatgcggcaaaatggaaagtgccatatccttaaaggcaatagtcgggccatggaacagctccaaatagtatgtgccgtccacatttgcaagcggagcgatggcttccgtatcaaatttttcatcgtatgccaaacgaatacagctctttagctcttcctccgtaaaatcagtgagaaactgcttcatcaccatataggcagtctcctgatagtccatcccggcaatctccgaaagggacacgttcagcaccggaatcctctctggcacaaacagtccaccttcgtcggaaagtccctgcaagatcgcctctgaggcggtcagcataacattttcgtttctcgtgctcctataaaataactccatggcctttcctccttatctggcttctcaatcttactgcaatgatcccacaaaccgtggaaacattctattcattgtccaaaagggcggcacgctttgggaatatggtgccgcccttttgatttcgtctgccggataccaagatccagctagccctttaatttctgattcgtgtagttgacaagtccgcctgccgcaatgatcttctgcataaattccgggaacggctgtccctgatactccgtccctttcgtacggtcataaatcttgccgctgttaaaatcgatttccacctcgtcgcctgcttcgatctcctcagccgcctccttacactcaatgatcggaagtccgatattgatagcattgcggaaaaagattcttgcgaacgtttctgcaataatgcagcttacgcctgctgttttcaagcagagcggcgcatgttctctggaagaaccgcagccgaaattttttcttgcgacaatcatgtctccaggctgtactttcccgacaaactcaggatcaatatctgccatggcatgggaagccagctcctgcgggtcaaaagaattcagatatcttgccggaataatcacatccgtatcaacgttatctccatacttaaatacatgtcctcttgcttccatgatctattcacctgctttctctggatttgcgatatagcctttgatggcacttgcagccgccgtctccggagaagcaagatagatcaaagagtctacatgtcccatacgcccgacgaaattccggttcgtggtggaaacacacttctcgcccgccgccaaaacgcccatatggccacccatacacggtccgcagcttggtgtggagaacgcacatccggcgtccacgaatatctccgcaatgccttcttttaaacattccttgtagattgcctgagtacccggaatgacgatcacacgcacatccggatgaaccttatgtcctttcaggatcttagccgctcttctcatatcctccattcttccgtttgtacaagacccaatgacgacctgatcgatcttgatcggctccatcgcctctatctcatcgatggtatgtgcatttcccggaagatgaggaaaagcaactgttggtcttacttcagaaaggtcgatctcgatgacctcgtcgtatgccgcgtccgcatccggtgtatagatcgtatatggtttctcagaatgttctttcatgtatgcttcggctttctcatctacaagaaaaatcccgttctttgcccctgcctcaatcgccatgttagccatggtgaaacgatcatccatagaaagctcagaaagtccatctccgacaaactccatggacttatataatgctccgtccactccgatttttccgatgatgtggagaatgatatcttttccgctcacatactttcccggctttcctgtgaggacaaactggattgctgacggcaccttaaaccagagctctccggttgccatccctgtggcgatatccgtcgtaccgactcctgtggaaaatgcgccaagagcgccatatgtacatgtatgggagtctgctccgataatacactctcctgctacagtgatccctttctccggaagaagtgcatgttcaattcccatctgtccgatctcgtaataatgagtcagtccctgatcttttgcgaattcccggattgatttggaattctccgccgatttgatatccttgttcggtgtaaaatgatccggtaccagtacaactttattcttatcaaataccttatccgccatctgccgaaataccggcaccgccatcggaccggtaatatcgtttgccattacaacgtccagctttgcctcgacaagctggcctgctgttactgcgtctaatcccgcatgtgccgcaaggatcttctgcgtcattgtcattcccatgccttttgctcctcctgttattctggcttacgcctttcttcatattttatcatacttccgtatagatgtgcaagaaaaatcagagcgcaatctgttttttcggcagtccaatcatccggaatcgcatttcatatttacgctttttcaaatttattatataatagatattgcatgaaaaatttgtcgtttaaaggagaatgagcatgacgttaaaaatgggaaccaaccagcacacctacatcgtccgctccattcaactggagctttcgctcgaacgcaggctcgaagccctcggccttaccgagggtgctccgattaccattttaaataatgataaaaagggagccatgactgttcggttccgtgggacccgatttgccctcgggagacggattgctgaccatattgaagtggaggaggccaagtaatgggtgaggtaattaatgtagggttcatcgggaatccaaactgtggaaagacaaccctgttcaacgcctataccggtgccaatctgaaagtggcaaactggccgggtgtgacagtggaaaaaaaagagggcatgacagaatacgagggcgatcgtttcaagctgatcgatctccccggtatttacagtctgacctcctacacaatggaagagactgtttccagagagtgtattatgagtgatgatgtggatgtgattgtggacgttgtagacgcttcctctctggagcgcaatctttatcttacactccagttaatcgagcttgggaaaccagtcgtactggcactcaatatgatggatatcgtagaagagcgaggaatggaaatcgacctgcaccgtctccctgagatgcttggcatcccggcaatcccagtatccgcaaggaaacggaccggactttctatcctgatgcatgcagtcaagcatcacgaaggtcttatcacccaggatccgctgatccatcatcatcaggagaaggaggaacactcctcccaccgtcacaatcaccatgcagagtacgcaatggtgtacagtgatgagattgaggacaagattgacattctcatcgaccgcctgtcggcgcaggatcctggtctcaccaacaaacgttggcacgctatcaaacttctggagcatgaccctgtcgtgatggaacgccacccggtacagcttgcggatgtggcggcagaaagtatggaaaaagaaatcattaaccagaaatatgattttatcgaggagatcattcaggaggtactcgtcaataaaagccagaaagcagagcggaccgagcgggtagaccgcattatgacgagccgtttcctcggccttccgatcttcctcttcattatggcttttgtattttttataacttttacagtgggtgactggatgaagggatactttgagcttggtcttgtctggttctcggatctggtgtcaaacggcctggaagctctccatgcgaacccgctgatccgctccttgatcgtggacggtattatttccggggtaggaggcatcctgactttccttccgaatatttttatcctctttctggcgctggcctttctggaggacagcggatatatgtcccgtgtagcctatatcatggatgatctgatgagccatcttggactttccggacgtgctttcatcccgctccttcttggttttggctgctctgttcctgctgtcatggcatcacgggctctggagcaccgtaaggaccgcttaaaaacgattctcgtcaccccgtttatgtcatgtagtgcgagacttccgatctacgtcctgttttcttccatgtttttcggaaaatacaggatgctggtctgttactccatgtatctgctgggtattgtaatcgccatcgcggcagcctttatcgtctcccggttcgatggcagtaaggcagaacatgccctgctcattgaacttccggagtacaaaacaccaaacgcacacacgattgccatctatgtgtgggaaaaagtgaaagattatctctccaaagcaggtacggtcatcttcatcgcctccatcattatgtggggtgtgatgaatctcggcccgcatggatttgtatcagatatttccgagagctttggctccatcatcggaaaggctctcgttccggttcttgctccggcagggcttggctactggcagattgccgtggcgctcatctccggtatcgccgccaaagaggtggtggtctcaagctgcagtgtcctctttggcattgccaatatcacgactccgtcgggaatggacagcatggtggccgtccttggctccatgggattcggagcggcgaacgcttatgcgctgatggtcttttgcctcctctatgttccatgcatggcgacgcttggaacgattcaccgggaagtaggaaagacaagcattactgttgcatttgcgtgttttcagctcgtcattgcctggattttcgctgtgatcttctatcggatcggaatgatgttttaacaaagcccatataaaaaagaatcctgtttagcaggattctcctgtccatcgggaacatttaagaactaacgaaaccgtagccgactcctcatttttctgtggacgttctgctacggtttctttttacattaatttctttcttgttttcagataatcccaaaatggcggataccaaagagggggatcctcaagaagtgatttcctgataatgctcttctcatgggtaaacgtatcaaagcttgcttttccgtgatactttcgcattccgggctgtcccgctccaccaaacagcaagtatggcgtcgcgagaggaacgacagtatcattgatacatccccctccataagagaactctcttaaaatgaaagactcccttttcttgtctttcgtgaacagatacaaagccaacggtctcgactgtgcgtcgatagcagagactgcctctttcagatcgtaatacgacataatcggaagaatcggtccgaagatctcttctttcatcacggcatcatcccaggtgacgctatccatcacggtcggctcgatcttcagcgtcatactgtctgtccgccctccgtaaataaccttccgctcgtccatcagcccacagatccgtttgaaatgtctctggttaatgatggaagaatactcctcattatcaagcggagcaaatccatacatcttctggatctgcttttcgatgtagtggatcagctttttcttgacactgtgctgtacaaggacataatctggtgccacgcaggtctgtcccgcatttaaaaacttaccccagacaatccttctggccgcagtcttcaaatccgcagtctcatccacaatacacggactttttccgccaagctcgagaatgaccggtgtgagatgtctggctgctttttccatcacggacttgccggctttcggacttcccgtaaaaaaaatataatcaaatttttcactcagaagcgcctcgttttcttcccgtccccctgtcactaccgtcacatagccggatgggaatacttcccggatcatctcctgaatcatagccgatgtatgtactgaataggaagacggcttcaacaccgcacagttcccggcgctgattgccccgatcagcggggccacggtaagctggaaaggataattccaaggagccataatcaatacgacaccataaggctctctgtaaataaatgagaaagatggaaactgcgttgccggagttttgactcttttaggctttgcccaaaacgtcagatgctttatgttaaaacggatctcctcttttaccattccgatctcagtcatatatccttccgtactggatttcccaagatcctgactcagcgctctcagaattctgtcctcgttttcctccatccatttcagaagttttctaaggtaaaatatccgaaatcctggtttctttgtcttccccatcttaaaaaactctttctgccgccttactaatctttcgtactccattccttctcctttccaactagtcttttaacttctgcatcttttcctttttagcttcccggaggtacgggatctcgatcggatcgatcggatccaccggactttctactttcatctttttctgccggctccggcgctttaagagctctccacccttattgtaaaaccagaagctgtaggcaagaagcttattggcctttccgatcttgtcttttacagtcttgtcatagaatcttcctccggcttttacaatctgattcttacggatcagattaatgagttctgtctcgcaggctgctgttcctgaaaactctgtataagccgtgctcacacactcgatcttatgtgcgtcactccctccgattcctggcttatggtatttttttgcaagttttgccgcaccctcgttgctctcctccgattcacacgcattaaatacttcgataaaatcaaatcgcttgatcagctccggggatttatagaaacgctttgtattggtaaagcttaaatatttctcaccgcatggatgagcaggcccaagcacacccccgtttttgtgtacaagatcaatcaacatcgcaagcggaagtcccctcatttccaggagacgcatcttgcgcccctccggcatgataacaagaaaatgtcccgcatctctcgtatcgtactcgatccctttaaacacgataaagtcctggtatttcttccctttcagttcgttcttccaataccgataaccattgtacgtgtcgtggtctgttacaaccatcccgtcatatccatgatcaatcagcttatcaatatactcttccagtcctactttgctgtcaatagacccctcttttacatgacaatgcatgtccagcttcatatacaagcccccttttgcttccaggcttattataccctttttttcaaaataccaacaagctcatcggcatttttttcatttgcgtattctgtttaccctctttcttctagttgtccgactcttcctgttcatcggaatccaaaacgtttctcgccatctcaatttcagactctacggatttcttttcccgaatctcttttgccttctttcgctccagtctcgcgatcttactggacttcatggcatactggatgcagattccgacaaccgcaagtacggcgcttaccgcataaaatacaatcctactctcatatggcagataatggtaagcgacaattcccccaagtacgcctccgctgattcccatcaccggaatgatcagaggatctccaaatacagccgcgagaatcgcaaatatgagcgccacgccgcctgcgattccaagtaccagataaccttctccgccgcccagcgcagccacacttacaaaaactgcgatcaaagaaaatacaaatgcaccaaacttcctaaataccgcttcaaatgcggcaagcaccagtccggcccctgcggatacaccgatcatcacccagccttccagatgcaggaaccaggaagccgtaaggccggctgtcacaccaagcagaaatccctgtatcgcaaacagtacatatttacacttggcgccaaacaaaatcatcagaagcgcaatcacacctgtcaccacaaaggctgccgttcctcccctcgaaaagatccatgaaaaatccatatttttcagaccatcctcaaaaagcagacggctggtctgatctgctgcctcaaatattctttccatctttgtctctcctttgtatctaattactcattagttctttttcttcctgcctttattttaatacaaaactgatcttcccgcaacacgaaagatggacgccgatgctgctcttatcatcaacgtccatccttaatttgttggttcttcagtcattcgttaacctaccttttctcagattatgtgaactattcttctcttttcggtggtctgtacctccttttctgaaatcccttgatttcttttcgtttatcttgtcttgatagtagcacgtgcagtttattttgtcaatatattttttagtattttttattttttctctattttataatgctttgtataaattatcagtcgatttatattcatcaccaatataaaaagataccatactgtctctgggactgtatggtatctcttccatacttttcttgtattaaaatgcaacttttccggaatcagttccgttaaccacataataaactgctgcttcctccggctttacataaagtgtgatatctttgatatctcccactttctttccgtttacctttgtccagtctttcttgactgcggcaatcatctctttttcctctacttcttttccataatactgaacgaatgtccgtactttgatctcttttttcgctggtttctttgcagttgtcttttttgccgttttgactgtcttttctgtcgcttctttcaccgcgtccttaaccgcgtctgtcttctctgccacaacttcttttacagcttccgtcttttccgctacgacttcttttacagcttctgtcttctctgctgctgcctttgcggtctccgcggcaactgcttccgtctttgcagctacttttgccaatgtacgttttcttgccataataaatcctcctaatgaaaactgtgacctgttgtcattctattttgtcttacctcgctagctgtccattattatagcacatttttttcaaattgcaaggaaagcggctttttattcatcgacattgaatttatatacggttgtcgtctgataagtctctccggctttgcggatcggagcctcaaactgttcatggtgaaccgcgtccgggaagtactgggtctccagacagacagcggcgtgtttgccgtagatcttctgtccttttcctgtctcgtgttcaatcccgtttcctgtgtacatctggattcccggaaggtcagtatacacttccatggaaatgccagtgtccggagagcttacttccgctgccctgatcagacttccgctgtttccaagatcccagttgtgatcatatcctccgccaagcttcagcggctcgtagtccgctttgatgtcctgcccaatcgcttttttcttacggaaatccatcggagtacctgtaacgtcaatgagccttccggtcgggatcagcatctcatccgtctctgtaaaagcatccgcatgtagacacacctggtggtttaaaaccggatctcccccctccccgttcagattaaaatagctgtggtttgtcagattcagtatcgtatcctccgatgggatcccccggtaggaaatcctcacttcattctcgtccgtcaaagtataggaaacctcgattcttacatcccccggatatccctgatctccgtccgggctaaacagagcgaacgtaatgctcttcgtatctgactgcttcacttcccaaagtctcttgttatagaaatcatagccgctatgcaggttatttccattttcatttgcgtcaagcgtatacttctttccaccaagttcaaaagcagctcctctaatccggttcgcatttcttcccacggttgcgccaagaaaaattgccccgttttcatacccttccacatcgtcatatccaaggactacatccctcttttctccggttcggtctttcactttcagactgacaagtgaagcaccgtaatctgtaagctttagttccattcctgccgcgttttccatcgtatagagactggcctgttctcctttggcagtttgtccgaaattttcttttttcatatcattacccaatgccctcccggggcttcctttctctgcatatttctgttctctattttacacctaaattccccgcatgaaaagaagcattacaaagggtgtccgaatcgttacgattttctttgtaatgcttctggatggtttctgatttcttctctttcttatttccgataagcaacggaattccatctgagctcatttttcagtgtgcggatatctgtatccttgtcaatgtaaaccgcttcaatacccatagcgtcagcccagtcccccatctgctctgctgtgatgtcgtaggaaaaggcggtgtgatgtgcgcctccgcagagaatccatgcttccgctccggtctgaagatttggctccggcgtccagaatgcagtcgcaaccggaagtttcggcatctgcttttctgtctttttgcagttgacactgttgataatcagacggaaccggttgcccagatcaattagtgaagttgcaatcgccggaccttcctttgccgtaaaaacaaggcgcgccggatcttctctgtctcccatgctaaggggctgtactttcatgctgatcggaccgtctgaaatagtcggacagacttccagcatatgagcctgcaaaataccctctttgcccggaacaagattgtatgtatagtcttccataaaagaagtaccctttgcccccttcattccctctgtcataatcttcataatccggagcatcgcagccgtcttccagtctccttccgctccgaaaccatatcctttttccatgagtctttggattgcaagaccagggagctgtttcaggctgcccaaatcgccgaagtgtgtaacaatggcctggtaatttttctcctccaaaaaccgttcaaaaccaatctccatccgcgcctgtactgccacatgctttttaaattcttcaggatctctcccttccagaagaatatcatatttatcatagtattcgtcaacaagagcattgacttctccctctttgacgtcttctactgcttgggcaatctcattgaccggataagcgtctacttcccatccgaacctgatctgtgcttccaccttgtcgccgtctgtaacggccacatttctcatattatccgccactctcataacgcggacatgactgctctcaatgacgcccactgccgtacgcatccaggatgcgatcttttcctgtaccttctgatcagaccaatgtcccaccacgatttttctctcaattcccatcctcgtgaagatatgtccgaattcacggccaccgtgtgcagactgattctcgttcataaagtccatatcaatggtgtcgtatggtatttcctgattaaactgagtgtgcaggtgcagcaatggttttctgtactcctgcagtccgagaatccaggattttgccggagaaaacgtatgcatccaggtaatgacgccggcgcaggtctcatctgtattagcctcattgaacgtccggcggatcagctcatttgtgatcaatgtcggtttccagataatctcatacggaagtacaccggatgaattcagcgcctccacaattttctgtgcgtgctctgctacatgggcaagacatgcgtctccatagagatcctgggatcctgtgcagaaccaaaattggtacgttttctgttttaacatttgtttgtcctcctgctttttattcatttctttttactttcttttttcccggctgcggctggttcctgccgcttacgtcaaatatgattgatgaccttgaccgaacttcgcatgatcagctctggctcaagctctactgtctcgatctccgtaaatccccgaatccgtcctatcatcatctcagcggcgattctccccagctctcgcaccggatttctggcagaagtaaacggtatttcgcagaatcgtgacaaatccgaatcatcaattcctataatagagagatcctccgggatccggattccctgatccatacagattccaaccatcttgttggctacctcgtcattgtaacagacacaggctgtgcagcccttgattcgtttcaagacccggccgcaatcatcccgcatctcttcaatctcatctgaatcgatccaaatcacctgttttcctttcaccttgatatccgcctccatcaatgcgtccacatatcccgcataacgctggtgtccctgaccgtcatcacctttaaaaatcccggcgatattcatatgaccacagtccagaagatgctgcgtcaccatacgccccgcttcccggtcatccagactaatgtgagggatatccagttccggataaaagctattgataaacagaatcggaacgcccattcgttccagctctttatagagcttcagattcgggtttgggattccactctttgtcgtttctgcaatcagtccgtcaatcgacttctcacggatgaaatccttcaggatcatcctctccttttcgatcgcattgttggatacggcaatctgaagaagaaatccctcgtctgaaagcaccctcccgatttccttcacaatcaaagggaaaatatagacgtccgcatacgttgtcatcaccgcaatccgcatcgaacgtttccgctgccgtttcccgatctcaatatacgttccgctgccacgcacactccgtgtaatctgctcttcctccagtacagacagtgccttgcgaaccgtctgacggctcacatggaaccgcttctttagcatattctccgaaggaagtttgtccccttgcttcagccgcccttcacgcagctctccccggatccaggcaatcacctcttcatacttcttctgcatgtcaaagcctctctttcattctggtatcactataccctatccacatgcacaatacaagccggagaattatccaaatttgtttcaaacaatttatatgaaattgaaaagttgtattgtaaaaatccaaaaatttatagtacagattttacaaaggggagggattccgatatatcggaatccctccccaatacgttatacctatgactctgccatgtcttttgcgccgtgccgttttcggatgataagaagaacagcaagcatcaggactataccaatcggcagtgatatccatgcggtctgtgtaaatcctgcgataatgtaggtaacgaagctgaccgctgccgccgtcatggcgtacggaagctgggtagatacgtggtttacatggttgcactgtgcccctgcggacgacatgatcgtcgtgtcggagatcggggaacaatgatcgccacataccgctcctgccatgcaggcagaaatggaaatgatcatcagctccggattggagttctcaaatactgccacgacaatcgggataaggattccaaaggttccccagcttgttcctgtcgcaaacgccaggaaacatcctacaaggaagatgatcgccggcagcaggttcatcagaccgtctgcggatgatgacatggcatttgccacaaaatccgccgctcccagatgatctgtcattgtctttaaggtccatgcaaatgtaagaatcagaattgccggtaccattgcctgaaagccttccggtacacagtccatacactctttaaagctcaaaacacgtctggcagaataaagaatcatcgtcgccaaaagtccgaaaaagctgccgattgccagcccttccgaggccgaacactgggaaaaagcagtaataaaatcagtaccgttgaaaaatcctccggtgtaaatcataccgatgacacagcatactacaaggatgagtaccggaatcacgaggtcaatgacttttccttttgtttcttttatgcttttattttccatattggcaaacggacggtcaggcgtcgtgtacaggtcgcctttgatggcgttcttctcatggacacgcatggagccgaattctatcttcatcactgtaagtcctaccatcatcacaatagtcagaagtgcgtaaaaattgtacgggatcgccttgataaagatcgaaaatccgtcttcaccttccacatagctggataccgcagcagcccaagaggaaatcggcgcaatgatacacaccggagccgccgtcgcatcaatcaaataggcaagcttagctctggacaccttatggcggtctgtcaccggcctcataacgcttcccacagtcagacagttgaaataatcatcaatgaaaatcagaaccccaagggcaatcgtcgcaagctgtgccccgactcttgtacggatcctttttccggcccactccccgaaagcagcggatccccccgccttgttcatcatgctgacgataacgcctaatacgaccagaaaaataatgattcctacattgtccgaacttgtcagtacgctgatcattccttcatttaacacggaattgacagtgccttcaaagtggaaattggaggcgaacagacctcccaccacgattccgataaagagggaactgtacacctctttcgtaattaacgcaaggccgatagccacaatcggcggcaccagcgcccagaaggttgcatacatcgcaggctgtaccgtctctccatctgaggcaaacactgtcagtgaccacatggatacaatcataagcacggccaccagcccttttcgtatcgttttcttttgcttcatgtttctctctcccttttttctttctttcgctgcagccaatacaatcaccggaagtgccaaaagacacattccgggattgtaagcggtcgccaaggtctcgggcaggcccggactttggttcgtcgccaatacaaaaagccgtgagtatatgcaaaacacactcacggctcagatatctgttccgattccacgatagcgctccacaatctgtgacagtatgctgtatcttctacaacatcccagaaagcaaagttacgtcctcctttacttccttcggcggtttcccctttctgctctgcggatggtacgtccgtctgtccagagcatactgatgaatcccgcgcctctatcttcttccttgaaatcaaggcttttattcagcttttttaactatatcacactttcgctgttctcacaagctctttttctccatttaaaacagcttccagaagctgatcgccttcgtagcaaagtttcagagagaaaaaggggacatccttctgaagcagatcgaaaaaaatcctgtctccttcccatagattcagcccaaatatttcatctttcggcacccaaagaagctctccttcatcacattctttgagctgtccggaaaaaccgtcaatcgtatacaggcagatatattccgggtcctgtttatcacagatgaatgtgagaatcccccggaacttcatagaggtgacggcaagccccgtctcttccttggcttcccggatcatacattcttccgggctttctccatactcaaactttcctccgattccgatccatttaccctcgttgacgtcctgctcttttttcactctgtgaagcataagataggattccctcgtctcaatatatccaagtgttgtcatttgtacttttggcatgttgatccttctttctttttacagctagtataacacgcctatttcaaatggtctactgctgcccgctcgatggcaaatccttctttatatcgctcgataaaagtatcaaatccggctacctcctttggatccgctcccatcacagttccagtctcacccgcaaatacctttgcggaaaggaactgtggcagactttctccctcttctttgtgtacgaggtaagacgccagaagagcaatcccccaagctcctccttctcccgcagtctccatcacagacaccggcgtgtcgattgctcccgcaagaatgctttgtcctacgccttttgttttgaagagtcctccgtgacccagaatcctatccagcttcacatgctcctgcttcagcataatatccattccgactttcaacgccccaagagaagtatacaggtgtacccgcatgaaattcgcaagactgaatctgctctttggagtccttacaaaaagcggacggccctcttcaaaattggtaatatgttcccctgagaaataattatatgccaaaagccctccgcagtcctcgtctccttccagcgctttccgatacagtgttccatacagatcattcagatcgatcttcataccaaacgtttccccgaattcccggaacagggatacccaggcattcagatcggaagtacagttgttgcagtgtaccattcccaccagatctccggacggcgttgtcacaatgtcgatctccggataaactttggaaagctcctgttccagcacaaccattgcgaacacagacgttcctgccgatacattaccggttcttggcgccacactgttcgtcgctgccattccggtacctgcatctccttccggcgggcaaagcgacgcacctgcctgaagcgctccggaaggatcgagaagctttgccccctcctctgtcagcacacctgcgtcttctcctgccaccaaaacctccggaaggatctctgccagcttccacggatacccctttccctcaatctgtgcgtcaaactgtttcatcatctcctggttaaactgcttcttttgaatatcaattggaaacataccggaggcttctccaacaccaagcacctttcttccgcttattttccagtgaatatatcctgcaagggtcgtaaaaaacgccacatctttgacgtgctcttcctcatttaagatcgcctgatacagatgggcaatactccatctctgaggaatgtggtactggaaaagttccgtcagtttttctgatgcctcctcagtgatcgtatttctccaggtacgaaacggcaccaacagctctccattcttgtcaaatgccatgtacccatgcatcattccactgaatcccagagctttcagccgtctgatccgaaccccgtatctttcctccacatcatacgccatagtctgataactttcccgcaaccccgtccagatatcctcctgtgtataagtccagataccgttgtccagccgattctcccagtcatggcttccggaagccaccggctcgttttgctcattgatcagaaccgccttaacccttgtagagccgaattcaatccccagaaccgccctcccttcttcgatcatcttttttgtattctgaacatcaagtgccatatgctattcctcctttttgaaacccgcattttggtactattatatcatcctccctgttgaccggcaatccaacctgtgtatactgcacaatttcagccaaatgccgaaaaaaaggacagcagctcctcaaagttgtattgaaaatccgccgtccgaaacttcatatttcccagatactatggttcccgcaaggacgctattccccgcgccaggattcttacatcatccagaatataatcaaaagctcctgctttgtacaaattgaatacaatcattccaaccggcaccgccagaatcattccgaaaatacttccaatccggtaacccacatacaataaaaccagcgtgacaagagggctcagtccgatgctgtcaccaaccagtttcggctggatcacctgccgcacaagctgggtaatgccgtagatcacaagcagccccaccgccgttttgatatccgtcacaaagaatttatagactgcccacggaatcagtgctgttccggttccaaaaaacgggagaaagtccagaaacgcaatcaacagtgccagcaggaaagcgtaatccacacccaaaatgagaaatccacacagcagaatcagtcccacgattaccatgatcttaaactgagctttgaaatacccgcccaccgcatacttcagattgtaaatgaccatggtcatccgggcttcgatggcctttggcgccaccttcttgctccactggatgacctcctctctctgagcggtaaaaaaatatgcggacacaagtgcgacaatcacagacacaagcgcgcttggaattcgtttcaccacgtttccggtcatctcaacagccggattcccgagacccgcaatcagccctccgactttttcgtccatattctgcaccagggaattccagccatcctgaatattgtccggcagcatattatagaacccctggaaccgtcctccgatctcttttaacccggattccagatcccggtaaagatgaggcgcattgttgagagccatctgaacctcacgaatgagtttcacaattcccagatagccaagtccggctacaatggcgattacgagtataatgatcaaggctgatccgaattttttcttgatctttacccggttttccagccaccctacaagcggatgcgccaggtaagcgataaaccagccgatcacaaaaggcatgaaaaagccgagtgcacggattccgatcacaagaaaaagcgccgtcccaagcaggctgaaaaagagacttgccgtcaccttccagtatggtcttgtatcttgtttcgttctgtctgcgtcttctcccatcttattcctccttgtcgacggattcaaacagtctggattcggcatactcccagatctcgtctctaccctgctttgtcttggcggaaaaaggaatcactgtagttccgcttaccagtccaagtcctgtccggatcgcttttaactgctttgccacctggctttttttcagcttatcaagcttggtggcgataatcactggttcatagccctgatgcaaaatccagtcgtacatcattttatcgtttttagaaggatcatgccggatatcaatcagaagaaagaccgccttgagcatggtcgatttatgaaggtagcgctcgatcatcttcccccatgcctctttttccttctccgaaaccttggcgtatccataacccggaagatccaccagatatatttcccggttgatattgtaaaagttgatcgtctgggtctttcccggcgtcgcggaaatccgggcaagggatttccggttcatcagcgcattgatcagcgaagattttcctacgtttgatttccccgcaaacgcaatttccggcttatcattttctggaagtgtactcgtaatcccacagacagtttccagcgtcacttctttaattaccatcctgttccctcctttgttccacctgctctgaaatagcagtatgtaatacttcttccattctggaaacaaaacgcacttccagccctttcgtgatctctttggaaagttcctctacatccgtctgattttccgccggcacgagcacgaggtgaattcccgcattctttgcggcaagcagcttctctttcagaccgccgattggaagtactcttccccgaagtgtaatctccccggtcatggctacatcggagcggactttctgtccggtcactgctgaaagaatggctgtcgccatcgtaatcccggcagacggtccgtctttcggcaccgctccttccggaatatgaacgtgaatgtcgtgcgtttcaaaaaagtcctttggaatcccgtatcgcccactaatagaacgaatatagctgatacccgcctgtgcggactctttcatcacatcccccatctgtccggtcagcagaagctttccttttccggaaaggacattgacctcaatctgaagtgtatcccctcccacgcttgtccatgcaagtccggttacaattcccacttcatcccggcttccggcaagatgataacggtatttttctttcccgagataatgtgtcagattgcgttctgtgatccgcacctgattttttccagattccaggatctctctggctgccttgcggcaaagctctccgatccttcgctccagtgtacgcactccggcctcttttgtgtagccgcggatgatcttccacagcgccccgtccgaaatgagaagaagtccgccgtccagcccgtgacgctccaactgctttttcaaaaggtgctccttcgcaatgtgcatcttttcattttccgtataactggatacctcgatcagctccatccggtccagaagcggccgtggaatcgtctgcagagtatttgccgttgtcacaaataccacctcggacagatccagcggcacctccagataatgatcccgaaacttcctgttctgttcggaatccagcacctcaagcagggcagaaaatgtatcccctttattataatcggtgctgaccttgtcaatctcatcgagcagcatcaccgggtttttcactcccgccttgcgaagtccgtccgcaatccgtcccggcatggcccctacataggtcttccggtgtccccggatctcagcctcgtcccggacaccgccaagagaaattctcacatacggctttttcatagactctgccagagatctggcaatagacgtcttcccggtccccggcgggcctaccagacagaggatttgagaaccactccggtttgtcagcgcacgcaccgacagatattccagcacccgctccttcacttccttcagcccataatgctgcgcctccagaatctccttggcatgggcgatatccgcaaactcttctgcccgcttatcccacggcatctccagcatggtttcaatataggtacggctcacaccggcctctgtcggattgttcaccgcctgtttaaagcgtcggatctcctttttgatcttctcatgcacttcctcaggagccagaagcttttgctctgccttttcaaattcttcggcatcagatgtagtaccgtcctcaccaagctcctctcggatatattttaactgttcacgcaagatatattcccgctgtcctctgtcaatccgttcccggacttttttctcgatctctgctgtgatgtcaaaggctcttgtctcctcctcaatcttagccgccagaagatagaatcgctccaggagactatcctcatccagaagcttctgaagagaggctgaatccaggccgatgcccgcagcggcctctgccgccatggtatagacgtcgtcgatctttaagatatcctgaatgactccttccgggacccgctttgtgcgtattgcatactgcttcaaggcatccgtcagtacctttttcattccttccagtgtcacgccttctggaagatccgggcacttctccggataaatggaaatatcaccttcccagaatccatttgcttcccgaaactcccgcaaaattgccctcttctctccataaaccatgacccggatgcctttctgcgggacacggacaacctgcctgatctcggcaagtactcctccgtggcagagtgcgtccttatccggctcctcaactttctcatctttttgtcggatcagaaataccttctgccctgcaagcatcgcctgctgaatcccctcgatagatttcatcctgatcacgtcaaaatgtactgccattcccggaaaaacggtcagtcccctaagcggtacaactggtatatgattgatctgttctgtcattatgtcctccgtattttacaaaaggtgcaggtaaaacatacctgcacctttcccatttctgtctattatgcactttctgtctgctatgcactctcggattcccgctcttcatgttctgtctttggcaggctctttccttctacaacatctctggtaatgatacaggtctttagcgtctcgtcagatggcgcacggtacatgatatccatcatcacattttccatgatggcccgtaagcccctggctcctgtatttctagcaatggaacgatccgcgatagcctccagcgcgtctttatcaaaatgcagtctgacgccgtccagctccatcagcttctgatactgcttgacaatcgaactctttggctctgtcagaatctgaatcaacgcgtcacggttcagggactccagtgctaccacaaccggaacacgaccgacaaactccggaatcagtccaaatttcaccagatcctgcggaagcacctggtttaacagtctgtccagattgtcctcgtggttttccgcaatctccgcattaaatccgatggatttctgatcaatccgtttctcgataattttgtcgatcccttcaaatgctccgccgcagatgaacaggatattggatgtatcgatctggtaaagctcctgatgcggatgctttcttccgccctgcggaggtacggatgcaatcgtaccctccacaatcttcagaagcgcctgctgaacaccctccccggagacatcccgggtgatggatggattttcagacttccgtgtgatcttatcgatctcgtcgatatagataatcccatactctgctctctcaatatctccatccgccgcctgaataatcttgagaagaatattttccacatcttccccgacgtatccggcttcggtcagagtcgtggcgtccgcaatcgcaaatggaacattgagcaccttcgccagtgtctgtgccagaagcgttttcccgcttccggtcggtccaagcatcagaatattgctcttttgcagctccaccccaagatctcgctgtgctttgatccgcttgtaatgattatagaccgcaacggaaagaacctttttggcctcctcctgcccaaccacataatcatccagaaagctctttatctcttccggcttcaggagattaatctctcctggcccgttattttcgtcttcataatcaaattcttcttctataatctcggcacagatctcaatacattcgtcacagatatatgctccgtttggccccgcaatcagcttgcgcacctgagactgtggcttattacagaaggaacatctcactacatcttcttttaaagccattctcacacctcattttatgtaacgcttcagccatgcggcctggattaccaaaatgcaggcttggctgcagaagtctttcgatatttcccggcatatagctgaatcgttactattttatattttccgtatcgttttgaaacacggaaaggggatgtcccaggccactgggacagccccttgtttccctttatcggcttgtaatgacctcgtcaattaaaccgtatgcctttgcttcctcggcagacatgaaattatcgcgatctgtatcccgtgcgatcgtctcaagcgtctgtccggtgttttctgccagaatctcatttaattttcggcgtgttttcagaatatgttctgctgcaatctgtatctcggacgcctgtccctgtgctccgcctgacggctggtgaatcataatctccgcattcggaagcgcaagacgcttgcccttcttaccgccggataacaggaaagatcccatactcgcggccataccaatacagatcgtagacacatcacacttgatgtactgcatcgtatcataaattgccagacctgccgtcacagaaccgcccggactgttgatgtacaagttgatgtcttttcccggatcttcggcttccagaaacagaagctgcgcgacaatcacgcttgccgaagcatcgttgacttcgccgtccagaaaaatgattctgtcttttaaaagtcttgagtagatgtcgtatgaacgctctccacggcttgtctgctcaatgacataaggtactaaactcatgcaatatgcctccttatttttatctcttattcttctaccgcgttttcaacaaggaatgtcacagcttcctggacagccatatccagtttcatctgttttttctcattttctcccatgaattctttgagcttctctgcttccatcttgtaagactcagccatcttctggatctcttcgtcgatcttctcatcgctgatctcaatattctcagcctttacgattgcttccagaacgagccttgtctgaattctctttaatgcctgcggtttcagctcttccgtcatcttctccgctgtcattcctgtaaactggaagtactgatccatcgtaaggccctgctgctgtaatctctgtgcgaaatcatttgccatctgtcttacttcggtatcgatcatggcatccgggatatccatctgtgcgtttgccacagcttcttccactgctttatcttcctgttttctcttgccttccgcaatcttctgttctttaatttttgccttgatatctgctttgaaagcatcgagcgtctcgaactcagatacatcggaagcaaactcgtcgtcaagctccggaagttcttttactttgatctcatgtactgtgcatttgaataccgcgtcttttcctgccagatcctttgcatggtactcttccgggaatgttacacggacttctttttcctcttccagattcgcaccgataagctgatcctcaaatcccggaataaaagatctggaacctatagtaagcggatagttctctccctttccgccttcgaatgctacgccgtctacaaatccttcaaaatcaagaacgacttcatctttatcctgaaccggacggtctgtcacagaaacagttctcgcgttcttctcctgctcctcggcaagcttcgcgtcgatctccttctgtgtaacacggttggaaatcttctctacctttaatcctttgtattcgcctaatgttacttccggctttaatgccacctcagctgtaaaaataaatggtttgcctttttcaatctgtacgatatcaatctttggctgcgatacgatctcaagatcctcttcatcatatacttttccgtatgcttccggaatgagctgatttgcagcgtcatcgtagaaaacttccggtccgtacattttttcgatcatctggcgcggcacttttcctttacggaatcctgggatgctgatatttttcttctgcttattataagctccctggagtgccttctccagttcttcggctgaaacttcgatcgtcagtttcgccatgttgtgttccagtttctctacttgtaaactcatttacatttcctcctaaatattatcgtatatgcgaaaagtcggcagacttatctacattacactgattgtttgagtataccatattctaatatggatttccagccctatcctgcactttttccagtgattttcgtcttttgcttttgtccttagtttgtgttcgcgatctcatccatccggaagaactgctccagaagcatctggtactcctcttcgctgacggcataagaattcccatcttccgccgcgacttccacgatcacggtttccggttttccgtattgcattgaggtataggcgtcctgtaaaaggctgtacgccctggacagataatcgtactgcatcatttcccgaatttcttcttcggttccctcgtatccgccgttttttgctgacttctcgatttcatcagaagcctgctcaagctcctttacataattaaggaacaaatccaccggctgtatctcaactgaaacttcatattccttttccccggccttttctgctttcttaacgtcgtatttcatcacactgaagatatcttttacaagtgtctcgtactcataaagcgtgtaatcattcagctcctcgtatccggccgtcagataggcataaacaaagctgtccaccgatgattcataatcctgtttcagctcaaattccgatgtgtccatgatctgcgccgcctccgaaaattccccctggagtctctcatccagcacggcctgcatataacctgccgcgtcaaagtctccgccgcagcctgtaagaccaaacacggcagcaagcagtatggccgcaaaagtatatgccatttttctcatggtgttttcctccttatacggtctgattctagcagactcacctgcaaaatgcaacctggcataacgattcagccatgcggcctgggcaacgaaaatctgccgcaaaccgcggctctgagccggaggccgaatcattacaacttgtcggaaaatactatttaggggggcttgttttcctctttggatctctttatactgaaagaaacaggaatacaaactccaggaggaaatgataatgaataatgacaatatggaaatcgagcgaaaatatctggtcgagacctgccctttctcactgcacgactatccatcccatgagattgaacagggatatctgaacacagagccggttgtccgcatccggcgttacgatgacagctatgtgctgacctacaaatccaaagggttcctggtccgggaggagtataatcttccactcacaaaagaagcctatgaacatctgcgtacaaaaatagatggaagactgatccaaaaacggcgctatctgatccctttagaggacggactgacggtggaactggactgtttccatggagatctcgctccgctgatgctggcagaaattgaatttccttccgtggaaaaagcagatacttatacgccgccttcctggtttggggaagacgtgacattctcaaagcagtatcataacagcgtcttaagcagactcagtatctgaaatagggatttataaaataataaatggcaacgtttcgttgctttttgtatatattatacgtttcgtggcattatctgaattttacataagaaactgctatactgtttctaaaaatggaggtatgccatggcaaatgtacagcttgcacggaatttaaagacgcttcgcttaaaatataattacactcaaaaagatctgagtgctattttaaatatcaccagacaggcatactctcactatgaaaaagcgctcagagagccagacttgtgtacgttagtccgcttttctcatttttataaggtcaccttggatgatttggtcgccgggatcattcatgtggatcagatcaacgagtccctgccgatttacaactaccacctgggagagaccgaagatcacaagcgttcgatctttctgacagatcaggagctggaattgatcgaaaagtaccgaaattgtagtgccaatgtccagcaggtgatccgcggatttctggaaaacaagtgagagcaaactttcccatatgttaaaatccgaagctaacattacaaaaatacgggacttcccatgaatacaatgagggtagtcccgttttctctgcaattattcaaaacttttcacggttcgttttaatccttcttttaacggcactttacatgtccatcccattttctccagtttctccgtattcagtcttgtgcgtcccattttactgtaaccggcactcatcgtttccggaatatcaaatacgacttttcttcccctttccgggaacagaccggtcaacatcccggcaacctcacggatcggaagcggttccgtctcatttgcaatattgtatgcctcccctgcttctccgtccagtaaagcaaacaacatccccgcaacagcatccgtgatgtaacaaaacgcccgctcggcgtcgcctgtactctttaacacaatatctctgttatttacgatgtctgagatgaaatccgccatgaccctgccgtcattgttgatggtcatgcccgggccgtaagaatgagcgatcctcacggctgtaaacggaacctgatattggtggtagtaactctgacagattgtttccgccatccgcttactttctggataacaggcccggaattccatcgggtccagacttccaaatgtctcctcgtggatttcttctgttccatccggcatttttccgtatacctcccgtgtggaagtgtacagcactttttttgtaccggactttcttgcaagttccaggacgtttaccgtccctgttgtatttgcggcaatgattccgaccggatcatgtaaaataaaatgcgggctggcatttcctgccgcatggataatgtactccggcttctcttccatggtaatcggcgtacacacatcctgcaccttcagatggaaatatggcatatcacgaaaatcctcaaatttttcccatgctttcttttcatttctgaccagagctgtcacgtttatatcatactttcttgtctcattaagatacataaaaaaatataccatataggtggcgagcatcccagatgctcctgtaacaaggaccgaacttcctttcagtttttcaaacggcaagtgttcctttgcaagctcacacatatcctctctgacgatctgattctgataatccattgccattcctcctgttttttcagattccgaaaagctgcgaattctcccgtgcctcaaaaagagcccggaatgtatagaaatccatgggtgtcgtaattttaatattctctaccgggccgtccaccacaaacagctccttgccatagtgggacataatcgacgcggaatcaatataatccaaacgtccctcttttcttgctttctcgtgactttccagcaattctgaaagccagaaacactgtggtgcccgtgcaaccagacattttgaccggtctatgattccatccactttccgctcttctcccgagcatatgatcgtctcaatcaccggagccgtcgtcaccgcgctccccttatccctgacagcctggatacagtttgtaatgagttctccattgatcagcgggcgtacgccgtcgtgtacgagaacaatacttttctctccatgcgcaatagcttctgccgctttcagcccctgataaatggaatcctgccctgtcgttccgcctggaacgacctttttcactttcttgaatctgtatttttccagcaattcattcagaaacgggatccatccctccacacacgccaccgcaatcgcgtcgatttccggatgcttttcaaaatgttccagcgtataaataatgatctctttcccgtaaagcttcaaaaactgcttcggaagcgccttactgttcatgcgtgttccgatccctccggcaaaaattactgctatgttcattctatttcctcctgatctttctgaaaacaccatcccgcatctgttctatcaatggtctcagattctccttgttataaaaaagataagccaaatacgcagctccataaatcaacatgcagaaccaggattgaatcatccaactcgacacaatgaagatgagagcaagtccgttttcaaataataaggtcttccctgatgatatttttaaggttctgataagataaatctctgcgatattgcatctgagcgcaaggatgactgtcagtgaagcaatcgataatgtcagattgtccagtacatatactacgactcctgtaatgatacacgaaatcactacgattccccaattaatatacatcatcatcttttcttttctgagcgctttcagataggtattgattaacaaagaaactttactttcatagacacacatcggaaagaggagcgccatatattttaagctctcggcatactggggaagccatccgctcaacaagaccttggccggataatagactaataacattccaagaaccggtatcatcagcatcatccgaatcgttttatacatctgagccaaccgttcttccggtgtctgtttcaacatcggataaatgacaacactgactgcactgataaagaccatcagcatattcgacattgtcattgtaagggaaactttcccgaatgtttccacattccagtgattctctatggcaaatcttacaattccattaattaaaagccctgcaatattggcaaacatcaatttactgcctattgctatattttctccggactccctcactccaattcctacacaagatagttttctaaaaaccatatctttacattgaatacaaagaagtaccaaagtgacaagccttgcaaataaatctgctgaaatcaaaatcacaaaattcttttgtcccagcgcgagcatggacaaaacacagactgcatacacgattttttccaacatataatttttggcataatctttgattcggtctgtaatctgtaaaatatactgaagcaatgtccgtggaagctggagaatacagcatgtccctgtcaggatgagaacgatctgcttctgtgaatcatctaccccgaaatatgcaactgcgccgattaccaaggcaatcaagatttcaaaaaacgtcagcagccaaaattgtctgttaaaatatgtcttatctaactcttcatatttctttccgccaaacttcagatagattccatctgcccacccaaaatgaaaaaagccggtataagtgacataaaaagtatatagctgccagtatgagtactctcttacccccagagctttcggtacaataaataccaggaccatggaaacaagagtattgattccattcgccaatacagagtaggatacgttttgaaatacattttttattttagagttcattcaactttccaactttctttttgctgactctcataagaacaaaatagattaccaaaatataaactgctaaatacatatatgacgtcgataaatacgaagaaaggatcagttcatcgatactctgcataaataatggatacatcagcaccccgtaaaagatcagcaaaattccaaatccattctcttttttgatattattataaaataaggaataaaatgcacctacagctccctgcataaataacattccaacatacccgtaatcattgatgtatctgcgcaggcatgtgtatacatttccagatgcatctccgaaatccacaaattccaaatgacgcaccgtttcctttagatgaaccagattcagctttctaaggacactggttactccatacaaggtctcttcgccaaagaccgtcgacagatccttggctttattcagccagtaatcaagagatggtattgacattcctgtataaacggaaaccatatcaaacaactttcctccctggctttttcctgtaataaatccaaacaggaaaaacagaataaagaaaacgccaagcgctgccgccgcaatcaatacaattttccatacatgaatggtcttccatccattcttttttctttcaatcaggaaatgaaaaataatgaccattcctaaaaactcgatcataaaggtacgtcctgtgcccagggctgccatacataagtataacacaactgggaaaagataaagaacgtcccgcctgttcttccctgcatgaagattattgataaagaaatataaaaaaaccgctgaaaatgcttttcctagcagagatatatgaatacttgcctttccgatcgtatatcctggaataatatacatttttcttgcatactccaacatcgaggccagaccattcgtatttcctgccagcagcgaaatttcatatgtctgcttgatcataactgccaagcctgctaccataccaagtacaattacgatcactaccgtttggggaatttcaattcttgaaattcctctgttttgctttctttttggaacagcatgtttttcaaaagcagctgaaatcaatatttctcccacgccaaatgcaaaaactccggtcaagatcacgaaaacagtcagcggactcagcgtaaactgccatgtgtcaatgttcagaatcgcaaaaaatgtactgaccagaaacatcccgatcgtaatgacccagggagacaatatatctttttgattcatcaaatatgctgtaacaaacatacaacataatccaaaaaataatatataaatcataaagactcctgtgctttatttctttcttacaaataatatcgtgatcacaaataatccgcctaaaactcccaaaactccggcaagagcaaattctttcactttaaaagtattctctgcctccacgatctgattcctgatatatgtcttctctttggcaacttcatatttcaaatccttttctaccaaagaaacactttccattgctttatctatatagtcattcatcatctcttccataacaggctggatttcttcctgtttcgattccgcaatcactttatagaatctcacttcatagatcatggaattcggtacatggtaaagctggaattgttcctggatccattctacctgatacttcagagccatatttccccatccgggacagacttgttccatatcatagttttctgtataagaatccgcaagctcagacaacaatgtacttcttgtccacaaaagactcatatcgtaatctaacgtttcacctgtcttcgtgctttccagtgaagctacgtcaatatttaacagacggtaaacatctacttcgatagattttccggctccgcctttttcttttgcgtataaataagactgtccgaaataggctgctcctcctatcacaagtaccgctaaaagaaaaatataccatttcctttttaaatgttttaaatattctaaaatcatagatgtctccttttttattttctcaattttttccacaatatgaatttataatatagatccgccaatatcagaagtatcatataccactgtctgtcaaaaagaaccgccatccatttcctttgcttcggcaaatttcccaactgctctttcttatgaaatatccgaaacactttttgggagcgtacccattttaacgcctttttcttgtcccgatatccataattacaccctcttctttcaaaaaggaagagaatatctattagataatccgttgctcttaatacccatgtaaacgtagtcccatactcctgattcattctacgcaggagatgatactctgcctccgctgcctttacatttgcttcgatctgatttggatgaaacttctttgaagtactatgctgatatctctgataatgaatatatcccacataatccataatcacttgtcgttccggtatcagatacatctgattgttaaaaatccaatcttcgtatcccataatcacagactcatcaaacatcaactttttatcctcaaacagagtccggcgatagattccattccagatcatattaaaatatccacttcggtagatattctgatattcctctccacattgttctcttgttataatcagttgttgttttatacaattatcccggacttctttggctccattcgggaaatcctcttctacacgatatccaaacttgacaatatccgccctatattttttcgcatacgagcaggatttttccataatatcttcgacaagttcatcgtcattatcaataaaagtaatgaattcgcccctggcttctttgattccccggtttcttgtcttcgtaattccctggttttcctgatgaaacacacgaattcttgcatcctctttcgcataggcatcacataatctcccggacgcatccgatgaaccatcgtcaatcaaaagcagctcccattctttcatggtctgcctctttacactttctacagccagatataaaaatgtttccgaattatataccggcatgataatactgatttctggtatattgttttctacttccaccatatttttcctctgtgcgacgccactcttttttccttgggcggcatctgcatataatcaccatataaatttgtcagatacttctcatatccctcaggcgcataaaatcgcttcccctcaaattccatttcaatcatattgtcaaaatactttctctcaatcaactcgcgctcgatacccgcgccgccaaccgcgcttgcgatccatttggaatcctggaacgtttcctgtttcacatacttcatcatataatgatagcatcttttaataccgatgatttttatcagtccattggcggcagatttaatcatttgatttttcagatttctctctttatttttaatttcatcttttttcagcgctgcttcccagattctgctgcgtaaacgaataatcttcatcaaacgctgcattgctttctctttttgatttcccatcccgtcaatcggaaaaatatcgataaatactcccatctgatgaaggtctttcccgatttcttccacaagtctggttctggtatccacaacttttgcaaacgtatatggatatcccttggtacattcaatagcaagcagtttatagatgggatgctttttgtggctcatgattttgataaactgttcatagtcctcccttggcatagcgatatcgatgtcgtcatcccatggaataaagccctgatgtctgaccgctccaagaagcgtacctccagcgaggtaatatcgaatgtggtaatgcctgcaaattttgtcgatttcctgcagcatttccagttctattttttgaagctcttttaattctgttatttcccgcatgatttttccctcttactgtccaggcattttcttatgatatttttgtccagcggatgtttcagatcatacccatgtttcattacctgttgtccctgattgttccgttccattcctctacatcttatgatttcatccgcccagcgtgctttatcatctaaagaaaggaattggcagtttcccgtaatatcggtttctcttgtcacacagtccgaaaagagacacggcagtccacttgcctgcgcctcgattcctacaatcggaagtccttcataaaatgatggaagaataaacacgtctgatgcctgcataatctcatttacatcctgccgtacacctaaaaatcggatgcgctctgtcacatgctttgcttttgcatattgcctgacttcctctttcatatctccggtacctacagacagcaaaatgacgtctttgtctttttttacggtttccgccaggatgtcaatcactcccttaggattcttttgatgggtcagccggccaacatgacaaatcacaaactgatcctctattcccagctctcttcgttttctcgctctgacatcctgatcaaaaaggtacttttccgtatcaattttattatgtatgacaacagtttgtttccttttcctttttccaaacaaatattccgaagcgcattgcgcacacgacattcgctgatttacagctagattcagaaaaaatctgcatatcttctggactttgcttttcatcatatcgccattatgactgtgcaccacgcattttcttcccataagacgcgctgccatcaccgttggaaataccatcggatccatgacattaaaataaatcacccgatattcccgatgttttctcaagaaatggaaaaacgctctcaaatgcgtgaggataccctgtcctttccccggaatataaaatatttgagatccgttttccctcatctctttttcaaaagccatagattcaaagtggatgagaaaatcaaactgaaatactcctcggaactccttggtaagattgtaaatatagttttcaattcccccggtaagattggtcataccataaactaatacccttttcattgttacctcgcactcgcttcgacataaaaccgctccagcttatttgcttcctcaagcacatcatatcctgcatttctgacattctgtgttcctgccgcccgatcctcaacacgcatatcgagcaatgtttctgcccacacatcttttttttcattcaaagataaaaacaccatattttccgaacattttgcttctcccggaatggtatctgtacaacagcatggcagtcctgccgcctgcgcttcaatcaatacgatgccgagcccttccgcaaaagaaggaaaggcaaacacatccatcgcctgaagccattcatttacattctttttgattcctaaaaatcgtacctggcgttccattcctttttcactgacctgcttcttcacatcgtccatcgtttcgccctctccgatcaaaagaagcagggcatctttttccttttccaataccttttcaaagacgtctacaaggaatttatgattcttattttcattaaatcttcccacatgcccaattaccagctctttatctgctcccagctcccggcgcagcctttctcttacctcggtttggaaagcatactcttctgtccgaatcgcattatgaagtacctgtcccctttcttgaaatacctgatcaccaaacagataatcccctgccatcttggaacatgccatcacatctgtgcaatatctttcaaacgcatgcctgctgacagacgcaatcagctctttcacaggcgacgtcattcccacactatgactatgcgcaattcgtaccggtactttgtattttttcccataccacagtgcaggcaaactcataatcgcctcgtgtccatggatgatgtcatatcctccctgtttcacaattttcctgatctctgccaaaaaacggatgggattttttttatagctggtaacaagaaaaactcttccacccatttttttaatttcagcatagcaattatcttctcttttgtcccagcacacaaaatccatgcggaattttttcatgtccatggctcgcaggtaattcatcagaaagcaagccactccactgtcagaattcatattggcaatattcaaaattctgattctctgatctctcattatcttcccgcctttaatttggtaaacagtttcgtgtttttcgtctttacaaaggtaatcacctttgcctccagataggtaagccaggtgctcttccaacgaaccggcagaagcatcactttcatatagaaagatcttggtcttgccactttcaccatcttacctactctcggatttgccagcatctttttgatctcggcacgtttttcctggtttgtcatttcgcatttcggattcgtgacattttccacacagccgatgaaacgctctacatatctccttgcaatcatctctttactctttgcgtcgccaacatgccactctttgtaaagatccatcatccagccatgctcttcttcccgcttttcatacatacccggacgataagccgcagtctcagactcggagcgtgcccgcaggaagtggtagtactgcttatgggtcacggtcactcgttccacatttcttacaatgctgacattgaacgggaaatcatcccagaatgtctcagggaaacgcagattgttttccataatatatctggactcaaagagcttattccaaggtgtatagagtagatttttgtcaaatagtttgtatgcgtttctccggaacgattctttgtccggataaacagcatcctccaccacgtaatcgtctgtcacataatgctccttgtcataataggtgtcaatgaagaaacctgccaccacgagctgcgcgttgtcccgctttgcaagcttgtacatatcttccagcatcgtcggttccgcccagtcgtcggaatccatgaaatacatgtattctcctttcgcgatctcgatcgcggtatttcttgcacttggagcgccgccgttttccttatggatcacatggattctttcatcctccgcagcatacgcgtcacagatctccccgcttttatccggagttccgtcatcgacaatcagaaattcccagtcctttaatgtctgagcctgaatactctcaatcgcctttccaacatattcttctaccttgtagacaggcataatgacgctgactttgatcttattctcttccatacttttattctcctattgcaattctttttccacaagctggaacgcggactcaatcactttgtccatatcgtagtatttatattctgccagcctgccgccgatcaggagatgctcctcatcagctaacgttctgtatttctggtataattcctggttcttttcatcgttgaccgagtaatatggctccatcccctcttcccagtctgttggatattctttcgtgatgactgtcttttcctgggttccaaattcaaagtgcttatgctcaattacacgggtatatggcgtctccctgtccgtataattgacaaccgccacaccctgatgattctgttcatccagcacctctgtctcaaatctcaggcttctgtactccagcttgccaaactgatatccaaaatatgcatccagcataccggtatagagcacttttcctccaagcgcgttgtacttttctttattttcattgtaatctacgccaagctccacatcgcagccttcgaacagtgcatcgatcaacacattatatccgccgattgggataccctggtagagatcattaaagtaattgttatcataagtataacgtaccggaaggcgcttgatgataaaagccggaagatctttacagtcacgtccccactgcttttccgtgtatcccttgataagttttttgtaaatatcttctcccaccagactgatcgcctgttcctccagattcttcggttcccctttgacagccgccttctgccggttgatgatctcctccgcctctttcggggtcgcaatcccccacattttgctgaaggtattcatattgaacggcatattgtagatttcccctttataatttgccaccggggagtttgtgtaacggttgaactccacaagagaattcacgaaatcccatacttttctgttgctcgtatgaaaaatatgggcgccgtacttgtgtacatggattccttccacgtcttcacagtaaagattgccgccgagcgtctcccttttttccacaaccagacaggattttcctgctttttttgcaaagtacgcaaatgtacccgcaaacaatccgcctcctacgatcacataatcatactttttcatgttttactgttcctccgttttcgtttcttgtgcttctttaaatatatatttccgtgtttcgttcgtccgaaaagcctctgtactgtcagatttcaaaagtacaatcgcagtctggaaaatcagttggatatctctcaggatactgaactcttcaatatagatcatatccatcatcagcttgtctttcggtgatgtgttatattttccggaaatctgggcatatccggtaaggccagctttcacccggagtctgtagcgaaattccggaagctggtcttcataagccctgacattttcaagcatttccggtctcgggccgacgaaactcatatctccttttaaaatattaatcagctgcggaagctcgtccattcggatcttccgcagaatcttccctggtttggtaatccggtcatcatcatccgttacagaatggttctccacatgttctttcatggtccgaaatttatatacttcaaaaacacgtccgttcagtgtcgcacgtttctgtttaaagaagatatgtccgccgtcataagctttaattgcgatagcacttacaatccagatgggggacgtcagaatcccaagcacaatagccagagacatgtccaaaagtttcttcattaccctctgctccattgtccacgctttcacattggcgttgagtacagagacatcatcgagcagatagtattttgcgctcatctccacaatatcttcaatctccggattgaagtaaatattaatcttatttttatagcagaaacggacaatccggcttctgacatccaacggtacatcatggatgaagacagtatctgcctttcccactgtctcaaacagattcttgtctttatagtccatgatgtagtcgatcttgtactgtttcttatactttagaattcctctgacaatattgtcgaggctctcctgagacgaagtcacgatacagcagctttccggcttatgaatcgtaaaaaacagcccgtttccaccgtaggcaaatacgatgataatcataacctgaacaagaaaactcaggagcagtgatccaaggctgtccaaccggaaagcataaatgctcggagtgatcgtattcataatcatcaactggatatatgtcacaacatctgtaaacagaaccgccaaagaaagggaatagatgattggcttactctttctccgtcccacatcatatctgccgtagatattcaaaaacaacagtcccacaacacaataggtagaaaatgtgatacccattgttctggaaagaacgcccaaagccctgttttctctggacataatgaacataaaggtgcccatcagtaaaatatataataataatttgatacacaaccacatggttgattcaaattttttcagttctcgtttcataaaacacctcgctggtctaaaactctctatattatataagatttctatcctttccgcaagttattagaccttaaaaatttcttatcttgtaataatttcgtaatatttccgctggaatttccctgaattcccctgttcctccattaagtgatgtaacattttcttttctcaatataaaatttccgagagtcttatgaatacaaaaaaagagaacatgcaacaggaaaatttccatgttcatcttctctcttttcttacataatcaacgttttctagtaaattccgctctcaattaattctttgattgcattgacaacactctctttgtcttctttatatgtcaccccaaaccatttatccctggactgcagcacagtgacttcagcctgtccatccgcaagaagtccgccaatgatggtaggcagaagatactctgctttcaggtccttggcatctgttttttccagaaattcctggaagcctttttccagaatattcagaaattccggctgtaatccccacatgttcatggaaaccggagcttcaagttcgagccgttttgctccgtcctctgcctcggcatgatccccatttctgacaatattgtgtgtctcaatgatgttagtgagcataccattttcatccacctcacagacacctcttgtcactccgccgttttcactaagcgtgtttttcaggacaaaacccaccatgcagattggttctttcccggtattttctctgttttctttgagatactgatatgcctccgcataggcttctttgccatagaaatcatccgcgttgatgacgagaaaaggctctgtcaccttgccccggcacgccaaaatcgcctgccccgtgccccacggctttgttctttcctggaatttcgtccggaatgtttccggaatatcgtcgagctcctgaaaagcgtactccactggaatctgtttttcaattctgtttccgatcacttctttaaaatctttttccagatctttgcggatgacaaatattactttgtcaaatcctgcctccacagcatcccggatggaataatccataataatttccccatttggcccgaccggttccaactgcttaattcctcctccaaatctgctgccgattcctgcggccataatcactaaagctgctttactcatcgtctgtctccttttattatgttgatttcccttacttttcttccatcagtctgtccacagcgctgaaaaacgcccggaaacctgcccgtgtaatattggcgctgacgccaactccataggtctcttttccgctgcggttgtcgcgcaggcagatgtaggctgccgcctttgcctcagacccctggctaagagcgtgctgtgagtagtcgatcagagtaaagtccattccagattcctctgtcatcagctttttcagtgcggcaagaggtccgtttcctactgccttagcactctttaattcctgacctgccatgaagaccacttcgatctccgtctcattttccgccacatcctctgcttttgcacggatgaattcatatggtgccttcctgcggagatactctttctcaaatacttccatcatcgttgcaggagccacttcaccctgggattccgcaatcttttgaatgacgtcggcaaactctttatgcatccgcttcggaagcttatatccaaactcgctgtccattacaaaggctacgccgcccttaccggactggctgttgatgcggacgatcggctcgtactctcttccgatatcggatggatcgatcggaagatatggtacttcccaccattcctgccttctctcctgcatggccttcattcctttgttaattgcatcctgatgagatccggaaaatgcggtaaataccagtttaccagcatatggatggcgcatcggtacatccatcttgcagcatctttcgtatacttctttgatctctgttacattttcaatattgagttccggattgattccctgggaaaacatattgtaggcaacggtcagaatatccagatttccggttctctccccgtttccaaacaaagttccctccacacgatccgctcccgcaagaagtgcaagctcggttgccgcaacgcctgtacctctgtcattatgtgggtgaatacttaaaatgacactctcgcggtcactgaagtgacggtgcatccattcaatctgatccgcatatacattcggcgtcgtcatctccaccgttgccggaagatttataatgattggattttcttttgtcgctccccactccttctgaactgcctcgcatacctccagggcatagtcaagttcagttccggtaaagctttccggagaatactcgattcttaaattcccctcgaaatcttttacgtattttttcaccatcttcgtgccgtcaatggcaatctgcttaatttcttccttttctttcttaaatacaacctctctttggagtgtggacgtggagttgtaaatatgtacaatcgcattcttcacacctttcagtgcttcaaatgttctctccacaagatgctccctgcactgtaccaatacctgaatccacatatcatccggaataagatcatcctcaacaagctttctcaggaagtcatattcaatctgggacgctgatgggaaccccacttcgatctccttaaatcccaattttacgagcaactggaacatctcaatcttctcttccaccaccattggctcaattaaagcctggtttccatctcttaaatccacgctgcaccagatcggcgctttctcaatctctttgtccggccaggtacgttccggatacggaacaaccggtactcttttgtatctctgataattcagcatgttatctcacactcctcattcttttttctattctcccaatccactttccacaagcgctaccattgtctcaagtgcctgctcttcatccacgccatcgcagataatctccatttcatcgccacatttcacgcaggctcccagaacactgagcacactctttgcactgctgattcccttatccgtacggaatttgacactacagcaaaactctgccgcagctttacagaacagccctgccggtctcagatgcagtcctgtgggattgctgataacgactttccggctaaccatatcgctctcctccagttattcactttccttattttccacctgctccagtctgaccttgatgacaacattctccgccaaggagcatccttccggaagcttcacttctacagggacatcatattctcccggctctttgtaggtcaccagattgatagacaagctgccctcatccagctccaaagcatccaaaagctcttgatctccctgtaccttgatctccaggttgtttccggatacataggaatactgaagtccgtcctgcaggttgttcaccacaatggctccagttggaatctcgatcgtccggctgccttcctcctcgattccgattgtcaccacaacagctcccgcattctcgtcgatcaattcgactccatccggaagatatggcgtaatatccaccacaacctcttccttgctgtccagatcccggatattcaacgcacttgccggaatctcgattttgtcaagatcctcaagtacgtctgtgcttcctgatacctgaacctcttttggctctgtctcaattccggtaaacaggtaaccgtccgctgccgtaatatatgatgtatcaaaatcaagttgaagtcttcttgtattccttacttccacctgtactctgacatcattttcatccttcaggtcctgaagcgtcaacaaagtattatcaatcgcttttccatccgcgtcatagaatacaagcttggactgcaacacggtatccgacgcgagtccggtcacatcaacctccgccacgaccttgtcgatccgttcgataatggacttcggaccgttcacacgtactttttccggatccgccttgatctctccgagcacatatccgtcccgtacacttcctgttgtcgtcggtgtaatcgggtacgtattctgcgcttcatcttcgattgtaacctgaagattcctaggatttgagtatgcttctgaatattcaactcccgggatcgatacctcgataggaatctgggaaccaagggacatctctttcatatccgcataggctttgatatcatgaaccctcagactatgaagaacggatcgcttcgcacgcaccgtcacccggacagtatcggtctcatcctcgatctggtaggtttttcctttgcttgtcacaacttccggatgcagaatctcaactggtacattagaaaactgtacagatgtgaccggatcgtcaagattcacgaccaccatccacaggaatgcggcaagggcaagcgacaacagcttcaaagcaaggttgttagtcagtttctctttcatgtttccgccttcctttccacagtctcgctatctttttctccgtatttttcgtctgaatccgaatcagactctccttcaagtattccggcgtcacgttccgcacgagctgtccgccctgtgctacagagacataaccggtttcctcggagaccgcaataacaagtgcgtcgctgacttcactcataccgagagctgcccggtgccttgttccaagttccttgctgatctccatattatccgagagcggcaggtaacaggtcgcagacacaatccggttccctcttacgataatcgcaccgtcatgcaacggagtgttgtgttcaaaaatattgatcaaaacctgggaagatacgatacagtccagatagataccggtactttcatattccgtcagacggatggcctgctctactacaatcagtgctccggtcttgacttttcccatagcaaaacatgcatccacgatcgaatcgatcgtgcggctgctgaaacgttcattttctttccccttatcaagcggcacaatcgctgtaaggaaccgcttttccccaagcttttccagcgcccgccgaagctccggctgaaacaccacaatcgccgctatcgcaaggatcgacacactgttccttgcaatccataaaatcgtattcattctcagtatggccgcgacaagaataaacacggccagcaccagaattccctttaacagcatccacgccttcgtgttcttaatccagaccataagctgataaatcagaaacgccacaatcacaatctcaacgatatctgtccaataaacatccggaagataccagtccggaaaatagcccctcagcgcctcaaaaaaccggttgttcactcctgtcacctcccatcctcttatactcacccatgattttcccctttgatttttcttctttgtctgtatttttacttatcttctttatcatccagctcatttttcagaatcttttctagatccatctcttcctggagctgctttgccaggagcatctcctccgtcattcccggtatgtaggacttttctgccggtttttctgccggagccggcgaagcttccggtgattccttcatcggatgctctttcgatttactttcatgctttctcagatccgtcttccgcctgctgatcttcttcacgcgcttttccggaactgccacggatactttcggaatcgcctttacatagtaatagtactcatcatcctcatactggaacttctccgctttagaataatcgacagaaaaaatgaaaaactctaaaatcagcgccagtgcgacggaaatcatgtttccaaaaatcagcgtcacatagtcgatcggagtagaaaaaacaatacttcctgccacaatcacaatgatatccgccacagcccctgatgccacagcgatcttccaggactgatcaaactcactctttctcagtgtatagacaaccagtaccgctacaacaaacgatgcaatgtaaatccacatttccttattctgcagaatccgggacgcaaacagagagatctcccctgccgttccgctggcaccggtcactgctgtagccgatgtctccagatagctgatcatggagtaaatcatcgtaccaaaaataatcggaatgatacagcttggcgtccccataagcgcaaaggaaatcgggacggcaaagggaatcttaaaaagatacgctaccataacgagcagcacgatcatggacgtctccggagtaaatcggaaataaaaaatgaacataatcgcaaaaagtgctgccgttactgccatcactcccatggacagggcaaaaatatgaatcagaatcaggacagccgccgccaggactgtcagtgttcccggcaaaaacgcacagatcagcgccaggatcagggcaacaatcggatttgaaactgcttccatgtaaccgatcttcgaattgatcagataaaatactataaacgcgagaagaaaatgcacgatcttatccacttcttttgagtacctcgcatagaaagcctgcagctgctccttcaggacaaataaattactcattctttttcttcctttctttgctgtagaatttatccagctgcgtcagcatacggatatagcgttttactcttccctttgctctgatatgtttcttctgataaaatctggacgcaaacagtccataagaaacaacaagaatcagatatagcgcaacggccgcaagtacaaacagaacaatcgcgaacagacctacgttgctcagaaaggtctccacaaatgccgccgcaaatactccaaacagaaccacataaccaatcgtgacccagataacggtaaaaatcgtctgatagctgacataatcctttttatagtaagaagcgatcttgaaatcctcttttccatacttttcttcataaagtgccatcttattcatcaactttactttttcttcgttaaccatattccaccttcctgtcatcagaaaaactatgttcagtatatcaaaaatcaaatatcttgtccaatacttatcgttaaaaagaaaacttgccgcacccccgactttttcagtattttggccgcttcattcacggtattcccggtcgtataaatatcgtcaatcaaaagtatccgttccagagctatggtttgacgttcaacccagaaactcccctcaagattatgtgctcttccacggcggtccaatgtcttctgcgctgccctggattttctcttatgaagcagctttctctccaccgggattcccgttatccttccaagctcccgggccagaacttctgcctggttgtagcctctcctgcgccttttcttatgatccataggaactggcacaatcgcctgtacgttccatttccggatcaatctatcaaactgctctttcatcacctcggcatagtacctggcatacactctacggttgtgaaacttaaactggtagacggatccgctcaccggcgggcggtgaacccagagactccgtccacggtcatagtaacacattcccgtttccaccctctctttgcagtctttacagaactccaccctctcatcccggagtggctttccgcattttttgcaggccggctccctcgcccaaaaaagatttttcttacagtcttcgcaaatcccctttgtgtacgcctttccacagaaaggacatacgtctgggtataacagtttcccaatgatattcatttgtgtttcttctgattcttcccccgatcagatgatttgtctccctacaaaatctcctgaatccgctctgcaagcgacgtattccgcttctgctcatccacattttgaatcatctcacgaaaaacagtttcgtttcctaccagtgtaacacattttttcgctcttgtaaccgctgtatacagcaaatttcgacaataaagctgtctcggtcccgcaagcagcgggatgacgactgccggatactcgcttccctgtgatttatgaatagttatcgcataagcaagctccagttcatcgagcatcttaaacggatattttacctttcttttttcgtcaaactctacttccacagtctcatcatatgtatggattgccgtcacgataccaatatctccattaaaaactccgacgcccttgtccacaaccagaccgtatttcgttgcgatctcccactcaagctgataattatttttcgtctgcatgaccttatctccgacacggaacagtctttccccatattccttctcctgctttttgacagaaggcgggtttaaatattgttgtaaaatccggttcagccgctccactccaagcagtcctttcttcattggagcaagcacctgaatatctgtcatcttcgcctttacatagcggggcagttttttctggatcagagtcagaatcacactgataatgacgtccgcatcctggcgtttcaggaaaaagaaatccctgctcttattatccagacgcacttcttcccccgcattgatccggtgagcattgacgacgatatcactttcctgtgcctgccggaaaatccgggtcagcatcatcaccggaaatgcatgggactcaatcagatcctgaaggaccttccccggtcccaccgacgggagctggttgcggtcgcccacaaagatcactctcgtccccggaaccaccgaggacaacagtgcgtgcatcaatgcaagatccaccatggacatctcatcaataatcaccacatccgtctccagcggattgtcctgatttcttccaaatccacctttgctgctctcctccggactgccgcttacttctaaaagccgatgaatcgtctgcgcttcataacccgtcgtctctgtcatccgctttgccgcacgcccggtaggagccgccagacggatatccattccctcacttagaaaataacggatcatcgcattgatggtcgttgtctttcctgtaccaggtcctccggtcaagatgaatatcccatgctttaccgcctccgccactgctcttttctgctgttcatccaatgtagattctgtctcttcctccagcttgtcaatccttctgcggatcagatcatctggttcgtcatagtttatattcagctcctttaacatccgggccgtgttcatttccatatagtaatattgggccggatagacacgcaccttttccccatcctgcttcagaaccacctttttggtcatcgcaagatccatcagatatttctcaatatctttcagctccacctccaaaagctgcgccgctctctctgacagtacattctcttccaagtatacatgtccctcctgcacactttggagcaacgtgtaaaagatgccactctgaatacggaaatccgaatcagtgtgaatcccgatccgcgaggctatctcatccgctgtccgaaagccgacaccctcaatgtcgtccgcgagcttgtacggattctcctccagaacactgtaggtgccaagtccgtatttctggtaaatcttaaccgccagatgaatggaaattccgtatttttgcaggtatatcatggcctgtctgaggtcttttttctcctccacctgcacacagatctctcttgcctttctctcactgatacctttgatctccgccagccgctccggctcttcttccataatgcgaaacgtatcttccccgaatttggcgacgattttccctgcaagtgcgggcccgattcctttgactgctccggaacctaggtatctctcaatggattccctgtcctccggctccttgatcctgtgatttgtcacctgaagctgcatcccataggacggatgcatggtgtattctccttccagttccaaaaactcaccctcgccgatataggaaaacttcccgacacaagtcagttctccttcttcattatttaattgaaataccgtatatccattatcctcattccgaaagatgatatggtcgatatatcctgtaatcttttccaaaccgtgcctccatctgccgttcttcagctcgctgtcacccgccgtcgggctgcttcagactgccgtttgcggccttttttcagaatagaacaggactgccgcgaaactcgtactcttctcccgcagcagtccctttgttgtgacttctatacatgaaactttttgttctcactcataaattcgacaaactgtccggtgccgatggcaacgacctgcattggatcttccgcagtcattgtatgaattcctgtccgctcttcaatcagctcctcaagcccacgaagcagagctccgccgcccgtcaggacgatccctctgtccaggatatccgctgaaagctccggcggtgttctctccagcactccgatcacagcctctacaatctggcttgtcggctcacgcagtgcttcctccgtttcagaagaagaaactgtcacggtcttcggaagacctgtcacaagatttcgtccccgtacctcgatcgtctcatcctccacaagcggatacgtcgtaccaatccgtatcttgatatcttccgcagtacgctcaccgatcaggagattgtgcttctttctcatgtaccgcacaatcgcttcatcaaaatcatctcccgcgactttcagcgatgtattaacaactgtgcctccaagagagataaccgcaatgtctgatgtaccgcctccgatgtcaacaatcatatttccacatgctttggaaatatcgatgccagccccgatcgccgcggcaaccggctcctcgatcagatgcacctctctggctcccgccgcaaaagtcgcctcctctactgcctttttctccacttccgtcacaccgcttggaacacagacactgatgcgtggccgcttaaacgtacgttttccaagcgacttctgcacgaaatacttgatcatcttttccgtaactgtgtaatcagaaataacgccctgccttaacggacgcaccgctacaatattccccggcgtcctgccaagcatcagtcttgcttcttccccgatcgcacgaatctcgctcgtatctctgtcgaacgctacaacggacggctctttgagtacgacaccctttcctttcacatataccaggacactcgctgtcccaaggtcaatcccaatatctactaccgccatgaactaaacccctttcgcaaatccatctatattcgctcctctttggtctattatacttcctctttcgtatgtcagaacgcataaacctctggttctacgcatacatttgttattataatcaatcttcctggaaatggaaagagttttttctcataatctgtaaatttcgtaacagttcagccatacacaaagtcacaaaaatctgagttccaacttgtttgaaaacgaagattttttgtgtactttgtatatggcgttctgccatcagcgaggatttagccacgcaagtggcgtttaaagccgcatagcggctaatccgagctgtgtggctgaactgttacatattcattctttaaggaatggcgcgagatatcgccctgtatgggattgtggacattttacaatctcctccggcgtccctttcgcaataacagttccgcctttgtctccgccttccggtcccatatcgataatataatccgctgttttaatgacatccagattgtgttcaatgacaatgactgtattgccgtccgccgccagtcttctgagaatctcggtcagcttatggacatccgcaaaatgaagtcccgtcgtcggctcatccagaatgtagacagtcttcccggtactgcgcttgctcagctctgctgccagcttgattcgctgtgcctccccaccggacagcgttgtcgaaggctgtcccaggcggatataggagagccccacatcgtaaagtgtctccatctttcgtctgatactcggcacgttttcaaaaaaggtcagcgcctcttccacagtcatattcagcacgtcgaaaatactctttcctttatattttacctccaatgtctcccggttgtacctctttccatggcaaacttcacacggcacatagacgtccgggaggaaatgcatctcaatctttaaaattccatccccactgcacgcctcacaccggccgcctttgacattgaagctaaaccggcctttcttgtatcccttcgcctttgcgtccggcgttgccgcaaacagatcccggatcagatcaaaaacacccgtgtatgtcgccgggttggatcgtggcgtccgcccgatcggcgactggtcaatatcgataaccttgtcaagattttccaggccctgaatctccctgtgttttcccggaatagtcctggcatgattcaatactttcgcaagtttcttatataaaatctcgttgatcagtgaacttttccctgaacctgatacacctgtcacacaggtcatcacgccaagcggaatctctacattgatattcttcagattattttcctttgccccgacaatctttagaaatccggtcggcaccgccctcttttccggcaccggaattcggattcttccgcttaagtaatctccggtaacagaaccaggcgtattcataatctcctgagcattccccgtagcaacgacttctccgccatgctccccggctcccggaccaatatccacaatataatccgcagcaagcatggtatcctcgtcatgctccacgacaatcaaagaatttcccagatcccgcagatgcttcaaagtggcaagcagcttgtcattgtccctctggtgcagtccaatgctcggttcatccagaatataggctacaccaaccagaccggaaccgatctgagtcgccagacgaattctctgtgcttccccaccggacaggctgcctgccgcccgtgaaagagtcaggtactcgagaccaacatcgatcaaaaacccgatgcgggaacggatttcctttagaatctgtcctccgatcatcttctgtacctcggtcagttccagcccatttaaaaattcctgaagattttcaatagacatagctgttacttcataaatgtttttgccgccgatcgtcacagccagcgcttcccttttcaagcgctgccctttgcaggcatgacacggtgtaattcgcatgaaagtttcgtactctgccttcatcgcgtcggacccggtttcccggtaacgccgctctacatttttgatcagcccttcaaaggccacgtcgtagacgccctcgccccgctgtcctttgtaatataccttgatttcctttccattcgttccatagatcagaacgtcatggatctttttcggatactcttcaaacggagtatccagatcaaacttgtattcctcgcaaagagcgtgcaaaatggcatttgtaaaactggatggatccatacaggactgccatccaagcgctgcgatcgctccctgattgatactcagagatttatccgggatcatcagatcctcgtcaaactccatcttatatcctagtccaaaacattccgggcaggcgccaaacggattgttaaacgaaaaacttctcggctctatctcatcaatactgatcccacagtccggacaggaaaagctctggctgaaattgatcggttctccgtcaatcacgtccacagtcatcaatccctccgccagattcagagtcgtctcgatggagtcggtcagacgcttttcaatccccggttttaccacaagccggtccaccacaatctcaatattatgcttgatattcttttccaggcggatctcctctgtcagctcgtacatgtttccatcgatcctcacccggacatatccactcttcttcgccttctccaaaagcttggcatgggttcctttccgtcctctcacgaccggagccagaagctggatttttgtccgctccggcagttccataatctgatctgtcatctgatccaccgtttgctttttgatctccttaccgcagtttgggcagtgtggaatcccgattctcgcatacaggagacggaaataatcatagatctctgttaccgttcctacagtagaacgtgggttccggttcgtagatttctgatcaatggaaattgccggggaaagtccctcaatactctctacattcggcttttccatctgtcccagaaactgtcttgcgtaggaggacagtgattccatgtaacgtctctgcccctctgcataaatcgtgtcaaacgccaaagaggatttcccggaaccactcaggcccgtcagtacaaccagttcattccttggaatatccaggctgatgtttttcagattatgctcatttgctccgcggatgcggatatattgtctgttgtccattgttgtttcccttcttttattcttcaatttcctgcaaatgcttttttaattcaatcatattgtctcgcagcttggcagccgtctcaaaatccaaatccgccgccgcttttttcatctgtcgctgcagatctttgatcagcttctccagctcttcctgactcatagactccggatccttctccagcacttcttcctgctttgcaactttcttggaaatactgatcaggtcccgcaccgcttttcgaatcgtctgcggggtaataccatgctcctcattgtaacgcatctgaagctcccgccttctccttgtctcgtcaatggctgcccgcatagaatctgttatcgtatccgcatacataatgacacgtccatctgcatttcttgcggcacgcccgatcgtctgaatcaatgacgtctcagaacgcaggaatccctctttatccgcatccagaattgcaacaagtgtaatctccggaatgtccaggccctccctcaaaagattgattcccaccagtacgtcaaagacgtccagacgcatatcccggataatctctgttcgttccagggtatcaatatccgaatgaagatatctcacacggattcccaattctttcatataatctgtcagatcctctgccatcctcttagtaagcgttgtaatgaggatcttgttcttcttagctacttccttattgacttctccaatcagatcatcaatctgtccctctacaggacgcacttccacctcaggatcaagaagaccggtcggacggattacctgctccgcccgcagaagctcatgttcctcctcataggcccccggcgtcgccgatacaaacatcacctggctgatcttgctctcaaactcttcaaaattgagcggccgattgtcctttgccgacggaagacggaacccatagtccaccagagtggtttttctggactggtctccatggtacatcccaccgatctgtggaatcgtcttgtgggactcgtcaataatcatcagaaaatcatccggaaaataatccagaagcgtgtgcggcggctcgccctctgcaagccctgtcagatgacgggaataattctcaatcccggaacaaaagcccgtctcccgaagcatctcaatatcaaaattcgtcctctctgaaatcctctgcgcctccagaagcttgtcctcacctttaaagaaacgaatctgatgctccagctcctcctcaatctgtccgattgcccgctccatattctctttggatacgacatagtgggacgctgggaaaatcgcaatatgattcagctcatttttaatctctcctgtcagagagtccacttccgtaatccggtcaatctcatcaccgaaaaactctacccggattatattctctccagaaccggccggaaatacttccagtacatctccatgaacccggaacgtgcctctcttaaagtcaatgtcatttctgtcgtactgaatgtcgatcaacttcccaatgacttcatcccggtcctttatcataccaggccgcagggaaatcaccatgttctgatagtcaatcgggctgccaagtccgtagatgcaggacacactcgccacgatgatgacgtcttttctttcggacagtgccgctgtggctgagtggcgcaatttatcaatctcatcgttaatcgccgagtccttggcaatataggtgtccgatgatggaacgtaagcctccggctggtagtagtcgtagtaggagacgaaatattccactgcgttgttagggaagaactctttgaactctccgtaaagctgcgccgccaatgtcttattatgtgcaatgataattgtcggcttatttaactgctgaatgacatttgccatcgtaaatgtcttacccgaaccggtaaccccaagaagtgtctcacactggtttccctcctggaacccctgtactaactgggcgatagcctgcggctggtcgccggtaggctgatatggagatactaatttaaagattttttcttcactcatacctgcttctccctttgttatttttgaatacttgattagtgattacacgaatttttcgtgtaatcagaatatcctttttctaataaaaatcgtaaaacacacttttggttgcaaagcggctatttttatcgttgttttcccaggaacaaatgttctgcttttattttatcttatgttctatttcgtgtcaattgtaatatgtctacctaaaacaaactaataaattccattttccacatcaagattaagcagtttctgttctgacttctaataaaaatcgtaaaacattgttttgagttgtgccgcaaaataaacgaatactcgtgccggaagttctgctatggaatatgacctgaaactatttagcagtctctttttaaaacgctggaactataaaccatttcctatcattttcagaacagcactatcaacttgctcctgattataaatgtgccagaatttacaggtcatcccattctgctttctttcattttcacaagtactaaatattttgggattcatgcctgattttgccatgttgctgcaacaagtgtggcggcatacataacatatgaacgtgtcaactataggacaaaaaataattctttttattattggaaaatacctgatcatttcactaggtatcctagcacttttattatctttcactaagccgcagttattcagcacattttatctccctaacaaaatacactcttcaatagagtgtactccagatgcatataagtattcattattacactgatgacagaatgccccatcagaaactggagtgtctttcaattagacaatcattaataatcgcatacgtgaggtcttccctttccccataaatctctctgtccctataatttttatcattgtctctacatagtacactcaaaaaaagaagaagccatccacaccgcaatagcttcctctcacccatactgttctattttatctatatccatactcttcttcaattgagattaataatctcagatttgttttttcgaaattgttgaattcctcccacttaacgccatgtttattagtttctctgtaccaactatatttctgataatgtgtgtcatttacttctccagcattgaatagctggccatgtcttgcgtaaatttcattaatagacatttttaaaagcctctgaaaacctactgtctcatcttctctcagagccaacaccatttcttcagaaagcacttcactgctacttttagcaaatacaaaaccatcttcatcgatggggggctgcacttcattccgaggaactgtatcctgtacctcagctccgttctgctccgaatgtacgctactataatagcttgtcccccctatgattagtacagcacaaataattactgcaatcacgtgcttaaactttattgtaacgtcaaaacctacaaaagcgccttcttccttctggaaagagatgcttttaccatcctcacttccaacagaatacctttcgctactaatcatcaaagattcctcctctcggagtaagctttgtaaccgtagtagtcttccatgtgaatcccaatttaaacttaataccagtcggtccagcctttacgtaagcctctggtgatctttccttacatacagcctgctgcacttcgtactcaattccattagcaacaaacatatctttaactgtctgcgctaacgcatatgcctcattctttgaaacatacgctccttgattattctttacgatcccgcatcttgaaggatcgattaaggatgtattcttcaaccttgttctctcctttttcttgatttgatattacggacataaagaaggcatatctttctggtgtcaattcaccaaactgtgcaagagacatcatagtctcaaacacttttttgttctcgtgttgtttcaaaaccttctgatatgatgccagattggattcagccctctttacgctctgtccagttgtcaatccaaatttcatatggctacctccacttaaaaatttgggttttcgtatgcgaccataagcatctggaacgtctctttatcaagtgacttattcttagcaagctcaaccattgtatcacaaagtttgtcacgatccattgtacgatgctccagcgcttttgtgcgatactccagtgttttgagcgctatctctttttttacctccacttcatgatatctctgaaatggtgctgcaattgcgttaggaactacagcaacaagctgagtagcaacctcagtaccagaaatctgaatgtcattagatctggtatcaacaacttcataatccatgatgttcataatttcgttctttccttccatcgttttctcctttcgtcaaatcagtataatatcatttactgttacgcacattagttactcatgtcagttcccctcctttcgagcacttacattatacaattcatattattttcgataccaatatcctaccacttttaaccatttttaacaataactagtcaaaatcatgaactgctttgaaaattatgtttttgacaaaataacatttgttttcattgtgtttttgacagaatttgatatactataactataattaggatggagatgattcgctatgaataacaaaagcaaaaaagatatgcagaaacaatcgttcacacaaattttctcttaccaactggacgaagtgaataaagatgcaagatataactcatatcttgtccctttgcattggtttgtgaaactttatacaagaagaactcataaaatgacaatgggggatattgctaaacaaatgggtattgactcagccacattttcaaaaatgttacgtcatggtattgccaaagacaaacgtcagatcacatctgaacatattaatcgcatttgtgagataattaatattcctctttcgtcaattctatttttgtacgaacataaagaagctgttgaaaaaaatttgcaacgcaatgattttgaaaagttgacaaatctactcagggggaattttgatgaaattctttatccatcagccttctatgatatcaacagtggaaaaaagatgtcaaaaacagctaatacgaaggactctgtcagcaccctagtctctgaaaattctatcctagaaccaatcagagggaaatggtatttttattttccaagcagtgactctaaaataaaagaacagcgaaaaaaaatcctaaaaaagaatccaagccatgtaccggaaagttcagaattggctgagctattttctctttattcaccagaccatatttattgtggtacactaaatattgaatttaaaggtggcagatactacgcagtgctaaaatacatgacaaatccttccgagcataaaatactatgctatgagggtagtgcttcttctccagtcgataacacttccatcttctgttctttaacgaggcagagcgatggtgatatcatgtatatgataatgtccaaaccttctacagagaagcgactgcaataccttacggcttcagttttaaccttatctcatcatcaagatgaagaaaggcatcgaccttgttcattacgtatgattcttagccgtaaaccaatcaaatttgattcgaaagcttataaagtaatgatttcaaatttaatgatgaacgaagcggttatttcgatagacgattatggttacagccaattaaaagaaaagcaaaaagaatatgattcacctgcccttgatgtcttccttgagaaatatccgactattgacagccttcccaaaaccaaaagatatttgaccgtacgaaattgtgcttatatcaacgagaagtttcttgataatttcgatgatagtgccgatgaatctaaaaaattagatgaaatagacatcctatatctcgaagcactacttcgacaacactccaccgcactttggtattcaaaaactaaagccacaaaaatcaataaggtccttaaaaaaattgatagttaatacattagcatcaaaaaggaacaatcgggaaatcaatgccaataagttaagaacatcgcaagagactcccgtatgaaatttcaaatggctgtgagcaagaatttctgctttcagccttttttattcgtaaaagcagtactatcttcctaacatgattgataggcacaaatcggtcactcagttccccttgccttaacggaacaatagtgcctctattagaataataccggtcatgtatcggaacgatataaaagcctaagagtttttcctcccaagctatttggtattatttacttttctatcctcagtagcagtaaaaccgtagtatcccgccagtcctattgcaccgatttgccgcatttcagtcgccaaaagccaacaaacactccctctctgactcttgtcatggcacacgaatacttttttaatcatatttgcatttctccttatatatgaagcaaatatccacgcaaaccacgcagccaaagaataaatagtagcgtacaagtctacatcataacgctttgtaatagtaactactttataacatacttagtcccccttctcctgtcttcaatttttacaacatctttcttccccatatctttcagtaacagagttgtctttgatatgccaaacggaacataaggagcaatttcgctgattgatttcagcattgttacaaatcccattttacggcagtcttcagccgccgtattaaaggcggatatctcagcgggctccccactgttctgccggtactggggataaagcttttccggctttagaccggtccgtctgttgatccggttcgttccgctgtcctttttgctctttctgtaagcatctgccagcgctgccagcatttttcctgatagtaagctgtacgcccatcctcaaaagctatcatcttccgtcctctctttcatataactgcactatgccaagctgcatactgtccggtctgacacggagtaccggcagaatgacttcacattcatttccaatcgtctctgtcttatccggagaacagaatattacctgaagcttctgctgtttcataaaatccagcatcagtttcacattccccggatccatcttagcaaatggctcatcgataaaaacaagcctggtggaattcgttctctggtagtagatcataagaagcgtagacgtaaggatcagaagataagggatctgtacttccgctccggaactatagcctgtctgccgcgacagtttcgccctgtttaaaacgtcatttgttatcagaatctcatatgtcatgtaattacggtaatctgcaaaccgggggatcgtctcctcgctgtttgactctataatacggttgatgatattcttcagctccctctcgagctgatattcctcctgggaaaaggaactgagcgcccccagaacctgctgtccatccattcctccaagcgctctcttttatccagaaattttgcgtaccggatgatctgcgcatattcggattcatcctttgccactctggtacaataccttttccagtgtcctcaatgctgatttttgtaaaaaattcctgtctgcacacagcgatatgaatatttccgccatctatagatatgaaagtcgtactagtctaccatagatttttccccacaaatcatctttttcataaggacttggttttaattcttcatttttcaacatttggactataacagtatctatttctctgtatattcataaacatcttgtttcaaacgtacatatttccaaagtgtaaaaataatgataaccactaacaccaaaaatatgataaagatgatcacttccatatataccccattccatatacatttgaaatataaatttctggataaaatcacatacacttttttcagcaaaatcttcatggagaaaggtttggttacatagtcgtccgcacctaattcatatccatttaaaacatcttcttctcggattttaaattgccgacccggcaggctttgtataaatagaaaaactttccttctctaaaaagtatctgatcccttttaaaaaggttccagattgctgtactgaaacaccgcctctgaatttttacaagcagtccagaaactgttactacaattcatctccagaacattccctcttttctccagtaatctcactgtatcaaaacaatttacatcttctatcttcatttcctccagttgatgttctgcaattttgaacaaatcgttctgatccaacagtaccttgggaatatattcataagaaaaatatggttcatctgagttactgttaattacatttaagaggtattcctgatacggcctcggaaataagtggtcaaactcaaccgtcagttctttttccgaactcttctttactttttctatcaaccggcgcaggatagggggagatataatgataagctccccgtctcctacaaatttcagcttataaacgatcaaattacccccttcttccttagtcctgcccttttctcagacgttccaccaagctctcttttgataccgaacgaagaactacaaggggtacggttacacatacgatcaccagaatcacaaacacacacaacatctgtactgccggaaaagaataaaccgcaaaatatatcacgccattttttataagcaggaagatcagataagataaaatctcgcccactgtcataagaagaaccatcgtaatgccacagtaataaaccccttcgagaacaagtgtgatctttatctgttttctggtcatgccgatactttccagcgcagccagttctttttgtcgtgagtaaatgcctgtaaaaataacatttataaagttggcgagccccataaagatcagaaatccgcctaacaccgttcctgccgcccggattactcccgctaactggtcaacgcctgcttttatctcggattttgaacttatcataacactgtccatctgcgccgccatctctttcagttccgttgagatgtccccttgtgtgcccgctttacagtctatccggattgtttgtatatgaggtgttttgtctattctatccactccttgttccgaggtataaaaagcactgatctcactgccattttgagtaccataatttaaatactggtttttataggttttcccttcttcccccgacgcctttgtcagaataccaacgacagtataagtaatgctttcgccgcttacgccaactttgcttacctgtatcttttttcccgtgaactctctgtaatcactcccctctgttgccaccagaaatatccctgttcccgactcaagatagttctgtatttcttcgtccggcaatgtactgttccatgtaaattcctggagcttctccatagataatccaactgccttaaaccgcaggtcactccagacttcttcctcagccccgctatacagagcctgtagctttacataaggagccagaaactgttccgcttcctctactttcgtaacttccacataatccgtctctattttatcgactccttcgagatttttaactttttcaagtatcccatcatccagacttttctccgccttttcttcattccccaactgccagcttatatcttccataacaaaatcatacggcatttcacggtcgtatttcaaattatagtcaagcttctgcgtagatgaacttaccgtcaaatagatcagaagtccgaaaaacagagaagcaaatgtgaccagcgcacgttttctgctgcgaaatacatttctgtaagccatccggtacaatttgcctccgccgctgcccttatggccttttatcttatgtacaacgtccacatatttcagagcctctgtcggcgacactttccctgccagcctcatcccttttcttgcgctgaaccagactgtcacatatgcaaacaaaacggtaaacacatagatcagcggagaaaccgtaattccgaattcaaatttcccgttctgactgttcatgagcgcttccagaaatttaggtactgtgatgaccgcaaatgtagttccaaaaagcaatcccagaataatccccacagccgcaaccagatttacctgtttcctgacaattttctttaactgctttgatgttgcgcctaacgcctttagctggccgtacatatgcatttcctgcagtacagaaatattgatgatattataaattaacagatagccgctaatcataacaaaaataactgctaaaatgggaatcatagcccccataagcgcctgtgccgctgttcctgacagcccggatacaaaaatttcatcatttccggcggcatgatccagcaaggcaagtgcttcttctgcatttaatctgtcgtcgatcagaaaagttcccaatcccccttcttcctttccgtgctcctctgcaaaacggctggaaacgatcatattcccggctgcacgcttactcatagaatggttgatgaaatacagatttgcagccatagtgttgccgctgttcggcgtaactccggtttcataaataaaatccgtataatagccactcaaagtaaattcctgctgtttttcttccccggaaagaagtttatattttacggaaatggtcataccaatctgcggatcatctactcccaatttttccagcgtccaacgtgaaagcataacctcactttcctgctgcggataattcccggctatatcagagacagtcggtttgataaaattttcccactccgtctcatcatacgcagtcattgaaataattgtctgactgggcatacccttcacatccagtacttctcccacaaactgctgttttcccgtcgcctctacttcatccaaagcggaaatctgctccatttctttctctgttgccatgtaaagaccgccgttcgcctttgttcccgcagtacggagatttgcaagctgaaagttatgaaatatgctgatcccggcgccaaacataacagtcataaggatcgtgacaagaacaactgctataacaagaattacatttcgcgccttattttttctggtattattctttacgaatctttggattgcccgattctgtatttttctatctgcccgcatattctcccctcctgttacgcaatgatctttccgtcaccgattttgatcatccggtctgctctagccgcgatatgcggatcatgcgtaatcatgacaatcgtctgattatagtgtctactggttttctgaaggagctccagaacttcctcgcttgtctcagagtcaagatttcctgtcggttcatccgcgagaataatctccggtttactggccaatgctctcgcaaccgccactctctgttgttgtccgccggaaagctgtgatggcattttatagaccttctctttcagcccaagcatttcaataatctcttttacaaactttttgtccggcgctcttccgtccaattcaatggggagagtgatattctccagaacattcagaaccggaatcagattatagttctgaaaaataaacccgatattctttctgcggaatacggtcagttcgtccggtttcattttctcaatttccttattcccaatcacaacttttccggaagtgggaacatccagaccaccgatcatattgagaagcgtggattttccgctgccggacgctccaacgattgctacaaactctcctttttcaatagacaaatccaaaccgtccagtgctttcgtgagattttcctcgctgccataatactttttgagctgctttactttcagaatactcatatcgtcaattcctcctgtgaaatgaaaatacagcgtcatcttttcgcttgctttcagtatatttttgagaagaattttttcaatggcagttgcgttctttgacttccacaatgcgtaatttgacctcagtcggcaatcgagtggaggggaagatcctttcatcctttcgcctcccagctcaccgcgatacctcgctcgtatcgcacaaaaagctgtatgccactcttcatgtaacatacagctctctatcaaatatccaaatcctatttttctgctattggtatcagaatggacagcatatacactccattctgataatttcgtttatattgtcctccgtatttttctgccgctctttggatatttttcaacccaaaaccatgaagaaacgtatcttctttcgtggtttttttctcctcttcctccagtatcgcagaattttctatgtgtatgacaagaaaatgattcttttctctcgccttcatcgtaataaaacgctcttcttctgacactttttcacacgcctcaattgcattatccagagcatttccgaatatggtactaatatccagggcatctatgaaatctccttttgagaaatctatctctgtatggaagtctatgattttctctttcgcctttctatacttatcccgcaggatcacatccaaaatagcgttcccggtctgcacataatcttcataatcagaaatctgattttggagctttgcgatcatctcttctgtttcctgctttttttccttatctccagtatgaccaatctctttcaactgcgcctgcaatacaagcaaatgattcttcatatcatggtaaatctcccggacacgttgctcgtcctttaaccgctcttcataatattgatattgagcctgcaatttctgtaacttctgttcttctatttgctggatcagacgaattcttgcactatcatgtacgaaataaatcagcagaaacaatgcagcaagtagaataataatgcctacagtctgtgatatttgggtaattatatcccgcccatagagtaaactatttacagaactcataaatatgaagatcagtgccgctaaaagaatactaaacaatagatcttctcgttttgtaaagttttttccaatcttcactaatgttttctttataacaacggcaatcaataacatgagaatatgatagatcaaataatattctgcctgccaagcaatatcagaatttgtaagatcagaaaataaaaatcctaacccagtagttaatatcatttctgtaaaaacgccgctgaatataaaaaacagcatggataaaagtccttttggcatactgattttatataaccggcatataataaatgcacataaaaatagttcaaccactatttttataatggaagagataggagaaaaagtcagtgtttccgcaagcaggacaaaaaagcatacccatagaacatcttttttccaaggaattagtttcgttgcataagtcctaaacagatatgccccaatcattccttcccatactgtgcatattatatcgatgaaaattgttacaatatccgtattcacagcattttcccccaatatccggctaacacctccataaactttttccgttttggcttgctgacatagactgtctctccggaagtcaattccacatccaatttctctacgttcttaacaaaagaaagattcacaagaaatccaacgtggcagcggaaaaaaccatacagggttagttctttttctatctccttcatgtttttatagcatatcacctctccatcatcggtatgtaacagtagatttctcttgtatgtttccacataatgtagtttactcacagccactttaaaagaacctttatcgttctgcacgacaatatagggatttttgtgtctgtgtctttcaatccagctattcatctctgttttcaggcggatatatttcatcggctttacaatatagttcacagcctgatattgatagccttccagagcatactgctttaaggatgttaagaaaataatgctgacttcttcatccagttcccgtatttttcctgcagccgtcagcccgtccatcttattcatctgaatatcaaggaaaatcagatcggtagttgtatcataattctcgatcagctcctgcccattccgatactcagctatcataagttctatccctgtttccccggaatatcgtttcaacagatcttttagttcagaaacaaattctatttcatcatcacagattgcaatatggtacataatccacctcgatcactctcatatctcagtattgtattatacctgttttccgtatgattttccaccagattattcatctgaaactgccctgtgctttggtattggcctactgaccttggtatatttttttgtccattagatacgtgctatctcatactgttgcaggccatgcccaagcaactggataattctcaattcatcctcagcatcccgaaccgcattatgcgtctcgctataccgatcatctcctgtgagcattttaaaaatctcctccacaccatatccacgtttcagtttgcccgtcttacagcagtccgcacaggccgggatcgcccgattatactgacggtacgccgccagacgcataatatcataccattcaaacattgcatattcccacaaatggcgcttgtcaaaggaagcattgtacgcaaacaatttctctattttatatgcgtccagccattgcctgatctcctttaatgcctgctttctgcttgccacactgattccatgttcacaaaatccaagctctgccgaatatatccctcccacctgatattctggtgaaatgatatagtagagcgaatcgattttttccttacttcttgcgtctgccgccacgattccgattgacatcacttcatcgttccagttggtctctgtatcaatgaccgcaaaattacaacactccattgttttcactcctcatttgttaaaaaattgaatcgaacactattttaccatatctggtcacgcacgctctcgttttatgcccctttcgtgtaacatagcttcgcaggccggaaaaggctggaccccttttctttcccaagatatgaaaacttaacaaggtatctttttgcatccaaacagagacgcggctcaaaatgcaacgcaaactcgaaaaaagcgccgtaaacacggcgcttttcgtatggacctggcgggaatcgaacccgcgtccgaaagcctctccatcagagcatctcccatcacagtcattattttgagattcccccggattgccgcctaatgacaggctgccatcttcggtagcttcataaagtcttccatctcctcaaagctttggaaacgaagtgccccgcaagtgttgaagccggtaatccagactgcgggcagtccggagccgactgctgccgaaattaggcagcgtacgctaatttattattgtctgcgtttatttttaagttacggtttactgcgcggtcccgtcccgcggatggcttctccaacttcaaaacccccgtcgaaaccagtacaagccctggtttggcagacagttgttctattattatatgcaggaggagctttcctgtcaaccccctgcctggatgatttctattttttgaaactattcggtcatgtaaactggccggatccttgatccgctcctttccctatgcctcgtcatccggaatgttgtgatcgatccatgctttcacaagatccatccactgtccgcactgtacctgcacgccccggccatctttagaacgactgagatcggttgccgtcccaagtccgtggtgtccctttggaaagaggtggaattccaccggtacccctgcctttacaagggcattgacataaagaagggaattctgtaccggaacagacgaatcctcataggtgtgccagataaaggtctttggcgtatattcagatacattgagttccagagaacatgcctcctccagactttcttccgcctgcgatccaagcagattcttaaaggagctttcattccgaaatgtgcccgccgtaataaccggataacttaaaatctgtccgttcggccggatcatctccggcgtggcacctagaatcttggcaagctccgtactgtgccagtaggtagataccatagcagccagatgtccgcccgcggaagacccctgaatcagaatccgctccggatcaataaaccatttatcggcacactctcttagcattttcatacaggccgccgcctgtaaaaacgcgtctggaaatactgcctccggcacggtcgaatagcggagaatggccgcatgatatcccatctccataaaccgtactgccagaccttccccctcccggtccgaagtcatcgcatatccgcctcccggacagatcaggacgcagggtcttctccgtccatcataaagctctttggaattactccagaaatatgtataaagtcttgcgtttgtttcctcttccccgatcataacaggaatgatctcgtgtaccatgcgtcggcctccccttttgtattttatttattcttcatcttccagtcccagtatttctgcaagcacctcaatgataatctcgttggtgcaggatttgacatagccaagcatatgcagggaaatctcgtccgatttctgcgcgtctgtcaaatccggatttttctttgtcatatcaatcaactgaatcagctttggtgtcagctcttcataagtctctattgttgtctgggaaacaaggttcctcagatccttttttgtcactggtaccatttctattataccttccttttccgtttgaatctacccaaaattgcgaattttgaaatctctttgtgcctctcttgcctgatcttttttggcaatgtccgcccgcttatcgtagagtttctttccccgtgccagcccgatttccactttaaccaggctcccctttaaatagaccttcagcggcacaactgtcatccctttttctttcattttccccagcagcttattgatctcctgcctgtgaagcagtagctttctgacccggagtgggtctttgttgaaaatattccctttttcatacgggctgatgtgcatcccgtacacaaagacctccccgtgttccatgcggataaaggattccttgatgctgcatttccccatccgcaaggactttacctccgtcccggcaagcgagatccctgcctcgtatgtctccagtataaaataatcgtgatatgcctttttattattggctatcatctttacccctgtcgtctttgccatatcctagtttctctcctttccaggctcaaagtcgattgtcctctgcaattcatccgccccgatgacacgtaccagaatggtctgtccgagccggtacgtcttcccggtatggatcccctgcatttcataacgatcttcaatatactcataatgatcatcggtcatgttcgctacatgaacgagtccctcgatcgtattggggagttccacatacatcccccatttggtaatgccggatatgactccctcatactcctcaccgatcttgtctttcatatactgtacttttttcagcttgacggtttcccgttccgcctcttccgcgcgacgttccgtctcacttgcgtgctttgtcacttcttccaggatagactggtaatgacagattctctcctcattcatccttccccgcagtgtctctttgataatccggtgaatctgcaaatccggataacggcggatcggagacgtgaaatgcgtataatacgcagtagcaagtccgaaatgcccctcattttccggggtatattttgcctgtttcatggaacgtagcgccaatcttgctatcattggctcctccggttttccttccaccctggcaagcagcttttggatctccttgggatgaatttcgttcgttccgacatgcatagtatagccgaagttgtgaagaaagaccgcaagtttcctgatcttttcctcatccggcgcctcatggattcgatatacaaatggaatctctctccagaagaagtcctctgccaccgtctcattcgcagccagcatgaagtcctcgatcagcttggttgctgtgtttcgttcgtatgctttcagcgctaccggacatcctgtttcgtcgagcaccaccttggtctccggaaaatcaaagtccaccgcacctcttctatgccgctttgccctaagaagagcagagagtgtctgcatctgctgaaacatgggtacaaaatcccggtaaatccggcactgctcttcgtccccgtcttccagaattcgcttcaccgccgtgtacgtcatgcgtcggtccacccggatcacgctttccacgatctcatgatctacgatctcccctttttcattgatcttcatcagacaactcagagccagacggtcctccccttcgttgagagaacagatcccattggagagcgtatgcggaagcatgggaatcacccggtccgccagatagacgctggttccccgcttcttcgcctcccggtccagagcactgttctcctgcacataattcgtgacgtcagcaatgtgaacacccaaataatagtacccgtcgcaaacattcaaggaaaccgcatcgtccagatctttggcgtcctccccgtcgatcgtcaccatcgaaacgtctcttaaatcccttctgcccgcacggtccgcatcgcttacgggctttgccacccgctctgcctgattccttactttttccggaaattcgatcggaagctcgtaggacatggcgatactcaacacatctgtccccggatcgttgacatgtccaagaatctccaccacttctccttccggcttcttcccgtctccaccgtaggaagtcagacggacgacaaccttgtgtcccgtaacggccccttttgatttctcctccggtacaaaaacatcctggagaaacttctgattgtcaggcagaacgaatccgaatgtcttattcttctgataatatccaacgatctgggacgtgccacgctttatgatccggatcaccttcccctcctggcgaagtccttccctctttccggcgccccgtgtaatctggatttcaacctcatctccctgcagggcgccgtttgactcctcctccggaatgaacacatcatcgtctgatccttctatggagacaaagccaaatccccttgcatgagcctgatagattccggccagccggttggcctgtcccttgatataattgcccttctgggtccggtgaatcttcccctccgcctccagcgcatcgagaatctcctttaagtcctggcggtcgtcccttttcacctgaagtatggccgccatctctttcatcttcatcgggacatagaattcatcacagatgaactggtataccattttctttcttttctcatattgtcggtccattgtccgcacctagcatgctcccttctattctatactcatatcgtgaaatcaccggaagtatcaaaagatatattccgggatcgtaaacggtgaccaaagttccaggcaagcccggactttgacgcgccgccattgtcaaaaaaaggacaccctatctttgaaatagagtgtcccgcatcttttttcattaagcaaatacttttaaattcaaaaccgcagcaaggatgataaacagtgcggcaagaatctttgtaacttttacaagggttccctccatagaacgacctctgttctgtccccaataggtatccgccatgccggcaatcgttccaagtccggctgattttccttcctgcattaatacaactgctgaaagagcaatacagtctattacaaatataattgtgatcacaatcttcaaaatttccaatttctacacctcctgcgtataaaccatttataatattagcatatcattgaggtttacgcaagcagtttttcacagactttcgggtcacacgtaaaaatcgttttttaacagaatggttgtttgtagatggccgcgtccccaagctcttcctcgattttcagaagccggttgtatttttctacccgctcggatcggcacggtgcgcctgtcttgatctgtccggtaccaaaagcaacggcaatatccgcaatcgtcgtgtcagcagtctcgccggagcggtgagaaacaatcgagcggtatccgtgttcctgcgccatgcggatcgtgtcaaacgcctcagtcagcgttccaatctgattgatctttaccagcaccgcattggctgcatgggcgtcaatccctttttggagccgtctggtattggtcacaaacaaatcgtctcccacaagctgggtctgtaaaccaagtctcgtattcatcagctcccacccggagaaatcctcctcttccagcccatcctcaatggaaacaatcggatatttttcgatcagttcggcatagtagtcgatcagttcctccgccgtgcggacgactttcttctccttccctttgctttcgcctacaaagacatatttcccaaagtcccgatcgtagatctcggacgccgccgcgtccagacagagaacgatgtcatgccccggacggtatcctgccgtctcaatagcttccagaagtgtctcgcagacgctctccgtgtcgggaagatccggcgcaaatccgccctcatcgcccactccagtatgcagtccttttccctttagctgcgctttcagcatatggtacacttccgtacacatccgaagtccttccttaaaacagcaggctcccaccggcataatcataaattcctggaagtcgataatattgtcggcatgccggcctccgtttaatacgttcatcatcggtaccggaattctacgggtatgtgccccgccaagataccgataaaggggaagccccagacttttagccgccgctttcgccgctgccatagagacactcagaatagcattggctccaagggcgctcttatcctcagtaccgtccagccttacaagcacacgatccagttccatctgatcgagggcattcatcccgatgatttcccttgcgatccggtcgttgacgtgatctaccgccagctccacaccacggccacagtaccggtgctgcttttctttgtcacgaagttccagtgcctcgtggcgccctgtggacgctcccgacggaacacttgcggttccaatggtgccgtccgataaaagcacctgcgtctctaccgtcggattgcctctggaatccaggatttctcttgcgtatatatctcgaatcgctttacagtgatacatgatcatttcctccttttctgccatagtatttccgaaaacatttcttccataccgtaaggaaagtattacatgatttttcctttcataattcagccatacagtctgaatattcataaaatctgacacgagctttctaatcaagtctgcataggtgaaccatcgcagatttcctcgattttcccctgacaggtcgttgactttttcatcctgcggagttacaattttgaagaaaattcttcataaaaaccgaaagaaaacgaggaagaaaaaatgaacagtaattaccatgtggatatgaaatattctatcccaaaaccgaaatccgatatcaaacctcattcaaaagtcaaggatttcgttgtaatgaccgccgcaaccgctgtcatggcctgcgggatctacttttttaaattcgcaaacaattttgcttttggaggaatcaccggtcttgcggttcttgtcgccaaaaccggagtaatcagcagcggagatttcaactttgtctgcaatattgtactcctggttcttggatttttagtacttggtaaaggtttcggagccaagaccttttactgtagcatgctcctttcctttctgctgtccattctcgaacgtgtatatccgatggacggccctcttacgaaccagccagtactggagctgatgtttgctatcgcagtacctgcctttggctctgcgatactctttaatatgggggcgtcaagcggtggtacagatattgtggcgatgattctgaaaaagtataccggatatgatatcggacgcgtcctgatgctctccgacgttgccattgcagtagccggcgtgtttgtcttcggtatggaaaccgggctcttctccattctgggactggttcttcgctctgtaatcacagacaacttcattgaaagcttcaacttgtccaagtgcttcaacgtcgtttgcagcaacccggagccgatttgtaatttcatcatccgggatcttcacagaggagcaacggtctacacggcgcagggagttttctccggcaaaaagaaatatattgtgttgacggcgttaaaccggccccaggcagtacgtctcagaaactttatcaaagagacggaaccgggagcctttatcctgatctctaatacaagcgagattatcggacggggattccacacggtataagaacaatatggaagcgcagaatcgccagtaccggcatttatcggaactggcgattccttcatttggaatttactgtcttttacaatgtttcttttggcgccatcagatacagatacgcatcctccagagtgatttggggctgggtacacggcacggccggccgggtatcgctgatcattttcaccgtcattccctcttctgtgtactgtttagaggtgatatggtattttgcctccagtcctcttgcctcatcttctccggagacagccgccatccagatctttccttttgcatagttcagaagatcctgcacggttccggtatagagaaagatcccttttcgcatgaccgccaggttgctgcacgttgccgcaatatcttctactacgtgggtggaaaacaaaaccgtacgccctttcgcaaaatccaccagcagattccggatccgcacccgctcttccgggtccaggcccgtggtcggctcatcgacaatcagaaattccggctcgccaagcattgcctgaatgagccccactctccgcttcattccgccggagagttggcgcatcttctttttttgatgaggcaaaagccccgtcttctccagataaaagtcaattctctttttgcaggtatttttcggaatttgggagagttctcccagatattccagacattctctcaccgaaagtcccggataaagattcagctcctgcggaagatagcccagtttccttttgatcgtttcatactgctgtggttcgtaccggatgtgatccaaccagatttctccctcctttggcgtaagcactgttgtcagcactctcatcagtgtcgtcttccccgccccgttttcccctaacaggccgtagatccctctgggaatcgtcaagtctacctgatccaccgcccggacgtgatttttaaattctactgtcacttgtttgatgactatactcattttgacaccctcttttctatccatggaatgagcagcacaaacagtgccgctattgctatctgaatcattgttccaaagatccagtccgccgtctttcccttgacaggatgactggccgaatatgcgaacagattgtaccgtccgaacagcgcctctcctgttttggaattggtgataatccagactaccgccgacactccgattccgatccattggctctttgcggcattggaaataaccacagttaaaaggctccaaaacagaatcgtcccaagaagcgccacggcatagtacccatactctgtttcaagtggacgctccctgatgggatatggattctgccagaaaaagacaaaataccataccagaaagagaacatataaatacaagacctgaatcaaccatcttctgtaaatcgtgcagatcctgcctgacaggggcttgaggagaaagatctcccaccgctgaccactttgatccatcacccttgtctccgcacaaaatacaaacgcaagaattgccgcccccgggataatcgtccggccgatttccggaatcaccgcaactcccatcgccagagaaaacaaaaggagaaacaacacggaatatacgattttgtacggagacatacagatttttatttcctttttcatcctatgcgcctccttttccagatggcggacgccataaaaagcagtcctgccgaaacaaccagaagaaacacctgattatacaccgccctcggagccaccgcctccagaaaaccgccgtcgaaccgtactgtaatcgccagaggccgtaaaggccccatattggagtacatcaggtacaaaaacaaaaacggcacacccggaagcgggtttcgaaagcccagcgcaatgatagtatagacgcttacgatcatcaggacatttggcagcatatagtagaccgccgggatcagaaattcaatcagcgaaaccggaagaccgtttcggattccagcgacagcactcagcgcaaaaaaaactaccacaaacagaagccaagccgccgccatggagaaaaagccgcctgccgctttcccaaatacataagccttggcagtgacaggtttcgtatgaagcagctcgtaggtgtctcttttcgtgtcccggataaagaggaacgcaagtagcaccgcactgaaaaatccaaggtataatcctccaaaatccgcgaatttcctgccaaaataccaggaatagctgtgggccgtaagcttttctttcagatctttgttgatctcattttttgtccctttgtgatactcatacacctggtaataatactgaaaactgtaacctttcggatatccatagatctccccgatcgcatcggacatctcagatacggacttccctgattcccgaatttcctttagcgtctcccgcacattttccgcatcctcgccaaattctttgacaatcatactctgtatctttttcgccgccagatcgatccgttccttttccgtggacttgacatagccgtccatgatatccgcatccgcgagcgattccggtttcgtctgctgtacctcctgcttagaatggaaataatgtacgtccagatacggagaaaggatctggaagagcccataaagaatgaataggatacccacccagtaaagtgggtttttgaaatagtttttcagttcctgccggatcatccctttcatcttatcccttctttcttttcttgataagatgatggtatcattcgattcacaaccaaaacacaacaagaacgattctttttaaaattcttccgtttccggcacaacagattccggtacaatcgaccggaaataggcacgcacgcaggcgccgccactttgattctccactgtcagaaaaccatcgtgcttcttgcaatacagctcgctgatatacattccgagaccaaaatgcttcagatcgtcccgcaagccagaggtcgtaaaggcctgctttgccctctcctcgctgatgtcaaagcctgtcccatcgtcctttacctccagggtcagtccactctcctcctccaatacacagactatcacctgcctttttgcaaaccgcagtccgtttccaatcaggttgtccgccacctccagaatcagatcccggtcaagaaagagcgtcttccctttgccgcccgcaaaaatctgaaactctcgtttcgcctcccgggagagaatttctcccaccttctgaatctcctcgctgagtttttccactgtttgcggctgacaggaaagcggttgttgttccagagcagaaaaagcacgcatccgctccagaaaccgttccagccgttcgatctgccccatactttcgcagagcatatgaagcagggtttccctgtccagcgtctcccccggcaaaaactccagcatcatctcctggtatcctttgagcacagtaagcggggttcggatatcatgggcgatggcggcacgcagaacctgctcatcctctaccatccgccacattttccggttgttctgtgtaagctgatttttcatccggtcaaattccagacagagttctcccagttcatccctgttttcatacccgatttcaaagtccagatcattgcccgcaatcttttctgccgccatccggagggctcccagtggtttccggattttcttttgataaaacagcatggtggacacaatgatcccacccgcgcacatgacaagaattccataagtctgtaaaaaatcgcaccactcagaaaagcgtgcgtcccaatctgacattctgctgttactgacccttgggatcaccacatcaaaagattcctcatctcttttgagaaattcttcgatgtatcgatcctgatccacgtatttccaccagatctgttcctgtatccgcccagcctcattcccggcaatggcgcccagcagaaatcctgcaagaattcctaccgccatgtagagcaaaatacttttacgcagagaaagatttcttactttttccatcgatatcccactccccacaccgtctcaatcggatcctcgtctgtaaactcaccgatctttttccgaatcctgcggatcagttctgtaattccacggccgtccccttgtccgtcaaatccacatacatgttcatagatccgctctttatcaaatacctgtcccggatgcatggaaaggaattccaagattccaaactccgtctttgtcagatccagcatctttccgtcaatccataccactctggctccatagtctaccagaagtccgtttccaaaccggtaccgtgtcttctgctgatgtctctcttctctccgcagatgggcaagcactctcgcttccagctccttcaagctaaacggctttatgatataatcatccccgcccatcatcagaccattcacccggtcctgctcctccactctcgcggtcaaaaataaaatcgggcaggatacctgccctcggatctttcgacatacctccaggccatccatccccggcatattaatatcaaggagaatcaaatccggctcctcggccgacatccggactgcctccgtaccgttacccgcctgcaatatctgatagcctttcatttcaaaataccgtcccagcatctccagcagatccctgtcgtcatctgccagtaatattttatatcccatgtttattcacctctgacaaaagtatacacaataacaaatagcatttacccttatgatagcataaagtcttgaactatgaaactacttgctgcttttgctcttttgtctactataaaaaaaggtagcctcacttgcgggaagctgccgaggtagattcatttgaccattgataaggatgattggttctgctatttcgtacaaagtaacataatggttgaaaaatccatatataggagatacaatatatggcatataaattgacaaatcggaaattgtagggatgtaattatatgcagaaaatgaatatgcttggaaaaggaaatacagcagaagtcttcgaatatgaaaaagggaaagtttgtaaacttttctttcaaggatacccacatgagtatgtcgggctggagtttaaaaatgctaaagaaatgtataggaatgaaattagcgttcctaaaccgtttcaaatggttaacatagaaaatcgtgaagggattatctatgaaaaaattgaaggaaagacgttgctaactattataaccgaaactgaagaaactattgaagcgattttagatatgtttgtgcatctgcatcttgatattcttggacatcattcaaaaaatgtgttgtcgtataagcaatatttaattgctatgctaaaaaataaaaaggtaactaatcagatgttatttaataaagtaatttcgttacctgatgatgactatcttttacacggagattttcatcctaacaatgtattagtaatgccagatgaaactcttgttgttattgattttatgaatgtgtgttatggcccggttttgtatgacatagcaagaacttattttcttattaaacaatataatattcaattggcaaatcagtatttaaagaaaataggcgtactagaaaatgacatcatggaatatctaaatatcatcgaattttgtcgaaaatatgaaggttgagattagattggcatagttagatttgagtaagggttcggggattttcccaacaaaccaaaatctcttacacttataaggatatataagatgattttcgtctataaaaacaacagataacaaaaccggggacatattcccatacatcggaatatgtccccggtggaatctgctatataccactttggttatctcctgcgaatcagtacaccctttggatataatcttccattcttatattgtctttggaacaagatctctcctttttcctgtagcgtaacgtcctcctgagcacagttcagaaggatttcgatctggttctgattgcggtcgagtttgatatagtgtacaagccggtcgtctctgtattcttccgggaagtgaaagtacaggcttttgaatgacggctccgtcttccgcaggtggataagcttctggatctcgtggatccgacgctgattttcttcggtgtgcaggttgtcccacggcatacatctgcggcagtccggatcaaagcttccttccatggcgatttccgtcccatagtagatgcacgggcttcccggcatggtaaagaggaccgccaactgttgataaaagatatccagatcccggaaccggttcatcagacgttctgtatcgtgggaatccagcaggttaaaaagaacattgttggactgctgcatatacatcgtatagcagtgattcaccatatactcaaagtcctcttttttcatcgtcctgtcgatgaaaaaatcgtggattccgctcatcagcggataattcatcacggaatcatactcgtcccccatgagccattggctggcatcgtgccagatctctcctaaaagataaatatccggcttcatggctttcacatgctcccgaatacgctttaaaaaccggtgtgatacttcatttcccacatcaaagcggatgccgtcaatgtcataatcccgaatccagccctcacagacgttctgaaagtagtggatgacctcttcgctgttcgtgttcagctttggcatcttgtccgcaaaggcaaaagaatagtaacgtccgtccctagtacttgcctccttattcatctgctcccagtcattcaccataaaccagcccgcataaggggactgttccccgtgtttctttacgtccagccatggcgcgaaattctgtccacaatggttgaacacggcgtccaccatcacccggattccgtgttcatgcgcctctttgacaagatgtctcatcgtcttggcatccccaaactgcggatcgattcttgtataatccttcgtatcatacttatggttagaatctgcctccataatcgggtttaagtagatacccgtaattccaagcttctgcaaatacggaagtttctggcggatcccctccagattcccaccataggtctcctcgttcgtgactgctccttcattcttccacgcaaggataccttccctgtcatcttccggcgtcccgttacaaaagcggtccgggaaaatctgataccagatcgtgtcgttgacccagtccggcgtccggttcacatccgcagggttcatccatgggacggtaaagcactgaagcatccttccctccatctccatctgctcttttgtcagaaacccgtcttcaaaatagtaccagatctcatcatccgtatgtaattcaaaaaaatatttgcaccgtttatactttggcaccagggttgtcgtccaccagatctgatgcttcagccgtttcctgtagaaaatctcttcccggattccggtccacgtctcttttcctcccagaatccccgcctcaaacggatccccataataaaggaaaacctgctttacgtcatatccggtctttaagttgacgatcagttccgattcgttcagaggataactcatttgctctgtcgttctatggtaaactcctgtaaaatccatctgtcatcaaaccctttctgtcattgctctccggtactttcttaattcttcttttgcctgtccaaaatccggcatccgccactcccagttcggggagcccaccgttcccggtgtgttgatgtgaccttccgctcccagtccgagaagatccgccataggaagaatggcgtattccgccttgctgcgaagcgtatatgtcagaaggcggtcttttacagatccctgtttgatgccctcccgctttaagaaacggcgcaccttccttctggcagctacgctcagtccctcataccactgcataagggtatcattatcgtgggttccggtgtagataatcatgttttccacatcatggaaactgtcatatgcatattttccacccgtctcaatggagaatacaaggatcttcatcccttttaaatggtaatggtccttcaactgcaatacttccggccgaagctcacccagatcctcggccacaagatttaagccgtcaatttttgcccgaagagtatcgatgacctcatatcccggagcctcgatccactcgccctcaatggcggtaggacagcttgccggaatcttccagaatgtgtcaaaggcacggaaatgatcgatccggatgatatcaaaaagcttttggttgtaaccaatgcggtcgatccaaaactggtattcgtgatctttcaggtagtcccagtcatagattggattgccccatctctgcccggtggcgctaaaataatccggcggcactccggcgatgaaaaccggccggccgtctgtatccaggaggaaattgtcctttccaccccagacgtccacagaatccacacccacatagaacggcacgtctcccatgatctgaataccgctttcgttggcacgccgttttacttccatccactggaggtagaactcgtactggaggaacatctggtaagccgcctcgtcctcctgctcctttggcagcggcgccggaacttccggccagatcttatcctcttctttccattcattccagcagactttgtggttcgcctttttcttggcgcggaatacagcgtactcgtagacccatggctgcctcgtaaattccctaaaatcttctgtctccgtaaagtttgaaaatgcctctttcaaatacggctctttaaaagtacggactgcatcataatccacggttctgacattctcgtggaatgtaggcgcctgttcttttaacagtcccgcctcaaacagaagatcgaggctgatatagatttcgtccccggcgcaggaggagtatggctggtatggggagttcccgtatcccaccggattgagcggcaggatctgccagatcttcaccccgttttcccacagagcctccacaaactcatatgcatatgctccgagctcccccactcccgtacgggacgggagggcggaaaccggcattaaaattcctgtttctctcatggctgctttcctttcctgctgcatccggcctacagacgccagatgtcatcgttgtattcccggatggtccggtcggatgagaagaatcctgccttcgcgatgttcacaagagcttttctctcccaggagagctcgtcctcataatccgccagcatcctctctttcgtctcaatgtactctttcacatccagaagtgtcataaaccagtctttggaaaccagttccttgtaaagtctcgcaaggctcaccggatctccgatacggatcaggtctttactgataataaagtccaccaattcctcgatcatggcgtcgccatcgtagatcttgccggagttgtatccgtttgtatcatagagacgaatgacttcctcggattttgccccgaagatataaatattgtcatcgcctacaagttcatggatttccacatttgccccgtcttcggttcccagcgtcacggctccattgagcatgaatttcatgtttccggttccggatgcttcctttgaggcaagggaaatctgctcggaaatatcacaggccgggatcaacttttccgccttggtgacattgtaattttctaccatcacaatccgcaggtatggacgtaccgccggatcattctcgatcagcttttgcagacagagaagcagatgaatgatatccttggcaatcgtgtacgccggagccgccttcgctccgaaaatcatcgtgatcggacgtttcggcagattcccttttttgatctctttgtatttataaatcgcataaagcgcgttcatctgctgtctcttgtattcatggagacgtttgatctggatatcaaagatagaattttcatcgatctccacaccctgtgtctgcataagatatttcttcagctctgccttcgcttctttcttgatggtcttcagatccgccagtacgttctcatcgtccttgtaagcaagaagcttctccaaattggaggcgtcctccataaattccggtccaatcagtccggtcagataatcggataatctgtgattgcaatgtacaagccatctccggaaggtaataccattcgtcttattgttaaatttctccggataaatatcgtaaaacggcttcaattcagactcttttaaaatctctgtgtgaagcgctgccacaccgttgaccgcatatccgaaatgaatatcaatatgcgccatatgtacccggttttgtccatcgataatatatactctctcatcgtggaaatctcttttcacacgggcgtccaggtcccggataatcggcatcagatgcggaacgaccttttccagataagataccggccatttttccagtgcttccgcaagaatcgtgtggtttgtgtaagcacatgtctttctcacaacgtccactgccgtatccaagttaaatcctctctgcatcagcaggcgaataagctccgggatcaccatcgtcggatgcgtatcgttgatctgaattgccacatgatcatacaggtggtagagatcataccctttttcctctgcttctgccagaatgagctgcgccgcattgctgaccataaaatactgctggtaaattcttaaaagctgtcccgcctcatcgctgtcatccggatagaggaaaagtgtcagatttttccgaatatcctctttattaaactgaatcccatcatggatgattgattcatccacagtatccagatcaaacagatgcaatttgttgcagccattttggtatcctggtacgtcaatgtcgtacatcgtagaggtcagagtgaaattctggaacggcacttcaaaatggcgctctgtctttgtaagccagctctgatccgtaatccacgggtttttctcttctctttgcttgttgtccacaaaagtctggcggaataatccgtcatggtagtttaatcctacgccgtctcccggaagtcccagggtggcgatggaatccagaaagcaggccgctaaacgcccgagtcctccattcccaagagacggctccggctctacttcctcgatctcggtgatctccttaccatatcgtttcagaacttctcttgtctcgtcaaataatcccagattgatgagattgttggacaagagttttccgatcagaaactccgctgaaatgtaatagagctttttgctgccttcgtttctcttcatcccggccattttttcttttgtaatctctaaaagtgctgtatagatttcttcattggacgcatcctgaatgttttttccatagttcttctgtaacatctcctgtaataactgttccatcttcgttctcctttcgatgtagattcttattcgaccgcctcgtacactctgagatcccgcctacactccaagcctgggcgaagcatcctttggatgaggtcgggtttcctccgtcataaatctccggaagctgtctgatacatccttccctcatggcgctctccatgacttccaactgctttcggacatgctgtctggcttcttcactgtacccgtgtactttcaaatacgccagataataagccccaagcgggaagacccacaccgttccctggtgatatgccagatcccgcttgatcatttctcctccgtaaaacggatggaactcctcgtccgcttcttccagtgtccgcagtccgtaaggggtgtaaagtttctcgtagaccgtccgcacgacctgccgttcctgctcttcatccatcataccaaacggcatggataccgcccagatctggttgcaccggatctgcgtatccgccttcgtcccggaaatcaaatcctttaagcagcctttttcctcgttccagaattgctgccgaaatgacgtccggaccttgtccgagagcaccccatacccagtatattccattcccagttcagatgcaaacatttccataatgcggagagcattatacgagtaggcattgacttccaccggttttccgtgtctcggcgtcggaagcaaatctcctacccggacatccatccacgtcacctgatcgagcccttccccggccaaaatcagaccgtcttcatccatacggatgccatgtctcgtgcctgcctggtagtttgcgacaatgcgctccattaccggccagacttcctttacaaaatccagatcccctgccgcttggtaatacaggtagacacagttgataaatagcagcgccgcatccactgtattgtaccgtggctcattcttcccctccggaaaaaggttcggcatcagaccgcccttttcgtgaacggcaaaggtccgtaagatctcttttgtagtctcatactgtccggtggaaatgcagacccccggaagagcgatcatcgtatctctgccccaatcctcgaagaacgggtatcctgccagaatcgtcttcccatccgtagactctctccgggaaacgaattgtcctgcacttttggcaagcacctttgccatcggtgctgtaaatcctgcccactcttccagttcttgacggtactgcttcgtgtccgaaagaataccttccgcatcctttcttccagcacaagtcgaagcgatgatctccagccgccccgtcttcctggccggaactctcaggctgatctgaagcaccgcctttgtcctgccggccggccgcctgccatcgcagacatcataactgtaatagcaggtttccgtctcctccttctgtaaaatctctccattggtctcaaagaagagcccaatcccattcgatatgaccgaatttccatcccactgaaagttctgctcttcctttagatcctcgccctttctcacaaattggaggaatggagtgacttgaagtgtgaccgcttccagtgtctcgttttctatttcatagaccaccgccacggtattttccatgtgcggcatcccgatttcctttcttacctgtacaccgccggcctcgtagcgccagacaggcgtatcctcaaaggtgaaggaggacaggtaccggtatccctcctccgccgtaccgccatcaaactcctgagaagaaagcactttcttctcttttttcgtctccaacacttcccgcagacggtgaatcagattgtagcggtggttcggcgcctgggtgcatcccatcagcagggcatggtcatttctggtcgctgatccgatcattgtcagggaagaaaagccccccagcccatttgtcagaagatagcagttctcctgccctctttcaagcgttttgatatcttgtttcccgtagatccatttcatatatctagccttcctttcctgtctgtccaagcaccaggacactgcgtccttccacccggatcgttccttctgtcacaaacggattctgccagaggcggctgctgtgcgcatctacaagcacttcccattttccttttggaaggtttcgctcgatttcttcctgtctgctattataaatcacgcaaagtgtctcccacagggacggctggctctcgctgtggttatccacgagaaagccaacgaccccatccgttttccactcgtcccggatccgtttccacgcatcctttgatttatcacaaagtcccggcagccgtttacgaagtgcaatcagaccgctgtaatattctaccagctcatactgttcatacatccggttccagtcgagacggttgatctcaatcggagcgttgtaggaattttcgagtcctccttttgtgcgggacgcttcttccccggaaaggaagaaaatcctgccctggcacgtcatgtacaccgccgctgccatcctgttggcacgcatcctctctgcctcatcctccactgtaagagaaagcttatcccagagtgtccagttatcgtgggcggatacataggtaacgacctgggatggcgcctgaactttggatcccggtccgcaccatgctttcaccgaggagagaatcgccccctcctgtccctttcctccatttacaaatccaggcgttttcccctcaaaggtatgccccttgatggcatcccttgtatcatcacagaaaaatccaacctgcggattcagccggtctatattctttttgagcgccggaagagcttcttgttccatgggtgtttcacttgccgaccatggttccccgaacacaagtttctcgccttttccatagcgggaagaaagctccatctcgatccggttcataagtccggtgtccagaagtcccatcaggtcaaaacggaatccatcaatatggtactctcccgcccaataaagcacggaatccacaatatagttcgcgcacatgatccgctcactcgccacatcattcccacaagctgatccgttcgccgtctctccgttctcgtggacacggtaataataccacggtaccgtcctctgaaaccaggaatccaggaaataagtatgattgtagaccacatccatgataacccgaaagccatttttgcgcagagcctttatcatctctttgaactcccggatgcgtacctctccttttcgtggatctgtggcgtaggagccctccggcacattatagtttaccggatcatacccccagttaaactcccccgattccttcgattcatcgacagatccatagtcgtatgccggcataagctggatatgggtgacgcccagtctcttcatataagaaaagcctgtgggatgcacaccgtcatggtttcgtgttgtattctcacaggtaaatgccttatactttccacggaaggcctcgggaaatcctcccgacggatcccaggaatattccccgatatgcacctcataaatcacctgctccggctgcatttcaggggatacctcctccagccacccgtccgggtctgtctgtttcaaatctacgatcatgctcctttgtccattgattccacacgctttcgcataagggtccgctgaccagatcgcctccccctcgattacgagctcaaaatcatagtatacgccgtggagcatttcttttgtccggtaagcccagacgccttgtttttccttttccataacctcggtgcgataaggtttccctgtctcaccatcctggaagaagcggacattcaccgtctctgcaaccgggctccacaggaggatggaagttccatcctccgtgcaggttgcacccaggtcatgtccctcataggtatattgttgttcaaatttcggatccgaataatatgccttccattctgttgctgtctttctcatctgtcactcctcattcatctgtttttgcctgcctttcacacttagcctttcactgctccggatacaccatctacatagtacctctgcataaacaggaagaggatcgcgatcggaatggaaatcagtacggctcctgccgcaaagctggtataccaactgtcaatatattccttttccagcattttccatagcccaatcgcaatcgtgtactggtcggagttggcacggcagatcactttggcaaaaatgaagtcgagccatggagccataaacgacgtcagcacggtatagatgataatcggtttgctaagcggcagtgtgatcctactgaaaatctgccatctcgtacatccatccagaagcgccgcctcatccaccgcaatcgggatggtatcgaagaatcccttcgcgatctggaatccaagccccgcgcctcctgaataacacaaaatcagcgccactttgatcagattcccttctgtcagtccgattgcctttaagataaagtaaacggcaaccatggacatgaatccgggaaacagtcccaggatcatcgccatgttcatataaggcttccgcaacttgaattttagcctggaaaggcaataagataccgccagcacataaaatgtggaaagaatacaggaacacaccgcgatgaacaaggtattcgcaaacatctgtggaaagttcagaatggaggtgtctgtaaacagtctcacataattatccagtgtaaagctctgtgggaagaaagtggaaacataggaccccttctctgcccggaagcttgtcagtattacccataaaatcgggaatacccagatcaacgccaaaatggcaagtacgacatgtacgatcgtattatgaatgaaacgtctctttttagctgaacgtacttttccagcagccatgtttagaatcccccttcttctttatatgatttactgttgcggtatgtaagaagagccgcaatcgccagaataataaatgtcaggataccgatcaccgcaccgatattgtagtactgcttatcaatggtcagcttgtaaagccaggtgacaagcaagtcggtacttcctgctgtagaggacagatccgtaaccggatctcctccggacaacaggtaaataatattgaagttattgacatttcccgtaaatgttgtaatcaggtacggcgtcgtcacataaagcatatacggcagcgtgatcttaaaaaagatctgcaccgcgtttgctccgtccaccttggccgcttcataaagttctcccggaatattctgaagaactccggtaagctgaagtagcgtatacggtacaccaacccagatattgatgacaatgacagtcaccctcgcccacatcggatccgtgaaaaacggaaggctggcgtcctgtgcaatcagtcccagattccgaagcaacacgttgaccgctccctccggctgaagcatcgttctcataatcaaaagggagacaaacatcggaacggcacaggagagaacgaagcagaatctccagaatccttttgctcttgtctctttccggttgataacgatggaaaggatcataccgaaaatatagttactaaacgttgcaaagaacgcccatacaatcgtccatgcaagtacagaccaaaatgtacttcccagaatactggtgtggtataaaaaaagttgacagcttattctcaaggatttcataataaaaccaagagaataaggaggtattcaaagccataaaataaacctccaaactggtaagtctatcttacatcagtttgaaggtttacacaaatcttgggatactcccattattgatgcgatattattccctgttttacaatcacgtaactgctcagtcataaacaatcctagctgttgggaagaaagcctatagtattcctgctctggtgctttgctaataaactgaaaatcttgggaagcatgctctctaatgtactgagctataacacttatggttgcatcattaaatacaacttcaaggggaacttcaacctctaattcttgttgaatcatattgattagtgacattatctttaaggaatgaccacccactgccaggaaattatcctctctgtcaaactggtctgttccaagcagttttgaccatatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctttaaggaatgaccacccactgccaggaaattatcctctctgtcaaactggtctgttccaagcagttttgaccatatctccgccagttttagttctatatcatccctgcatgcaacagcgtttttcttcctatttgccatggcctttggcaatgcctcatagtcaaccttgccgtttactgtcatcggaatcttttctatctgataaatacctgatggcacttcatacgctggcagcttgtcatgcaattcctggtacattgcattctcattgacttttccatccgcaacataatacgctacaatactcctctttccgtcttccagctcgacattctcatcgtatccaagctcctctagaatctcttttaccttttcctgatcgacttctattccaagctcttctttggactgctccaaactaatatgtccaagccttacctcccagctgtttggaaacgtataattgtcatatcccttcttctttctctgtatgtatattccaacgtcattgacacggcagttgctagaacaagaacctgtatcctttggcctactccataacccactcctgctctttaggaatcctataatctcgtccttggttacttctgtgtaacgatagtaatctatcaactctaccttttctaatatttccttgccaatcagcatgtcatcgcctagtatccttgtgacataatccttctttgcatggtacagacttctctgttcctttattttctcttctaccatgtcaacatctagcttctttccttgttgcatgatgtcatacagtctgacatcgaagatttgtcctctggaaagtccgttgataatgtatggaattccatgctcgtatgcatactttgtactcagcacattcagtaccttaaagcagcctaggcacacgctacattcttccttaagcccctcgcaaaacacctcattcatgttctcttgtttctgtatcacacagtccagtttgcattctgatatgacttgatggatgttctcgaacgctgtatctgatatataaccattatcaaacacgaatggcaacacccttactcccatttctaccagcttgtacaatacatatgtactgtcctttcctccactgtataaaagcaagcagtcgtatttgccttctgcctttgattcctttagtttcttctcaagttcttccattggacggaagtagtccttaatcatctgctcttgttcttccatctcatggcaaacattgcagacaccgtcctctccaatcgtcactccgtcatacttagatgttagcccacatatcttacagtactttgtctctttctcctcctgtgccacatgaaccacacattctctgattcctggataagaaagtacggtttcctcgatttctccaagttctaccctgtttcctcttacctttacctgtctgtcacgtcttcctaagtactccagtgttccatctggttgctttctcccataatccccggttcggtacatcctggtttcatcacagccgtctaacttgaccatctcgaacttttccttcgtcagctcctcatttttgtagtacccaattgacatgaattcggtggcaatccagatttctccttcttctcccaccttgcattcttttctctggctgtctaagacatatatgcttgctccttccattgcctttccgattggaatactctttctctgagtatcttccttcttaatctcatagtacattttgaccatggttgtctcagatggtccataaaggtttacaagttgtactcggtcgccctctgcctcataccaaccttttagctgccttggcttgattcgttctcccgccatcagcacatatctaagttctaagtatctctctttaccccgtcttgccttgtcaatctcagcaaacagcgtaggtgtacaatgtagcacttggattctagatgattccagccagtttccaagacgctccccatcaagtattgtctctctatccttaggtatacagattgttccacccatacataaggttgtgaagatatcccttagcatggcatcaaatcctggtgacgatatctgacttacccttggtctgctcacatctttcaagaatttcttttcccattcagcaaaatgcacaaggctcttgttcttaccaagaatggcttttggttttcctgttgttcccgaggtaaagaatatataaatagggtcttcttcgttatatatactcttttcctctgtttttgacttctgttttccaagctcctcttcaattaacaggattccttccttctttactatctcagtcgctctttccatatcctccatatccgtgataagatacttaagcccaaccgtttccgccatggtcttaagccttttgttctgatggtttccatctagtggaacaaatatacaccctgccctaaggattccaaggattgcctctatcatctgtattctatcttttaaaaagattccaaccagctcatgtttttctatctttctggctcgtatcatttctttaaatagttctgctctttgatccaatgccccgtaagattctgaccgttctccgtattcgattgcagtttccttctcatactgtttcagtaccttacacagtttgtcctgtattgtattcgccataaccgttcctccttctgtaagcttcttttcctgacgctacaatttctctgatttcgatcttttctttttttctgcatcaaggtactttttcttaatatcagatatacagaaaccaccgtattcacagtataacccataaatgctattcattgatttccttaccttctcattatcttcatatcctagcgtgattaacaagttaaggcataaagaattctgcatcagggcaatgtgtgtgaaacatttcgatcttggaatatactcttcatagtatttctctgctttttcaaactcaagcatacgatcctttgtaaatacattttctatcttaagaccatatggtccgtttttttggcaggcatcggcttcttctaccatactgtctagcaaaaattgaatacccttttttactatctgctcttctttggatactccaagtcttgttaacctatccaggaaataaacggttgccactacagagtgttcccatgagccgtctgcttcctgattacttgcaattttttctatcatctcttgaatcacagaatcatcttgtgctgttaggcattgatagatttccttcttaataagaatcgcatagtaatcatatttttcttctaaagactgtttagaattatttagctgttttcccttatagagggaatctaattttccaacatactttaatgccgaaagaatctcataagtctgttttgtattatcattttttccccaaaatccattctgtttctgcttgcttaagatgtctggaatgattggttctagtatctcttttgctatattttttggcaaatttggaattgcataatagctcttcttttcccttattttctcaaagtcacctaaacgtgaagtatataattgctcactgattgacttatactcttctgatttcataagtggcatcataccagcaactgtacatcgtaacatagcatattccttctttctgattaagtttataaatatgttataatctcttcgctaaaattgaaaatcaatatccttctcttcaaaattctctagtgtatccatgctcattctagaatctaggctaatgtcttttatttttatacctggattttccactattacctctagaattctaaagtagtccgatatcatttgtctaatcgtatcttccttaaataaatcttttgagtaaataaaagaaatatagatcttgttttcataatggttacataccactcgtaggttctcatactctacattggtctcatctaaataatcaaatgtagcatcaacgttttcttcaggaagagtatctatatattgcatcgaaaaagaagcatcaaaaaagtttgtactatccacattcgaatcagcataatctaataaagacgtaagataattgattgggtattcgtcatttgaaaatgctcctacgataacatctttcatctccttaagataggtatcaaatttcttatccatcattggataactacgaattgcaagcatattgataaacattccaacaagattttctaattttgcattcttccttccttgtattggtgtgccgattaatatatcttcctcagcagaatatttgctatataaaatgttaaatccagcaaacagcaaaataaacatcgttgtcctattttcaactgctaactcattcagcctatcgaatagctccctggatatttctttttgaagattaccaccacgatactcccttttatcacccacttcaaaatccttatgaagtccattgttctttcggtatcctttcatgaccttcttccagtattcttccaaaacgtccttctttttttcaatccttctattaaaccagttgacatagtcaacataccggatatcaagttttggaagtgtatcttctcctcgatagaacgtcagtaaatctctcaatactagtcgcactgattttccatctgcaatggtgtgatggaaatccaacacaaagatgctcctgccttctgatactttaagtagtgcagcacgaaacaatggtgccttgctaagttcatatggctgaatgaactttttaataacagagtccttttcttcctccttgcaggtaaatacagaaacatgaaaatcaatttcatccttgataaactgtacaaaatcaatatccttaataccaaagcatgtcctcagcatttcatgtctctctatcagtttattgaatgctatatttaacctatcctcattcaactcacctttaacaacaaattggttcgtaatatggcacagattttgcacactgctaaatttctcaataaataacattctcttttgcgtctctgcaatttcataccattcccgttctccgatattctcaatatcctcaatatggacccgctggttatttcgtataaactccgctatcttaccaataacagcattattaaatatgacttctaatggcagttccacatcaaagcactcgtagattttagaaactaatgacattacctttaaggaatgaccacccactgccaggaaattatcctctctgtcaaactggtctgttccaagcagttttgaccatatctccgccagttttagttctatatcatccctgcatgcaacagcgtttttcttcctatttgccatggcctttggcaatgcctcatagtcaaccttgccgtttactgtcatcggaatcttttctatctgataaatacctgatggcacttcatacgctggcagcttgtcatgcaattcctggtacattgcattctcattgacttttccatccgcaacataatacgctacaatactcctctttccgtcttccagctcgacattctcatcgtatccaagctcctctagaatctcttttaccttttcctgatcgacttctattccaagctcttctttggactgctccaaactaatatgtccaagccttacctcccagctgtttggaaacgtataattgtcatatcccttcttctttctctgtatgtatattccaacgtcattgacacggcagttgctagaacaagaacctgtatcctttggcctactccataacccactcctgctctttaggaatcctataatctcgtccttggttacttctgtgtaacgatagtaatctatcaactctaccttttctaatatttccttgccaatcagcatgtcatcgcctagtatccttgtgacataatccttctttgcatggtacagacttctctgttcctttattttctcttctaccatgtcaacatctagcttctttccttgttgcatgatgtcatacagtctgacatcgaagatttgtcctctggaaagtccgttgataatgtatggaattccatgctcgtatgcatactttgtactcagcacattcagtaccttaaagcagcctaggcacacgctacattcttccttaagcccctcgcaaaacacctcattcatgttctcttgtttctgtatcacacagtccagtttgcattctgatatgacttgatggatgttctcgaacgctgtatctgatatataaccattatcaaacacgaatggcaacacccttactcccatttctaccagcttgtacaatacatatgtactgtcctttcctccactgtataaaagcaagcagtcgtatttgccttctgcctttgattcctttagtttcttctcaagttcttccattggacggaagtagtccttaatcatctgctcttgttcttccatctcatggcaaacattgcagacaccgtcctctccaatcgtcactccgtcatacttagatgttagcccacatatcttacagtactttgtctctttctcctcctgtgccacatgaaccacacattctctgattcctggataagaaagtacggtttcctcgatttctccaagttctaccctgtttcctcttacctttacctgtctgtcacgtcttcctaagtactccagtgttccatctggttgctttctcccataatccccggttcggtacatcctggtttcatcacagccgtctaacttgaccatctcgaacttttccttcgtcagctcctcatttttgtagtacccaattgacatgaattcggtggcaatccagatttctccttcttctcccaccttgcattcttttctctggctgtctaagacatatatgcttgctccttccattgcctttccgattggaatactctttctctgagtatcttccttcttaatctcatagtacattttgaccatggttgtctcagatggtccataaaggtttacaagttgtactcggtcgccctctgcctcataccaaccttttagctgccttggcttgattcgttctcccgccatcagcacatatctaagttctaagtatctctctttaccccgtcttgccttgtcaatctcagcaaacagcgtaggtgtacaatgtagcacttggattctagatgattccagccagtttccaagacgctccccatcaagtattgtctctctatccttaggtatacagattgttccacccatacataaggttgtgaagatatcccttagcatggcatcaaatcctggtgacgatatctgacttacccttggtctgctcacatctttcaagaatttcttttcccattcagcaaaatgcacaaggctcttgttcttaccaagaatggcttttggttttcctgttgttcccgaggtaaagaatatataaatagggtcttcttcgttatatatactcttttcctctgtttttgacttctgttttccaagctcctcttcaattaacaggattccttccttctttactatctcagtcgctctttccatatcctccatatccgtgataagatacttaagcccaaccgtttccgccatggtcttaagccttttgttctgatggtttccatctagtggaacaaatatacaccctgccctaaggattccaaggattgcctctatcatctgtattctatcttttaaaaagattccaaccagctcatgtttttctatctttctggctcgtatcatttctttaaatagttctgctctttgatccaatgccccgtaagattctgaccgttctccgtattcgattgcggtttccttctcatactgtttcagtaccttacacagtttgtcctgtattgtattcgccataaccgttcctcctaccattcattactgaattccaaactgctccaaaaacatgttaaatgttaatacaataatcagcatatcattatcatagggtacatttagcctaaatccatcactcatataaagctttttcaatctctccacttcatctggattaaagaatccctgacgtttaatacgttcatatgataataaatcttgaaaatactcatttcctgactttaataaatcagcacttcctggtgcaacgaatgcaaatttgggtctatttataatttctttaggaacaatactttctgctactttcttaacaacatatttttccttgaaattccttaccttcatgctataaggcattttcacagcaaactctattacctcgcggtcaaggaatggatatctggtttctacagaattagcaagtgccattctgtctccatgatctgtcagtaaatgatcacccattctcaatttaaaatctacataagacctcctattaaatacattcacatttgctaaacgctctttattgaccaatggatgatggaagcaacaaaattcatcataaactgcatttacttctttggaatacagttttcttacctgcctagaatactcatcgtgattcttctcatataaaaagtcttcatttccccatagttccttacgaatactacgttcacgtagaaattcatcgcttaatgcagtattctgctgtgaacgtaactgatcaaatcggtaacccacatatccaccaaacaattcatctgcaccctctcctgttaaaataactttaatattgtcattatgtgcagcttcagacaaagcaagtgaagcagtattatagctctccttcaatgccgtctctgaatgatagattgctttcttaatccttttggcaatttcattaacatcaaactgaatttcatggtggatagaatttacttttttcgccatcagcctctggtatttaccttctgataacgttcgttcttcaaaatcaacagaataagaatttctctcaacatagcctgacactttatgaatgtatcctgctatcaaagaagaatcaattcccccacttaaatagaatcctactgggacatcagcattcaaccttgctttcactgcctttgtcagaagttcatctaaatgctctatatagtatgactcctctagttcttccggttcctccgattcttttggatatatcaaatcccagtactcgttatcgacaattccatgctctgcatcaacaagtaagaaatgtcctggttgaattccttgtatattatcaaacaacgtcctaggtgttgctatacctggaaaattcataatctgatccaaaccgactaaatccacttttctctctacataaggatgttgcaatattgatttgatttcagaggcaaatatgaacattccattggttacggtatagtaaaaaggtgctattccaacctgatcccttgcacacataattctttgtcttgtcttatcataaattgcaaatccaaactgaccatttaacatgttgagaaattctgttccatattcttcgtacagatgcaacacaacttccacatcacagtttgtacgaaatacatgtcctttttcttccattttatttctcagttctcggtaattaaatatctcaccattacagattagcacaatcgagttattttcattgataagcggctgatgtccacccgctaaatcaattatacttaatcttgcaaaaccaaatgctaaatcattatcaatatattttccaaaatcatctgggccacgatgatttaaaacttgaatcatattacttagaactttctgttctattctattttctctctttaaatccaaataaccacatatcccacacatatgatcacacctttacttacttctgctatttataagtttatctgcttcctcaattgttattttgccattttctaattcactaagcacttcaataaaatactgtttctgttgttctatctcagaatccttgttccctcttatatcttctacttcataatcgagctgattactaatgtactctgccatatcatgaattgactgataggtgaagacatcggatactcttgttatccctgggtactttttgtccacttctttcataagagcaactgcctgtatagaatctccccccatatttaggaaactctcataaatatcaaccgcctcgattcctaggatatccttccatacaacaattagtgttgtctcaactttattcaaaatcttttcactatcggtattagtagttttttccttttgcgcctttttccttctatcttgcttgtcttggatacgttttataagctggtcatctaattggaattcttctggcctatagtactttgctaagagattaaaatcaatttcaccaattagaatattggaataattgctgcacaatgcccgttccaatgcttcgaaagcattttttgaagaaatcattttgaatacaccgttatcctctaaattacgttcgaacgccattccagtatctttccatggagcccaattaatagaaatgattttcccttttccatctgtcatagtactggaatcaaggtatgcgttagccgctgcataatccccttgtcctcggtaaccatacactgctgaaacagaagagaaatgcactagaaaatcaaacttctcttcctgcatcagcttcattaataccttgcccccatatacctttggcctaagtacctccttaaagtcctctatagttttgttctttatcaactggtcatttactaacccagcagcatgaattacgccatcaattcttccgtattgttcctttaccttttcacataaaccttccatgctctttgcatctgccacatctgcactaaagtagtgaatctcactttcggaattttgtatttctcgatatatacgtaaattctcatataaagagccattcttattctgcaatgcttcattctctaagtcttcgaaggatttcctacctgacacaataagatttaccttattcagtctggaaaattccctagccaaacgtattccaaggcttcccattccacctacaatcaaataaactccctgagccttgacaatatccgcaatgttcttcttagactctagttctgcactgctgattatctcactatagaagctaccattacgataggctagatactgatgcctatattctgactctatctccattacaatacgtttccagtcttcttggctttctaattcatcaacatcaagtagtctacaagtaatgttttcaacttcattggatatcactttaccgaatccaaataagcatgcatttactggatgtatgatattctgttctttgttgattttttttacaaaatctgatattaggtaaatctgtatcttttggcttatttccagatttacaattgcttttgtgattttgaataaggaatatacgcctagttctagctgcttttcaatttcatctgtactttcggagttttcttctagggaacatagatgaagaatcttcgttaatggtctttttttacaatcagaaaacagtttcacataactactctgatcattatctatacaataatgattggcacttaactttcgatatttctctccaaaattaatctctattacttcccgtccatctcttcttaatgtctctataatgccagttgattttcttcctgctgttgaaaatgccagaataagttcttctttacagtcatcctctttttgcttctcttggttcttcacatactggaactgataacttatacatttctcagcagaattcgtttcgacatggtgtactctcttggcaatgaaatctgttacctcagcaattttagttccattttcatgaaaaagaatactatcacattttataatctcaccgttacttccatcttccttttttctaatataactatacagtttttctcctgttttctgatagacagtcaagctctcataggagaatggaagatacacatcatctccaatgttctgagaaattgcattgattgccatatcgtatatagctggatgaatatagtactcattgaggtcattttgatattcctttggtagcattatagttaccaatatctcctccttattctgacaaattttctgaataagtcttgtccaacgttttcctaaacaaagattatttttcttggattgcgttgtcctcaatgcaatttctttggaaaactgactctttatccgggtaaaagtactggtttccttagtaattccgctactaaccgatacttttccttcacaaaacacctgcttccagttttctgattcatcctgacagccgattcggaattcatagctacttccttgcctaatcatttccatattaataagcatggtttctttatcttcaatcacaagcgaactaacaaatacaatattttcaaactttactacttcacaatcgcctaattggcgaaccccctctcttaccatttccaaataggaggttcctggcaaaatatacttatcaaaaattctatgttcattcaacacccaatgtttagaaactgaaaactctgttgtaaagcaatatacactgccctttttcttttctaccaaatagtcaagcagtggatgtctgatttctactactttttcttcctgttttctattaataggttcaatccaacaccgcttcgattcaaaacaatatgaagggagattaatcttccagtaaactcctccctggtaaacttcctcccaatcaatagctgctccacggacaaaatactctgctaagcacaccagatgttccagagtatggaacttctctttttcttcctttacgataagctctgcatcattggatattgactttagtttggatacgtgaatttcgaatgggttctttaaatcattcttatcggatataacgtgatgttccccataaaatacatggtcctttgtggccttttccattcctccttctgcaaatcttaaaagcttctgctgaagttctttacaggtttttgccactatagccagcctataattatattgtcctcgcccggtcgcaacggtatagcagatatctccaagagctacatcctgattttcaccaaggtaatccaccatactatttactagggatagcaagcctttcttttttttagaagaaagaacaaataaatgtggaaactgttcttctgtaaatacattttctctagtatctacctcttctagaacaacatgagcattggttccacttaatccaaaggaacttactccacatcttctcttctctccgtttgtcttccagtcatgtaatctattatttacatatactgctgagttctcaaactcaatatttcgatttggacattggaaatgtatacttggtggtagttgcttcttcctcatcgccagaatcattttgactaatgaaaccaaaccagacacattatctaagtgcgatatatttgttttcactgagccaacaccacaaaactgtttctttctggtatatttctgaaatgctctcgtaattccctgaatttcaatcgggtctccaaggcttgtacccgttccatgtgcttctatataggaaatggattccgggtcaacccctgcgtcctgccacgcccctctaataactgcctcttgtgctgctacgttcggtgctgtgattccaatagaagtaccatcctgattaaccttacttcccttaattactgcgtaaatgctatcccgatcctgaactgcatcggcataacgttttaaaaccagtgccacacttccttcaccaaaaacagcaccatcggaattgtcatcaaatgtccttatcatttccttttccgattcaacaccaagcttatcctccgtgtagacagggcaaaaagctatttttacccctcccacaattgctgtatcaatctccttatttctaaggctccgacatgccaaatgaagtgcaacaagggaggaggaacattctgtattgacaatcatacttggtccttttaaatcgagtaaataggaaagacgagcggcaacgatagaacttaaatttcccgtctctgaaaatggtagcaatgtatggtcaatctctttgacatattgccgatactctcctcctggcgtaaaaccaacgtaaactcctgtattggttccagaaagttttttgccaccataccccgaatcctcaatcgctttccatgcattctccaagaaaattctctgatttggatccatcagttttgcttcattatatgagattttaaaaaactcataatcaaacttatcaatttcccctagatatccccccttagcaaatctgatgttttcctccttctccccagtaaaacaaaggtatttaacaatatcttcctttcgtttcttggacaaatcagtaacacaatcccttccgaatttcaggtttgtccaaaactcattcagactatctgcttttggtaatttaatgtccattccaataattgcaatatccgttgatgatgtctcctcaataccttctaatatggcatcatctatatgtaagtctaacatttacctctcaccttcttcctcactctatttcagaaacagtttagtcactgcctgaattgtttttacgtatcttgacaacagttccttcatcgcatttatattaagcctaccgctgtaataaacccttattcggatttgccctgcaatgttctcaacctccaccgcataatctaatacttgttttagaatatgtaatacattggatccagctaagagaaataatactactgcctcattttccttacgctttgtaaaatcagtcttcagggaactgattggaacgccttctttctttcttgcatctcctattacttcagacagatacgtaaaaagctgttcttctttatcaatttcctgctgcttatccctaattatatctatcagttgattccgttccttaatgttagaagcaatgacaatactatctccttctgtaatgtctctcatatagtaggtaaacactcctagtagccactcttcgagtgttacctgtttcttttttgttatattctgtatttcttctaccagtctatcaggcaagacataagacatttcggatacctttcctgatggaataccttttaccataaccctttcttgcaacacaactggttttaattcatagcccgcatcatcttttagaagctgaacaagcttggtaactgtactattttcgaaaaatgcagtaatatcaatctcacattcaaattctttcttgatctgagactgtaactgaacaagggaaatggaatctcctccaatatcaaagaagttctcgtctactccgatttcattggtatgcaaaaccttctcccatatggaaataaggcgcttctcgatatccgtctttgctattttaatattgtttttatcttgtatttcccgtcttggcttgggtaagccgttcctatcaaccttttcattttttgttagtggaatttcctctaactgcataaaatacttaggaaccatatactgaggaattttcgtcagcagatattccttcacactagcaaaatcaactgttacattgctcgtaacatatccgcataagtatgactcattctcctcatcccacctttttacacatgcatgtagaactttttcataactacgtaaatgttcttcaacctcatcaagttcgatacgatgtccattcagttttatttgattgtcatttcttcctacaacttccacttctccattaaacaaccatctaccaatatcacctgttttatagattctatcctttgtgttatatggattggttacaaacttctcctcagtcagccttggattgtttacatatcctttagcaacaccagaacctcctatatacagttcacccaaacatcctattggtcttagttccagattcggtcctaaaattaagaacgtggtgttcataataggctttcctattgtaacttcttcactatctgttacttctttcaaggatgaccatatagttgtctcagtaggaccgtacatattaaatatccttcctgaatatacctcctgaacttgctttaataacgaattatctagtttttctccaccaatcaaaagcatcttaacagaagcaaatacctcttttacctcctctatctgaagaaacatactaattcttgatggagttgcttgaatgatatcaacctttctttcagtaatataatgaccaagcatgtagatatctctttgcaatgtttgatcagcaagaaccagcttcattccatttgccagcgcacaaatcgattccaactgaaagatatcgaaagataccgttgttagtgataaaatactcaatgtgttgtttagtgctaatttctctttcattgccaatataaagttatagagttgtcgatgcccgaccataacacctttgggctttcctgtggatcctgacgtataaagaatataggcgatatcctctggtgctggcttattctcacagatttcttttgcctcatattcttctaactgattaatatcaatatttctataatctgatattttctcttcttgactcgtagtgataataatttccactttactatcttctaacatgtattgaatacgttcttcaggaaaatctgagtcaatcagtagatatgctcctcccgctttcattatgccaatcatggcaacaaatatattacaagttctttcgaggaggattccaactacggtattttttccaactccctgtttttgcaatatcctggcaagtaaatcagattttttgtctaattccctataagtaagatttcccattctgctatctatagctatagaatcataatgtttcgaaaatatctcctctaacaaattccaacttgtatagtccttaagttcctttaccgtaccagttccaagcttgatgagttcttcttcttgttcttctgtcaataatgtaagttcttttatccttactctaggatttctaatcacttcttttacaagtttacagtaattctctgtaaacctttcaatatacgctctatcatacagctccgtgctgtatgacaagttaaaagtgattccatcttctgtttcctcgctatctaatgtaatatcataagttgcggcattgatatcatattctccctctataatttcccaatcctctgtgcctatataggaactcttaaggttactatggaatgcaaataagacattaaacaaggcattctcattatccagtttcacatctaatttctttagcaggttttggaatggatactcctgattttcatatgcatggatgcagttctctttgactttgcataaaacagaaaggaaatctgaatcctcgtctgcctctacccgtatggcaatgagattaataaaatcaccaattagactttctgtatccggatgatttctgcctgctataggacttccaattaacacatcctcctgctctaggtatttcgagagttcaactcctaatactgccaaaagcaacataaataatgtagtatcagtctgtatagttatgcttttgagcttctcagtctcctcacttttaatatggaaccagatactgtcagaatggtaatttgatttgctggcacaagatctactcggcataagaatactataagaaagtttctcttttaatgtactaatccagtaatcttcctgtaattttagcttctctgatgttaactgaaggttatgccatgctgcataatctttatattgaatctttagttcaggtaaatattctcccttatacagggctaccaattcatttaagattactccaaaagaaaaactatcaaacaaaatatgatgtacgtcgtaaaacaaatataacttatccttggcaattctaaccagcttaattcgcataagcggtgcttcatctaaatggaaaggctgacggaattcttcgagtttttctagtacctccttattttctaatttctcgcaggcaatatccatgttaatgttctcatggattttcattttaggcaaaccatctaccaaatgataacttgtgcgaagtatctcatgtcgatttactatctcccgaattgctttttccagtcgttttacatctatccgtccattgataattactgcatttgttaaattgtaacggacattctcgctatcaaacatacaagcaaagaaaatcctcctttgggctgctgataaatcataatactcactacttgagatacgagtaattttgttatattgtgacttcttaagtgaaacgattttactaaactcctgaatagatggatttttcaacaggtctgctacatcaacattaatctgaaatgtttcatttactgcattgattattttcaaagcttgtattgaatctccacctaattgaaagtaatcagcctgaagctttatactctcgtatcctagatagtatccccaaatttttgctatctgtaaggttgtctgggattctcgttctagatgttccccaactacctttacaaaggcgatatcctcttgcgtatctctggttgttgctacgacagtttcatactctttcctctgtttcttttttttgaaatctatccagctccttgttttttcaaatggatatcctggagcactgattcgataaaccctctttctttcatataaaagattccatggaataggataacctgatatataaaactgacatagctgctctaacatcgtatattttaattctaagttcttttcttctacaatctgcgagatgaggcttctgtatacgctatccttctgttcatcctctttcgttacatgcacttcgttataaaggataccattctcccttatacttaacatgttggatgcgataacatgattcagtctttggattagctcatctctcgttttaaataggaacgcaatgcggtacgcgtagtgcccccttcctgtattacacgtaaaacacaaatcatctaaatctatatcctcatgaagcagaaaaaagtcctgataaagagataacaagcgctgtaaagctgcctgtgtccccccgcttaacgctaacaccctgatatcttctttctctttcttcttcctcctgtttgaaacatattcttccataataacatgcacgtttgtaccacttagtccaaatgatgtgacaccacatcttcttggataataatcactctcccatgatttcaattctttacagacatatacagcagaattttcaaaaagaatctttcgattaggcacttggaaatgtaagcttgctggaatctgaccatgttgtagagaacatactgcctttagtacccctagaattcccgctgcagtatctagatgtcccatattagtcttaactgatcctatagcacaaaactgctttctactagtgaaatcacaaaatgcttcattgatgccctgtacttcaatcggatctcctaaaccagttcctgttccgtgggtttcaatatagcttattgtctctggatccattctggcatcttcccatgtcttcctaattactcttgcctgcgctttcgggttcggtgatgttaagcttgcagatcttccatcacagttcattccactgccttttattactgcataaatattatctctatcttcaattgcaatactaaggggtttaagcagcataacaactgcaccttcgccacccgtgctaccattagcatcatcatcaaatacttttgccttactatccttagatgcaatccctatatctgaactatccatatcttcatttggcataaggcttaagcgtacacttcccgtcaacgccatactgcattctttatttcttatagactgacaagccacatgtaatgcggcgagtgaagatgaacaggcagtatttatattcatattcggtcctcttaaatctaacagataagataccattccagctaatgctgaaggaaggcttcctgttaaagaatccgctaaagaagcttcctctgcatctaaaatcattcttttatactctaatctaggattaaatcccacaaacacacctgtatccgttcctactattctctcaccaccatatcccgcatcctcgattgcattccatgctgtctctaaaaagattctgtgatgagggtccattaattttgcctgttgtggcgaaatatggaagaactcatagtcaaaacagtcaattcggtccaaatatgcagcttttggcatactaatattctctaatttacctgataactctaaatacgctttgatatccttcatccttgtatcaggaatgtcatctatgcaatttctttcattcacaaggttctcccaaaacgcctccaaggtatctgctttgggcaaacgagctgaaattccaataatcgcaatgtctcgctcatttacttccataatatcttgcacatccataaatttgatatcttccaacccttcctgtgccattctctcatctcctcgcacaaatgctatttccatttttctatgtaactatgatatattcctcgtgatagctcatgtagtatttctattttttctctctcctgcaccttctttacgtttaatgcagaaagaagcattgtgtaagcctctcttgccatcttagaatttgcttcttcccccttatcttttcgaacatagtaatcctgctttatcctctgatatggcttaataaattctctttccagttcatcattattgctattactatttttcgcacaaatagcagatgcaatacactttgcaataaattcattccagtctggtacctcttcttttaactgattcattatacggtttacatcagattcaacatctaatgatacgttctctttaccgaagccagatgccagcttctttaatatgcttttcggtcccacctcgataatagtttccactccggtttctttcataaaagtcataatctctgtccaccttaccgggcataccatctgccttctcaaatactccttcacaacattactactaggatacagcctagctgtcacattagaaaatacagggatggtcatatccgaaaaagaatagtcttccataaaattcatgagcttctctgatgcttcctgcatataaggactatgaaatggggcctttacttccaactcaattactttcgcccctaacccctcacattctttgcccacaaggtcaactttattactgtctcctgatattacactttgcatcggagaattatagttagatacatttacgctgcctgtcccttgctcatactttttacagatatcttccacattttctgcctccagaccgataatgcatttcataagaccgcctttcttctctactgcttcctgcatgtattgtcctcttgcacgaacaagtttaagaccatcacgaaatgcaattgcacctgcagctgtcaatgcggcatactctcctaggctatgccctgctacataaatcggttctataccaatacttttctgagagaagcggtacatagccatactggttgtataaatggcgatttgcgtgttatctgtacgtatgagctgttccttgtctcctgtaaagcagagctttctcatatcgattccgagcacatcacttgcttcatcaaacacttctcttgcttctgtcgattcctcatacagcttcttacccattcctatgtactgggaaccttgccctgaaaacacaaatgccactttcttcataattttcaccctttcaaatcatctttaatttcttgatctatcttttgattcatacgtccaattaattttttcaggatattcttgcataactcttcattcaagtaactagaattgaaacgataaatgagcgttatctcctcatcatcagaaacacttacaccgataaccatatcatatacggataaaatctcttgattgaactgatacagttccatactgtaaaatagcgaaacaattctcttaccatcttttttaatattcttttcatccaaatcacatagatgataatggattttgggtgactggtatgctttctcaacccgcctccgatattccgcctcatatttttcttctttcaccacttctaccgcactaacagcttcatcttcatcgcagataaaatacatacttacttctttacccaaggcaatatctgctaacgtatgtaaatattctgttaggatgattgcctcaattggcaagttccatctctttgaaagaagaaataaggattcacattcttcttccccaaaatcaaatactaatgttacatagttcttatctttattcaaagccgtggcaaaataagcttctggtaactctattgcatatctttgtacttgctcatatcctacctcctttaacgttacactttcttgctttttataaataaattgacttaattcctttatcgtaggattcgaaaaagcatctactacgctgattgctccaggatataatttttcaacctctgctaccatccttagtaaaagcgtagagtcccctccaatttctagaaacttgtccttttccctaattatcttatctcctagtagcatcttccagatactatatagctgtcttttaacctcatccatctcaaatgaagcagaaacatcttccccagaaacataatcatcgatatcattctcttccaaatcatctctatatatctcatatgttcccctgctattttttcttgccttaatatataggtgatagcacggtatattttcagctataggtgtctgtgaatagaaagtctttgttagggagtcattatgtatatatccatttgccagccctgtaccagttactataagttctccaggaattagactttcctgctgattgccttctttatcgcatacaaataatctacagccttccggaagttcttttagtggaatccacatagactcttccttatatgcatctacatcataacaggcaattatcggatagtattcgaatttctccatgacaaatgtataatgataggaactgttacaatttctatataattccatattatcaactaatcctaaaaggattatattatgtaaggagtccactcgcatcgtcaatgtctgctttgcacaaaatgccggcaatataagaagatttatctcattttcttgtacgaactgttctaacccattcagattatagagtgtctgttctggtattgtaacaatttccacatattccatcatgaacatctgaataacccatagaggtgctcgtggatttaacgtggttgagagaccaactttaatatacctatctttctttgctacaatttctttccatacagatacctgttcatagaatgccgtcctagtaatttcaatccctgcaaattctccattcttcataaccttatatgctttacatagtgtatcctcactctcttcacacgatttgcaatcatttagcagctctgaaactctgaactcactctctaaggagtctttttcaatctgtatagaggcgcaactatccgtttgaaggaatctctttttctcctccgttaactgtggacttataattacaaagtttcctccagtaatggtaaccgcacaagctcctattatcgcgcttattgaatcttccacacagacacttacagttactccttttcctacctttttactttgcaatgatgtagccagtttacttgctctttgatttaactcttgaagtgaaatgctataaccattttcagttattacactttgcctattgttatttaaagctatctttgacaatagttgctgaaaatcgaattctcccaacgtgtcttttggaacttttactacattcctagttttcgtatatgtttcacttgactcaagattcgcaaacatatcagtcattatttgttggtaacatcgtaaatacgcgtgaaccgtttcgctttctatcttactgctatcgcttaacacttgtccaaggagttttccttcttcttcacgcagggaaagggcaaattccgttctgcttaattccaaaacggaagtaactttctcttttgtatgtattccatcaaaggtcattaaatactggcacagattaacactccttttttcactgttttcacttcccacatccgagaatgggataaactgattctggtatgcactttttacatcctcgaaaacttccttgataacttctttataattccaattctcatggaacacttgcaccataaacaccaggtcattaaattcagattccccataaactggtgtactaaccaatatgcagtctttctgtgttaccttatgtaatagaatatgaaaacctgataataaataaatgaataaaaccattttattaccttttgatttttttatcagtttacttgataactcatcagagaatgcaaaggtatattcctttatagactgcaacctaactcctttataatctttcagtagcactgcgtaatcctgtatacattgcattttcttacgccagtactcttttccctctgaaaccttttcttctatctcacaatccattcaacccgccccctctcatattatcttatctataaaaagcaatcaatttcaaaatccagacttttttctagattattggcttcctgtagcatcattacctgctcattactcgtatatactcctatctcttttgtacataaacaagggtttgctaacacctgatccattattctttgcaggtactctgctaatctgctaacgtatacttccgaataaaacatctttgaatactgcaataccaaagtatgataatctggaggcaggattcctagtaacaagttataattattcttctctatccattgataggattctatgaagatagaatgtttattttcttttttcatccaaggttctaaacttacaggataattctccattactactaaagatgtaaaaagattctcttttgattgcatacctaccacattcttaattctgatcagatttccaagctcacaatccagtagtttccttttcgtgtctgtaatattcttcagcaatgttcgaaaatcctcattctcatccaaacgtatccgtaggggtaacgtttgaataaacaaaccgattgactgattgatatctgctatatcagctgttcttcccgacattgtaattccgatgttgaaatctttattttctgtatagcgataaataataatactccaaacagcatacatgaaatccgcaacagttacatgattttgtttaagaaatacatgcattctatctcccaattcttctgtaagctgaataaagtatctccccatcttctttttctttctactagaaaccgataaatccatcatctgacgagatttttccctgaaaccactaaaatattctttccagaaatgctcctgtgaattttcacgttctctactccatgatataaattccttgtattttgcctttttagtctttactaaactttttccatccaaaagagcttcatagaccataaaaacttctttaagaaaaaccatattgctccatccatcgtagacaatatgatgccacgtaatagcaaaatcataccccgaatccgagcatttaaatagctgaatgataaccggactagtttgaatatcaatttcttttatcgcctgttcttttttcagtctaatcatttcctcatctttgatggtatcaaaatactgaaaaggaatctgataattcttcaaaataatctgtaccggctctttaagaccttcccatcgatatacacatcgcaacatttcattttcctgacatacactacaacatgcactttttagcaactcgacattaatgtcattttcaatatatagtgatatctgtgcaacatatagctctacatcatttgcaatcagatattcatacaatattcctgattgaacagaacttaatccaagtatatcctctacattctctttttttaccctcatatgcgtttccctaccttcatacgccggttcctacagcttttttctgatttgaactatcaccttatgcagttctctttcctttaccattaccttaacaatctgatctgtcaaatcaaaatctttcttgacatggtaattaatcaaagcgttatttgcaatggaaagccactgtgcaatcatcttctcactgatgttctctaatttttctattaagctttcctctattccaatattctttatagctaaaaaaagattttttaaaaaaaactctttatatcgaatatttcggataaaaataaaatccttgcttttcaaaatctcttccccttcataaagaacttgtataggctgatcagaagcaatttcattttttatctgttctaggtaattcaactctgtatatggttgtttgtcctgattatagagatagagatctaatgcatttctaatcagttccccttctgtataattgcactctccatccaaatctacgctccaaacagtcgaaattgaaaaactatttgatgctgcttcaaaaagttctgccacaaaatcaaaggataatgttcccttaaaatactgacatccatcatttccttcttcgtggctattatcgcaaacaaagtaaaacttctcttcctgatcatatcccgtgattaggaataagtgcttccaatcgcattcctcatagtattcacaatttggataccgaataagattgcctggaactagtgcatatcttccactgtcaatcgtttgtttgataacatcgtgcaaagaaccagattctgcctcttgaatcagcacttctatgttcaacatatcctcgaagatatactgcagtgcctcattgtagctaatagtatagaataaagaatcatcatcaaagcaggaaatatgataactttggataagcttaaggtataagaaaaatattatttggaaatttctatccctatttcctaatatcagacctaaaggtttttcaaagcaattgacataattaaaggaactcttattgatagatggatcaattaaaatgtcacgtttcatattaccattttatcctttctttttttatatctataaattgttttgtatatctaaaatacgctgtgcatttttaaagaaaaatttatctttttgttcttgtgtcagaaaatccattttgtcaaaatatgcaatgtcctccaaaagtgtatgatacatcggccaatcacttccaaacaatatcttatccggtatttcacacatctccctctgcatacgttcaaacaatatctcttctttatcaattattttttgatacccagaaacttccagatatacgttttctctatttgctgccacatgaaagctatcttcgtagaaaagaagtgcagcatgcccaaggataaatggtatattagaaaatctgtctgctgcccgtagaatgctttctggataattaaaaactgtcttcatggacttccaggactctcctatatggattaatacaggaagccgatagttatcgcatatttcatagtacggaaataatctctcatcatcaatttcaaatccacaaggaggataaactttgaatccagaaaaatgatactgttcaatgctttttctaaacaatttcactcctgcctctcctcgtctcggatcaattcctgaaaacataataaaccggtcggcatacctttttattgcttcgtaatgtatctctgtaatttcttcaatgctgtattccgcctttttaccatagccaaaatctgcctgcaaaactacacatttttttactccacactcatccattgccttgatttttctcttgcaatcataatcgctcaacatactctttatatacatctgtacaaagctatcttgaacagaatatcccatttgcttttgaaactgtaaagccatattttcttttatattctgaatccaataatccggatacacccttaaatccgatagatgtgtatgcatatcaattatcatgtatctcttcctccaaaatgcctttaatcagtcctatgcatgtaaaatctgttccacaatttcatctgcaccgttggcactgtccattttctccaaattctgcacgtattgctgatagcaattctcatcattcaatgttgcaacagcctcaataaaatgttcgatgctatctacgataattccaatctggtgttctttaagcaaattggctactcctttttcctgataaagaaatccctgtaaactgtcaactagtattggttttttcattgatacacattcaaaaaaactgtttgctcccgccttagttacaacaaagtctgcgatttttaagatatcgttcatattgtcaacatatttacagatacacactctatctttattctcaccaataattagtttcgctaactggtacaaggactcattcttcccacatacgaagataacctgtagttcgggaaaattctgcaacactgctttcaaaaattctgtgctatgaaaggatccttgtgaaccactattaattaatactatctttttacgctttctaagcttcaagcgtttgtaaatttttgttatttcatctttctcatattccttaaaaaatttctgctgaattgggaacggaacaacagatatcctttctaaatcaatattcttcataagataagatttcacgttatctgtagcacagaaataatgatccgctccttttacatcaaaaccaaccgaaattggaatatagggatccgtaacaactatataaaacttaatctttttctgtaaattcaattcctttcgtgcacgtatcagtgcaaagtttatagtatgtgacgttgaaatgattacatcaaaagaagattgacgcagaaagtttttcaatttatcttctactccactatagaaatcttcagataaatctggccttgtgatataggaaagctcactaaatttgtaacacagctgtggtgatgtcatcatcaaaaaattgtagtagtcactgataatcttattactctgcattaaatcttcgtagaaggatgaaaacaactctgcctctattgaccgcttctcaaacgcactttgcaatgcttttccaacattgatgtgtccatgtcccgtctttgctgcaagaattcctactttcatctcaatcctccttactattcttactgttctcttctcctactcaaatttcttagaacatccgatactatcaataccaaaaaaatttggctcaaaatatatagaaggtaggattccctctgtctcatgagtacattgctcacagactttatgcctgtttaccaactgtttaacttttaaagcctgttcactgttccaaagcttaataaagtccatatcgtaatctcttagattacccattgtgactggtttgttattacattgaacatcattaaagacctcacatacattgacttctccatcataatcaataaatgctccatgcttacccgcatagcacatgaactctcttttaccgctatgtagtgtcttgctcgtgtagtaatattgagaagctggaatatacgttgttggaatatcacactttccgttgtagcctttcaatgtatacttctctaaacactttttcgcaatgtcataattctttggattcacctctttaagatattcgccccctcttggactttgccgtacaagaagcatcataatcctattaggttttaacgtgtcataaacccatttaaagaattgaggcaatgtgttctgattcacagagttcatagtaacaacaacgttctgaatgatatttccatatatcttctgaagcttcttacattcgttccaggtttcaatcgtcttcttaaaagcacctttacctcttatctcatcattttcatcttcaaaaccctctaacgaaaagttcatcgaataattctcatattttgaatactggctgatatattccatctgttttacgaccttgtcagtaagctgaccattggtgctacttgaaaatgcttttgctttattgttcacacggaataatcgtacaatttcatgtaaatcgtctcgtatgaatggctctcctccacaaagaagagcatttagaaagaatcccattgatttggacattttctcaatttcatctaaactaagttccttacgcattttctctgagcttgttttctccacttgatggttaaagcagtgtttgcaacgcaaattacagcgtgccgtaaccagaaaagaaactgttaaaggtgtggcatcgtaaaataagtgatttttttgatacatgtttaaaactctatgtaagttttccatattgttatcatattcttctctatcgaaattatacacgtttcttacctccattatttaataggtgaatctactggctaacaatgctatttgctacgtcaataacatcctgaacagtctcaattcttgtaaaatcaatactagcatctgatgcatttacatcaatccccttttccactagcattgatgcaattgcaatcatctttatggaatcaatccctaaatcttcacgcagatttgcttctagtttaactagatttcttttctttttcaaaataacatttgatataatctccattacaatcttctctgtattcttcaacttatttccctccatttatttatacaaattctctatctttacttcgtattttttatatacggcatttctatttatctttaatgttgaattcattaagccattttccaccgtaaaaggactattagcaataataaagtctttaattttaaaactattcgcatatcccttatttatttcatgaattgcatctttaatttttcctatagggagctttggatcttctaaaacgataacacagacaatgaacggtctttggtttccaattgcaacagcctgcttcactaatctggtctgttttaagtcttcctcgattactcctggatgtatcttatccccattgcttaggacaaggacttctttcaaacgtccctgtatatagaggaaaccatcttcatccaaataaccgatatctcctgtagctacatagccatctttcgtaaatgtctgcgccgctgcatttcttacatcattaatataatgtgtcccccaattatattcactcttaatcagaatctcatgctctttgctgattaggatttcttttgatggatacggtttcccaacactacctcttcgataatcatgctcattatttaaagaaaccaaacctacttcattgataccatatgcctcatagattcttaaacctgcctgctcataaattttcaatatattcttgcttgttggtgcagaacctgtaaccaggatacgcatattaccaccaagcatgtttcttaagctactaaagagattttgattccattttttcgctatcttccttggtaaaaagccagacaaaaccggatagagactgaaactaatacgctttttcatagattgttttattatactgtaatatgaattatagaaagtctcaaatagatatggtacaccttgcataatcgttggttttgctaaagctaatactctaagaagctgatttgtatttgttaatgttaagctaaactgtattaaaattgatgcgtaaacaaataatcttgcattagaaatcgatagtgtaaagaaatcaattagcttatcatcttcatgaaagtcgaatgaattcaccagattaatcatccaatcttccacacactttactcgaacttcaattccttttggaagtcccgttgttcctgacgtaaagataatagtgaaatactcctcgggttctcgtggtacaattacaacatcatcataggttaggtgctctgcgtatttcattaactgtgcaaggttttcaatttctccattacttacgtatttctcatctgcaaaaatagtagctaagtcaaattgttcttttagggaaccaacttttccactaaagtctttctctggaaatggaacggatacatatcctcctataatagtagccaaatcgagaatcatgtactcatatgagttgatgccgatgattccaatacggcgcccccttgctatttccttagagcgcaaatatgccactattctcattacatccacatatacttccgagaaagttttctttatgtactcaccagaaccgtagaattcaacatagttggtttcattttctttcattttcttaatcacatcattcaatgccaacttatctctcatatttacctcttttctataccagatgatctaactactgcttttttacaagaatttccttgagtgcaacgagcaggcgattgatttcttcataactgatggttagaggtggctccaatcttataacattcatattgttagtagagtatgccgttaaaatgtggtatttctttacaaggtttacagcaacactggtcgcaatactattgagtccttcttcatcgctagtctcctcaaattctataccaatcattaacccctttcctcgaacttctttgattcccttataagccgtttttatcctctccagttcagttttcagataatcacctttttgtctacaggtatcaaccagattttccttctcaatcacatgtaatgctgcaattcctgcggcacaagcatacgtatttccaccaaaagtactggaatgtaatgtacaacgttctatatcaccataagctttctcgtaaacctcttcttttgagagacaggcgcccactgggataattcctccaccaagtgactttgctaaacacaaaatatcaggtacaatatcatagctttcgtacgcaaataatgttcccgttcttcctaatcctgtctgtatttcatccataataagtagcacctgatattggtcacaaagtcttctgacttccttaaaatatccgtcagatggaacaataattccgccttcaccttgtattggttctacaacaaatgctgcagcacctaatttcatctgatcttctaatgcagttaactgatcaaatggaacttcacacacctctggcataagaggttcaaatgatttcctgtaatgctctcttccagtaacagacaatgcacccacgctttttccatgatacgaatttttgcagtaaatgattctttttttccctgttgctgccctcgccatttttaatgcactttctattgcctctgaaccactgttgcaaaagaatactctctccaattgtgattttgtcattactacaagatcatatgcaaaaactgcttcataggggttcaaaccaatatacgtaagattaattttatcttctaccttatgaattgcttctatgatatccttgttacaatttcctagactcattgcaccataagcaccaataaaatctaaatactcttccttattgttatcccatatcctacatccctgtgctttcgttagtacattagcgcatcccattgaacaaagtaattctgtcattcccttattcagattctctctgctcattttcgtgatttcctcactacttgccgtttcaacatcttcgagtgtcattaatctctcttttccattatgttcaatcatttcactccttctttctatttatcaaaaaatactcttctataagttcccagctacaactgctaatgccatctgccagtaagcataaatttcatatctgcttaactcatctgtttctataactggtattcctgcacctaaatagtcacagcccatccaaaaatcatcataatccttcgaaataatatgtatcccattcttctctggatttttaaagatatccgttcccggatacggaacgcacattgtacaatgagtaaaatcgattagtttctcatcaatacagcgacgtaataattttatcgttgcatgagcactatcatgtgtctcatatggcaaaccaaaaacccaatatgtatataatctgattcctgcttttttaacttgcctacaggctgataaacccatttcaacagttgtcagcttatttgttttatccagtatttcctgattcgcactctcgatacctaagcaaattaaaatgcagcctgctttcttcatcttggtcacgacttcttcactaattagatctacacggctttggcatacccagtatatatcaaggtttctctcaattagctcatcacaaaaattcatggcatatttgtaatcacttagaaagttaagatcaccaatcatgaaaagcctccagccattattcctatagtagtgttcaagttcgtctacaacgcatttcacttttcgaaatctaagcttattaaatactttggttggcacacagaacgaacaattattgctacatcctcttgatgtaataactctaatcattacattatccgtaatttgattggatagcaactcatacagcggatatggtagtgaatcaagatcttgtatatattcacgtccttgtgttacaacaatgtcatcttgcccttttcgaaatgcaattcctttcaccttagataaaacatctgtatccattcctttctcataaatggaatcaaccagctcaaccatagtttcttcgccttcgcctatagcaactatatcaattgctttgttgttctttaaaatgttctcgtactcaaagcttccatgcaccccacccaaaattacaatggcatgttcgtttactttcttaacttcctctgcaatcattgcaccccacttaaaatttgcagtcatgcaggaaatagcgacaacctgaagaaagtctcttggagcacttgaaatttccttttcaatatcacaaagttttattggtcttcctaaatccttacgtacgtcgttatcaataagcgtaaaatctatatactccaacaaacaaccagctttttttaaagaagacgcaatataaagtagtccaatattgggttcaatagcgtgatacccatcaacaccattacttaaatttgtttcttccaatatacgattcatctgactatctaatttttcccaataagctccctgtatttcatcaaccaccatttccgatttaaatataggaggctgtataagtagtatctttttatccatccatcttcccccctcttatcttcgtaaaatacgtctccagttattcttcatatcttccttttcggaatatagtacaacagagtcagcatccaattcataagtggaatcgtgataagaaatacctaattctttaaacccgagcatcttaagtatctgataactatttgaattacgaaatgtatctgctaatataagggtacaatcaatatctaataaacccttatatatttcgtcaattagtctccatataaccttagaatacctatagtcacttcggactatcattctacttacttcaactttttttacattactaaattcttttgaaattcctagtttatttagaattaataacccttgccctaaatccttaataattcttgcatacgccactatttctgtatctttgcgaataacaatatgtttggaatactcatcatactcatcacgttccatactggtaccgcaaactaaatctgaatcacatgcaaagtagtttaattcatctatatatacattatatctaaacctaaaaatctctgacattaactgctcatcaatctgagttgctgctatttctgccataataccaccttgtctctctttatcatcttaaatttcatttttcaagttacttagttcccgctaatcagcagtttcatacaatatattacatttaaaaatatttataggaatttaaaaaagaataaatttttaagaaagtagcaattcttgatctcgaagttgacaaaacgcagaaagttactttaagaattatcaataattttatacttgccagaaaagcaaatcacctaattcaaaaaacttgcttgttattatcgttaagtacaataaatcaatggcttttgaccttctctgcaagtgctaaataattgatgattattctgatttttctcctttattctaccaccacctgtactataacaactttgttattataaacatactgttgtgtatctaaaatgtaggttacctctccagccattaccatttatctttggaaactttgcagaagccttgaatatgtatttgctattctttaattgatttcatatacgtgtgaattgcatgcaagacatactacataattggttttgttgcatactgcacatcgttctaaatactcaataacctcatatatttattttatcttgctaaagaagaaatctttatacctattttaattaattttaataaatatttcaagttttttcctgtatttttccatatctgtgatagttaagtttacgttatttttaacttaatttttatagcaacatattccctgactattggctaatgtgatttctgtaggtaaaatcaaaattttgccacacctagggcatgtttagtacttatattattacaccatgctgggtgtaacaaataaagaacaggggacgactcctcctacatttttaatgattttgcatcaccattcttaagtacaatgctgcaggtaataattctgttaatcttgtatccatacaggatacaattgcgacattttatcaggatatttattggtaatatacttttcataccccttattttcaccaaaagctttattatattctagaatttcaaagctctccatccgtaggaatatgtgaatctacaagatcaatctgctccgacacagagggtattttgcaacgcacggaaatctaatataatcgtatcgcagccagtagtttctaccaaagtttttagtgattcctttgtcttttctcctgcgaatttttgtttcttacttgggtttaatttaaatataactcctttaataaaaacatatttttttctctttatctattgtatttactagtatttgcaactctcaaagtgattaacaccttcttgtgatagcataataccattaccactctttagtgtgtacttagtttcccttcaacagggtacgtggcaacagtaataatcgcattatccaattcaggatacataatcttttctattgtaattgtaaccaatcgtcttccaagagcctccatttttatctccactgttataatatctgatttaaagatttccggctcgatggtattatcaaaaacaacaatttctgtttcctttacaagcctcatatcctttttcataagggcagttgacacgtattttgcaacatcatcgtctacacagacaaatacctctggtatataagggaggctttcaatgctatcttcaatcatgctgtaattataataactattggaattcccattgctaagcatcagcgcttcatcaatagttattccattcttcaaaaaagtttgtcgtatcccatcatatctcattgctatgttcattgatgcattagtgactcctataaaagaaaatgttcgtttaccatgatcgataagtctttgcacaatttttgctatagcaaatcttccttcactagctataatattaccatatcttggatactcttctacatgctttggaacactaaacattgtaattggtaagctactctttgctagtccttcgataaaaatctctggaaatgtgcattcttccgatgcagcctttaatgtttctgttgcgtctagatcatcttcctccacaatgtacatctgcatacgataaccatttgcttttatttcatcactaatacctgtaaagattttattccaaaaggttgattctgcacgattaaacagaactaaaatagtgcctccaacatttttcttcgataactcttttgctttctctattaatgcgggttctaatttctcatatcccatctcatacgctctgagaataactgtcattctagtcgcattataaacttctccgacatttaaagcctttgcgacagtattcctttacaactctaatttagctgcaatatcttaaattgtaactcgtttcataaggccctccttaactatcttataattccattcataaacttatcttataatatctcattaactactgacatcactatacattataaatgcataaaacacaacacattttcgtttttatttatgcactattttgcacgtatgtgcatttagtgttcattttgtttagttaatgtttttataactgaattaactagatttttataagtcgccccccccactcgtaaaacaggcaatgtcatcaacttaacaactttttcaagaccaatatgatttgaatcaaaatggaaaaaatatatatttgcattataaataagctgtgactacgagaagtacacagctatcttactccatatttattttttatttcaaaggcaacttttcaaatgagcataatatcttcttcgagtattctttctatatctgccaaattttccgtttgggcatacaatgcaaagaactttcgatgattcttcaattatcatatttatcagttgttgacgtatgtgtgctgtacttttcaataaaaatatcaggttggtttttattctgttcaataaataactacggttggtttgatattttctcttgtttttaacggaaatcataatataagaatcagtctgttgtttagcgatggctgccaaattaaataaaaacatggaggcaaataatccttgataaatacttactttttttgtacagttaatagcctctatttccaaacgatttttttaattctctatacttacattcaatccccatcggatccgatagagttctttgaatgaacatgaatccagttgttcaggcatgatgttcgttactaaatattctattgttccaccttctaatgggaaatggatgcttctaagggtcagtttttcttttccatcgcttgcgggataagatagtacattaaatttgaaaaagacagtttacccgaacgagaaaaagctgctccaatcttatgttattcacgaaatgattccgacatgattgtttgattggccgtctgggaaatagaacataatatcattgttgatttcataaaaaccccacacattgaaaataattatcaatgcggggcaacttttttgatgattttgtcaaatatttataattttcttaagttgacgacattgcctgcacagcaggtagattttagcctcaaatagatgcacgctgcgcatttattttcaacaggctaaagtctattatataaaaaacggttctaaactttacttgggggggtaaagtaaaaattgaatagacatagagattcaattcctatataattaagttaccacacaaaatatatagaaaggattgaactctatgcctatctctgattttacctcaaaacttcttgaattggaagatgtttttatctcccatttaccaacttcaaatatcgaagtccatgttttcttttccttaaacaaaaagcctcatacttgtccacattgtggctccattaccgaggctgttcatgattaccggacttccattctaaaaaatcttccgtttatgggaaaaagactttcctccactaccgaaagagacgttaccattgccctaactgccacaaacatttttatgaatcctttcctttacttcctaaacattgccgcatcactaccagacttgctttttatgccctccttttattgaaatcccgccaaaatgtacgctctgccgcggctcttttgggtgtttctgactcctttatcttccggcgcttacgggatgtacgttacccaaaaccttcccttcttcctcgggttttgtccatagatgagtttaaagggaattccggcggataaaaatttcaggcaacccttaccgatccaaaagctcataaggtatttgacattcttccctctcgtgctcaagtagcccttatgcagtatctaaatgaatttccaaataaaaaggaagtccgctactttgttacggacatgaatcaagtttaccgtgaccttgcaaaaacgtatttccccaacgcggttattgtcatcgataagttccatgtggttcgatatgttacctgggctttggaaaatgtatgcaaacgtgttcaaaaacaattgcatccttccaagcggaactatttcaagcgaagccggaaattattactgactcataagaaaaagctcagccaggagagtcttgagacattggaaatcatgttgattcattctcaggatctggccattgcctatcatttaaaagaattattttatgaatttatggaattcaaaagtaaagctggggctatcccaaaattacgaacatttattctggccgcgcaaatcagtcagctgacggaattccatgcctgtctaacgatgcttgggaactggtctcaatacatccttaacgcatttgactgtccttatacaaacggttacacagaaggtgtcaacaatgtcattaaagtgataaaacgaaatgcttttggatactgtaactttgaaaactttaggaatcgaattcttctgtccttaacgtaaaatgagacacaggtaaaatacctgtgcctcgaaaaacttttaccccaactcttgataaagagcctaaaaaacagtatggccgaaaccatactgtcttctttcttcatcctattctattctgctgcctctgcattgctaagtcctgaaagataatcatcgaaagcggtgtaatctgctgtcacgctcgctctcggtttattctcctcaattttctgatatccggaatatccgatccaaacacagatcaacacaacaatgactgctgctagtgctgtctttagacggaagagcagcttctttttctttgcttctttttttctcttttccctgttatttttataagaatctgcatttgtcaggctcataactgttactccttttgcactcaactagtatacataatatcacattcaccggacaaatacaagtttggaatccggatttcacatttcccacacaaaacggcattatcttataccgcaatgataatccctccgtcatttgcatacatgctactgacccctctcgtatcaagaacaatgatatctccaagcggcagcttctttaaaagcatctctctgaccatctctgcccgcgccggacagttgcagtgagcgataccaagtgtcttcttctccggggaaacaatctcctccgacacacgatccaccatcttcgccagagccttgttgattccccttgcctgcccgtgctggatgatgacgccctgctttgtggctcccatcaccggcttaatattcaaaacagacgccgccaaggctttcagtccggtgagtcttccgttcttacgcaaggtctccagtgattccagaacaaaatacgtattttgtccgtcgatatatgtctccaccgcattgaccacttcctgaaagccgagcccccgctcttcacactccatgatcttcttcgtgattagcgtctcacccacagaagcggaccgggaattgaaaatgtagatatctttctgtccgtgctcctcaaggaacagatttttcccaaggacggcgctgttgtacgaaccgctcagctctgctgaaagcgtcaccacatagactctctcttcctcgccctcaaatgctttcatataagcctccggagacggacaggatgacttaggacattcactgcatcttgccacacgggccaaaaagtccgcctggtcaaatgtctcgtcatcaacaaccagatgtccgcctacattcaatgtgagagaagccgtaaaaatattcccggcttttttcatatcaggcgtaagttctccgcagctatctacaatgactttataactcatctctattcctcctacataccattgtatgatttttacatctataatatgtagttttcaatactacttccttatcataacacaaaccaggaggaaagaaaaggaattttatctgcggattttgatttttcctgagacgttcaacacaatccccatctcaatcatcagaaagaccgctgaagtacctccgtaactgataaacggcagtgtaattcctgtcgtcggaatcacattcagcacaaccgctacattcaaaagaacctggatggcgatgtgggcgaagactccggtcacgatcagcgatccatagagatccggcgcattctgtgcgataaacatcagacggtaaagcaacattccaaacagtaccaggacaacgatcagtccgaagacccccagctcctcacaaatgatagaaagaatcatatcattctgcggctccgggatcaccatcttctgagcgctgcctcccagtccctttccgaaaaatccgccgcttccgattgccagaagtccctgcattgtctggaaagctccgcttttggcgtatttttccgggtccacccaggagaggattctctgtaaacggaagttcccgctggactccaaaagccttcccagaatctgtcccgcaattagtccgccaaccacaaggcagacaaaaacaattccgatctttcttgtccgtggataagccacaaaaaaaataacagccgaaattccaaatacaatgatcgctgtacttaagttttccgtcagcacgaatacccctgccgccgcaagtattccaaacaggagaatctgaagcgcccccttttttgtatacgcttttttcccaaacttacaaatcaagtaaggaataaaaagtatcattgcaatctttgtgatttcggacggctgaaatcgctgaataacaggaaatcgaagccatctcctcgccccattgacctcaacccccaacggcgtctgcaccagagccatcaggatgaaggaaacgacataaaggatcgttgcataccgtgtgtaacgatgataatccaccttcgtcactacatacatgaccaaaaggctccccccactaaacagaagctgtcgtctgaaataaaaggcaccgtcccccttatagtcaatctgagcagaataatagctcgtgctgtaaagcatgatcagtccaaaacagatcagaaaaatcaacacagctacaagtccgtaatcaaaataagcgtactcggcgtttcccgccattttcttctgacgtatcattctttttcgtttcagtctttgccgttgatccatatcaaaatcactccatatttttctttatacttccccgatgattccttattatatccgcaacagaaaggaaaaacaaccttcttgccaaaatgaattgtaactttcgctttctttttccatatgataatcttagaaaaaagattgaaaggagtttcggtatgcagaattattatcagcgtcccgcgtttcgccagccttatcaaaaccgcgagaacagccgtgaagctactcgcgaaatcaaccggcagaaaccttgcgacgtgaaagacaaactgagaaaagaattccctgtcgccatggcctacgttccttggcagcgctatctggaaccttatccggtctgcaaaggttttatcagaggaaccatttttgaagaacttgacaaatcatttcttggcaaagggggatgccgcttatgaaaaacttcccttccagaaaagagcttttaaatcatattaataccgtcagctttgcggtagatgacattcagctctatcttgatacccacccggacgatgaagaggcgcttgcttattttcacaaatataaagaacagcgtgtcaaagcactcaaggagtatgccgcatgttatggtccactgacaatcgacacggtggacgaatcctgcggcgacagatggacctggatcaatgaaccgtggccatggcaggaaggagggtgctgatttatgtggaattatgaaaaaagacttcagtttccggtaaaaatttccaaaccggatccaaaggctgcccagattatcattacacagttcggcggaccggacggtgaacttgcggcgtctatgcgttatctgtcccaacggtacaccatgccttacaaggaagtcaccggaattctgaccgatatcgggaccgaagaatccgtaccgaatccctccttcctctttttgtctttctttgtctatttccgtctaaatatgtcgcttttctgattttctatttttctatattataatatggcattgtgggtttttctcagatgtaagagaaaggagaagcatggaaaacctgtcacagctgattcacaggctcggaatcaacgcgacataccggggatatcattatctttacaaagcagtccttctggccctctccgacgaagactatctgctttccatcacaaagaagatgtatctggatatcgcagcctactatggcatcccggtcagtaatgtagaacggaatctgcggactgtcatcaccatctgctgggagcggggaaaccgggaatttctgactgaaatcgcatcctatcccctgactttcaggccatccgccggggaattcatcgatattctcgttgcatattgccgggagcatcaaatcagcgaatgatctggttacatattgttcatgcttttttcaaatcagaaacatagttttttcatattcttcctgtatagtaaaaaccatagaaagcaaatacctttctaagcaaacaattttctttttcataattctgccggtacagtatctgtaccggcactcctcattttgggagcttttcatattctcctgtatttttacatagattgctacaaaaccgacaaagagggttttgtttttgtcctattgtatgtatcttagaaaatccagaaaggatctggaactggagcgtctccagcctggaagtaccttagcacgccatgaatccatcctctgttctttggccaaatccttgacaatttctgttcagtctatctaccgtgaagtagggtccggcgacacgattcaggaccgcccggtgatgcagcagcttcttacggaagtggaaaagggcctctgggagggcgttctcgtgatggaaatagaacggctggcacggggcgattccatcgaccagggaattgtcacccgaacgttccagtacagtcgcacacggatcatcacaccctataaaatctatgaacccggaaatgactttgacctggaatactttgaatttagtcttttcatgtcccgccgggaatacaaaaccatcaaccgcagaatgcagtctggccgccttgccagtgtccgtgaggggaaatacgtcggcaacatcgccccatttggctatgaccgtgtccggctcccggaccaaaaaggctttaccctggaaccaaacaaagaagcgaatgccgtccgcctgattttttctctgttctgtcagcgtggatgtacgatcagggagattgtctccctgataaacgatcagaaagagtatcgcccacgtaaagccgcttccttcacctattcttccattcacgacattcttgaaaatccggtctatatcggaaagcttcgctggaattaccgcaagacaactccacaactaaaagatggcgtcctcacccggcaccgtccccgtcaaagtgagtaccttctcgtccagggactccaccccgccctgatctctgaggaatgtttctttctggcacagcgcctccttcatccggattcggggcagaagaactcgcccatatggaaatgatctgtgcgattgtccatcaactgacgagaaatctgacaccagaggaaattgagcgctcaggattcggcacctactatgtggatcacacactggcgctctggcctcaagcggcaagtggtatgccgtggaccgctacggtcttccagtctaagggagatcccatcacagatctccatgaggatctcgccgcagaacaaaaagcgcgcacaacatacgacaacatcctccggcttatcagcgacccggatatcattgctccaatccgtttcctcagagaacgtgaaattgttcattaccaaagattcggagaatctttaagaatcgtgaccgaccggctcgacagcaaaaacttctatgctttcaacccggaattcgacaatccggcctgccgttcttaaagaaaagacgcgactgcttcggtctgagaaagcacagacagttaaaacaaacgggggtgttcttcgcacacccccgtctctataactgatggtatctcgttatttcatcagttttttaatcgtctcacacaattcatccacacattcaacatttccttcctggatatcctttaccacgcaggaatgaatatgctcggaaagcagtgtcttattaaacccgttcaaagccgcctgaatcgcctgtacctgaacaaggatatcgatacagtagcgatcctcttccaccatcttcttcacaccgcgaacctgaccttcgatgcggctcagccgattaaccagatcccggtattccttaccttccctgtgctttgtcttttcttcttgcatcctctttcccttgctttctactcatcgtcatcccgttactgccgaagttagagtatccataccctgtcccggtatatattcatactacaatgacagcaagtgtttgtcaagtggctttcccgattttcccaaaaggccttaacttaattgctttgtcagggtaacttccacgtctttctccttgtactctccctgtccctgtgggaactgtacggtcagggtcactttctcaccgatccggtagtaactgagctgctcctgtaagctttccatattattcactccggatccttcgattccggtaatgacacatccctttgtgatacccgcctcagccgcgccgccgcctttcatcactctggaaacatagacgccttccggcatcccgaattgctctgagctctgagaatctacattcgttccttcaataccgatatatcctctccgtgtttccggcacctgtgtcctcgtctctttattcatcaggttagtaatgatatcagtcacatcagaaatcgggatcgcatatcccattccctccactgcagaatcgtttacttttactgtattgattccaatgacctccccccggctgtttaaaagcgctccgccgctgtttcccggattgatggctgcattcgtctgaatcagcttgctgtcaaatccttccatttcaatctcccggtctttggcactgacaatcccgtttgtcacagactgcccatagccaagcgcattgccgatcgcaatcacctcttctccaacgagaagattctccgaatcaccaagtaccgcaactttgatgctgtcctttgtatcgctgctgatctgtttcagcggaacagcaaccaccgccagatccttggtggcatcggtccccttaaccaccgcttccacactcgtttcatcatggaacgtgaccgtcaatgtctgactcttctcgatcacatgattgtttgtcacgatcatcagctctgaatcattctgtcctacaatgattccggatcccgcactcgtctgctcctgctcccggatcccgccgaagaaatcctgtacctgctttacactcatattctggatagagacaacaaacggcatggaattagccgcaatctgcgtgatatcagatcctttcatctccccatccgcagaatctgtcgtctgcaccggctgtacctgggaagaattctgggaactatttcctgtccccaggacttttccggatatataatttaccccctgaaaactcagccctccgactacaccgaataatacagcaagtcccgcgacctttgccgccatggatcctttgccccttttcttcggcggcttcggatgtctgtattctggagatccgtattcggatccattcccggtttgctcttctcccggacgataatattcgtattcttgattcataacatttatcccctttctgacagttatcccttttctactcgatacacagtctatcgaataaatgtgtattttttgtgatgaaatcataaacaaaagctgaattcccttctcggaaatccagctcttttctctattctacagtcacagatttggcaagatttctcggcttatccacatcgcagccacgtcctactgccacataatatccaaataactgaagcggtacaatggcaagagaattcgtgaaaaaccgatttgtctccggaatatagactacataatccgccgccttctccacatccagatttccctcattggtgactgccatgacaaaggcacctcgcgtcttgacctcttccatgttgctgagcatttttttatagagatcctcctgggtcagtaccgctgtaacaagcgttccctcctcaatcaaagaaatcgttccgtgctttaactccccggcagcgtaggcctctgagtgaatataagagacttctttcagcttcagggaaccttccaaagaaatcgcatagtcaattccccgtccgataaaaaaaatgcttctggctgccagataccggttggcaaacttctggatccgatccttatggctgagcaacatctccacctgtgccggaagctttttcagatcttcgatcatctccgctaattcactctcgctgatcgctcctcttgcgtatgcaaagcgcatagccagaaggtataatgcagtcaactgacaggagtaagccttcgtagtcgctaccgcaatctctggtcccgcccaggtgtatagtacattgtccgcttctctggcaatagagcttcctacaacattgacgattccaagcaccttgcatcctttctttttggcttctcttaaagccgccagagaatccgccgtctcaccggactggctgacgacaattacaagggtcccttctgccagaatcggatcccggtatcggaattcggacgctagatccacctctaccgggattctcgccatgccttccaacacatattttcctgtcataccggcgtggtaggcagaaccgcaggctacaatcacgatcttactgaccgcccggatctcctcatcattcatgcccagttcctcgattacgatctgtccgtctttgatccgaggtgaaaatgtatccgcaatcgccttcggctgttcgtacatctcctttaacatgaagtgctcgtatccacccttctccgcagcatcggcatcccagtcaatatgaaccggctttttctgaagaggctcctcatccactgtgaaaaactccatatcttgttcggtgagccttacaatctcttcattctctataaagtagacatctcttgtatatttcagcactgctggtacatctgaggcgataatactgcccccatccgtatgtcctacgatcagcgggctgtccttccggacagcgtagagctcattgggatgctccttaaaaatgataccgagagcataagaaccttccatccggtgcatgatcttcgtcactgcttccagtggatttcccttgtaataataatccagaaggtgtgcgatcacctccgtatctgtctcagatacaaactggtatcctctgccctccaacttctttttcagcttgatgtagttctcgataattccattgtggacgactacaatcgtctcttcggtgttcagatgaggatgggcgttcgtatcagatggggaaccatgtgtcgcccaccgggtatgcccgattccaagtgtacccggcaacaggatgccatcgtgtgtgagctcgctaagtgccttcagacgccctttcgtctttgccacattgatcttctctccgtcaaaaaccgcaatcccggcagaatcatagcccctgtactccagctttgacagaccatccagcaaaatcggtgctgcttcttcttttccaatgtatccaactattccgcacatatttctcctccattttgtacaatcagccgttttttttatacttttagcatcacggccattattttagcaccttccctgccggttgtaaagtattattttctgaaaaacaagattgcaaaacttgtccgaaatatccgtaaagtgcaaaacagcagggcatgtaccctgctgtttcttatcgtttcctttctacagatcaatgaaatcgatagaaaagtcgtcatcatcatctttttgcgtctttttctttttaccacgcccgaacttcttggacggtctggattcctcataattctcttcaaagtcgtcgtaatcgtcatcatagtcatcgtcatagtcggaatcaaaatcgctgtcatcgtcggaggattcttctgtgtagtcatcctcaaagtcctcgtagtcatcttcataatcttcaaactcgtcgtctgcggaggaatcgtattcctcatagtcatcgctgtcaaactgctcaaactcatcaaatccttcttccggcatctggatctttggcagatcatcagactccttcttcatcgaagacttcgtctccggcccctgtgtgcctgatgaagagcgcttttgggtgaggtcatccagctcatcgtacacatcgtccaactccagatttctgcggtgcagcttcactgcaaggatcagaatgagaagaagaagaacgaggaacacaaatcctgctccaatcagtacgacttccacatgatcctgtacaaaagtggtcaccttcccaaagacgccgctgtcagaatcctttccggacgtcgttgccgtcacatcatctccataatactggtatgtctgatccttagaatcatagcggtaaatcgcctgatctccatcagcattcaaaccattcataagataatatctgctgttcttgctgtcctgccatgcaggaagagtctgagtatcggaaagctccaactctacttcctggtatcttgcaggaagcgtcacatcccctctgtcgcccagaagaatcaaagaaccgccagaggcaagattcacaatctgaatcggggaaacgcttccatcctctgcatgataaaggaaaaacgcgcctacattgccggaatccaacaggtataaaagctgtacgttaccattctcttttaccgctccctttaccgtctcgccatttaccgtaatatctgccacggaaaatcccgcaggaagctcattacttgggaaactgcttgctaccgtgtattcggtatcatttacattcagtgtgactttgctgcctgttgccgtgccagaagatgactgcgtcccgtctcctgcctcaatctttacatcggagtatcccggaggatccaaaagatttagtgtctcgccattggcatccgttacttccgcgcctttctgctcaagcctcgtttctccctggacgagcgcctcaaactccatattgaaatccagacgctcctgaccatttacagtcccggaataaactaaagttccatctccctgatctgtgacgtttgcatcaccgtcaacatatctcatggccgtcgtatcgtaactcatcgtcagctcaacctggccaaggtttccgtcacgattcaccacgcttccctgtatggtgaacgtctctccgacctgaatcccgtcaaggtctgtaaagaaaatcactccatctgccgcattgacatacagccgggtaaacggtactaccagacacactgcaagcagtatgcctgccaatcgtttcatcaatttcatatttgtacctcttctttcgtctcagattttgtttacatacataagaatatgatacacggtttacgacgaaatgtccagaaggtatcttgtgaaatccagatacttttccttatatttttcttaaacagattttgaagatcggttatggctccagcctgtgcatgtctctcgggaacagagatgctcttctgacattgctgtatcctaagagctggcttgtaaggcgttccagaccgatccccatacctccgtgaggcggcagccctgcccggtgtgccatgagatagcttgcaaatgattccgggcgcatccccctgcgttgtaactttgccacctgctcttcgtagttatgaattctgaggcctccggtagtaatttccaaaccttgatagagaaggtcaaagcttcttgtcagttccggatgttctttactttccatggtgtagaacggccgctttttctccgggtattccgtcacaaacacaaactcgctgccggtcttttctttgacccattggcagatccttttttcttcctccggctccagatcttcagggtctgtcacctcactgtggcgaatccgcgccacaatctccttgactttcgcaaaaggaatgaccgggatctcctgtaaatccggcagactgaccttgagaagcgcaagttcctcttcatattcctccttcagataagaaaacatcgatttcagcatgtaagtctccgtctccatcagtgtttccacactcgttacatagcccatctccacgtctacactggtgtattcgttgagatgccgggaggtatcgtgtttctccgcccggaacaccggggcaatttcaaagaccctttcatgaactccgaccatcatctgcttataaaactgcggactctgggcaagataggcttcttttccaaagtagtccatacgaaagatatttgctccgccctccgctccggcggaaccgatcttcggagtatggatttccgtaaatccgtactttcggaaaaagatgcgaaatccatccgtaattccgttctggatgcggaaaacagcccgttccttttcatttcgcagtgttaccggacggtagtccaaaagtgtcgcgagagaagtgtccacctctttttgattgatcacaacctggcttatttcataaggttttgagaggatttccacatcaatgagatgaagttctgcccccatacgggaccgctcttccccgacgacttctgcctggaagatcacacagctttcctcaacaagcacttccagcggaaatttcgccttttcttctgaataaacacactggtaaatgtgcttggcgcaacggagcagcacaaacgcaaatcctctcatctttctgattttatagacacttccgtggattcggatcacttctcctatatgctccaaaagattcgtttctgtcaccggtacggagcttcctgtgattttatatatttcattcattcctgattttccttctttctcgtttttgatttctgtttttctctttcccacattttgaacctttcttcgatccgcctgccatccatgtgggcatcgtctttatgtcccatttgatcacaacctttctctatctgtcaggaactcttttgttaccgggaaacaaaaaaacagaaccacacaagactctctccacatcctgtgtgattctgctcttctttttttccacacaggtacaacacaagaagcgcttgtacctgtgaatcgttcacaatacaagcgctacctatcgtcgtccctgtacatacttacaaaattactcactggggtcatacaaaagcagctcctttcgatttcccccattctacaccagagcatttcatattgtcaagcagagaaattattttttttgtatttttcataccgtatttccgaaaactttcttctggaaaaaaatactgcaagccagactcctaaaaatacaattaccagaaacggtgtcacaaaaaagcatacgatcgctccggccacaaaccacaaagcccacaaaaagagttggtttctcgccccggccaccaccagatccgcatcgtagcactttcgtttttccttgggaagctccctgtagcttttgatgagccacacacatttttctcccagaatggtgaacacaactgcgtgtgccacatgcagagccgccatcatcatacagagaaatacagaaattacaattacccgttccatgttccttctcctttgcatcggtcttctattatcttactccgaattttggaaaaggcaagcgttttctcagccaaattatcgttttattgtattagccaacattcgcctgaaacttctgtcttctacctggtcttttgcacacggataacgattgcggccgcaagaagcgcaactccggtaacagcaagatatactttctctttgtagcttccagaaacaagggagaacagataccagttccccagatattttgcccctgccccaaaagagaaaagataatatccaagggatgccatgtatccgatcaccggattatcactcagtgcaaaggccgccgcaccgaatcctcctaagaataccatccccgcaagggaggccataaaatagtttccaaacgggaagtcgcatcctcctctttcaagtcccaggagaaacactcctgtcagagcagccatgacagccacattcaaaaagattcttaccaggtagatacttcccatggacgtatatctggcacggatcagatcccggatggctttatcctgttccggcaaaaagaccgggatcaaaaggagcatccccggaagaaccacataaaaatccaaaagccttgcggtctctccaacgcttaaattgcggactcccgcaaggagaggcgcagccgcaaaaagcatgatactaacgagcgcctgctgtggcagatgatgccggacgtactcttttccggatgcgagatatcttcccatttccccatttcccctttcttcttgcttcaaagatcatagctgctccggtcacaagagcaagcgccagtacaacataaaagatacggtttagcaaaagctgcgaaaactgatcatggaatcctacataattcatctccgtattatgtcttggaatcagattcatcccatactggcccccgtgcatcgtctcctctccggagaagagagaaagaaaccaccatgccgcctgaacaagaactccggctgccgttccggtcagctccgtaaagaacatgccaagggctgtcactacaaggatggtcggcaaaagccatcccaggctgtagacgacaaacgcactcatatgaagatccacatcaatgccttttccaaagcttacgcactccatgagcggatggcaggtaaggagcagtaccggcacaaacatggagaaacaaagcgctgcatatctgctgaagagaattgtaaaagacgaagctttccgcgtgtagatcagctctttcatctgtgctctcttatctcggatctcccttgtcactgccacaaaaaccgggagaatcgccaggatgattcccatatagtcgcagaacaatcttgcatatcctccggtcagtccgtctttttccagaagattatgatactcttccagtgcgtcctcataggtcatctccaccactgcgctgttcttaattgcctctgccgtaaaatcggatcctggtccgagaatcttgcagacttccttcatctcctttaagaatgtttcataagtcaacccgccttttggtttcagagtgtaatttcctgccttgataacactactgccgtccggcatttccactttctgctcttcttcccaggcatcgaagtctttctggagatcttctatcggaagcccggtcatctcttccaggattgtctccactttctgcttctcagaatcattaagattcacatgcttgttaaaaccgatcggtgctgtcgtaaagctgttatgaaaataggattccgcgagattaccaagcgccccttgtatctggtcttccggtttgtcggaaagcttcatgccatagcttccttcctgctctggctgaggctttggttcaaaggtgatcgttcccatctgactgaaaaaaaacagtgccactgccagaatgtagagccagaaaatcaggctcttccacagcatacgacattcctttttaaacaacgtccagatcatgtgaaaatccctccttttcctgcatcagatacagataggcgtcctccacttgtggctcgcaggccgtagcccggatcttcggaggctgctccgccagaaaacggacggtcacattgttgccctgagtcaacatactcgtcaaagtatagttctctttcattctactaagatcttttctgctgatctgagctgtatagactttcccttttgtcatttccaaaagctccgttactgtcccgctgtagtaaagctctccttcatccatgatggctatctgctcacaagtcgcctcaatatccccgacaatatgagtcgataaaatgacaattctctcctccgcgatttcgcacaaaagattccgaaaacgtacacgttcttccgggtccagtcctgccgtaggctcatcgacaatcaacactttaggctcgtggagaatggcctgggcaatcccaagtcttcgtttcatgccgccggagagcgccctgacctttgtccggtattcatcctgaagattcactttctttaataataccgggatcctttctttcctggtctgtctggaaagccccgaaagagctcccagataatccattgcctcatacacccccatatttggatacatggaaaaatcctgcgggaggtatcctgtgatcctgcgaaccttcgctgcttcctctactggaatcccacagatcgtgacctccccgctttgctttttcaacagggtagcaagcaccttcatcagcgtcgtctttccggctccgtttcttcccaggaggccaaacattccggaaggaatcgtaagggtaagatgttttaaggcatgttttcttccgtagtatttatccaggtctttgatcctgatttccatctggttttttctcatctgtctacttcctttcttgttgatatctctatcatacaagggatttccctagattttccctagataagtgaaaggatttctttagatttccttccgaattcggaaagaggctgacaccacagccccatttccactgatacagttggtgtagctgacatctccgccatgtttccggcagagaatagcggaaagattcagaccgattccgaaatgttcctcctttgtaccctcgctgaaatacagatgggaggcatttaacagggcatcttctgaaaatcccggaccatcgtcggagacaaagagatacaatatgtctccttctgtttctgtcaatatttccacatgactttcagcatagcggttagcattagagagcaggttatccagcacctccagaaaaagatcctcgtcaagatacagcttctgatctttcatctgattccggtaacagatccttacctcttttgccatattgagggcgtccaccatccccaaaatccgggccgcaatctcagaggatttctttctgaccggatgaaatggaatctcttccaccgaacggagggatttcatcgtcccactgaagcgctccagccgcccacactgctcagccaaaagtcccagtgtatcctttaatttttcctggctgatcgttccttttggaaggtaacgaacaagaaaatccgaatacccgcggatcaccgtaaggggagtacgtagatcatgggcaaatgctgcattgagctgtttctggtcctccaccagcttccacatttctttttgattttcttccagacttttccgcatttcctcaaacgaagcacaaagtctccccatctcatcctcactcgcataggagaccgtaaaatccagatccttcctgccaatccggtccacagccccctccaggatggtaaacggtttttttagccgcttccggtaaaaaaaggaagcaaacaccagcatcgtgatcactgtatacacaaacggacaccatttggaaatctcctgcaaaaaaatcatcccggtctgctcccaggccgaaagtttccccttctcatggtaataaacataatggcccccatcactggcgtacatagagtccgtatccaaagcatttcgctctaccaggatgtccatccaccgctcgcagacctgggtggtagcaaaactcagcagtaatgcagccacagcagcaatacacagataggcaatcaacgcctttttgatcggaaggttccgaatccatatccgaaacgtttccattttttcatctacccaatccatttataccccactccccagactgtctcaatgtaatcttcctttgttttctgtgcgatcttcccccgaagcctccggatatgctccgtcacaatactgttgtcaccgtttccttccaacccccggaccgcctcgtagatctgctccttactaaacacctgtcttggatgcatggagagaaattccagaatatcaaactccgtctttgtcagacggatctcctccccgtcaaagcgtacactgcgttcatcgtagcgaatccggaaccctttcgtctcctcgctctcctttttgctttgtctgccccgcttctctctccgcagatgggccatgactcttacgcccagctcatcaatagaaaagggctttgtgatataatcatccccaccggagagcagcccgttaatcttatcctgctcctctatcttggcggtaagaaacaaaatcggacagcgcacctcctcccggatctttcggcacacactcataccatccagatctggaagattaatatccagaagaatcagatccggctgcttctttgccagttcgactgcctcccgtccattttccgccgtccaagtctcataccccgtcatctcaaaataatcttttaacagcatccggattcccggttcatcgtctacaatcagtaatcgttccatcgccctttcctccccgttgtttgaactgtcatacactttatagtatacaatatctttccctattttttccctattttctcataacacttcagggcttgtacatcctgtaaaacatgctataatgaaacataggaaaaattacatagtaaaggagaacaatttccatgaaagcttatgaaagattactaaaatatgtcgttgtccgaactccaagcgatgagacaagcgacactgtcccatcctccaaatgtcagtttgatcttgcaggcatccttgttgacgagctgaaagaacttggcgtggaggcacatgtggacgaacagtgctatgtctacggaaagattccggcaactcctggttatgaatcgagtccgaagatcggatttatcgcgcacatggatacggtttctgatttctgtgatcacgaaattgtcccggtactgcacccggattatgacggaaaagatctggtacttggagagagcggacgcaccctggaggtcagcgcattcccgcatcttccggagctaaaaggccgtactctgatcacaacggacggtacgactgtgctgggagccgacgacaaggcgggtatcgctgagattatgaccatgatcgagcggattaacgaagagaacattccgcacggaccgatccgagtagcatttacgccggatgaagaaattggcaccggagcatcccacttcaacgtgccggaatttgatgctgattttggatatactctggatggagatacagagggcgagattcagtatgaaaatttcaatgcctgcaaggcagacttcgagatcaccggattttccgtacatccaggttccagtaaagatacgatgatcaacgcctccctggtggcatgtgaaatcaacaacatgcttccgggctgcgagacccctcgcggaaccgaaggttatgaaggtttctatcatctcgtatccatgagtggagatgtaggaaaagcagagcttcattacttcctgagagaccatgacgccaatatgtttgagtcacgccagaagacacttcgtctgattgagaaagacttaaatgaaaaatggggcgaaggtactgtgaagctgacgatcacccagcagtacaaaaatatgtccaccatcatcaaagactgtatgcatctgatcgaaaatgcaaaaaccgcatgtgaaaatgcaaacgtacctgctcagatccttccgatccgcggcggtacagacggatgtcagttaagtttcaaaggtctcccatgtccgaatttgggaaccggcggacacgcctatcacggcccttacgagcacatcactgtcgagggaatggatctggcgacagacgttgtcatcgagatcgtaaagctttacgcagaacagaactaacatcataaaaaagagtatttctgccggatgtcaaattccggtggaaatactcttttatcccatcctatttagtgtgctttgaatccctctccaagcacttcgttggattccacgataatgatgaacgccttcggatcaatctcttttactacctttcggatcccgtacatttctttattgttgcaggcacaaagcacaacgtcacgctccacacgggagtagcttccttccgcctttaaaaaggtacatccgcgtcccacttcctgatcaatccgctccgcgacttctttcgggaagtctgttacaatcaaagacattttaccggcatcaattccgtacatcatcttatccacaaccgcggataaaaggaaactgatcaccattccataaatcaggctgtcaatatctctggaaacaagaagcgttccgagcaatacgacaagcgcctccaatgcaaaagaaatctttccaagggacaaatgtggattcagtgccttgatggaaagcatgatgaagtcagatcctccggtagacgtatttctcatgtagatcatcgcatagccaagcccggaaaaaacccccgtacagatcgctgccagcatccggtcgccagtgtagactggaaacatcggcgccaccacgtccataattacggatgtgataatgatcgtccgaatagaacgaataaaaaagtcttttcccagaatccggaagcagacgatcgccaccggaatatttaacagcatcgccaccgtaccgatcggcagaccaaacaggtgatagaaaatcagggcgattccgttaaatcctaccatcgggaactttgccatagcagcaaaattgtacgttccaatggcaatcagaattccccctataatgtcgatcagtatatccatgcctagtttttttgtatccagtttcttcatcacagattctcctttccagtatgtcttcactttacgccaaaaaaataacatctgcaaactataaattataattcgcaaatgctcttccagaaaatagtatactatttttctttttttcttgtcaaccccttttctttacttttccgttcaacctgactataatgaaagaaaaagatcacaaggaggtcctatatgaaactcgtctttctggacgccaaaaccattggctccgacatcaatctgtctgccttcgaaactttgggcgaagttgtctactatgatttcactaccccggacgaagccagtattagaagcagggacgccgacgtcctcatcgtcaataaaacagaaatcaacgcaaaaaccattggggaggcatcccacttaaagctgatatgtgtgactgctactgggacaaacaatctggacaaagactatctcaaaagccgtggcatagcatggcgcaatgtggcaggatactccacagattcggtggcacagcacacctttgccatgctcttttatctgctggagaagatgcgctactatgacgactatgtaaaagaagaacgctacgtgagcgaccggattttcactcattttgccgaacattttcacgaacttgcctccatgcgcttcgggatcatcggacttggaaatattgggcgaaaggttgcacagattgcctccgccttcggtgcagacgtcgtatactactctgcttcccaccagccgcctcaggagggctatcatcaggtagaccttgacactctgcttgccacctccgatatcatctccatccatgcgccgctgaccgtccatacacagggacttatcaattccgctgcccttgagaaaatgaaaccatctgccatcctcttaaatcttggacggggaccgatcgtcgtggaaacagatcttgcaaacgccctcaaaaaggggaccatcgccgccgctggactcgatgtattaagccaggagcccatgacggatgacaatcccctcctttccatcaaagacagcaaaaagcttcttattaccccccatgttgcttgggcggcaatagaggcacgaacccgtctgatggagattatttatggccagataaaagactttttttccatttcctgatagtctttcctatttctgccgtggctgcggctgctgcaacgacagccgctccgcccatcaaacaaaaatcccccagattaaaggtgatctttctgatctgcgggtccgccgcttcaaatccgatataatccaccacatagccccttttcagacggtcatacagattgctgaccgctccggagagcatgagggatgtccctgcaaatttccattttccctttttggaaaacaaaagcttcatgtaatatatcagcaacaggattcctgctcccagggagcctccctttacaagcctatcctcaccgctcagcgtccccagggcgaaaccgtagttgtgaaccttgcgaatccggatcttccccccgaacatctcctcttcctttgcgctgtccggacgcttttcgatgcggtctttccagaacaaatccaatgtcgaaaaggcagcgcttatggtaacgatccattttttcatttgctcttattctcctttgatccggtcaatctcctttttcagatcctcaatctgctcctgtctcctctcaatagcctcgcagaattcaatacagcactcgtctgtcaactcgtgattttcaaacttttcatacacagacttcccaatatccacatagtcacgctcattagcacgctctaaggtgcggatctgactttttaatttctccctgtcccagatctcattggtcttcttccctacgatatcggctgtttcagaaagctttttaccaagttcgtcaaaaaaatgatccattgtttttcctcctttataactgccggatttcctcaaaagtatgatacaaatccatggtaccgtacccccacaaccggtttggatattcgatccctgggttcctcctcgttccaagtatcaatatattgcgaatttgtgacgaggaagcctgggctccctgatcctgtataatccactgtaaaagcagcgccgcgctccctgccgcaatggcaattccaacgctggagcctgaccgctccgtaaagctccccccagggatggccccggtcacattgactccggggacggcaaattccggcttaatgttcctgtctctagtatatcccctgccggactgaaccgcaactgaattttcctcccagttatagaaagcggccgtaatcgcagacggggtgctccccggttccagcatcgtttcatccgggcttggccgcaggaaatacacctctccggtcagaaattctgagaccggaagccagatgtgaaaaagtccgtcaatgctctgaagcggctccagaccgatcttccagattccctccgccgggtcgataaaccgtaggataatcagctctgaattggtacgttccaccaaaagccggtaatcgatgatgaccgtcgtcttttccagaaaaaagcgatactcatttctactgttctggcggataggcactttctggatcatctcacctgatggcgagaccagagatactgccaggacattgggaatatctgtccagatctccgcctgaaatcctttgaccccctctcctacccgaagctctaccatctcccgatccccctggatcctcgtctctccctggtagtgatgacgcttatccgcctcgttgcccgtccccgtcaccaccacccggtctctgccgttagcgtaattttccaactcctcgcagataggtgccgttccgttatgccctccgagactgcatccaagcggtacgcagatcacaagcggcctgtcgtatttccgggcaagctgatccaggtaataaagtcccgccagcatatcattttcctgaaaggcaatcgctccctcccggataaaataaaaatcccgcagatactgtttggcaggctttaactttaccatggcaatcatcgcctccggcgccgcccccacaaactgattctccacattggcgctccctgccgccacgcttgccgtaaatgtcccgtgtccgtcctcgtcccttgtcggcacaaaggaaaacgggtcctcctgacgcaacgccttattaatatcttccctcgtataagcgctgccatagcagaaaccctcaggcggattcccatcctgaatcgtctgatcccaaattccaagaatccttgtagatccgtccagcccccgaaatactgcgtttggatagtcaattcccgtatccagaaatccgatgagcatctcctgaccctttaattccagaccgggataattctggacggctgtaatccctgccgcattgagtgctcccatatcaaggggggtatagcatctgggaatggaatagtagggaatcatgttttccggaaagcgctctgcctcctcctgtgggagatacacatttttatagtgtactcccgcaggctgggtcagataagttccctccctcagatacggtaaaaaacgatctgtaagcataaagtcccggtagtcctctgaaagcacggcctccctgcactgttcttcttccataaaaaacctacacatactttttatcagtatatgtaggtttcttctttcttatttcactttttacctgccaagccttgtggtcgtattctgctctaacatcggcacttcctgtcccctcagccggatcaccgggccgccggtaccctctatgtaagctcttgtaatgatgacttcaccgatactgtcatcctttggaatctcatacataatatccagcatgaattcctcaatgatcgcccgcagagctctggctcctgtatccttttccattgctttctctgcaatagcatacagagcgtcatcctcgaactccagacgcacttcgtcaagtgccagaagcttctgatactgcttgagaatcgcgtttctgggctcctttaaaatcttgacaaacatctcccgatccagactctggagtgtacagattaccggaagccgtcctaaaaactcaggaatcatcccaaagtttctcagatcctctaccgtcactttggatagaagattcttgtcgtggtcgtatttgtccttcagatccgcaataaatccaatggaggactgcttattcaggcgctctttaatgatctgctccagtcccgggaacgctccgccacagatgaaaagaatattcctcgtattgaccgtggtgagtggaaccatggcattcttactgttggctcccaccggcacctccacatcgctgccttccagaagcttcaacattccctgctgtacagactccccgctgacatctctttgattggtgtttttcttcttggcgatcttgtcgatctcatccacaaagataatcccccgctctgccttctcgacgtcgttgtccgccgcggcgagaagcttggatacgagactctcgatatcatccccgatatacccagcctctgtaagagacgtagcgtctgtaatggcaagcggcacatcgagaagtctcgccaaggtcttgaccagataagttttaccggagcctgtcgggccaagcataaggatattggacttttcgatctctatatcgtccatcgtatccgtcaccacccgcttgtaatggttataaaccgcaacggagatgatcttcttcgcctgttcctgcccgatcacataatcgtcaagctttgccttgatcttgtgaggagccggaatattacgaagatccagctccggcgcctcatccttttctttcttttcttttttcttcttaaccttctgctgctttggcatcatattctccagatcctgcatatttaaaatctggactcccggcatccgcatcagttggttcaaatcgatctgcccgttattcatcagatcaaaacttttctgcatacagtctgggcagacatatagattattcggaagctctatcatcttacctgtcacgctctccgggcggtggcagatggagcacagtttctcatattctctgtcgtccttagacgtatcttctacaacgcctttgacagcttcttcgagtttctggtcttctgttttttcttcgtcgatcgttgtattcttttcctctgacatttgctaaaaccccttctatactgattttacagcacgttatagaagttattatagaccagatatcacgcccggacaagtaaagattttctaaactgagaagttactcttctatccactcttttaactcatcttccatcaggacgccggaatgacgttttaaagcttctccgttttcaaacagaaccactgtcgggatgcttaagatccggtactgctttgcaagctctctgttctcatccacattgatctttccaattttcactgcatccgtcttctccgcataggaatgaagaatcgggatgaatgtctgacatggtccgcaccactctgcccagaaatcgatgagtaccggtttgtcagactgtaatacctccgtctcaaaattctcctgtgtgatttttaatacttctgccatttatgtttcctcctttttggttacggttcagccatgtacaaagtcataaaacctaaactcaaacttgctgcaatcgagccgtcatagctgaactgtttcttttttcttttattatacctgattttccattgttttccgtaacaaagtcaccaacagatgcgcttagcgtagactgtccccggccagttcgtagagccgctcttcgtcgaggacgcgaatcttacctcgggatagaagcacaagcccctcctgctgaaaatatcgcagcatgcgggtgacgacctcccttgcagatccaagctccctcgccgcccggtcgtgagtaagcgaaaattccattttacctgaattttttgcctcttcaatcagaaaagccgccaaacgcttatccacactttttccgagaatctgctccatcgtccacatcacatcagaaaaccgctctgccattagttcgttagtatatttcatcaccgaaagtgaagtatccatcagctcctgataggcatacggcgggatcacccagtagatggtctcctcccttgcctccatccagatttcaaagtcgatggtacggaaaatacagcttgcggccagaaggcacagatcccgctcaaacatcctgtacactgtgatctctttgccctccccggatgtcacaaaagcccttagctgtccgcatttaacgataacaaatcccaggcagtcagcgtttccccggtggataatctcgcctttcttcgcggttttgagtaccgcttccctcaggattttctcctgttgcggctggctaagctgtttccagaaaggcagatatgcttctatctcattttctgcacgatttcccatttttatccctcattttccatcatctttagaaaatcttcctccgaaagaatcggaatatcaagctcctttgcctttcggttcttggaagacatagactccgtgtcattattaatcaggtagcttgtcttggaggtgacagagcctgtcaccttgccccccctcttctcaatctcttcctttatctcattacggttcttaaaatgatgaactgatcccgtgatgacaaactgtatcccggtgaaaatctgtgcttccctcgtctcctcttttgtaagtttcacttcttttagaagcttctcatagccggcacgtctgtcctgatcctgaaaatagtctgtgaatgacccggcaatcacatcaccgataccgccgatctcactgagctcctctctggttgcgtctgccgttctctgcggatcctcgtcaaactgcttacagatcagtttcgccgtagctgctcccacattttcaatgcccagggcatagatcagccttgcaagggttgtctccctggatgtctcaatactgtctaacaagttttgacaagatttttctccaaatccctccatcttcctgatctcctccctgtgctgatccagatgatagatatccgcaaattcatggataaaaccttttgcgataaacttctccatcgttgcctcggaaaggccgtcaatattcatggcgtcccggctcacaaagagggtgaacgccttgatctgtttggcctgacacagcggattcgtgcagtagagcgccctggcatttaaaatctgccggaccttggtcctgccaccgcagaccgggcaggattccggtacgtccttcaccccgcttcttgtcagattttccgcaatctgcggaataatcatattggccttgtacacctggatcgtgtctcccacaccaagctccagctcctccataatactgatattgtggacactggctctcgatacggttgtcccctccagctccacgggatcaaaaatcgccaccggattgataagccctgtccgagacggactccactcaatctccttcagcgtcgtctcccgaatctcgtccgcccatttaaaagcgaaagaatcccgcggaaatttggccgtacttccaagtgactctccgtaggcaatgtcatcataaacaagcacaagcccgtcggatggcacctcgtttttctggacctgacccgcaaaccacgccacctcctcttccacgctttttgcggtcacgagatggtattccacggtctcaaatccctgttctttcaaccactccatctgccgtgctctggaattttcaaaatccacaccttcggcccgaacaagggagaatgcatagaaatggacatttctcctggccgtaatttcattattgagctgacgcaccgacccactgcaaagattcctcggattcttgtatttggcgtccacatcctcgatctcttcattgatcttctcaaaatcatcgtaccggatcaccgcctcaccccgcaggatgagttccccctggtacgaaattttcaacggaatatttctgaacactttcgcattgttggtgacaacctcaccgatttccccgtttccacgagtaactgccttatataaagctccatcccggtaagtcagaacgatcgtaaggccatccattttccaggaaatcaatgctttctgatcccccagaaattctttaagacgttccacttccttcgtcttatccagagacagcatcggccgctcgtgccgctctttcgggagctcactcaccacctcgtaacccacatgaaccgtcggactcgccgccaaggtcgtatgaagcttgtcctccagtgctacaagctcatcgtacagtctgtcatactcgtaattactcattatttcccgcgcctcctggtagtaagcgcgccctgcttcattgagcagtttcacgagttcctccattctccgcttcttttcttccagacttgcatctatctttgtcatgttcttggtctcctgttcccttttctttctctgcgaccggttgaacgcctgactttcaccggctgattggtggaatattccagcatactgctaagctcctccagctcctgctctgtaagtttccggtactgtccgggcttaagatctcccagtcggacccccataatccgcacccgctttaatgtgattacctgatatcccagcgcctcacacatccggcggatctgccggttgagcccctgagtcaggatgatccgaaatgtgcgcttcccttcctttttaatctggcatggtcttgtcacggtgtccagaatcgggacacctcctgccattttctctaaaaatgtgtccgtcatcggtttatttaccgtgacaaggtattctttctcatggtaatttccggcacgcatcatcttattgataatatcgccattattggtcatcaaaagcagtccctctgagtccttatcaagcctcccggcgtaggtaatcctcgtgggataattgagataacggatgatattgtccggttcacgcttttcttcggtgcagacaatccctcttggtttattgaccgccaacacaatcattttctcctccggtgtgatcactttcccatccaccatcacttcctgtccggaggaaattttcatccccatgacggccgcttccccatccaccatcactcgtccttcttcaatcaggcggtccgcctccctcctggaacagacgcccgattcgcttaaatatttattcagacgaaaggactccctcatggaacgctcctgaaactgtctttctatctggctgttcatacgattgatgactcccctttttctaaaactacgttatctctatcttacttagaacagccccaaaagtcaacggacgccccaaacaagactatatctttttttccccacttctgatatactgatacaaagaacaacaaaatttcttaacattatgaaacgatgatgcctggaggctatctatgatcagctacattatgaatacaaaaaactgcatgtccgtccttcttctgtccgaccgcttcgacagtttctccttcatcggaggggaaatcactacctactgcacctttcagatcgacgggacatatcacccggaattcttcgcggacaaagaagacgccggaagcgagccgtacgtacgctggagctatgtacgggaatactgtctttcactcatcaaagggaaacagacgcccttgcgtttccactttatcctatccctttcaccggatcagatcgaagcactcctgcaaagagcagatctcccttaccggtccggcgatatcaaaggtctttacctcaacttccgctttgatggcacccgtctgctctgcaccaccggaacctcttttcacacatttgtactggataagagtctggagcatctgtgggatggcacagtgatgaaactgtttgcgtccaaaggactggaatttgaagaacatggttaaatagatagctttacatagaggcaggtgcgatttcatacaaaatcacacctgcctctatctgttagaggtaaaaaatcggtattaccgacatcccccttttcattaaaaaacattttattttgtcagcatcaacatgatatcgttacttctcttgatgaagtctgtcatctgttccgggctgagcggtttgttggagagcattgcaagatcgtaaagctgctggcagatgatattgatgttctcgctgtctttattgttttcgatatactgtaccagtgggtggttgatgttcagtaccagtgtcgtatcgcttccaaacatggaggcgtccatgccgcccattccgtacatcttcatcatttcctgcattcttctggactcttcagaaagggtcatcatggatgcgatgttttcgtctttgatcttttccactttgacctgaaggttttcgttgttcatcgctttcttgacgatagaagcgatctcctcagcccgttttccaaatgcttccttttcttcctcaccgacttcctcttttacttgatctgtcacatctgcgtcaattctctggaagtggatatgctggtttctctgctccaactgtgtgataaacggtgcgtcaatgttgtgcgaaagtatgacagcatccataccctggctcttaaagagattgatatactggctctgctgctgttcatctgtcacgtagtagatcgtcttcttctccgtctcttttgcttcttccttgtttccaccgtcctctgtctttgcttcttccggtacttctccgatcagctctttcatggacagatatttgtgatccagattcttaaagagaatggagtccatcatcttatcacagaatttctgatccttaaggcatccgaattttacaaaaggactgatatcgtcccagtatttctcgtagttttccaagtcagtattgcacattccggtgagtttatccgccactttcttggaaatatactctgccaccttattgacgaatccgtcattctgcagtgcgcttcgtgatacgttcaacggaagatccggacagtcgatgacaccttttaagagcatcagatattccggaatgatctccttgatattgtcggcgataaacacctgattgttatacagtttgattgttccttcgatagaatcgtactccgtgttgatcttcgggaaataaagaattccttttagattgaacggataatccatattcagatgaatccagaacaatggctccttatagtccaggaatacttttctataaaattcaatataatcttctttgctacattcgttcgggtgctttgcccagagcggatgaatatcgttgatcggaaccgggcgcttctcgattttgactttctctttcgccggagagacttctaccatctctttttcaccctgctcgttttctttttcttccatcttggcatcttcgtgaatgtgctctacgacaacgtccgtatctttcagttcactctcgtcaatagtctcatattcgattggggcattggccttttccagataaatctccaccggcatgaaagaacagtatttctccagaacttctcttgcccggtattcgttcgcaaactgtaggctgtcctcatttaagaagagggtgatctctgttccgacgccctctttactgcctgcctgcatctcgtactccgtgccgccttcgctgacccagtgtaccggctcggctccctctttataggaaagggtatcaatgtgtacttcatccgccaccatgaacgcagaataaaatccaagtccgaagtggccgatcatgtcgtcctctgtcgtcttgtctttgtacttttccagaaactgagtcgctccggaaaaagcgatctgagtaatgtactcctctacttcttctgccgtcataccaattccgttgtcaataaacttcaacgtcttttcttccgggtttactactacatgaatttgcggcttgtagtcctcagaaaggttgtactcgcccatcatatccagctttttcagctttgtgatggcgtcacatccgtttgaaatcatctcacgaaagaaaatgtcgtggtcagaataaacccacttctttataataggaaaaatattttcactgctgatggaaagacttccttttttcactgacatgatatatcactccttcatcatctatcctgccggagtcagccttttacaatcttattataatctgaactgtctctccggcatgtctttttcacatctaactgttatcttaatacccgcctgcgaaaaagtcaatagaaaattagcactcttttaaaaagagtgctaataatacctcttcgggatacggctctcgcacggcacttttgtctgacattttccgcacccataccgtggagcgtacatcttcttcgttgattccagaaatgtatcacatgggctatgcctctttcccccttccatagaaatcgctcctgcggggcagcgccgaatacacgccccgcaccgtgtacagtactcatatagatccgtatatttccgctttctcgcctcaaatgtttccgttacaatcaggctccccaatctcccggccatccctttctctgtaatgatccccttggaaagaccaaaagttccaagtccacagacaaaggcgacatgacgctcggaccagttactcgtataagacgcatcctgccagtttcctactcttttgggatctggctttgtcacgctgcaaaaccgcccatccgcagcaggaatcacactctcaattcccttctatcccaagtattttctggatctccttacaaaatgccattacaaaccgctggccctctatccgggcgtgcagccacaaagcggacggctccggtcccggagtacgattactgctcctgacttcttctgtaaaagggagaaaaaagctcatcacactgttcgcttttggaagccattcttccggcaataaaaactgcggtccaaccgcttccttctttttcagttcttgaaacatcggatctttggcgtccccatatccccagaccgggggatcaaagatccgcgccccggcaagttctggtgcaatcgcctcttccagagatacgacatttcttctgctctccgccacaaactgcgccgcctgcttttccatatcttcttttttcatatcctctgtcccctctcttcctttctggctctgctttcaaaataaaggaaacgctcaatcgagtccaggatatcccgaaactcctccctcggtgccagctcaatataacgttccagaaggtctgtctcctgctttttgtatcttccataaaaaatatcatacagattgtgtccccggatatgaatccgaatctcctccatgtgggctttcacatcctccactgtctccaaatccttccccagaacctctcgcagcttctttccactacggattttatgcagatactccttccatttttccaaaaacatctcataaaatgcttcctcggacggcacgaccccaagaagtgccataattttaggattcaaaaaataattttcaaaagaataatatttgaggatgagaacattcttctccgtcacccgtggaagccggtccacatcttccagattccgctcttcgtaatactggcatagctgccgtttcaattcgttcgcgtctttcccatccccatcccggatcataagaaaattgtcctgaagataaatctgattcatgtatttcaggttggcgtacgtcttaatattcgtacaactattggtggtaatgatcgcaatcctggaaagtgtcccgtcctcctcgtacgtctcatcatagtatttcttaatcagaagcggcaacctgctcttatcctgtttgccctccacgataaaaacaaaatttacattcatcagatcattggcagaataccccagatcatccagcaccccactgatatccgtccgctccttcacttccgatgtaccatcctttccgacaagcacctgtcggatctctctgctgttgaaatttgccagcagattaggggcatgcgtcgaaaagatcacctggcttgttctggaaagccggtaaagaatatctcctgtcactctctgaagcttcggatgcaggtaaatctccggatcctccacaaggatcacatccgtcccctcctcctttgtctcctcacatgtttccaaaagagacaacatataaatgcttctcattcctttccccatcgtatccatactccgggccatcttctcatcttcccggcagatctccgtggtaacggaaagcatcttctccagatcccggttcatggaataacggatcgtctcttttcccccgttcttacggaaattggtgttgacccgtctggaaaactcatccagattaagctggtagagcttatgctccaaaagctttgcagcctcgaaagcattgaggcttgctgtttccttcttatgaatcaacccgatacaggagaaacaatgattgcagactttccccatgtcaaacatgcagttgccagccctcatccgtttgacaaggtcatcctcctgcatcagcaaaagatcttcctcaaaattttccagatcacgctgtgcgtcaatgtaatacagcttcgggagcagcatcgggatataacgattatgcttggaaatcccgtctccgtaccggctcttcccttcccggtttgccgtaaactcaaatgttacttctccgtccttaaaagagggaatcttcctgccaaaatcccggcgccacgattcgtaccgccgataagaactgacaataccgtgatggtacatccgctgtaaatcctcttctcccaccgtcagtgtcagcatgatctcaatattgggataatcctcccggaaatcctcttttcgcacctgataactcccggctacggcacgcaaggcatccagtaccgccgtttttccagtgctgttctggccaactaaaatcagcgcctgttcaatatcgggaatgtgaatttcccggatcgatttgaaattccgtatccggatatccttgatcctcatggaatcaccttctttcttcctactcctattgtagcaggaagcctccatccctgccagccataatcctcctccaaaggcaaagaagaaaggacagcgggagaaaactctcttcccacgctgtccgtctgccttcgtttcatctttgttttcttttatttggatatcgtctcccctgcttccactgcattgattttctcccggatggacgcaaccgatgtgtcatccggcacaatcacagaaagcggacctccggaataggaatagcagtactgcgtggaagaagttccttccgccgcaacggatatgacgttccatcctttcattcccgcaagctgtactctgacaagctcctggagctgacttgtagacatattcgtctctgtgttaccactgacctggtcaataagacgcggtcccttaatcagaatcgatggagacatagcctttttcaacatcgcttcaatgactgcctgctggttctttcccctctgattatccccctctgccaaagcatgacgctccctgcagaaagccagggcttcttttccattaaaatgattgagcccttcctttacttccacaaccatgccggaatcattgcccgtcgtaaaggccagctcagaatctacgtcaatcccgccaaggatatctaccatctcgatcagagatgtaaagttcacacgtacatagaaaggaatatccacctgataaagctcctccagggttgccatagaagtggcgatcccataagtaccagcatgggtcagcttatccggcgctccgtttgacacgcccggaatcggcacatagtaatctctcggcgttgtcacaagcaggatctgctttgtctttggattcactgtggcaataatattcacgtcgcttcggctctgctgagtgatatctccatacacatcaatcccactgatataaacactgaacggttcttccgatacattcaccgcagcggcagcttcctttcgctcaggagcctcgtttccgtcggtgatatcattcaacgctgtacgcacttcaaacatatagtaagatgcaagcaacagcagagcactgatcagcagccccagaatgcctcccaggaacctctttttccggaatccgttctgcatccgaaaaatcagaagcgccagcacaagcagcacgactgccgctccccccagaaatgtccacgggatcattccgaaatagactgctgttcccagaaagaccgccgtcgcaatcatctgaatcaaaaaaatcagtctgccatgtaatcttttggtatgtctcccccctgccggacctggctcgcgccctctgtatccggaggaagaactgcgctttttacgggtaccaaatccgagatcttccggcatccgggtccgccttggccgctcctcatattcataatcatcatcatcgtaatcattatagtcatcatatccatacgaatcgtaatcgtcataatcatcgtatgtatcataggcgcgactgcggtcatagctgtcataatcgatataacgactgcttctgcgattacgaatatcattctcatcgatctcattgccatcgtaatcggtataccgactcctggaacgtctgcctgacgtcctcgtcgtattgcgggagctgctggaatttcttttcttagtagaactgccctgcttctttctcttcttcagggcctgctcgtaagccagtctctcctgacgactcattttagacatattacatcttcccttttctcttatttattccctcgttagattatagcccgtcccacaaaaggaagtcaaggacaagggtacactttacaaaatcaggtagaaagccggaaccctgataaatcccgtatttacgcaggtttccggctctgaatgaaattccgtttcacaaaatattaagaaagttgtcagatttttgtacttttatctggcgctgtcctcccatttccgatagattgcttccagggcgtccgtcaccccctccactccgagaagacttgcattgaacaacataccgtgcgcctcaatacttccccattctcttccggtatgggcctcgtagtatgtttttctgtcccggtccatcttcttgatcttatcccatgcctgcctggaatctaatccgtaaatcttcataatacggcggattctgtcctccttatatgcatagataaagctgtgaatacaattactgtaatctcccagaatataatctgcacatcttcccacgaaaatgcatggtccccggtcagcaagacggttgatgatactgctctgcacttcatagaccttatcacttaacggcaccgactcattactgtcgttgataaataccgtataatcccgcatattaaccacataggcagacaaaaactttccgaggatcgtctcatccaccttctccgccgcctcctgactgattgacaactcatgcgccgccatagagatcagattattgtcatacagcggaatattcagtctctctgaaagccggttgccaatctcatgtcctccgctgccaaattgcctgacgattgtaataatagtatgattcgtcatattcccacactccttttcccactctatagtgaaaccatgactgctactctctcttctttttgtggatctgaagctgcagattgaccgacatcggattgatcaccacgccctttgtctccggcgccagcagatccggaatcttctctgccggaatcactgccgttcgaaagcggttctccctgttaaacttttggaactccagtacgtcggtaaataccggctggtaggagtcttccttcttatcttttaaaagcggcactcccttgtccgcctcaaacgccacaatataacggcctctggagaaatgtgccatcacttcttcctgtaactgtttgacctccgattctccttcaccctggtgcagtctctgggtcttctgcatcaggtataatgccgtcaggacaagctccggattctctacacgaatcttgccctccggaagttcttctgtatccgccctatgtacaatctccgaaagctggagactaatctcactttccaatccctggccgataacgacacagttgactcccattgcgtatagatttgagaaaaaccgcaggagctgcttattctccacttttacaaggcttacaggttccttttttgcagcaagcgccttagcggcattctgcgcgtcttccagtttcatgtatacgagaacctcatcatcaaatgtatccggatcacagattacatatggcatccttgtgcaggcagatgcaatcgtataaacctccggggccctctgaatattgcggatcgcctcctgtttttgaggcgtcagtgttccatttttcttctcatcactcatggtcgatcttgtcctttctgtatcattcctgtacagatatagtataaacgatttcccgaaaacctacaatttctttctgccctttcttcggttcctatttcttgatatgaatgtggctcaagaagatgaacagtgccatccccagtgccaggatgtatccaaaagccccaagcgccgggatcccccagatttggggcttcatatccgtagtacaaatgatactggaactgatcaaaagcgccatggccagaaatcccatgaccagtctctttacaatcctggaaagcatctcgtttaagtcatccgcggcgtgcagatccaggttaatccggttctggcctttcagaaatccgtgcaggatatctgccgtcagtgccggaatatcgagtgctttgtgaagagaacggtacatgcttctggcatttttcttcaatgacttcttaaagtccttccccagataaaaatttcctgccatacgggcagcagcaatgtccaccatattgatctccggcgcaagatccgcaaggacaccttccatatgggtcagcccccttgccagcatcgtcagaccgtgaggcatccggatcttgttcttcttcatcacttccatcaaatcctgaatcacatccgccaaatcgatatttcccatatcggtagtaccgtacttagacaacaggtctccaatgtcccgatacagctcactctgatccggccgcccctggaactctcccagcgccatcaccacttccagaatcaatgccacatcattggccgccacaccctttaccgcctcggcgatcagatccttgtccctctcggtcagccgtcccatcatccccatgtcaatccagataattttcccatcccgtatccgcacattacccggatgtggatccgcatggaaaaatccgtcatccatgacctgcttgatataattgtccacgagcttcgttccgatctccttcagatcgtatccttcttccagaagacgctctttttcatggatcccaaatccatcaatatactccatcaccaggacatgggtcgttgtatattctttaaaaagagccggtgtcccaacaaaggcgatgtcctcattttttctggaaaactcctccatattggcagcttcgattaggaaattcatctcctcctgggtgacagtccacagctcgtccagcaccatatccagatccacaagtcctttcatgctgatcggaggcaggagccgtactgctttgtgaagtagaccaatgtcgcgggacataatatcgtaaattccttttctctgcactttaacgacaaccttctcacctgtctttaatactgccctgtgcacctgggcgatcgaggcagatccctgtgggatcggttcaatctgctcaaagacctcggtgtacgggcatccgtaagcctcctccagcacctcctgtaccttctcaaagggcatcggagctacttccgaccgaagtctcatcagctcatcacagtatttcttcggaagaatgtcggaatgcatggaagcaatctgaccaagcttgatataggtcggtcccagctcctccagaatcagtcgaagcttctccggagtcacgccccgggaaatctcgtgtttgtgaagcacggatgtaatctcttttaatcgttttccatacttttccgatgattgaccattcattgaagctattctgtctctcctttatcttcttctgtctgtttttctggcgtctccatcttcgcaatggcttctttcagatccgccaactgctccggtgtcatctttccaatcatctcctgcagctcttctggggaattcggtttgagagatacattgactttctccttcattgtctgtcggatattgtgcttaagctcttcattaagtactttcccctgctcgacagtcagttcaccttttttcaccatctcatccagaagttccttggatttctccgctgtcacagcgacggcacctactccggcaagcatcactttctttaagttttctcctaatccatccatatgtattctcctctcttatatcgtaatcagatccatgtaacaacatgtggaacaaaaatcagcaaccccacaatcaccgaggcaatcgcagcgatcagaaccgctccggccgccgtatctttggcgatctttgccaaaggcttcttctcctctgtcgccagatctactaccgcctccacggctgtattgacaagctccaacgacaggacgagagcgcacatgatcatgcaaatacaccattctaccacagtcagcttcgctacgattccggcaatcagaaccaaaacaagcgccatacagtgaactttcatatttcgctctttgcggattccggtccagatacccgaaaacgcatatccaaaacttctccacagcggattttttctgtcacccggcatattcatcatcccctatcttttgttcccgtttttctgctccactaatttattattattttatcaaagttctcacaaattatctagtctttccctattattttttttattttcagaatttttatttttttcaaatctctattgataaaatgcaaagaatcgtgcacaatgaaaacatctgacaaaccaaaaaaggagatttgaaatgaaattatatattgcttatggcagcaacctgcacaaacaacaaatggaaaagcgctgtcctgatgcagttccacacgctgttggaacgctgaatggatgggaacttgtctaccgcggagtcaatccgaacagaatctatgccactctccaacaaaaggaaggagcctctaccccggtagttctttgggaaatcacaccgaaagacgagacaaatctggacgagtacgaagattatcctacgctctactataaacaggatattcccgtgacacttactgatggaaccaccatactggctatggtttatcttatgacggatcaggccacacctggccgcccttcggacacctatattcagacgatccgggaaggatacgaagactttgatctggatctgtccgtttttgaagcatctctcaagcacggatgctgttagaatagctataaaaggaaaggagagatcacaatatgattttatcagataagacaattatggcgatgctgggggaaggctcccttgccatctttcccatagaaagcggacagattcagcctgccagcgtcgatattcgtctcgggactacttttagtgttgtggaggatacttccagcggcatcattagtatggacaatcagatctcatacaaaacgatccagactgagaggtacctattactgccaggacagtttgtcctcgccaccacaatggaatacatttccctgccaaacgatctgactgcttttgtcgagggcagaagctctttaggaaggatgggtctcttcatccagaacgcgggatgggtcgatccaggattcgagggagagatcacactggaactatttaacgccaaccgttgtgccatagagctccaggccggccgacgggtaggtcagcttgtgtttgctaaaatggatgcctgcgctctgcatccgtacaacgggaaataccagggacagactggcgccaccgggtcaaaagcctttctggatccggacagacacaaagaataggaaatctgtcgtttatatggagaagagaatgatatatgaaaattttactttatttctcttccccattgcagtattcccacagagatcagaagaattccaccgatcatccatgtcgtctcaatggaaaaccaagctgccagttttcccataataagcatggagatatagttgaagatactcactatcatcgaatgaaaagatagaaccgttgcacggtttccatgactgatttctgtgtttaaaaccgtctcttttaacggataaatcacaccgaggaacgcttcaaaaagcaggattccgatcagcagactccaaaacgtatgcagaaatgccagtccaagtatactgattccgcaaaatgtacttgttatcgcaagggccaaaaaggatctgcgctttactctttccagcaccgcatttccgcccagcatcgccacccggatcagaacccacgcaaatccgatgatcgtataattcacatgttcaaaccgatgaagcattgttttctttctttgtacttatgatctccaattttggcatcattactaaactgatcccgatataacataccgatgagatcaatgcaaacagaaagatcccctccaggaaccagtccgcgataacacctccaagcagccctgaaaggatcatcataatggaaagacatttgttcttcttgagaaacaccgtcttactctcgctgactgatgtattatcaatcacccatgcatccaaagttccggattcaaaagcgcaggcaaaccccaaacagatctgtgcagccagaaatgccatcataccatttccaaagaaaaacagtacattcgtagctgccatcaaaacaccgctcaaagctgtcgttttcacataaccgatctgatccgccatcgcccccgccggaatctccataaaaaagactgcgatcagagacgttgccaccacaaaattcgtctccaccgcatccagccccttgctgtacaaaaacaaaacaaacgtcgctcctgtgatcccggcataaaactcaaacagacagttcagaagaagaaaggtacttctgacttttttgcatctgatggcctctgcttcctttcctctctcctcttccatacgccctcccacctcttttaggataatatggcatcgattatatcacctttcgtcatagaatactatggtatttttatgttttcttagcccctgcttatgttctctccttttcctctgttttcaattcccgcaattatccggatcaacactgtccccaaccatgcacaaataatccacattccgtatacgagtgccccatccttgtagcataagcggattgcctggtacgtactctgattcgcccagccgtctccggcaaggaattctttgactgtatctatgtagaagccaatatccaaaatctgttcccgcggcaaaaattctcttgggatgttcagcctacctgtcagataatatacggctgccatccagacagcaatgatcgccaccccctgcagtccctgcagccagttcttctcctgcagcgcccccagcttcctgatactcaaaaccagcaacatcatactgagtggaatgaccgccgcaagccatgcaagtcttcccatctgcaaggcaatgcttctgtgagcgctaagattcatacttttgccttcgatcggccggccaaatagatccctggtgaaatcggttactttgcctatcagaaccgctctttctttctcacccctgacctcatagatttcccttccatgctctcctgcgcccacatttttgattctgtatccctgtatctttgccgcttctatttccgccgtttccagaggctccttcagttgtaacaaaacgccttccggtaaactctcggcctcattcttgattccttcactgatcaaaaaattcattaccacaagccccgcagttatcacagcagccgctatccatacaatcagacgctcgcttccttttcgcttacgttcccttttcatcactcttcccccgcaatcacaactacatcgtcatcctccagaggccatgtggaataatttacgattttccttggcctgagctgatcgtcaaaaacggaactcttcggaaccaaagacatattcccctcttccatcaatggatcactttcctccttctgaacgacccactcttttccaaacagtccttcccgctcttctgcaaaaaataaaacaaaagatccattctcttcctgtttataacaagatagcggaattttgaccatatctgtcattccttcttcttcacattgtacggcgcgaactgtttctacttcgatccgcatcattttctcaatccgtaaagacaataccgtgcagataacaagcagtaaaaatacagtacatccggctatccatactttctttttcctcatgtttcatcaactccaaagcacatctcgtaatccatccgtcagttccttatgatagtacaggaagaagaatgtcaccggaagcagacacaaaagtccgcacacagactggaccgtcatgctgttttccatcacacccgccagaaaaacggaaagtggataatccagttctccctccaggaaaataatcggctgttccaccatgttccagctctccacaaatgtcagtacaaataatgtcactactgcgggctttgcagccggtacgacaatatacctgacaatctgaagctggtttgcccggtcaagtcttgccgcctcaagccattcatccggaatagactgaaaaataaaggtcagccacactgttccaaacggggaaaaaatccccgggataattagcgatttccaactgttcaaaaatcccagcttttccatcagaatataatttggaagcaatgtgacctgcaccggaagaatcataaacaaagccatcatagcaagccagaacttcttcccgataaaccgatatttggcaaaggccgtccctgccatacatgcaaggatggtctgtcctccagcaatcaaaagacacattccaaggcttctccagaatttcaccagatatccggggctttcaagaagcacacggtaatagcccatcatggagacccccgcatttttcccttcccacaccgaacagatcaacatatagattaccggatagagaaaaacaagggagatgattccaaggaaaagaacacgtttctgtctctttttagccatactttttcccccttctcacaatcagataaagcacgtatccaaccactgccggcacaagaagcgccgccacaatactgaccgcagcagcagaaatcttctgataattcaggttctggaaattattgttcataaagtgctgcaacaaataaatactgtcatccggataatttcctcccagaagaaaggcctcccggtaacatttaaacccattcatcaccgaaagtacaatggtaaagccaaaggtcggaatcaacatgggccatgtaatatgccaaaacgactgccatttcccggcaccaaacattgtcgcatattcataatattctcttggtatcatctgtagtctggcaaaataaatcaaaacataatacccggtgaaccgccaacaatacagaatacacagcacccagaatgccgccgacgtattcagccagtctttcggttctcctccaatcaactccaagaccctattccagataccggactctccccataaaaactgcacgccaagaacgactgacgcaatcggcagaatcatcggatacagaaaggacaactgaaagaaccgcacgccctttaccgcattttgcaacagtatggaaagaaacatggctcctaccagcgtcacgggaacagtcacggccatgtattggatcgtatttttcaccgccagaagaaacatctcattttcaaacagacttttaaaattatccagccccacaaactcacgtttcccaatgccgaaagatacggaataccagaccgtaatcaaaaacggtacgaaataaaatacgagaaatccggccagtgccgggaatgccagcaagaatccattattacgctttctcatcttcctgccccctccccactttactctgacaccagtttcttgtagatgttccatgtggtatcagcaatctcagagatcttctgctccatttgaatcgaaggctcatacctgtcgaaaatcagtgccgacaattccgtatacagattccactctgcctccgtcataaaatagacattctcgatttctctcaggcactccactacttcctgggcaacatgctcatccgctgaactcatccagttttgtaccgcattctcctgcaatggagctccggaaaaatcaatccatccgtccaaaaccggaagctccctgtcgtgcttttcttccttatatttgcgtgtccgttcattgagtaacagcataatcagctcatatgattcctccttgtaatcactggacattcctaccgccccataggatcctaccgacgccaccttgtgcccattcatgtcaggaataagccggagcgttgttcccggttcatatccaacactttctataaaattaagagagaagccagatcctgactcttctatcattgcatccgtactttccaagaaagaaacccattgcttcacaaactctttccattcttctttgtcaaagaacacttcctgattctcatagtcaaccgccggctgcatccaccgtccggcgccctgccatatacctcttaacgccactttctgctgaatatcagaagatacctcagcccgttctatccattcccatagggtatctccctctatttcgtctataccggatttttgtgccaatacaaaccaatatccggacagcggaatgatgtactgtcgtccgtcaaaccttccagcttttaaaaaagcctcattatatgtgctgttctcccagtaagaatccccctccatatactcatccaacggagccagagcgccactttgcatcgcctgatatggattttctaataagtaagatctcacttcggctatattatcctggtcactctctaacagatagacatccggcccctttcctgccatgatctctgtacgaagcttctcgatttccgtctcccgctccggcccctcacccggaagcgtttgaatctcgacacgaatccgactgtgaatcccctccataaatctcgccgccatatccaccttgtcatataaacgttgatccgtaatgactctcatcgtctttttctcctctttctctccgcatccactgaaacctgcagccagagacacaaggcaaaccatcgctgtagcctttctgaatcttttcctctttctcatcactttccctccctcctcatgttatttccgactgctattatctaaattatatcatttttatcaattatcgtctatcattaatgtatttagttgatattttgttataatatttaattattatatttattttttcattattcaccagctctttaattttagttatttcagaatttcatcctcctcagtatttatcggagtttattttaccttgttaatgtcacaagaaaaataccattcaactaagggaaactgtatgatttttgtcaaaataattgtatgtcctttcacggatactggttctgattcgacaaaaggaaccatttctccccattttcataccctgataatgaagaaatgaatctctcaaataaaaaatacaggaggctttattatgggtattacaagttctaacaaagaaatcaacagctcacagatccgttgtggcgggacattccgtgtcacacttgcactctccgcagctccagatatttcggaaaacccgaccgatatcgttctagttctggaccgctccggtagtatggctggaagtcctctggccaatttaaaacttggagcaaacaccttcatcgatatcatcgatgagagtaccgacagtacacaagatggtcagattggcttgggaagccgcattgctattgtaagtttttccggaagtgcaacggcaaatacgcagcttatcacatccgtttctgatttaaaatctgctgtcaattcactctccgcaggcggtgcaaccaaccatgcagatgccttttccactgcaatgtccttgtttgatccatcctcttctaatgccagggtgatcgtcatgttcactgatggaaagacgactgccggaattccacctgccccgatagccgaagcgatccgtgattccggtgttgtaatctactgtatcggattaatcggagataatggtatcgacgtagactccctcaatgattgggcgacagatcctgacacttctcatgtcgtttttactccggatgagtccgaactggaggaactgtttgcagatctggcagccaatatctcaaaaccaggagcaacaaatatagtaatagacgaaacattgaatccatctttcacaattttgaacgtcagcatcccctccaccggtactgctaccaccattgactctcattctcttcaatggaaaatcccgtctcttggcgtatccggaaatgaaggtgcttctttagaattttacgtccagcataccggtaagacctcgggcactcttccggtcaatcaatcgatctcttatactgatgacgaagggaatctggtaactttcccagacccgacaatccaggtagactgcggtactgtagtcaaccctgaaccttgccctgtacctattgactttactatcggaagctgtcaggattcccttattgtagatcttggcgatacctgtctggaatcttccggccggatcgtacagttaaatattactttgaaaaacgtctgcccaaaaaaacgggttgctcttggaatcatcctttcggagaccgattcttacggtcaagaatatccgcggggaatgaaaactatcaccgtaccggcgcacagtcttgcggggtgtcaggacgtggagatccaatgtatcaaattcattttgccagaagatttaaccccatccgaaaattcctgtcgttcgctttgccacgaacggaatctgaaagcccggatcatcgcccactacattgataccgattttcagtgctgtgactcaacggttacgttctaacataaaaaacagaggaaggctctttttgagtcttccccttgctttatcgcagaatgatattgtcattgtttttattcttctgttaaaatagtgacctctaccgtaccatttgggcaatctgatgaaaaatgattcctattaaaatcaaatacgcatagttcatattattgtatagttaaaacttagttagataaacttttcgcataaaaaaccaagtccatcccctttttgatattttctatctttcctgtcctggtatagttcatcttttcatacaaatgacacagctttttttcctgtaggatcgtgtccagttcccatcttattgcttttggatacaatgcttctacagcattgatcgtatcctgtgcatatcctttattctgaaattcatgcaaaataaagatttgcttgagcttacaaagcgttccaaaatcacatacacgaactgcccctattatttcttcattcagttttatcatccagtaatcagtttctgattgttgaaatcgttcgtagatccgttctattttttctgcccccggattcgtctcataatcctgatatttttcaaggagttccccaaacgatcgaatttggagtcgatagatatccgggcaatctgaaaatgttgtcctgatcagttttaacttcatatttttctcctagtaaaatttctgcctgtccgtatcaatcataaatctcttttagaacctgactgatatttcggcaataatcggtttctcctcttctgtctatgtaaataaatctacaattcgccctttttgcagtttcaaaatccttcttttcatcaccgataaaaacaagtttatccatgcccagttctaattctctggcaatctcacaaagtccccttggattaggcttgcgatatccgcaactccccgatgatatatagaaatctgcatatggaagtaaatccgatattttttctttcataatctcatctggcatcccactaggaaggtctgtaaaaaatgcaattctgtccccatgacttcgaatttgtcggaatgcatcaagtacatctccataaactctcgtctccagcttcattccttcaaaaaaagtccttataatggcatgaactttcggtctgttcttccaatgtctggttgctttgtcgaaaatgctctctggtgaatactctttttctctataatgaagccttggattataggttttcaatacttcttttgcccgtttgatatctttttctgaacatctaagctgatactttttattcacatgttgtagcccaatttcataatattccgtccacaaatacgacataccaacaaactcaaacagcgttcctcctaaatcaaaaataatccccttcattcaagatttcctccattctgtactaatttcccaaatcacatatagcccgttttcgtatcacattctcccacatggatttacgatcctatggaacttcgatcttcatagaagcgtagttgctatttacccatctgcgtttgtaatcattccggtggtcgtcattattggaatgctccgttccttcgtatccgtaataatcatcatttccttttccagcatttctttgatggttctcccaagcaaatccttaagtgcatcttgaatgtcttgcactgtctgaatatcgtattctgccagtagctgatagattatgttgagatttccttcttttacgtgtatccgatggacaggtttcgattattttgccgtaattaaagacctcctatgatttggtatgctgctttttagttagacacaaattacttaaaatatttttttgtaaattcatataatccaatccctgtggcaattgataggtttaacgaatccacctcgtgaagataattaatcaaaatagattgtccaatttcggaatatgtatctggcagtcctgttgcttcatttccaaagataagcgaaaaagctctatcaactttcatttcaatttcgtaatcctgcaaagcctttgccccatttagcatgaatgggaacatatcatgggactctttatatatcgcatagtaagtatcaaacgaatcgtatcggcatatatttacatgaaaaacagctcccattgaagctctaacaactttgggattaaaaatatccactgcaggctctatcacagccaaattttttataccaaatcccacacacgttcggatgatagttcccatatttcccatatcactaggattaactaatacaacatgattcgaatctttatctaattcattgttgtatttttcaaatacacctattacaaaacaattttctttgtctctaagcttttctacaattctatcgttacattcaaaaaaaatattatttgcattacaaatacctgtaataatttcctcctgtgtcacgctatttaaatcggaatgtgtaaaaactttcatcacttttttaggatatttttttaaaagttctattgttggaaaagcccctaatgtataagaatacgtcaattttttattatattttttcatttttatatttgatatcataatacgctccactgtttctcatctatttttttactcattttatttgttctaaacgaaaatataaacaaaaccatttttcaatatcaaattcatttccaataattccatctacgtacacctaataattgcagaaatacgggatattaaagaaatgtttttacataatagctcttacgatatttagtaaaaaaacttgcttaataactttaacacaaaatccgataaatttcattctttattgtttaattctgttaacattaaaactatcgatataccaagtacagctaaaatctcaaatgcccaatactcctcatagtttcttaacagaatggctatacaaatccaaagagcagttctccctagagcattttttttggcaatatccttttcactgctatccaatttctttgcaaacggtaccggcgcaaatttatatatgattaacagataaacacctccaataaatgccatctctaatcgattacatctaataaagcttaaaaatttacatattaaaatagaaaacgcaaaaaaaatgttataacaaacgaaacaccctccatatgactttgcgtgatatcctcctaattgagttctcacatttcctaatatgagaatataaataaccccaagaataggataacctaaaaatgcagctacaccaattatccaaatcgaattaaaaatggatgtaagtaataacctaattccatattcataaagaactttctcttcgctttttattatttctatttttaataaatttttcaccaaattatttactattttttctatcattttttcttcttataataattttaatattaaaatatgggacattcctgcgaaatccccagggaataggaccactatattctttttttgctgtatattctctgatcttaacaattctttcctaaaaattatcttattctcatacattcttaatttaacctatatttaaaatagttggtatttatatgaattacctattttagtttttaatacatatcacaaaaaagtcattcctctttcctattttgtaattgcagagattccaacggtatcatcacatgaacacaaaaattatcttttaattcaaaaacttcaaacattccatctatattttctaccaattctttaacatgttcaatccccaatccatgttcttctgtatttttcttatttgtctttaatcctttattattctgcaacacagactgatttatcttatttttaactatgcaactgacatattcatttttcattatcatttcaaaatatacttctctttgctctactttcctttcagcctcaatggcattatcaagtagattaaacaatataatgctgattgcaaatccatctattgtatcgtactcaccaataatatagctgtataattcaatttcattctcatgacaaatattaaattttgaatttaatgtcacatcaatcagtgaatttcccgtaaatatatattctttactctcttttatataataatcatcaattttctccaaataaactagactctcctgtatattgccattctctatcaagctttttaagtttaatagtgtattcctataatcatgcctaagtctacgaattcttttttcagaacgtttaatttctttaatttgttgttcttgacatatattctgaaattgtaaaatttttatcttatcttcttgatacttttgttcgctaattttacatattgtaaatacgatataaatatctacacctactgcaccacaagaaataaatagcagccctaaatgatatgtatttatataaacttccctattcagtaaatacaaaattaccccttcaaccaagatggagtaccataaaatcaaactataaataatacaatatcttttattcaagaaaatcttgattctttttccatattttaatattattgatgttataataaaatatatagttaatacccctgctattcctaagtaataatagggattatgaatatctacatattcttcgaaagacacacctccaatcagaattattatttgcaaaaaatttacattaattaatgggatcaaaagcaacgaaattaatacaataatactatgctgtattttatttcccaacaaatacttttcacaaaatataaacagtatcacaaaattaattaatgttaataatatgtcatttatatttaataaacttcccaactctaatggcaaaaaaatcaatacaatgcttatcaatctttgccgcgctacatgtccccatactgatttagttccgaaaaatttgataagaaagttttgaattaaaaatgcttgtacaaaattacaaaaaaatatacaaaagcccaatatcatcctaaatgctttccctccaacatttcatgaaacgttctttacactcttttttcttttcacgacttatctgaattatattattgtcttccataacaatatacgaatcttcaaattttttagcatatcttaaatttactatcgctccactatttactctaaaaaaagattcttctttcaactggttgagacactctttcattgtccctcgaaattcatatttctccgtcgtacttgttattaattcaattttatgttcccaataagttagatacataatattttctattggtatacacattgtggttttgggggtttctaaaagaaatgaggaacattttttactaactcggtaaataaattgttctatcattttaggaatttccgtttcaacatttttctttcttataaaagcgaatggataacattctaacgaacgaaaaactaaattgtcataacttgttatgaaaacaatatttttattccttccctccttttttaagtattcggcaatttttatacctgatatatccggcatttcaatatccagaataatcaattcgttattaaattccttgttatattccagaaatctccttccgcttatgtagatattacagtggaattcaatccctttttcactcaattcatattctatcagcttttttattttttgagctattattacatcatcatcacaaatagatatataaatcatataccattcccctctcttcttgtttaaaatcgtttatgatcatataagtgttcattaacttggacgaatatctatcttcgtgccaaactcaaacatatgtttttcccattatcttttaccagtctcgtttccttattccttgacttaaagcatgatattcttacctataattgaatatatctccttaaattattttgttattcttatcttaatgacattgttccagatgagaggggcttatgagttgaaatgtctaaaacactttttctaagagtcaaaaaaataacattatttagggattgcaccaaaacttagaaaatgcattagatacattgtactatacgttttataaattagataaaaagtattcacaaattttatattctaatgtttcgcatttttctaataatgggaaaattctttcaaagttacaatccccagccttgttgttcctcatagattcccttaaatataaatttagagtaagttttgctgtattatttaaatcagaaattatagattcaatataatcagatgcatttaaatacttcttctccgaaaagtattgatatcgataactccacattttactgtgagcacgcagtagactaaaatgccgtctaaccattggggatggaaatatgtttttccaacattctattccccagaagaatgagtccttataattattttctaaaaacaaataagaatcgcattttgataatagattagtgcaattcaaaaaatcattaatagttttctttaaattatcagggttaaacatgtattcctgttgtgtacgatactttaaaagaataatttctgaataattatttaaataatcctctacattaaaccccttacattgaggaagagagcgaaatgcttcattcatttcatcataagaacattcatacatggtataaattccgttattaaaaaaatcatacatctgtacagtctgcgataatgtatctatattagtaatgatcggattatggtcctcatctatctgcgttttatatttatgaataggacgcatattcaagatagaatagacataaaaaccatctttaagacagaactccaaaaaatcggtgtaattggtaaaattgtcttttacaaatataaaaggaagagtataagtgtcgataaaaggacaaatattccaaagaaatttggggaaaaagtaatccgcaccgctttttttattaatatagacatttataaagtttgagtagatccaatcaaaagtatcgggataattttgtaaaattcctaatatgcaattatcaaatggtacatgtgttatcataggaaagttaaatggtaaatttgtcttcataataatcttattctcctctaatataaaaataaataataatatccttaattaataataaaaaaatagccaaaagatgtcaacaataaaagtaaaatattatgtgattcaacaaaataaaatttatataaatgtacaagataagaaaaggtttattaacattgacactaaacaggaataaggcaaattttcaaggacaggatatagtcacattatagtcatatagaaactataatatcataaaagtgcaattgctagagagttattgactttagcagctgcactgattttattataatagggaagtaatttgtctgatgtagactctattgaacattttattcaccatctccctccaaccatcccccaactataagtattcggttaagtaatttaagttctcattcctatttttctttacatgttaatttgcaatactactatattttcgaatcgcttttttaaaaacgattctcgctcctccaaaaaataaaataggtgctactatcccccatatttgtgttccaatattcagccttcccataacaaacagaggcggaaaatttgaaacaataaatataggaataataaacgtaccaaaaaattttaatgctttaggataaattgccatcggcatcatattaaaatttgataatcctgaaactatctgactaattccttcacttttaacaaaccaaaaagacagtaaaggtggtaacaaaagaatactgtaaagcataacaactccaagtataatgtaaaacacatatcctgctataatgaaaggctctgttgataattgaagtgttttccatgcatttgataccataataactcctgcaataaagtttggaataggtactgcaagatctattgtagaaactgtaagataaaactgtaatgaaattggtttcgtaattgcaatatctaggcttccatcataaacactattttgtagatttgtaaaattgaacataaataatgcaccataaactgcagaaataataaaaaatgtaccagtaaacatagtaatcgcttctggtttcaatccgtccacaatcatatcagtattatatactacaactgtatataacaacttcgagaataagattaaactttctactattaaaattgtaaaaaaactagtacgatactccatttgactcataatataccgttttgtaaacaatcccatcaatcttaaatgttttgtaaattctttcaatacttatccccctaccgcaacatattgtagcaaaccacgtttccacaaagatctagttaatacccctagcacgaaaatccatataatctgtattccgattccctttaatgctgccattaaaccgattttcccagtaattatattgaccgtgaaatataccatgtactggaaaggaagcaattgaaaaacttgaatgatcgtttctccaaaaatatcaattggaaaaatcgcaccactcatcatatcaattaaaaaccgagcaccaaagaaaattccccatgcatctgttatccaaaaggaaagcatacttaaacaacagaaaacgtaaaaactcaaaatcaaagccaatagtattgctactagaaagagtacaatcctttctatgctcattgctatatgaattttccaactaaaaacaaccagtacaataaaaataaacgccagaataagctccatatgtattgccttttgcccaataaaactgaatagtttatataacaagtagttaaaaggcttgataatatatttgctaagtcctccagtttttacgtctgccgatatttcattttccactcccgtttttaaaaattttgcaatcatttgtgagaggattgtatacaaaatcatttggcttaatgtgtatccatatactatttgtttttgtgaattatcaaaaattgcaatccacaaaaacgtttgtatgatcataggaaaaaaggcgctaaataatacaaatataaaattcaatcggtactcatatgcactcttcattcccattctaaaacagcaaaaatattttttcatacttaaaactccagtcttgctatttaccggtaaagtaattcaattcctttttctactggaatatccgaaatacttatgtctttaatattaagtttttgggttacataaccgataaattcatgcaagttttctctattgacttccattgtacaattcagtccatctttttttgtaattacaccgaatttacctaacttcatatcgtctatttcgcttgatagttctaaatttactattttgatgtccttaaacatataattaacatcgcttaaacttccatcatagagtttttccccaccgttaattacaataactcgttcacataaatcctcaatatctttcatataatgactagtaatcattacagttgttttatattgttcattccagtatcgaataaaggaacgaatttttttttgggacactaaatctaagcctatagagggttcatctaaaaatattaattgcggagaatgaattaaagaggctattaattcaagtttcatcctttcacctagtgataaacgtctaacctgtacatttagcaaatgttttacatctaaatattctgtaagttcgtctaaaagcattttgcattttctttcatctacttcataaatgtattggtttaatcgaaatgtttctgaagcaggtaggtctggccataactgacttttttgccctaacaccatagaatacttcattttaaattctttctgccgcttccatggacaatatcccaaaacatgtacttctccgctagtcggatataaaattccactcaacatttttaatgttgtagttttccctgctccatttggacctaaaaatcctataatatcaccactatcaatatcaaaacttatattttttacagcttctttagttttttgttttctaacaagaagatttttaagtgaatgctgaaatccttcctttttttcataatatgtaaacactttattaagatttttgactgatatcgcattcatgcatctcacctcgtcttattagtttgctgctgaatatagctaaacaaagacaatatatcgggaaatttcgtcatgtccaatttatcatcttcaaatatgatattgaattcatcttctacttttacaattaaagaaataaaatcaattgagttgatccccatttcttgtaaactagtgtttaagcttatctcattatattgattattcaattgatgaaaaatccttgccaatttttcaaattcggggttctctacaactactttttctgtaatgttttctggcataactgtaagttcttgaatgtgcgatttcagaaactttctgtctatttttccattgattgtatattttaattctgttatttgcacaaacttaaagggaatcatatatgccggaagttttttactcaagaacgatttgagttttgtttgatccaacttgttttcgtatacataataacaaattaaaccatgatctccttctggaaagcatatgcattgaagttcagaatcatagctgcaaatagtgctttctacctcttctatttccactctatatccccgtatttttatctgattgtctaaccggccaatacattcaagctctccataagaattcctcttacaaaaatctcctgatttatagtatctgacttttccatcagaggaaaagataaatttttcatctgtaagctcttgattattatagtatttctctgcaagacattcacctgaaatatataactctcctgtatccactgtatcccctacaagtttatatgaaacattcttcataggctgtccaatgtgaacacggttactttctgtcaaatcagctataaagcaccaaacagtcgcttctgttggtccatacatgttatatatctttgctgatgtcttgttttgtagctcatgtaataaatcagaagggaaaacttctcctccaaccaaaagtactttcactttagacaaacatgttaaatttttgtcatattctctaagcatacgcaaccgtgatggagtcatttggataacatctgcacaatacttttctatataataactgatcattttaggatttgactctattccatctgctgttagaacaatagataaaccacaatgtaatgcataaaatgcttctaatacaaaaatatcaaatgaaactgttgttaggcaaagcattctcgaaacatcttttaaatcaatcgcttcatccaaaccatcaaaaaaatttagaatagaatgattagttataacaactcccttcggattccctgttgatcctgatgtatatattctatatacatatttgccactttggggttcaatgtaaaatttttttgtttcgcaaagcttttcgatttgaactgtcgttttcccatggaagtgttccttattagattcgtctgtaataagaacacttatatcactatcttgaatgatatagtgaattctatcttcaggcatcgtcacatctaaaggaacataactaattccaagcatattaactgcaagaatcgatgcaattaaatctggcgaacgacttaacaaaatacctaccgcagattgggtatcatctatataatttttaagatttgttgctattgcaattacacgattgttgagctcaagataactaagttgtttttgttctgtacatattgctaacctatcaggatacctctttactgattcataaaaattggtatataaactatttcgcattttcttcacctatttgtcctgcaataatgaataaacataatctgtcaacgatttaacactctctaataaatccgtatttaacttttcttctggaattgcaatttcaaatgcatcttcaatcataattatcaattctaatgcgtcaatagaactatacccatactcttccaggaacaaattctcattactatctaattcctcaacttttttgtctaactgcaataattctataaaaattttctttatctcattctcaatgtcttcatatttaaatttattcatttttttctcctaaactgtaattatatttatgtacacttgaactttctttacattagatcttttttgttttgatgctaaattaagttctaaaaatactttattttatatattgaaatctatctaataatgtagcgacaacctcctgatcatcctggtttgcacgaccaaaagattctaaaactacccagccagcaaatccatgatccataagttgcttatatactttttgaaagtcaatcaaacccttgcccggttctacaaattctgtaataataccccttagccttcttatttttacgtcagaaaaatgtacaatttgaattctgtctttcaaacaagatatccaacgttctggcatcccagaataaatagaattgcctgtatctaagcatacttttaaagccggcgaatttattttttcaataaagctcaacacgtcatttggataacataatactccgctaatactattttccaaacagattataacatctcttttttgagcataatctgacaaggcggtgaaaaaattcatttcattttgtacggcttctttatagcctacaaactgcatgtttttttcgtcactacagtgcatagaaatataaggaatttctaagaaagaagctacatctatcattttcttaacaatttggacaacttgcatattcaaggttccggagggcgtccaaaattcttgtccgcttagcaaagttgtagacatagccataattttcatcttattctgtttgagtagctttaaaacattttctaaagacgcaggagtgctttccatactgatagctccactttgtgtaaatcctgcctcaaagaaatttatattagatttctttagtacgtcaatgatatgttccattgaagtttccccttcaattccacccttaaatataaatgttgatggtaaaatcatatcattcctcctttctaagcatgctgtatgcatgtgggatctgcatatccagtatttccgtaataattataagtcgccgcaatacatccccccttgcaactattatattctttacatttggaacaaggttcttttgtttttaaatattcttctctctctttaataaaccgaatcttttttgaaaacttttcttccattccttgaactgattcttcttttatattcccacaatgaaagtcctttatatttacgagccctgtacatccggtaatatctccatatgccgtaattacaatactatttttaaatgcaggacatccatgaaatggatcatattgtacatataaagaaatattatttgaagttactactctcgtcttaggtatttttaagctctctctccagaggcatcccggtaagactaattctatcgaaagcttcttttgaagtttcgtatttttatatttttttacccattcactgacgatataatatatcttcatataatcgtctttttcaacattatggtttacattttgttgcttttcaacaacatcaatgaacctgagtagctgcaccctactcaaattcattttttttgcaaaattcaaaagttctataaccgtactctcatttctgcttgttatgacactattaattccgatcccatcataatttaagctttgtaataattggataccttttactgctctttcaaaagtcccctttactccacgcatttcgtcatgtatctctttattgctcgaatcaatagaaatttgaaaacggtctatcatcgtaataacttctgctattttacttagttctttttcgatcagcgttccattactaacgagataaatttgtgtatctctatacgatttaatatatctgattaaatcatatataaattcacataataacggttctccgccactgatatcaaaaatccgtactcccataccatatagtttatccactaccattttgtactcttcaaaggttaattcctctttcatacgttcttgtactattggcttatgagcacctgagtaacaaatcgcacactttaaattacaacgcattgttggatataaaaatgctctcttagcatcgttatgaatcattctactaattccctttctctaattattttgttgcattttaactttcccaagctgagttttttccaaattatctgtgaacgaaatgatcttgggaatttttattggagggagaaatctgctgcagaatttttttaggtcatccgcatctatatcttcttgtactacaacgagagcctgaatggcttctccgtaccttggatgctttactgatctaactagaacctcctttacgctctgatgctttttgataacttcttcgatttcaagagggttaaccttgactccggccaaatttatcattcttttttctcttcctttaatatagatatatccttcttcatctatatcaacaatatcacccgtgtcataccattcaccttggaaaagttcatctccaacatatccaattcctcttcccttgctttttatgagtgaaattccatctataattttgatttctactccagtcaaaggtttccctactgattttatattgctttccagatcatcgcagagattaatcgcaatggtaccgctttctgtactgccatattcttgatgtatcacttttcctgtgatattgtaaaattcacgtgcgatatcggaatccagctttgcacccgcagatatacatattcgaagattatccaagttgtactttttcttttgtaatattcgattaaataatcggtacatatatggaacaccatgaaaaactgtaatctttttatcctgcaaaatttccagcaccttgcgtggcgtaaattcattaacgacttcaatgcacgcaccaatacaaataccttctatcaagcagcttcccagtgcataagaatgataaaaaggagtcacacccattaatgtatcttcttttgtaatacttacagttctttggtaattttgaaaagcttcaaataaactttcatgtgttagaattacacctttaggccgtcccactgaccccgatgtataaagtattaatgcaacatctgtaagcataatatcaatagaatgaacgaaattatctacattatcttcattaataatatcagaaaataaatcatctgttatcttttccaactcattaacgcagatccccttcacatgaatatcattcgcaagggcggttaatcgaattgaattttcatcaataatttcattaatatcgtatgaaagttttggatcagcaattactggaaccctttttgctaacatcgccccaaacaataacacaataaatttgtgcgaattagggagcatgattaaaattttatctgaactgtttgattgtttttgcaagtaagaagccatattacatatttgcatccatagtctcttgtaactaacttcgttgtcaccttctctcatacatattttattaggcatggttctaacattttgtaatagcgtactaaaaatagtcattccctaattcctccaccttttttaaacatgcctctaaagtttcctcactgtttagaatactactaatcatttttgctaattgttgaatatgattagactgaaaaatatttcttccgattgcgactcccgaaaaaccatatgtaattgcttgatcaattcttgtcaataatccttttacattatttgaataatttccacctgccaaaactgtatgaattcctgtattggaaatgcaatcttccaaatttgctaaatcgccattatagctgatttttactatatcagctcccatttcttgcgctacttttataaggtgtgatgtagtattgggatcattttctgccccttttgcatacatcatggccaataatggaattccccacttttcacactcatttgaaacatatccaaaatctttcaacatctgcgcttcctcttctccgcccagattaacatgaatcgatattccatcaacaccatacgtcaacgcctcttctacctgcgtaaccagcacttttttctcactatatggagcaagagctgtagaagctgataaatgcattatataactatatgaaccatatatattttcctctattagttttttaattgtccccttatgagcaataacagcatctactccgccgctcgcagctaactttacagtatcacaatacgaatttattccctttattggaccaagggtaatcccatggtcaattggcagcaaaaaagtcttatctgaattataattaaaaagacgtcccattctaatttttttactcattacgcacctctgacactcatttattcttcttctaaaaactcatctattttaattccaacatgccttccgccttcgcaaaaatatgctaataattcatctccaatttttatggctgaggcattatgcactttcccctttggtcctaaaatacgaatgtgccaatcatcctgaacgattacattaatcctttttccagactttgattccacttcaatctttagtaatggccgtatttccatttttttccttccgacacttaccgctcgtcctcttccctctgtatttacagccattacttgcatacctgatttcagttctgataaatatatggtttcatcaaaaaaccatgtatatgaatgaactgcccccgcattaactcgaaatggtcttaattccatataagggagatgatgagtttctgaacttatcaatattcctcctgttgaagtggatccgattaacattccttcattcttatctaaaattgacgttgtatcaacgcatactctgcatcccattccaatatgtttaatatctactacttttccggtttctaaatttaactgcacctgatttgctttttcgatcagtttactcatctcctctatttccatcatttcccgtgatgtaaaaataatgccgtcacttcctttttccataaccccaaatactatttcagcgtcttgcacattatttacaaatttcattaatacacaattctttttttgaaatgccgcgataagcaattcaagcggaatatttgtcgtttcataaaacaacacacatacataatcataaaaagcgccgtttttatagacatattctaaatcatctttgtttgtaattactttaaataatgcgcttggtaagcctttttcttttgcttctcttaaaatttcttcgttttctgaaaatataattacatcttctaattcatccaactgttctattttctctacatgaacagcaatcgacattctttttggcaatatttcttttttatacaattcaggacgaattaacaaatgatcaaaatttttttcaaataccagacttaaaatattattatctaattctaaatctcttgcatcaaaccaaacttctctcttcttcatagcaatatttcctttctaaatgaacaacttgtcataatcaatctcttttaatagatacctgcacatatgaacgatttcctcatctttatgctttttataaaaatatgaaaaagctttctttaacttttcgttcaaatcatagcgataatgtgaaatatgataattcacgcactgatcggagtaaataataggatactttttgcataaccgatatcccaattcaaaatcctcgcagccccattcctttcctaaattttcgtcaaacccacctgcctctatcacccattctttagggcaacagaaattccctcctgtcatacctatccaatgatatttgctttcttctctttctaaaattttatgaattgtttcttccataaacgaagtagtcttataccttgcaatttttctttcaaaatcattgaaaatgtcttcaaccgatatacatcttttcttaaagttgtccattttcctgctttcatctattgtttcatatagaatacctttagatggatctttaaaataagccaatggaaaaatatcaattattttcccatgtacacatcttggacactccttttgaagtagtacatgatttttcaaatattcaggtgaaagtattaagtcatcatcaacgaaaatcacaatatctccttgtgctttaccaagaccttcgtttctggctgccgatctccctttattgtcagataaatgtaatccccttattctaaaggggaaagattgcgtttctaaatactcttttgttccatctgaggaattgtcgtttaccactattacttcaaaactgcttctgtcaatggtttggaagttaatggaagctaaggtcaattttaatctaggaagtttattgtatgtaggaattatcaaactaatcatctttttgccttcttgtatctttttgaataatgtaggaagaagcagtacaccctccatacttacctgcttgttctatatgtttagataattgttgttttaagtacaaccgcttttcacttttccaaagatccactaaagttttttcgtataaatttccaagcgataaggaaggatcattcttcattgaagcacaaccatatacgttaagtttaggatctatatacaattcttttagctttatgcaggcagcacattcgtgtatctcaagcataatgttaggagttgcgaggattttttctaaaacagcttttccatatgaatcattcaaacaatgcttgtatatcttgattgtaagatataatttttctgaatagtttgggaaaatatctaaaattctatccaaagcttttaaatatctaaagcggaaattctcatcattttctttacgatttcctaccatgatcactggagaatacttcactgatattgctccaaaacgataggcataatcaatcatttcgtctattgtatcaacattttcttctgtaacagtgcaggaaatactaaccggaagtcgttctgaaaactttttaatattttcacatacagtatcatggtgaattccaattctagttctttcatttatttctttatcaaacgaatccaaagatatgtctactgcaaatccgctttcatataacgctttttctatattttttgaatagatggtcccatttgttgatacaaaatacatcggcaagccttgccgaactaaaatttttttatactgcatgccgaatcgttctgcgggcaactgcaatttcagcaggttttttaaatcattgaaatatttagctggaataactttcttatattccttcattttgctcaaaatatcaactatatcttttcttataagaggttctcccccctgtaagacaataaaattccctcgaatatcaacaatttgttttatagtatttaaaacatcttctgtggatacttcatcaacttgtttatttaaactttctcctctacaacaatatatacactttaaattacatcgattagtaatatcgaatactgacatttcaattttcctccatgacacttttaaaaaatcgtttttcatcttccagcagagataagaccgactcatttaatctattaagactctgttgcgataatcgacgagaaatttttattaagatataaacaatgttctgccatcgatatataaattcttgcactttttctttatatacagtgccaactccagatggatattcatcaaacgccttaagtaacattttacgagctggtataatagaatcaaattgtattttaaagcataagcttggtatttgttcatagatttccttttctgaaaacaattctgggagtctccttaaatcattagcaaaaatggatagctcttcgtcctcaaaattatttgattctatatgaaattttttattattcgttgcttgtaatttagaaattttctcactttctaacgatataattgtttttttaaaagcagaaaatgcattccaaaatacttctttttcgatttcacctacaaataatgaactggggtgtgttggaacaaagcagtcactaattatataaccatttttagtaacatctaaaataactataaaatgcttatttgtatatccggtttgataactagaactgtaatttaaatagtttgtcataaccgcaactaagacaggccggaagttatccacctcattttttatataatttcgaaactcattctcattttcttgatattcaataatttgatttttgatttggttttttaaaaagaattttttataaattttaccgaattcatttgttaatcgaatatctgataaacactgtccttcttcaaaacggtaatgtgttttaaaatagccaccattaaaaaagagatttgatgatttgatgttagggttataataatttacaacatttgctaaagacgagaactgacaatgtacaccttgatctgtctgatataaatcttttaacttttgcattttgagtcctttatctttcttctatttttcctattttcaacgattagttagttttattaactcaaggataaaaactatatattttttatatatgaatctaaaaattggatcggtatatcaaaatttttagctccattaaatataatatcagcatatatttttgttgaaatagaatatttttcttcttgatactttgcagactctataaaataggtagcaatgtcatccattttcatattaaattctttcatatttcgttttatacgtctataaagccttaattcaatatctgtatcaatgaaaatttttaattgcagtatttctcttagtttattaatggaaaaaatatttacaccttctacaataattatttttgcactcgtcttcgtagccttctttaaatccaccaaaagagcgtcgtagtcaactgattctaagctgttccaatcatcgtactccctttgtgtcaatggcgaaatcattttaggaagtttgtttttaaaataacggtcagcacaaatcaatataacctcgttttttttatatagttttacaaattgtttgcaaaaaaaagattttccacttccagatccacctgacactccaattattatttgctccatagtttttctccctttcacttatatatcaaactaataaatataagtatgaaaaactccttacatacttttagtaattcattacgagttctcatatcaattaacattttaattctatttcaaccttatcattaaaattaattatagaattaatataatagaatagttggtatatcagtttctttcttatactttgcatccatctaataaactgatagtcagtccctcattggtaacgccaacttgggggaatacactatttcaaatcacggatgttctgatcaagacgaattttgacaatgctgtttatctttccataaacaaaaaaatgcgctcaatgtaatccttattatgtttacataattgaaagcgcatacgattttctacgattgcctattatattcagactattcgtttatttatcattctttttttcatttttcttttttgctaaaatagtcttaatatcagaatccggaataatctcgtgaaatccccagtaggtaggccatccatccccttgctctgctgtatactcacttacctttgcaacttttgttaataaaatttttttcaagtccatattagcttcctcatttctttttaatatgtaaaaataattaattatcatattagtttattacccatttttcttcaatatatttgacttaatctgtcatttttcgtgcttattctgtacaggaagattgaacataacgtaagaaaacgaagtaaaatcttctattgaaagttctgagggattaaagctttcttaattttacccggaattattatatttacacgcttaagttatttattagaaataccactcatgcactttctataaccaaaacttcgccacttatccagtcaatctcctgaaattatttcattttttgtccatacattttcactgaatcctaatagcgttcttatcattagttctctccgctaatttaaaaaacctaatatttattactgttaactagtaaaaactgatctgcctttagttaaaactttatttttcatttttaaattattttatttgatttacaaaaattatattttgtatttcattgaaactaattatcagttatgctatattaacaaataagaactatttaacataaaaaaggttttcacatattttttaaaacttctttgcataactttagtattgtgattgtgaattatattctcttaagatagtatatactcagaaagatgttataacgaagccgttgtcccttgtgataatgtgaacaaagttaggatattaatgaagttgatacctcaaaaatatgcgtggcccgaaaagagggaaggaagaaacaataagattatttttatggctgttttcctgattcatacaacagctaaactactgactcattatcttgagtttcttacatattttatttacagccatcaccgtacagaaatcaaacaacagtttttcttgctatgccctaacagcttaagcaacaagaatggaaattcccttactacccctaacggacattttttacaaatgtcttgtaagcctgcaaataaaaagtcaatagtaaattgattatttcaggcaaaaaggtttatgtaggattttgaacattaaaataagaccaccgatattcgctggtctaaaataaaggtaagtatgagatggttatttcggaagcgatgaaagatattcttttacccgtccatagtagatgcgaagaaacttattcgcaccggcagtcatgtagacatagtaaggtttgccttgtgatcgtttcttatccataaacagatatacggggtcatcctgcggtttggttttgataagagcatccattacctgaaataaggttttacgaagagtgccagaacctcttttggaagcaggaacacttttctgttcgtaagaaccggattcatttacgccggggtcgacaccagcgaaggcggtgatagcccctttgtgagtgaagcgggaaatatcaccaatctcagccataagctggggaccaagtgatttaccgacacctttcatagccattacaacagggtattcaggcagtttggaagcagcgtcattcatcatggtacgaagctgttccacggtctgagaagccatatttaattgctctacagcctgtttgataattagttttgtcaaatcgtcttttggaagtacagaaacgatctccttagatgcttcatagatttcaacagcttttgactggctgaagttgtactttctacgtttgcaccacttttgatagtggttgataaatgggttaagagacagtttgcgaacacaatccacatgccaataggtggttgcaaaatcaacccacttctggcttccgtcctcacgggcgggactgtcaaaataggtatttgcaccgggataagtctggtcaagaacgccgataaggttgttcttcatggcggttttgtgtttcatgtaaaaatcaaactggcggttcatggttttaagctgattacgaatttcgtccatgagactatactgtctgagttctgtccaactgtcaagagtatagcgagcaatttttacagcatctgctttgtcagacttcactttgcggagagaattatctccaaagtctttgataagtttgggatttacggcagatacaaaaaggtcagcctgtgagagttcacggataaggggttcgtaataacgccccgtatgttccattacaatgcgtgactcaccatcaatggctttgatatgctcgataagagagcgaataccgctgactgtatgcttgacttcaaatggtgtggaaacaatttcaccaaaaggacgaaggatggcaaccatacttttacctttagaaacatcaataccaactgcgttcatgttcataaatttgtcactccttaagatttatagtgcaaaagataaataccaactttactcattgcctattcaatctactgtggtgtgacacgaacgcactgaaagtggttcaacctgcataaaacgaacgctgcgaatgaggagctggttatcagtcttaaaaacggacgtgtaagtccaagaaaggaagccgatataccgattgccccatcattatacagcttaagcaataagatggctaacaacctaactggttgttaagtatattaaccaatttatattgtagtagagaaaggagttatatttatgaaaaaaattttaccttttagtaatccaactattacatcatggacttggaccgctgcaactttttccattttaggaaactatcctaaatgtttaccttggttatacaataattttatacaattattttgtgaatgttacgaaaaatgggtttctttacattatattcctcatgtagatgtattttctgtctgtccattttttcattcctccctaatacctcgttcattccttcttgatcttaatataagtcttaatagttttattagaacttgtattaatcacaattattatgtctattgtataattgacgaatcctatattagtaggaaaaaacgatttttacacgaattactgatttatggatatgatgattcaacacagacatataatattgctgacttcaccctaacatcaacccaaaaatatactcaatcgaccacctcatatgatagtataaataaaggttatgcttctattagaccacatgaagattgtttgactgatggtttaggtggtataggtggaatttatattttttctgtcaatccaaattataattatgattttgatatagatttaatgaaaaactatctgaatgattatatttccggttctgacagtggttatccttatcgtacctataatttaaaacggcaaacaggatctaataccggtttgcaatcaataagctatggattagatatttacgacatgcttcaaaaatattataaagaggtgaaacaagaagaaaaaacttttttcatacaaccattgcatgtgctctacgatcataagtatttgatgctacaacgtttattatatttaaataaagaattaaaatttaaaattcctaattcccttctgaaagaatattcagtgcttttttctgaggtaaacattcttcgcaatttgggaataaaatactgggtttcaaggaaagtttctgctttagatacagtaatatcgcgtttacctggcataaaacaaaaggatttagacttgactaccgaacgggagtatcccaagatttgtgtaaaccttcaaactgatgtaagatagacttaccagtttggaggtttattttatggcggcagaacctcaaaaaattggtcctgcccaaagtaactaatgacatatcttatatcagtttttttcgtttacacaaacttgggatctgttgacaaactcactttttcagtgtttatttctgcatgttttcttgaaatgccataaaacagctggtaaattcggttatttaaaccgcttttaccagccgttttagatttaacgccgttgccgataagaggcattcttctatcgctttctgaaggcctcttttctggattttattcaatttatgtcctcgttttaaaactgcgaatattccttctgcccatatcttcctaagcctcatgactctcagataatcactggtccctactttcttgctatttcgataaaaagagggataataagcactcgcattgattctgactgtaccgagatctgtggcacaagctgaaaaattcgggcagtttttacattgtttttttgaacggctatataaacggtaatagttttccgttgactttttataaattaatttctgaaatgctaaatattctccctgtctacatacaaagcggtctgtttcttcctcataacagaatccttttttcattgcattgttctgatattcacgtatcgctgtataaccttagacccctaataactccagccctctgtgtaccgctcctatatcatatccgccatctaatccaatctcctgatatttaacaaggctgtcctttcaaatgttccaggataatatcacttttcctctggttagctggataacagtccacccccgtaataatgccatgcctggtatccactgtcatctccgtcagataacccagctcctttttacgagcctggtggatataaccatactctggagttgtccgctttgctttcccatcataaaaaatgatctcctgcaatggatataataagtataccatatagaaagccatttctctttagtttgtcaacaggttcatcttgggatactcccatagtgatggctgttgtaatctttccaaatcaatcccccaccccaaaatcggtattttcataaagcacttcgatggacggatcgtgttccagttcgcggtattcctccagaaaccatttcaccaattcttcatcccttttcacatcggtggaattgttggtgaacacattgatagtgccgagcttaaaaaactgttttaaaagtctgatatcgtttcggatcatctcttttgtctgcccctggatgccgaccatcaggcaaggggagtcaaagtaacggctcagttcctcggcatcacgaaaatcagcgtgtttattcaggtagtgctcccgaaaatgatagtcaaaagtttcggcgccggtcttgtatacaatcgggatgcctaaaaattctctcatttcatccaggcggctgcggtagatccagtgagcctcaaaaaacagcttttggatgtgcttttcccgaacgacggtacggatgtcggtaagcgtttcctttggaagctcaaaacagcttccggagtttatcacttccagtacgccgaactctccggtgacgtgggagagcacgtcccggtttagggtaatcatcgactccctgtctctggaattgtcctcaatataatcacagaagcgacacttgccccaggcacacggaagagctttcaaaagtacaatctcccgcttatttttattggtgatcttactatatcgatccataagtacggtctcctttttttaaaacagtcaatacggaaacgggtaaaacatgcaggactgtcagagacagggccagcatgacggtccggtcaataaaatcggtaacaagctgtacgcaaaatacgcttacagtaagattcagtcccagatgatgaaagagctgtaccacgactgtggaaccggatgaggtaattcctccaaataaaaatgccgtaatgcaggaggaaacaatcgttcccggtaaagtaacgacaaacgcatacagcggaatccggtattttccgttccgaaatgatttttcatagaaaaagagtccggcggtcagtccggtgaggagctggactggaagataaaacagggaataaatatccgttgtcattccggtcagaatcccacttaaaaatcccggaaccattccgtaaaacggaccgaacaaaatggcggcaaggaaggttcccagtgtatccagatacagtggaatccggatcagaagggcaagatttgccccggcaatattcaatacagcggccagtgccagaaacgacatctgaagtacagtcagttttttcggatatctcatactgtcacctccctggaaagaatctggggaagaatcgattccgcctgtgtcggattggcaccgagtaccttacagaaaaacatcaagaagaagcgataaggatctgtcttggtgagaatgtgactgttatgtggtttcttccagatttcgtggtcatccaccagtgtctgtccaaagcttaagccctctgtctccacagaggtgtaggcgtcaaagccatcgcagagagaaggatcggcaaaataagcaacagccagcgggtcgttgatgacacatccgatgatgccctcctgttcccagtggaaatccatatagaaccgggtgatcgattccattacggaaccaagatgcggattgatccgtttcatgtaggctgcaagatttggcgtcaggacaattttacgtgtcacatccagtccaatcatgtggatcctttttccggcaagttccggcagagaagcataggcttcatagacaacggcggcggcgtcaggatcgcaccagtagttatattcggctacaggggaacagtttccgtgggctttgtatgtaccacccatggacacaagattctgaatacgcgcaaaggcgtccgggtactcctgtctgagtctggcaagatttgtcagtggaccgagcgcaatgacggaaacatcgtcctgcgacagtagaatgtcggcaagaaaacggacagcatcgcccttggcctgtcccactgtggagtcggctagccctgattcgccaagcccgtcccggccgtgggtatccatggcatcgacataaggacgaataagcggggtttcttcccctgcatagactccaatctctgtacgattcataagttcaaggattttcaaagcgttttttacgcccttttcgacgggaacattcccgcagacaactgtgatcccgacaacatcaagtcctggaagggacagagcgagcatcagtgcaagcgcgtcgtcgattcccggatcgcagtccagaattacttttcgtgcattcattctccaatctcctttgtatgtttcatttgagatacttggttttttatactgggaagttcacgaaccagtccgggcgaaacgcccgattgtataaatgcagaatctagtatagcagaagacaggtggaaagggaagagaaactttccacctgcagagaatctcttaatttaagaaatagataccaagattcagatatccggcaaatgtgatccataaaagataagggatcatcagagctccggcagttttggaagccgaccagaagagccggatggtctggtagaccagaagccacagtgccacaagccagataaaggaaaacaggtaaagattaaggttgaaaaagagtatcggccacataaaattcacggcaagctggataccataggctttcagggcaatatcgtctggttttccggaggtcagaaccagataggacgcaattcccatcagcacatagagaatggtccagacgacaggaaagagccagcccggtggtgagagcggcggtttgttcaccatctcaaaggtctccatgctgctctgagtcaaaagagcggacagtccgccgacgagaagtggtatggcaatacagattattagttttttccaatgaattttcaaatcatcaccccctagtactgtatgtgaaaaacgtctgttttattcagaagagcaaaaatggcacatacataagttatgagactgatgtatgtgccaaagaaactatataaactttttggaggacatgtcttttacggccagatcgctctcgctgattttgcgtcaacgacgcgtttgagcgcgatcaggtaggcacccatgcggagtgtcgtatgcttctcctgagccagatcccacacggatgcgaaagcggcatccatgatttccctgagcttcttgttgacttcatcttctgtccagcttacggactggatattctgtacccattcgaagtaggagacgacaacgccgccggcgtttgcaagaatatccggtacgatcaggattcccttttcggcgagaaccgggtcggcttcggaggcgaccggtccgtttgcggcttcaacgatcagtttcgccttgatcttgtctgcgttgtgtgcattaatctgattctccaaagcggcagggatcaggacagtgacatccagttctaacagttcttcgttggaaatatgagttgttccattctcgttgaaatctttcaaaaggtttctgcggtctgcggcaagataagcaaggattgccggaatgtccaggccttctggattgtagataccgccggacacatcgctgatggcaacgactttcattccggactggtggagcagccttgcggtgacacttccgacatttccggcaccctggacagcggcggttgtaccctctgccgggatgccaagtttgccgaggatattgtgtgttgtaaacattacgccgcgtcctgttgcgtcatttcgtccaagtgccccgccaagttcgagaggtttacccgtgacaacgccgtgaatacagtgcccttttaacatgctgtaggtatccatgatccaacccatcacagccgcgttggttcctacgtccggcgccgggatgtcctgctccggtccgatcagtggagcgatggcagccgtatatcttcttgtaatcgcacggatttcattttcggaaagtttggtcggatcgcagacaacaccgcccttaccgccgccgtaagggatatttacaacggcacatttgaaagtcatccaggcggcaagcgcacggacttcgtccgcgcttacgtctggatggaaacggattccgccttttgcaggtccgcgggaagtggaatgttggattctgtagccctggaatacgtgggtcgttccgtcgtccatccgaaccggaatggagactttgagttctctttccggatacttaatggcttcgatatcgctgtcgctgtagccaagaatatcagcagcctgctgtactacctggagtacgttgtcgtaaggattgtacgtctgattcataatgtttttccttctttcttgatcgttctatttcggctggattcccagcttgttttcaatataggcaagtttcacacagagtattaggatgtccatagcctgggacagctcccctacggaagggtaggatggcgcgatccggatgttgctgtctttcggatcctttccatacggataagaagctccggctcccgtgagggtcacaccggcttctttggcaagtgctactgtgcgtttggcacatcccggaaagacgtttaatgagacgaagtacccgcctttcggatggctccaggaggcaacgggagggcttgctccgagaccgtcttgcagtttttgaagaacaatgtcgaattttggcttcagcagagctgcaagttttgtcatgtggttatgaatattctccgatgtgccgaaaaactgtacatgccggagttgatttagcttgtcgtgactgattgtctgagcagacatatgcccaagcagttcttttacattgtccgggcttgatgcaataagcgatacgccggcgccagggaatgtaattttcgaggtggagaagaagtaatagcaccggtttggatatccggccttctcacaggctttcagaatatttttcagaggaacttcctcgtatatatgatgtactccataagcgttatcccaaaaaatacggaagtcatcggctgcggtcgtcatggatgccagtgtgtctacggttttgtcactgtagcatacaccctgagggttcgagtggagcggcacacaccagattcccttgatttgttcatcttctttcacgagcctagttaccagatccatatctggaccgtcggaaagcagtggtactggaatcatttccacgccgagttcctcgcagatagtaaaatgacggtcatatccgggaaccggacataagaatttgacggggcgaccttgtgcacgctcatctgcccacggttttttcccttctgttccaaagagcaacaggaacgcaagagtgtcaaacattaaattcaggcttgcgtttccgcccataatgatctggtctgcgggaatatcaagaagatcgccgaagagacggcggcactccccaattccctgcaggacaccataatttcttgcgtcagtgccgtccgccagtgtataggatttgggaaattggagcagttccatggaaagatccaactgttccgcggacggttttccgcgggacatattcagatgcaggtcttttgtctgttcctgtttataaatgttccaaagggaagaatgaagatcttccagatcttctttggaaagtgttgtaagagatgccatgatcgtttcctccttgtttctgcccttattataaaaatccagcctgaaaaaaacaaatatttatatctatataaactttataagctaaaagttatatagaagaatagtatacagaaaaattctgggaaataggcaaaattgttttgaaaaaaatacagttatcgaatatgatataaataaaagattatagaatctatatataccccttatgaaaagcttataattattgctgcaaagaaggggtgcagggcgtatgagaggagatgggaacgccatggaagaagagagaaaaagagaatggtgctataggatgatgaccagtgatcccagacttgcaagaatgatcttgacttactttaacgaggatgattttcagaggattgaggatcataagaccggagacggcgtcatcggcgggaaatcttgcggatttcttctggtggagaaaatgatggaaaagcttcttcctgaatacagagacagatgggagccatgtccgtcctggtttgtggggacagggattttctgtcaggttcgtgatgggagaccgattcgggtgtttgcggaggagtttcggaagattctcgactatttcgatggcgcgccgtttattgtgcgttccagcagtctgatggaggacgggtatgacaatgcgttctttggaaagtacgagtctgtcttttgtgctaaccagggtgccagggaggactgtctggaggcgcttcttttggcggctggccgggtctatgacagcgtaaagaatcaggaggccatggagtaccggagaaaatggcatcggccagaccaggaggagcagatgggtctgctgattcagagagtcgcgggggaacggatcggcgatctgtattatccggcgattgccggtatgggatgttcctacaatccttataaatggatggagcatatcaacccggaagccgggatgcttcggatggtggcaggactcgggacaagggctgttacgagaactccgggggattatccaaggcttgtgggattggactgcgcccagggtaatctctggggatcagtcggggagaagcacaagtattcccagcgccaggtggatgtggtggatctggccaaaaacgaggtttgtacaaagcggctttcggaacttatcgatgggatgccaaagtcataccggaggctgatcctggagcgggatacggatgcggaagagatgctttcaaggcggggtgattacaggaagatctactttgcggactgccagggaatggtggaagaccggatttttattcagatgatgaagagactgttaaagagcctggaggagaattatcatcagccggtagacattgagtttgctgtcaatgccgtaggggacaaggactggagcgtcactctcgtacagtgtcgaccgttacgttccggaatttcggatcaggttaagataccaaaagacgtggatgaggagtttttgtttgatgtgcgccggacgtccatgaggcggtctaaggagcagaaactggattatattgtttgggtggatccacaggcttattatgagtatccatataagaagaaaccggacgtgggacatgtaataggaaagatcaatcactatctggaagagtcagaggagaaagcacttcttctggttccggggagaatcgggacttcctcaccggagctcggcgtcccggtgtcctatgcggacatcagtagttttggcgccatctgtgaagtggcctacggaaaggccggatatcgccctgagctgtcgtacgggagccatatgtttcagaatctggttgaggcggacgtctactacggcgctatcaacgaaaatagtaagacaagaatctaccggccggagattctgaaagcatatcctgaagtgatgacggagctcgtaggagagattacacaggaattgcttcatattataagaatgttccgggtgaaagaggctgccattctttatctggacgcggcggatggacgggctgtctgccggctgataaagacagaaacaaaagaatgagaaggggaaaacgatgaaagaaaatatgttcgcgaacatggattatgtctatgaggtatataaagagggaagtttttccaaggcggcggccaatctgtacatctcacaaccggctttgagcgcaacggtgaagaagatcgaaaagaaaatagggatgccgctttttgaccggagcacagtccctgttcagttgacagagtgcgggaagaagtatatgaaaacggcggaaaagatcatggatcttgaggaggattttcagtgttatgtcggcaatctcaatgaactgcggacaggccggctcacgatcggaggaacgtatctctttatctcttttgtactcccgccgattgtcaagaagttcaaggaacgttttccgaagattaagctgaatcttgtggaggcaaatacctcccagattgagaagaaactcttctctggagagattgatctgatgatggacaattatccgatggatgaggagatctatgataagaggttctttatgaaagaagctttgcttctggcagttcctgcctcctttgagagtaacaaggcagccggagcctgggggatgacttccgaggacatcagacagaatgttcatctgaaccctgaagtctatggcgttgcgctcaaactgtttgagaacgatccatttctgatgctacgctcccataacgacactcgggaacgggtagacgccatttgcagaagagcgggattcacgccaaaagtagcctttaagatggatcagatcttgtcggtactatcttatacagaaagggaaatggggatttcgattgtgagtgatacggtagtgaaaggatttccttataaccggaacatgatttattataaaatcgatgacccggcggctcagaggaacgtttacttttactacagaaagaataaatatttcacaaaaagcatggcagaatttatgaaagttgctgtggaagagaaggcaattataaacaaaaatatataaatagtatttgagaaacaaataaaaagctctgcaatatgatcggacagtttgcgatcctgattttgagtattgatgctctgcttcgtatgctgcttgacaacgatcagacaaaagagtttatcccggagaaacttcgtaagcagaacaaatatggtgcgtttagcaacggaatctggctggtagtgattctttccggagcgattattctgatccagacagtaatgccgggggcggcgtccgtgctccagcagctcacaagactcaattcggtttgtatgcctttgcggtatttgtgggtattcgtagcatatattgcgctgagaaaggcgatcaggacgattgacgcggaataccggtttgtaaaaaatcagaaaattgcctacttttttggcggatggtgcttccttattaccgctgcttgctgtatcatgggaatgtacaataaagatccacttaccatggcgctcaacattattacaccgattgtgctgactgcgcttggtctgattctcccgatgatagcaaaacgggagcaaagaaaggaaagttagaagatggataagaaggaaacagtcaaatacagggaagaagcgatggaacttgcggcatttattaaagagtcaccgactccgttccatgtgaccgccaatattggagtgatcctggaaaaagaaggttttatgccgcttcaggagagtagaaaatgggagatgaaagccggcgggaaatactatgtgacacgaaatcattctagtatcatcgcttttgagatcggggaagatccggcagattataattttcagattgctgcttcccacagcgattctcctacctttaaggtaaaagagaacgcgcagatggaagtcagaggccactataccaaactgaacacagaaggatatggcgggatgctttgcggaccatggtttgaccggccgctttctcttgcgggaagggcggttgtcaaagaagagggcggactcaaagaatgtctggtgaaaatagacagggatcttttgatgattcccagccttgccattcatatgaaccgtcaggccaatgaggggcagagcttcaataagcagacagatatgcttccgttgattgccggccgcgtgttggaggaaggcgaagtgaaggcggagatcgccggagagatcggcgtaaagccggacgaaattctggggatggatctattcctttataacagaatggagccttctatctggggaatggatgaagagttcctctcctgtccgcagttggatgatctccagtgcgcctacgcttccctgaaaggattcctggcaggaaagaacccgaaaggggtgaatgtctttgcctgctttgataatgaagaagtgggatccgggacgaaacagggtgcggcttccacttttctggcggatgtgttaaagcgtatcaacagcggtctcggaaagacagatgaggacttctgcagggcggccgcgtccagctttatgataagctgtgacaacgcacatgcggttcatccgaattacacacagaagacagacgaaggaaactgtgcttacatcaatgaggggattgtggtcaagtcccatgcgggacagaagtacacgagcgacggcgtgagtatcgcaatcttcaaggcgatttgtgagaaggcaggtgttcctcttcagtattttgccaatcgttctgatatggcaggcggaagtacccttggaaatcttgcgatggcacaggtatccatgaaagcggtggatatcggactgcctcagcttgcaatgcactcgccgtttgaaacgtccggggtcctggatatcgagtatctgaaaagagcggcagaatgttttttccggactcacatacacgaggatgaggacgggtcgatccggatggaaacagagtaactgtagcttttttgaaaaatatattgacaaccataaaaacccatgctatagttacggagtaactgccgaagacagtaggtgccggatggcataaggattaaaacgcctaccgaggaagacacaattcattacttgaatgttgacctctctgcctttgtgcggagaggttttttctggcagctcacaaatactacaaggaggtgcgttaatcgtggcaaaagtggaattaaaacagccaatcgtgcaggcgatcgctgatgacatcaaagacgctcagtctgttgtcctcgttgactaccgtggacttacagtagcacaggatacagaactgcgtaaacagttaagagaagcaggtgtcatttacaaagtctgcaagaacacaatgatgaaaagagcttttgaaggaacagagttcgcgggcctggaagaatatcttgagggaccgagcgctctggttgtatccaaagacgatgctacagctccggcaagaatcatctgcaagtttgctaagacagcagaggctctggaagtaaaagccggcgtagtagagggtaatgtttacgatgcggcaggaatcaatgaactgtccaaagttccttcaagagaagagcttctttccaaattgcttggaagcttacagtcacctatcacaaatcttgctcgtgtacttaatcagatcgctgaacagggcggagcaggagcatgtgaagcagcggctgaggaagctccggcagaagaaccggctgagacaccggctgagtaattaattcaaagagaacaaaccgaaacaaaatatggaggtaaatgaaatggcaaaattaacaacagctgaatttattgaagctatcaaagaattatctgtattagagttaaacgaattagtaaaagcatgtgaagaagaatttggtgtatccgcagcagcaggcgttgttgtagcagcagcaggcggagaggcagcagcggctgaagaaaagactgagttcgacgttgagcttgtagcagcaggcgcttctaaagttaaagttatcaaagtcgttcgtgaaattacaggacttggattaaaagaagcaaaagaccttgttgacaacgctccgaaggtagtaaaagaagcagtatccaaagaggaagctgaagaaatcaaagcgaaactcgaaggagaaggcgcagaagttaacgttaaataatttttgcaaagcaatcaggcaggattccgatgggatcctgcctcttttggtttttagacggccgggggctggtcagagtgggctgctcctggtaaaatggaagaaaggaccgatacttcagaaggtcataggacggtatagggagggcgagataagattgagcagaaacagaaagaaaaaggcagaattccggtattaccggatgccggaaaaccggacggtaatggctcttttgggagaaaagtggcgtcagaactacgggcgcgatattgattatctccatttccataattatcttgagatcggctattgccatgaggggaagggcgcaatggtgatcggagatgacgaatattattttgaaggagaaggtgaactgacggtaatcccgagtaattatctgcatacaaccaacagtgatccgggaaatatcagctattgggagtatctgtttgtagatgtggagcagatgctgaacaagatggttcccggatcaccgaggtacgtagagcagatgctgcaccaggtcaaccagagggcgatttttactaaccgtggtaaggccccggaactgacggagagtatcgagaatattattgagattatgcgaagaggagagccgttctatcaggaagaagcagaaggggagatgcttgcctttctttccaaaattgcaagagaaaatggaaatatacaagggggaggaagcgtaaatatgcgtgagaaagccaagatcagcaatctggtctccagatccctcgattatatcagtgatcattaccgggagcagatcaaggtcggtgatattgccaagcgtcttcacctgagcgagacgcattttcgaagggtgttcacacaatacatgggtgtaagccctctagagtatatcaatatggtgaggattcggtctgcgtgtgaatatctgatcaagacggatgattcgattgccgcgatcgcggagaaatgcggatattatacaagctctacatttaaccgcaatttccacaagaccgtagggatgacgccggaagagtggagaaagaaaccggaaaattttgaacggaagctgctggaattcaacgtacattcagaggagggatggtagcatgtatgcaataagaataacagaacaggtgacaagaaagaagaaggcgggggcaggtcttttgaaggtgttgatgatcgcctttggtgtgttttttgtgcttttggggattgttttttccaggggatttatgctgtcgggatttctgttgatctgtctttacctggcttatgatttttttagccagaaggaatatgagtacacgatggaaggaacacatttttcgattgatatgattacagggaagcgtcatcgcagacagatgcatgaactggatctgaacaaactggaagttgtggctccgcactggcatgacaaggttgcaaagtaccggaaaaaaggtggaacagagcacattccaaagtatgattacacatcgtatgatgatgatatcccgtactacacgatgatcataggggaggggcgggagaaggtgaagcttctactggacttaaatgacgagatgctgcgtgcattaaaaacgctttttcctgagaaagtcttttttgcataaagaaaaggaaacgaatcggatccaaaagataaaaaaaacggaagatcagataaaaacagaaagaatatgaggggataagaaaatattttcagcctaatagtgtgcaaagtggatagaaaaagcgggaaaatgaagaaaaaagtgtactgagcagacaaaaatggttgaaaatgcataatatatgtgtgaatatgcgtaaattgggaaagcgtgtcttgatataataaatcgtaggagatgtccggagagacagaatcggacatgaagataggaggtaatattatgaaaagaaagtggctttccattttacttgttggggcaatgacactgtcccttgcggcttgtggatcttccgacagtaaagatgaaaagaagagcgaagaaggcggacacaaattatcaattatggcatgggatccggcgttcaatattccggcgatccaggctgcggcggacgactacaaagaaaatgtagattccgaatttgaactggaaattttagagcaaggcggatctgaggacgttgagacagcgatcacaacggcaggatcagcaggagattattccaatcttccggacatcgtactcttccaggatcactacatccacagatatgtagctgattacccggacgcatggacttcgcttggcgacatcgatatcaactgggatgattttgctgcggaaaagattgactattctacgatcgacggggaacactatggagttccggtagacaatggtactgttgtatgtgcataccgtaccgatctacttgagcaggccgggtataccattgatgaccttacaggatgtacttgggacaagtttatggaagttggtaaagcggtcaaggaaaaaaccggaaaagctctgctttgtatgaactctgatggaaatgacctcccttacatgatgatgcaggcagagggcgtgtctcagttcaaggacggcaaaccgtatatcacagagaatgaaacacttgtaaccatcgttgagaagctcgttgagatggcaaaagaagggatccttctgatgccgaacagttggtctgattatacagacaaggcaattcagggtgatcaggtggctggtgttatgaatggtaactggattcttcctacaatcgaaaaagtagaggcaaacagcggtaaatgggaaatcaccaccatgccgacactggaaggcggagaaggatatgcaagtaacggcggctcatccctttatattacatccaactgtggaaatgttgatcttgcaaaagatttcctcgcttatacattcggcggaagcacaacaacatatgacaatgctctgagagacggcggcgtgatttctacttatgctccggcaggtgagacagaagtctacaatgaaggtgttgaattcttcaacaatcagccaatctacgctgatatcgttgagatgggaacacacgtacagaaagtagagcagagtgatttccattatgcggcacgtgattatgtcggatccgcaatcgtaaagatcatcaacggaacagatacgatggatgcactgaaagaagcagaagatcagttgaactttgatatgggcaactaatcatcgggaatcatcgtagaagaaagtatcagttaagataacgaggggcgagttttcgttcctcgttatcattcgaacgaaggaaagggagggactccagtgaaatcaaagaaaaaaatgaatctgctggcaaaacagtcggcatccggatgggttttcctcaccccggcgacgattttgatcgcggtcatggcgttctggccgatgattcaggcgttcatcatgtcgctgcagaccggttccagtgcgaatatgaaatggtccgatccgatttttaacaactacacaaggatgttttcagataagctgtttctgacatcggtaaaaaatacgtttctgtatctgctgatccaggtgccgatcatgctggtactcgcaatccttctggctcagcttctgaacaataaagatctgaagctaaaaggatttttccgtacatgtattttccttccatgtgctacgtcactggtatcctattctttgatttttaaatcattgtttgcgacagacggtttgatcaacgcaattctggttcatttgggaattttagaatccaactataattttctcggaaatgcggcaagcgcaaaggtcgttattattatcgccctgatctggagatggaccggatacaatatggtgttctaccttgccggcctgcagaatatcgaatactctgtatacgaggcggcgaaaattgacggagccaacgggtggaagacattctggaacatcactgtcccacttctgaagcccacgatcattatgacatttattatgtccatcaacggaaccctgcagttgtttgacgagtccgtcaatctgacaaacggcggtccggcaaatgcgacaattacaatgtcacattatatttacaacagtacgttcggaaaaggtgtcgcgaacttcggatatgcgacagcgatgtccttctttgtatttattattgttgcgatcctggcgtttatcaatataaaggtaggtgatacgcgtgactaagaaaaagaatagaagcatggttcagagaagattgattcctacatatatattcctcgttattgtagcgtttttctcagttttcccgttttactggatgatttccgcagccacgaatgaatctattgatgtggccagggggaaacttgcgattggcggacatttcatggagaatttccacaatctggtatccggcaatgatctttggggcgcgatgggaaattctgcgctgtatgcgattacccagacagtgcttgctattttgatctgctctctggcagggtttggatttgaactttaccacgataagaaaaaggatatcctgttttcggtcctgctgcttgcgatgatgatcccgcaggtcgcaacgatgattcctctgtttaaacttttatccggtgctaaacttttgaactctgtatggggctttgtacttccgtctttgtcgacgccgtttttgattatgatgttccggcagaattcgcgtaacttcccgatcgacgtgatggaagccgcgcgtattgatggcctgagtgagattggtatttttgtgaagatgtatatgccgatgatgaaggcgacttacgcggcagcggcagttatcacatttatgaatgcatggaattcatatctgtggccgaaggtaattatgacgactccggattcacagacaatgccaatgttgatttcaaacctggcgtccggatatacaacggactacggaatgttgatggtaggggttcttttctgctctattcctacgatgattgttttcttcattctccagaagcaatttgcagaaggtattacaggagctgtaaaataatagacagagtacccgcataaagcagtaggctgccgcaaatgcggcggcctgttttagtataataagacaccatatatcatagaaaaagagaggtaaatatgaacagacaatttgattacgcaaatgtaaaaaatccggaatatttctgtgacggtagaatggaggcttattctgaccatgcatactatgcgtccgaaaccgatatgttggatggggaaagcctgtttgccgaaagtttaaatgggatttggaaatttcactatgcgaggaactatggcgcggtgatccggggatttgagaaagaggaatactgttgtgcatcctgggatgatatccgggtgccggctcatatccagatggaagggtatgacgtcccacagtatgccaatacacagtatccatgggaaggccgggaggatatccggccgggggagatcccggaatattttaatccggtggcaagctatgtgaaatatttctctgtcccggaacggatgaaagggaagaggatctttgtttccttccagggagcggaaagtggtctggcagtttggttgaatggagtttttatagggtacagtgaggacagttttacaccttctgattttgagctgacaggctatctgaaagaggggcaaaataaactggcggttcaggtatttaagtggacagccggaagttggtgtgaggatcaggatttctaccgtttttccggactttaccgggacgtatttctgtacactgtaccgaatgtacatatccgtgacctcaggatcagggcaattccggacgagacacttcagaaagcagaattggagattgtttcttgcacctggggagaaggaaaagcgagatttgtcctttcgcgtcacggaaaagtatttgtagatgaggaaaaagagctgaacagagaaaaccggtttgtgtgggaggtagaccaccctgcactctggagtgcggaagtgccgaatctttatgatctgatgattacagtaaccggaaaagacggggctgtgacagaactgattccggagaaagtcggatttagaagatttgagatgaaagaccacatgatgactttgaacggaaagcggattgtgtttaagggagtgaaccgccacgatttcagttctgtcgggggacgtcatgtatccgaggaagagctgcggaaggatctcacggtgatgaagcagaataatataaatgcgatccgtacaagtcattatccgaacggttccctgctttatcgtctctgcgatgaatatggcctctatctgattgatgaaaccaatatggaaacacatgggagctgggatacggttcgcgcagatggcgacgacgactatattgtaccaaatgacaggccggaatggctgccgcttctcctggacagggagaattccatgtaccaaagagataagaaccatccgtcgattctcatctggtcctgcggaaatgagtcctacggtggaaaagatatttacgaaatgtcacagtttttccgcaaggaggatccgaccaggctggtacattatgaaggtgtatttaacgaccgcagatataatgatacgagcgacatggaaagtcagatgtatactccggtggagaaaatcaaagaatttcttgcaaaagacaggagcaagccgtttatctgctgtgaatatacccatgccatggggaattcgtgcggagcaatgcataagtatacggatctgacggacacagatccattgtaccagggaggctttatctgggattatatcgatcagaccatttataagaaagaccggtatggacaggaattccaggcgtatggaggagattttggcgagaggccgaccgactataatttcagcgcgaacggcatcgtctatggaggagacagagagccgtccccgaagatgcaggaagtaaaatataattatcagaatattacggcgaaggtttccgaaaacagggtgacgatcatcaataagaatctgtttctgaacacgaacgcattcgactgtgttgttctcgtggagagaaatggaaaagcgcttcgacagatcaagatggagacggaggtagagccgcttggtgaaaagacctatccgcttccgtttgcgaaggaaactctgccgggagagtatacggttaccgtttctttccggctgaaggaagatcagatctgggcaaaagccggacatgaggtggcgtttggacagtatgtctaccgtaaccagggggagaaaaagctgtgtaagcgtccggttaaagtgatccggagtaaacataatattggggtcagaggtgagtgttttgaagtgattttctctgttttggatggtggactggcatcctaccggtatgccgggaaagagatgattaaagaaataccgaagccaaacttctggagggcgcctgtggacaatgaccagggtaaccagatgccaaaacgttatgcacagtggaagattgccagtatgtatgccggacacaaagattaccgaggcgctgactgctgtaaagtcttggagccgaaagtggaggtaaaagagtattcggtccgtgtgacctacacatatttgatgccgacgaccccggacagtcagtgtcaggtggcgtatgaagtgtacggagatggaactgtgcagacgacactttcttatgatccggtaaaggagctgggcgatatgccggaatttggtctgatgttcaagctggacgcggattatgaccatgtgacctggtatggcttgggaccggaggagacttatgcggaccgaaagaaaggggcaaagcttggagtatatcaaaatcttgttcaggataatttggcaaggtacattgtgccgcaggaatgtggggcaaaagaggaagtccgttatgcatctgtgacagacagaagcggaagaggtatgctgtttgagatggacgagaagagcggaccgatgatgttctccgcgctcccatatacgccacatgaaatggaaaacgcgaaacatgtgtacgaattgcctcaggtgcattacacggtggtacgtgcggcgctcgggcagatgggaattgcgggagacgacagttggatgtcctttactcatccggaatacttactgaatgtagagggaaagatggaatttacgttccgtttccgtggaatataggaatgacagggaggacgattgatgttaggtgggagaatcctttacgggggtgactacaacccggatcagtggctggaacatccggaagtactggaacaggatgtgcggcttatgaaagaatcgaaagtcaactgcgtaagcctaggcatttttgcctgggctgcgctggaaccggaggaaggagtctatcagatggactggcttgaccggcttatcaccagaatggaggaggaagatattcaggtcattttagctactccatctgccgccatgccgcactggttgacgcaaaggtacccggaagtaatgcaggtacaggcggacggtcgccgcaacctgccggggaaacgtcacaatttctgctatacttctcctgtcatgcgtgaaaagacgaaggcgatagacagagaactttccaggcggtttggcagaaggaagaatgtgatcttgtggcatatttccaatgagctgggcggaaattttgcggactcagtctgccattgtgagtattgtcaggctgcgtttcgcaattggctgaagaaaaaatatgggacgctgcaaaatcttaaccaggcgtggtggaattatttttggagccataattatacggattgggaacagattcacagcccggtgccgaatggggagacgaccagcacggcacttctgttggactggcggagattttcgaccgagcagatccatgatttttatcagatggaagtgcaggtggtcagagaatactcagaacttccggcgacaaccaattttatgtatttctttaaggggctggattacaacagaatgaaacacggagtggacgtcatttcttgggacaattatccgttttggcataaacgaaaggatgaagtgccctctgcggtgaaagcggcggccaatcataatatcatgcgggcgctgaaaaggcagccgtttctcctgatggagagcacgccttcggctgtaagctggagggagtacaatcctctgaaaaggccgggtatgaatatgttggccgggatgcaggccatcgctcatggttctgattccgttttgtatttccagtggagaaagggacgtggaggatatgaaaaattccacggtgcggtgcttgaccataagaatgggacaaatacgagagtattccgggaagtgactgagctgggagaacggcttgcaggattgggagaaaagatccagggaacagtcaacagaccaaaggcggctattcttttcgattgggagaactggtgggcggtagaggacactcaggggccgcggttggatatcaagtatgtgaagacgatcctttctcattattgcgcgttctgggagcaagggattgaagcagaccttattgggatggatgagccgcttgatgattatcttcttgtatcggccccgatgaattatctgtacaaagatggatatgcggatcgtgttcgtgcgtttgtggaatctggcggcgtgtttgtaacaacctgttttagcgggatggtgaatgagacggatctttgttttacagagcagcatccgctggaggacgtgcttggcgtcatacaagaagaaattgacgcaccgtccgaggagtttgggaacagctttcactatgatggaaagacgtatccggcaaaattcctgtgtgaaatctcgcatgcgaaagaggatacggaggtgcttgcgtcttacgaggaagatttttatgcagggtatccggctgtgacctgtcatccgtttggaaagggatctgccttttatctggcggcaggttccgatcaggagtttttgagggtgttttaccgtgatgtgttccgaaaagccggagtggaaaatgcccttcgggcaaagcttccatatggggtgacaacggcagaacgtattgcggatgatggaacgaggattgtatttgtgatgaatttcaaaaatgaaccggtcatcgtggaagatatcggaatctggacagatgcggaaactcaggaacagtatgaggatgctctgcagatgaagccgttcgagtgccttgtactgacaaaacagaaaacgaatggtaattgagcttgattgccaagagagcgcaaacataataagatagaatgaccagggagacgtgttcttatgaaaaggagcgcgcctccctggtcttttcattggtgtgagggatgggatgggttagattacggagccgagaacttcttttaattcggtagcagatcttttgagcttttccagctcgtccggactaagggggatctcaagcgcctgttcagccccttttccggatacgatagtaggtacgctgatacagagatcacgtagaccatactcgccgtttagaagactggaaacagggagaacggaatgttcgttgcgaatgatggattcggcgatccggctgacagccatagcaacaccataataggtagctcccttgcggtcgatgatttcataggcactgtcacggaccgtatggtagattcggttcatggcttgttcatggtcgtaatgtccccgaagttcgcagaagtcgttgatgctgatgccggagacattggaactgctccagacggcaagttcactgtcgccgtgttcgccgataatataagcatggacactgcggctgtctacggtgagatgttcgcttaagaggtaacgaaaacgggcggaatccaggacagtaccgcttccaagtacccgttcttttgggtagccggaaagcttcagggccgcataggtcaggatgtctaccggattggcgacgatcagcaggatgccttcaaagtttcgttttgtgatctccgggataatggccttgaaaatggcgatatttttgtggacaagatcaagccttgtctcacccggtttttgattggcacctgcggtgatgatgatcagagcgcagtcgctgatatcatcataggatcctgcgtaaatgtgcattggagaagtaaaaggtctgccgtggcttaaatccatggcttcaccctccgcttttttttgatcggcatcgataagcacaagttctgaaaataatcctttgtgtaccagactgaatgcagtggacgctcccacaaatccacacccaatgatggcggcttttctgatattgatcatatggttgacctccttgagtatattcattgataaaaacaataatagtttctgtttcaaagtagcataaaggataatgtaagacaagggggcaaaaaaagaaaaaaatccttgacacacggaaagggcttgtgatacaataaaatgcactattgtggggaggtgggctgtaaaaagggctgagatagcactttaacccccacaatatactatgaaaactggtgattttcacgagaataataatacaaggagtgaaacgtcaatggagaaaaacagaattcgtcccatgaaaagcggaagaagttcccggatgacctattccagacaaaaagaagttctgcagatgccaaatctgattgaagttcagaaggattcttatcagtggtttcttgatgagggtctgaaagaagtgttcgatgatatttcaccgatcacggattacagcggacagttgagtctggaatttgttgattttacattatgcgaagatgatgtgaagtacacgatcgaggaatgcaaagagcgggatgcgacttacgcagcgcctttgaaagtaagagtaaggctttataataaggaaacggatgagatcaacgagcacgagatctttatgggcgatctgcctattatgacaaagacaggcacctttgttatcaatggtgcggaacgtgttattgtaagccagcttgtgcgttcccctggtatctactacggaatcgcgcacgataagattggtaaagagctctattcctgtacagtcattccgaaccgtggcgcatggctggaatatgagacagactctaatgacgttttctatgtaagagtagatagaacaagaaaggtaccgattactgtgctgatcagagcgcttggtgtcggcacaaacccggaaatccttgagatgtttggcgaggagccgaaaatccttgcaagctttggcaaagatacggcagagaactaccaggaaggccttcttgagctctacaagaagattcgtccgggtgagccgcttgcggtagacagtgcggagagcctgattacaagtatgttctttgatccgagacgatatgatctggcgaaagtcggacgttacaaatttaataaaaaattactccttaaaaatagaatcacgggacagattctcgcgagagaggtgttcagtccattgacaggtgaaattctcgctgaggcgggaactgaggtgacaagggaactcgctgacacgattcagaacaatgcagtgccgtttgtatggatcagccgtgaaggagaagacagagatatcaaggttctttccaatatggcggtagatctgaaagaagcagccggcattgatcctgaggaagtaggcgtttccgagcttgtatactaccctgtccttgcggacctaatggaagaggcggcaggtgatgcagaggagcttaaggaagccatcagaaagaatcttcacgagctggttccgaagcatattacaaaggaggacatcttcgcgtccatcaattacaatatgcatctggaatacggccttggaaatgacgacgatattgaccatcttggaaacagacgtatccgggcggttggagagctgttgcagaaccagtaccggatcgggctttcccgtttggaaagagttgtccgtgagaggatgacgacccaggatctggagggaatttctccacagtctctgatcaatattaagccggtgacggctgcggtgaaagaatttttcggttcctcccagttgtcccagttcatggatcagaacaatccgctcggtgagctgacgcacaagagacgtctgtccgcactcggaccgggaggtctttccagagaccgtgccggatttgaggtccgcgacgttcattattcccactacggaagaatgtgtccgatcgagactccggaaggtccgaatatcggtctgatcaactcccttgcgacatatgccagaatcaataaatacggatttgtcgaggctccgtaccggaagattgacaagacgaacccggaaaatccggtcgtaacagacgaagtagtctatatgacggcggacgaagaggataattaccatgtggctcaggcgaatgagcagctcgatgcggaaggacattttgtgagaaagaatgtttccggtcgttaccgggaagaaacgcaggagtacgagagaagcaagttcgactacatggatgtgtctccgaagatggtattttccgttgcgacagcacttatcccattcctggaaaatgacgatgccaaccgtgcgctcatgggatcaaacatgcagcgtcaggcagtaccgctcctgacaacagaagctccggtagtcggaacaggtatggaagagaagtccgcggtagactccggtgtctgcattgttgcggaggaggcaggcgtcgtagagagggcggcttccacagagatcatcattcgtcaggacgatggcgtgaagaaaacttacaagcttacgaagtttttacgaagcaatcagtccaactgctacaaccagagaccgatcgtattcaagggcgaccgtgtggagaagggtgacgttattgcggacggaccgtcaacatccaatggcgagatggcgcttggaaagaatccgttgatcggatttatgacatgggaaggatataactacgaggatgctgttcttttgagcgagcgtcttgttcaggacgatgtgtatacatccgttcatattgaggaatacgaggcagaagcacgtgacaccaagctgggaccggaagagatcacacgagatatcccgggcgtcggcgatgatgcgctgaaagatctcgacgagagaggaatcatccggatcggtgccgaagtgcgtgccggagatattcttgtcggaaaggtaactccgaaaggagagaccgaactgacggctgaggagcgtctcttaagagcgatctttggcgagaaagcccgtgaagtgagagacacttctctgaaagtacctcacggagaatatggtattgttgtagacgccaaagtatttacaagagaaaacggagacgagctttctccaggtgtgaaccaggcagtgcgtatctacattgcccagaagagaaagatttccgttggtgacaagatggccggacgtcatggtaacaagggtgtcgtttcccgtgtgcttccggtagaggatatgccattccttccaaatggccgtccgttggatatcgtgttgaatcctctgggcgtaccttcccgtatgaatatcggacaggtgcttgagatccatttaagccttgcggcaaaagctcttggctttaatgtggcgacgccggtatttgacggagcaaacgaaaatgatattatggatacacttgacctggcgaatgattatgtcaatctttcctgggaagagtttgaagaaaagcataaagaagagcttcttccggaagtgatgcagcatctttacgacaacagggagcacagaaagctctggaaaggcgtgccgatttccagagatggtaaagtgcgcttaagggacggacgtaccggcgagtactttgacagcccggtaacgatcggacacatgcactatctgaagcttcatcaccttgttgacgataagatccatgcacgttctacaggtccttactcccttgtaacgcagcagcctctcggtggtaaagcacagtttggcggacagcgtttcggagagatggaggtttgggctctggaagcgtacggcgcttcctatacactgcaggagatcctgacagtaaaatccgacgacgtcatcggacgtgtgaagacatacgaagccatcatcaagggcgacaatattccggagcctggtattccagagtcctttaaggtgctcttaaaagagctgcagtctcttggcctggatgtccgtgtgctcagagaggacaatacagaagtggagattatggagacctccgattacggtgagacgaacttaaacgcaatcatcgaaggggacagaagatactccggcgacagagaatcctacggcgagcatggtttctcacagcaggaattccagggagaagaattagttgacattgaagaaggacaggatgaggaagaactggattttaacgacgaagactttacgattgattttgacgaaatgtcagacgaagaatagaaaggggtgccgtaatgacgggaaacaataatgaagcgacgtatcagccgatgacctttgacgcgatcaagatcgggctggcatcacctgaaaagattctggagtggtcaaggggagaggtcacaaaacctgagacgatcaactacagaaccttaaagccggagcgtgacggactgttctgcgagcggattttcgggccgagcaaggactgggaatgtcactgtggtaaatataagaagatccgttataaaggtgtgatctgtgaccgctgcggtgttgaagtgacgaaatccgcagtacgccgtgagcgtatgggacatattgcgctggctgccccggtatcccatatctggtattttaaaggtatcccaagccgtatgggactgatcctggatctttctccgagaactctggagaaagtactgtactttgcttcctatattgtactggacaaaggggagacggacctgcagtataagcaggtgctttccgagcaggagtatcaggatgcgagagaaaaatggggaagtgctttccgtgtcggtatgggtgcggaagcaattcaggagcttttaagaagtattgacctcgagaaagaatatcatgaattaagagaaggtctggagggcgctaccggacagaagcgcgcgagaatcgtgaagcgtctggaagtggtagaagcgttccgggagtccggaaacaagccggagtggatgattatgacagttatcccggtcattccgccggatctgcgtccgatggttcagcttgacggtggacgttttgcgacatccgacttaaacgacctatacagaagaatcatcaatcggaacaaccgtctgagaagacttctggagcttggtgccccggatatcattgtaagaaacgaaaagagaatgcttcaggaggcggtagacgccctgatcgacaacggccgccgtggccgtccggtcacaggacctggaaaccgcgctctcaaatctctttccgatatgttaaagggaaagtccggacgtttccgtcagaatctgctcggaaaacgtgtcgattactccgggcgatccgttatcgtcgtaggaccggagttgaagatctatcagtgcggtcttccgaaagagatggcaatcgagctgttcaaaccgtttgtaatgaaagagcttgttgcgaatggtacagcgcacaatattaaaaacgcgaagaagatggtggagagacttcagacagaagtttgggacgttctggaagacgtgatcaaggaacatccggtaatgttaaaccgtgcccctactctgcatcgtctgggaattcaggcttttgagccgattctcgtagaaggaaaagcgattaagcttcatcccctcgtatgtaccgctttcaacgcggatttcgatggcgaccagatggcagttcatcttccgctttctgtagaagctcaggcggagtgccgcttccttctcctttcaccgaacaacctgctgaaaccgtcagacggtggtccggtagccgttccttcccaggatatggtacttggtatctattacctgacacaggaaagaccaggagccaaaggagagggcaaatcattcaagagcgtaaacgaagcgattcttgcttacgaaaaccaggcgatcaccttacattccagaatcaaggtacgtgtctccaagacactaccgaatggaacggtgaaatatggaattgtagagtctacactgggacggttcctcttcaacgagattattccgcaggatcttggttttgtagaccgtgaagcagagggtaatgagctgcttttggaagtcgatttccatgtcgggaagaagcagttaaagaagatcctggagaaggtaatcaatacccacggcgcttctgcgacagcagaagtacttgacaatgtaaaagccattggatacaagttctccacacgggcagcgatgacggtatctatttctgatatgacggtacctccgcagaagcctgagatgatccagcaggcacaggatacggtggataagattacacggaactttaagcgtggtctgattaccgaagaagagcgttacaaagaagtcgtagagacatggaaagcaacagacgatgccttgacagaggctctgctttctggtctggataaatacaacaatatctttatgatggcggattccggagcccgtggttctgacaagcagatcaaacagcttgccggtatgcgtggtctgatggcagatacgacaggacggactatcgagctgccgatcaagtccaacttccgtgaaggtctggatgtactggaatacttcatgtcggcccatggagcacgtaaaggtctttctgatacggctcttcgtacagctgactccggatacctgacaagacgtcttgttgacgtttcccaggagctttctatccgtgaagtagactgtgttgccaaaggagaagaaattcctggtatgtatgtcaaagcatttacggatggaaacgaagagattgagagccttcaggagcgtatcacaggacgctactcctgtgagacgatctgcgacagtgaaggaaatgtcattgtaaaggcaaaccacatgattacaccgaagcgtgcggcggcgatcgtcacaaaaggtgtggatgaaaacggcggcgaaatcaagaaggtgaagatccgtacgatcctgacctgtaaatctcatcttggcgtctgtgcgaagtgttatggagcaaacatggcaacaggtgaaccagtccaggttggagaggcggtcggaatcatcgccgcacagtctatcggtgagcctggtacacagcttacgatgcgtactttccatacgggtggagttgccggtgacgatatcacgcagggtcttcctcgtgtcgaggagcttttcgaggcaagaaagccgaagggacttgcaatcatcacagagtttgcgggaaccgcaacgatcaacgatacaaagaagaagcgtgagattattgtcaccaacaatgagacaggagaatccaaggcatacctgattccgtacggttccagaatcaagattcaggacggtgtgcagctggaggccggagacgagctgacggaaggtagtgttaatccgcatgatatcctgagaatcaagggactgcgtgcagtacaggattatatgatccaggaagtacagagagtataccgtctccagggtgtagatatcaacgataagcatatcgaagttattgtgcgtcagatgctgaagaaagtccgcatcgaggagaacggagattctgaattccttccgggaaccatggtagataccctcgaatttgaggatagaaataaagagcttgtggctgacggaaaagagccggcgacaggtgagcagatcatgcttggtatcaccaaggctgcgcttgcgacgaattccttcctctccgccgcatccttccaggagacgacgaaagtcctcactgaggcggcaatcaaaggaaaagtcgatccgctgattggcctgaaagaaaacgtcatcatcggaaagctgattccggttggtacgggcatgagcaagtaccgtgacatccggctgaataccgacgctatgattgcggccaagaaagaagaggaggaacgtcttcgccatgaagcggaagaaaaggcggaatccgaacaggaggcagcagtagagtctgagggcgagaatgcagatgagatagaagtagcagatacagagatggaactgacagaagaaatctctgaggaaacagaggaagatctggatgacatgtccggcgagtcggacgacgaagatatggaaaacgtcgaatcggcggaataaaatccgaaataagatccgcaagttgagttggagattataatgttaagaaaatggcttacagattgtaagccattttctatgtataaatagatttatttccgttccagtgtcgtccctttgcggaaccgttcacaggacttcatgtacttcatgcagaagtagaatacgagtccggtaggtatggttgcggtaaagaaagacacgtcaacattaatcagaccaatcaaagcgccgacagcaatggcgatgattgcggcccagttgacgccagcatgattgccctttggatcgtacagatccgccagcgcggcgtcactgtatttccttttgtgcagaatgaaaaagtctgtaatcagtaccgcaaagatcggtccgaagaatgcggtgtaaatcttactgaacatggcaaggcctgcggcggaactgtcgtttgtcagaatccatgggcaggtgcagacagccagaataccaatgaggatgactgctgtccggtgcttcatcttgaaagcgtccataaatgcataggccggcgggatgacgttgctggccaggtttgtggtaagctgtgcaaagatgatgaaggatagagtgacgatcataacgaccttattatctaccatctgcgcaaatgcgttgatcgggtttgccactcctgttgctgtagaagccatggctccaatgacaccaagaaggatcgttgcaggaaccattgccaggaagtaagaggcacctcgtttcataacggacattcctgacttcatctcacgagagtagtcaccggcattgagcataaccgtcgtactgtttccgaagaaggcgatgattgccgctacaaacggcataccccaggtgccggatttctgcatcagattctcgctgacaacagtaccgtactgggtgacgcacagatagagaagatataacatggcgatggagatgacaacgccgccaatattaccgatccattttgcgccctggaatcctttaatggaaaggagaatctggatgatctggaacacgaagaaccacagccagatattgtcaaatccaaagagggcgatggtgatattgttgatggccgcgccgccaagccaggtctggtacccataccatacgatagcaggaagtccacggatcagacttggaacaacatttcccttcgtaccgaacgcgcttcgaagctgtacagcgtacggagcgccggtcttgtagctgaattgatcgttcagcgcaatgccgacgaccaggatcagggaaccaatggcaacagccagaaacaactgtgtcaggttcagcccagcttcaagctgtgcagaaccctgtgccagcgtaccaatagagatacagccgccaagccagagcattgtattggagccccagctcataatccgtttctccgcaggaatcggatttaaggaggcactttcctgttttacttcattatttttttttgcttcgctcatattgtttttccttccttatggttgctaattaacaggggtgatgtattcgccgtaccctattgcgtccggaatgtaagtctggccgtctgccacaacttttccgcggatcaccgtgcagacaggagcgccctttccttccagaccatcgaaacaggatacgtggcccttggtgagcagcttgctctggtcacatttccatgatttgtccggatcgacaatgacaacatcgccgtcaaatccaagctcaaacgctcctttgcgtccataaagcccgaagacttttgcaggattgtagtccatgactttggcaatcaggcttgggctaaatccttttttatgtacgaccatatcgaacatcattggaaggaagaactgaatggagttcaggccaccccaagcgtgccagatatctttggtggcattatctttctcctcatcggccgccggagaatgatcgcttccgatacaggaaagtgtgccatccagtacatagtcccagagcttttccattgcctctttgtttcgcatcgggggtgtgcattttgcgggagcgcctttctcaaatacaaaatcctctgtaaaaccaagataatgcgggcaggtctcagcagtgatcggaagaccttcgtggatggcgtcctttacaacctgggcaaccatcgggtggctgacatggcaaatgtggacacgtccgccggtggcccttgccatatcaatcacattctttgtcgctacatattctgtccagacatcgtgagaatccagaaaatcacgaattttctcttcacttgtgcggttctctttggacttggcttctttttcccgttccaatacctgtccatattcctcgcagtggaaaccacaaagtgcgttgtacggcttcagaatctcgagagctttccgcacatttccgaggttgacggtaggaaagaggtccccgttcggacaggtgaatcctttgaaagcggcaacgccacagttgtaaagatccaccagatcgtttatgttgtttttgacggaatctggcttgttgtcgtaatcccctacaagtccgccccacaatgcgtagtctacgagtgaatgacggctgactttgcttagcttcaagtcaaagatttccttgttcatcagggacggatcgttgttcagcggcatatcgatcagacatgtacagccggcaacaacagcggcacgggaaccagtctcaaaatcctcgcggtactcaaatccaggttcgttcaggtgtgcgtgacagtcgataattccggggaagacataatttcctttggcgtcgatcacttcttttgcttcagcttcggtgccttttgcaagaaaggccgcgtacttgccgtcctgaatagcaatatctgcctcgtagatccgatccggtgttacaagttttccgtttcttaccaacaaatcgtacatacattttcctcctataaattttctgaatattttttgaaacagatgcaaattcaaacaaatacaatgtttcaaaataattatataaacaatatattattccaaaaacataaaaaaaacaatggaggaaaatcgggaaaataaaaggggattttatctattatgtataaaaaagtttttatggttttactaaaattggtgaaaatgaaaaatataaactgttgccggataggcattgcgtccgcttatttttgtgttatacttaaaaacaaagacaaaaatacgaaacagaacaaatgagaaaggatgatgaagtaatgaatcagtttcaagggttgacggcggatgaccttgcaggatttgaggcaaagtatatggacagtgcgctctgccgcgcgattacgaatgtactttataaacattcggtaaaggatgcggcattttgccatgagggccttgcgaaatcccaatatgctttttccatagacatcccgaccatgccagttacaaatcagaaagcaagcggacgctgctggatcttctctgcgctcaacgtgcttcgggaagtgacggcaaagaaatgcaatcttgagaaatttgagctgtcccagaactataccgcattctgggacaagtttgagaaagccaattatatgctggagagtatcatcaatttagcggatcgtccggtggatgacaggattgtctgtcacgttctttccgagggtgtaggtgacggcggacagtgggatatgtttgtcaatctggtggaaaaatacggagttgttccaaagagcgccatggaggagacataccagagtagtaatacgagagatatgaatgggctgttgaattccaagctccgtcaatgtgcggccgcgcttcgccagactatcagagagggaggcgacccacaggcgcagaaaaaagaaatgatgtccgagatctatggatttctctgcatgtgttttggaaaaccgccgaagagtttcgattttgaatatgtggataaagataagaaataccatgtaatacgtggattaacaccgcggacattctatcaggaatatgtgggactgaatctccgtgaggattatgtcagcattatcaattccccgacgaaagacaagccgtttgggaagagctatacggtggattaccttggaaatgtagctgagggtgcgccggtacgttactacaacattccaatggacacattaaaagaactgattatccgccagctttctgatggtgagatcgtgtggtttggaagcgatgttggaaaatacggggagcgtgatatgggactttggagcacagactgctatgactttgagggtacatacggcatccattttgatatggaaaaaggagaaagcctggactaccgggagagtgccatgaatcatgccatggtgattaccggtgtggatctggacgagaagggcaaagccctgaaatggaagatccagaacagttggagcgacgaacatggtgagaaaggctactatctgatgggagccgagtggttcgatcgttttgtatatcaggctgtgattcataaaaaatatttgacagaggctcagattgccgaggcaaatgcggagccgatccatctcaatccatgggatccgatgggaacacttgcaaggtaaaacagcagaacgaaatcaataaaaatttttatggcgccggaaaactgatccggcgctgtaaagtttaaaaataaaaaagcaggaggagagaatcatggtgatgacacgtgagagggcacatgagattttacacaaatatatggaaggggagcgctatctggaacattcctatgcggtggaagcgatcatgcgtggagtcgccgcaaagctggctccggacgaggtggaatactgggggattgtagggcttctccatgatttggacgaggagcactgcctttggaaagagcatccggagacacacggaccgacatcggtcgagatcctgaaaaaagaaggcgttgaggatccggttctgtttgacgccatttgcgcccacaatccggagagcggagtgaaggcaaagacaaagctgcagtacgcaattctggcctgtgatccgatgagcggatttttaaaagcaatcgcccagatctatccagacaaaaagatcgcaagcgtcaagcacaaatccgtgcagaaacgatttcgagagcaccgttttgcggcaggcgctaaccgggattacatggaagcgattgagtttacgggaatggattttgacgagtttattgatatcgcgctggaagcaatgcgggaaattgcggaccagatcgggctgtagaaggagggttttgctttccgtatcaatcatcattctttatatcatggattgcggactcagaagagtccgttttctgttttggacaaaaaagtggagccgctgctctggcagattacagatctactgtagcatcagccccacccggttttattgatctaattttaagccatctttaaatgcttcgccaactcgctcggttactttatagtatccatgagtataaggatcaaaagcgatagcgtttaccaaagtcatatcaggcttatcgccaaccataatgcgctcatcagcggtaatattgacaacttttccaatcacaccgcatccatattcgtttttctggtattgaataaattcgcactctaagcagataggaaattcgttgatgacaggtgcgtccaccatctcggctttacttgtagtcagcccgcttttttcaaatttatttacgactttgttgccggttacaacaccaaaatagtctgcctcaactacatgatcggcgtccgcgatactaactgtaaaagagcctctggcccgaatgtttttaaccgttttatgggattctgttaattgaagagccacggtatttctggactgcatggttccccatgcggcattcataacattgacgctgccatcttcgttataagttgttaccattaaaacaggcattggaaaaataccttccgttaattttaatttttttctcatgctgtctgcctccttgtctgaaattgacataagtcctaatcttgcatataattatagcaagtaacaaagaaaagacaagtactgtcaaaaaagacaggtactattattaaggaaagtatacatgataaaaaaatacattgaaaattcaaattttgaagagacaggattttattacacgctatcgctgatttcagggaagcacaagatgattattctttattgtctgatggaatttgaggttgtacgtttcaacgaattgaaacgctatttaaaaaagataacggataaaactcttagcaataatttaaaagaactggaagcaaatcatcttatcattagaaaagagtatcctcaaatacctccaaaagtcgaatatcgtttgagtgacagaggcaggtccttgatgaaagtattagatcagctatgtgtttggggagaaaataaccgagaagagtgagtacgggaattcaaattggatgattttgcaggccggaaagctgacagagaatgagtaagagtgctgtttcgtgctaaaatagatgaagcagcataacggggggaacggcaaatggtttttgaaaagatgctgacgatgcaggggatgatgttcttctttgtgatcattggctttattgtgagaaagagaagaattgtagggacgacaggtcggctcaatatggtggatctgtgtctttatgtgttgctgccttttaatatttttcatgcctttttagtacagccccatcacgatgtgtggggaccggtggtgattacgatactgttgtctgtactctacaatgtaatctcggtggcgtctgcctttctgctttacaaaaagacggacgaggagaagaaaaagccgctccgttacggaaccatcgtttctaacgggggattccttggcaatccggtgatcgagagcatttacggaacgtccgggcttttgtacgcagcggttttcatgcttccagtgcgggtggtgatgtggtcggtgggcgtctcctgcttccttccgggacagaaaaagaacgtgctgaaaaaggtgatcactcacccatgtattgtcgcgatctatctgggactgattgtgatggtgctcccagtggcatggccagattttttcccgaatggggtggagggcttaagcagcgctaacacgccggtcagcatgatgctcatcggaatgatgctggcggagatggatccgagagggcttgtcgaccggacgatggtatggtatacggcagtgcggctgatctttattccggcagttgtatttggggtgacggcgccaatgacactggatccggtactgagggggatcacggtgattatggccgggatgccggctccggtgacgacagcgcttctttcctctaagtaccatggggacgagcggtacgcaaccggtatgatttttttaagtacactttcgtctcttgtgaccctgccgctctggtgtttgctgctcggataggagatagaaaaaactgataaagagaaagaaattgtctataaaataactgataaattattaaccgataagtttattttttaacgcttgacgaaagaaggtgtgaattttataataaatttaaagttgaatgaagaatctgtgagataccactatggtgcgatgtgcagcacggaaatgatagccggagccgaaggggcatgcaagaaactctcaggcaaaaggaacaggttcggacaacactctggagaacaatatgattgtaccgaagaagtaatctgaccggcagcacagcaacgtgtcagataatctttcaggtaaaaggacagaggcagatttgagaacttctcgtaaagagggaaggctcttgatctgtcttttttgatgcgccggattttcggccggaatccgctgtggcaaaaaagacatggacaagtaacagttcagccataaccgttcagacataacagccaggacgagccgctatgcggcttttatcgccacttgcgtggctgaatcctcgctgatggcagaacgccatatacaaagtacacaaaaattcttcgttttcaaacaagtttgaactcagatttttgtgactttgtacatggctgaactgttgccagcgtattgattgaggaggaattacgaatgagtatggtagacgatgtaacaacttacatcaaaaagtatgaccctgaggtcggagcggcactggaacaggagctgggaaggcagagacggaatctggagctgattgcgtcggaaaatatcgtaactccggttgtaatgatggcgatggggacggtgccgacgaacaagtatgcagaaggatatctggggaaacggtattacggcggatgtgaatacgtggacgtgattgaaaatctggccattgaaagggctaaaaagctctttggaagcgagcatgtatgtgtacagcctcattccggagcgagcgcgaacatggcagtgtaccaggcgtttttgaagccgggggacacagtaatgggacttaacctggatcatggaggacacctgacacacggatcacaagtcaatatgtccgggattctctaccacttcgtaccgtacagcatcaatgacaagggatttttgaattacgacgaaatccgccgcattgccaaagaatgtcagccgaggatgatcgtggcaggcgcgtcagcttatccgagggcgatccggtttgatttgtttgcggagatcgcaaaggaagtcggagcgattctcttcgtagacatggcgcacattgcgggactggtagcggcaggacttcaccagagcccggtgccatacgcggatgtggtgacaacgacgacccacaagacgctgcggggaccaagaggcggcatgattctgtgcaaggaagaacacgcaaaggcaatcaacaaagcggtattcccaggcacccagggcggtccgctggagcacgtgatcgcagccaaggctgtctgcttcggggaagcgttacgaccggaatttaagacttatcaggagcagatcctaaagaacgcaaagacacttgcggatgcgctcatggaagagggattccagcttgtcagcggcggaacggacaatcatctgatgctggtagatctccagaacatgggaatcacgggaaaagagcttcaaagacggcttgacgaagtgtatatcacagtcaacaaaaatgcggtgccgaacgatccggcaagcccgttcgtgacaagcggaatccgtatcggtactccagcagtcacaacgagaggactcaaagaagaagagatgagaacgattgccagactaattaagatggctgtgacggactttgatacaaaggcggatgagatccgtggcacagtaaacgaaatctgtggaagatatccgttatacgagtagaaaggagtgaggggatggaattaaaaacaccactttatgaggaacatgtaaaggcgggcggcaagatcgtgccgtttgcgggctacctgcttccggttcagtacccggcgggagtcatcaaagaacatatggcggtacgtacccaggccggactctttgacgtttcccatatgggagaagtactctgcaccggaccggatgccaaagcaaacttacagatgcttctgacaaatgattatacaaagatcaaggacgggcaggcaaagtacagcccgatgtgcaatgaacacggcggcacggtggacgatctgatcgtttaccgcaaatcagaggaagaatatctgattgtcgtcaatgcagcaaacaaagagaaagattatcagtggatgctggatcatcagtttggcaatgtgacgtttaccgacgtctccgaacagtatgcacagcttgcgctccagggaccaaaagcgcttgacattttaagaaaactgacaaaggaagaatggattccgcagaaatactatcatgcggtatttgacgccgaggtggcaggcatcccttgcattgtatccaaaaccgggtacaccggagaggacggtgtggaactgtatctggcgtccgaatatgcggcgcagatgtggaacgcccttctggaagctggaaaggaagaaggcctcattccatgcgggctgggagcgagagataccctccggatggaagcggcgatgccattgtacggacacgagatgaacgaggaaatcagccctgtggaggcgggacttacctttgcggtgaaactggcaaaagaggacttcatcggaaaaaagtcattggaagaggcaggagagccaaagcgggagcgcatcggccttaaagtgaccggaagaggcattatccgggaagagcagaccgtaatctgtgcgggagaagagattggaacgacgacctccgggacacattgcccatacctgggatacccgatcgccatggcgcttgtgcaggccggtaaagtagcacctggggacaaagtagaagtcaatgtgcgtggacgaaatgttgaggcggaagtagtagaacttccattttataaaagagcgaaataaacagagaaaaggagaagaatcatggaaatcagagaagaattaaactatgtcaaatcacacgaatgggtaaaagaagagggagaagtcgtaacaatcggtctgacggattatgcacagtcagagcttggcgaccttgtttttgtcaatcttccggaagaaggagatgaagtgagtgtgggcgaagcattcggtgatgtggagtctgtcaaagcggtatctgacgtttattccccggtgagcggcgttgtgtgcgagatcaacgagcggctccttgacgaaccagagtacatcaacgaagctccgtatgacgcatggtttatcaaagtcaaagacgtcaccgaaaaagaagagctgttatcaggagatgaatacaaagcatttgtagagagcgaaaaagaataacggagaggcggtgaattcgcatgggcggctatgtaccaaatacaaaagagcaaagacaggacatgcttaaggcaatcggactgttctccatggaagacctgtttgtggatatcccgcaggaagtccgtctcaaaggagaacttgagatcccacagggcaagtccgagctggaagtgaaacgggagatggaagatctggcaggcaagaatcgggtgttccgcacgattttccgtggcgcgggggcgtaccgtcactatatcccggcagcggtcacaagcatcatttccaaggagaattttctgacggcgtacacaccgtatcaggcggaagtaagccagggcatcctgcaatcgatttttgagtatcagacgatgatttgtgatctgaccgggatggacgcatccaatgcgtcggtttatgacggagcatctgcggcagcggaaggtgttgctatgtgcagagagaggaagcgggcgaaagcgctgatttcgggagcgacgtctccgtatgtgattcagaccattcagacctattgccatggaaacggaatggagatggaagtgattccggaaaaggacggaaagaccgattgggagaaactaaaggcacgcctggattccgggacagcctgcgtctacatccagcacccgaatttctacggaaatctggaagacgcaaaagagatcggagagctgacgcatgaggcgggagcgaaattcgtgatgggcgtcaacccgatttcgcttgggatgttaaagactccggcggagtatggagccgatgtagcagtcggagaaggacagcctctcggacttccactggcgttcgggggaccatacatcggatttatggcatgtacggacaagatgatgcgcaagcttccgggaagaatcgtcgggcagacgaaagaccggaatggaaagaccggatatgtgctgacgctccaggcaagagagcagcatatccgcagagaaaaagcgtccagcaacatttgctccaaccaggcgctctgtgcgctggcggtgacagtctacctttcctccatggggaatgaggggcttcgggaggcggctttgcagtccgcatccaaggcacactatctgtcaaaagaactggaaaccatcggatatcacacagaaaatcagggaactttcttccatgaatttgtgacgacgtcaaaggtatccgcaaaagagacgttagacgcgctggaagcgcaagggattctgggcggatatcctctggatgagcaccggattctctggtgctgtaccgaggtcaatacaaaagaagaaatggatgacgtgatccggattctgaaggaggtgcagtcatgttagtgtttgaaaagagcagacagggacgcggaaatgggatgctcccgaaatgggaaggagaaacctttgaactcccaaagacagaacaaagacagaaaaagcttcacctgccggagattgcggagggtgatctgagcagacattacagtgagcttgcaagaaaatcccacggagtcaacgacggattttatccgcttggttcctgtactatgaaatataacccgaagatcaacgagacggcagcggcccttctgggatttacggagattcatccgttacagccggaacatacagtgcaaggatgtttggaagtgctgaaaacagcggaggaaacgctgtgcactattacaggaatggaccatatggtcttccagccggcagcaggggcccatggggaatttacagggctgcttctgatccgtgcctaccatgagagccggggcgacgtaaaacggacgaagatcctcgtcccggattctgcgcacggtacaaacccggcaagcgcggtgatggcaggatacaaggtcgtcagcgtcccgtctggctcggatggatgtgtggatctggaaaaattaaaagaagctgccgacgatgagacggcgggcattatgctgacaaacccgaatacccttgggatttttgagaaacagattcttgagattacagaagtgatacatggctgtggaggcctctgttactatgacggcgccaacttaaacgctgtgatgggaacggtccgtccgggagatatgggatttgacgtggtacatttaaacctccacaagactttctcgactccacacggaggcggtggtccgggaagcggtccggtaggatgcaaacagattctggcggactttctcccgtccatcctggtagagggcgaggatgtcttacatatgaagaaaccggagcacagcattggagagatgaaaagcttctacggcaatttccttgttgttgtaagggcgcttacttatctgaaatcccttggaaaagagggaattccggaagcaagccagaatgcggtgctcaacgcaaactatatgctgcacggtcttgcagatatcttcccggccgccaatggaacgaggtgtatgcatgaatttgtcattagcctgtctggcctgaagaagaaaaccggcatttccgccatggatattgcaaaaggacttctggacaacggtatccatccgccgaccatgtacttcccactgatcgtggacgaagcgctgatgatcgagccgacggagacagaatccagggagacactggatgaggcacttaaagtcttccatcggctgtatcagcaggcaaaagcagagccggaaagcctgcacctggcgcctgttagcacaccggttacaagacttgacgaggtggaggcggccagacatcctgtgctgaagtatgaatttgaagaatagggtgaaacgacatgttggaaaagctgacttacatagaaagcaacacaaccaatccatatcataatcttgctctggaggaagcgcttttgttcgggtgcgggaaggaggaatgtatcctctacctctggcagaacgagaagaccgttgtcatcgggaaaaaccagaatgcctggaaagaatgtcgtacggaaaaactggaacgggatgggggacacctggcacggcggctctcagggggcggagccgtctaccacgatcttggaaatctgaatttcacctttctcgtttccagagagcattacgatttggaccggcagcttgcagtgatccaaagggcgctggaacatctgggacttcgtgctgaaaagtccgggcgaaatgatcttttgatcaacggaaagaaattttccggaaatgccttttaccgccatggagaccactgttatcaccacggaaccatcatggtggcggtggacaaagagaggctgggttcgtatctgacggtttctacggcaaagcttcagtccaaaggggtggattccgtacgctccagagtggcgaatctgacggattatcttccgaatctggcgatcgacagcctgaaagaagcgctccggcaggcgttcggggaagtttacgggctcccggtagaagaaagaagccaggatgaagaagaacttgcaaaacggacagaattctttagctcctgggaatggctctatggacggagaatcccgttccagcacgagagaacgaagaaattcccgtggggcgaagtgacgatccagtttgaagtggaaaagggcagaatccgggaggcggcagtctattcagacgccttaaaaaccggactgattgaggtgctgccagaatatctgaaaggagtccgctttcagagcagcagcatctggactgagctcggtctctactggtctgcggatccggaggaagagcagatgatgatggatatcagaaaatggatgaaagaagaggaatggtagatggaaggacaatttgatctgattgtaatcggagcaggaccgggcggctatgtggcggctatcaaggcggcaaaacttggccttaagactgcggtcatcgagaatagggaagtgggcggaacgtgcctgaaccgtggatgcatcccggcgaaagcgatgatccatgcgtcttctatatacagggaaatgcaaaacagtgaagaaatcggaattttcgcatccgaagtcacctacgattacggcaggatactcgaatataaagaagggacgacaagacagctcgtccaggggatcgaacaggtattaaaggcaaacagcgtggagatcatctgcggaaccggaacgctcctgccgggaaatgaggtgaaagtcgcttccgaagaaggagaagagctactgaaggcaaaggatgttttactggcgtccggctccaggccactccggattccgattcctggcattgatctgccgggggtcatcacaagcgatgatctgtttcggatgaaagaagtgccggaaagccttgtcatgatcgggggaggcgtcatcagtgtggaattcgcaaccgtatacgcggcccttgggacgaaagtaacgattctggaagccatgccgagactggtcccgaatatggataaagaaatttcccagaatctcaagatgattctgaaaaagcggggaatcgagatccacactgcggcagcggtgcagtccattgagcaggacacagacggatatttctgtcattatacagagaaagaaaaagcgcggcaggcgaaaggcgcttatgtgctttgcgcggtaggacggtgcgccaacacggacggcctgcttggcgaagacatgactttggagcttgcagggggccgtgtcgtggtagatgaaaactttgccacgtccattcctcatgtctatgccatcggagatctgatcggaggagcgcagctcgctcatgcggcaagcgcccagggcgttgctgtggcagagcgtctggcaggaaaagcgcgttccatcgatgtgaatgtgataccgggatgtgtgtatacagatccggagattgcttccgcaggtctgactgaagacgaggcgaaagaaaaaggaatcgaagtagagacaggtaagtttattatgagtgccaacgggagatctatcatcacaaaagaagagaggggattcatcaaggtggtggcagacaaggatagccatgtgattctcggagcccaaatgatgtgtgcaagggctaccgacatgattggggaattcgtgaccgccatcacgaaccagatgacggtatctcagcttctgaaaggtatgagggcacatccgacctacaatgaagggatcggagaggcgctggaagagctggaaggcggcgccatccatgtccttccgaagaaaaaacggtaagaaaaagagacttgtcagatgtcggaaaaagaagtaaagtaatatggaaatatacgaggaagatgaaagaggaagagatatgattgattacaaaaatgatgaagcaaaacgtcagaatgtgattcagtttgtcagggcgacgcaggagattatggagaaggaaggtattaaaaaggtttccatccgtaagatcgcggctgtttcgggcttccataattctactatttatctgtattttaaagatctggacgagcttataatgctgtcgtccatcagacactttcaaaaatacagcagtgatctggaaaaattaagtaaccgacatgttgacgcctacgaaaatttcttcgcgatatgggagtattttgcggattcagcctttcaatattcatgcgtattctataatttctttttcgggaaatacagtgatgatctgaccgtttttttgaaccgctactatgatctgtttccggaagaaaagagtgcgctcagcgaggaaatcgaagctatgtacctgggacgcaattatcaggaacgatgcatgaagatcctggcgccgttgatcggagatccgcggacacgtgtgacaaaagaaaacgcggagattgtaaatgacatcagcgtctgcttttgtatggatctgctcaataaaaagtgtgcgaatccgaaaatggataatgaagtattgaaaaagcatatgatggatatgctacgatttattattgaaaaatagaagaatagaagagttgaaaaagccttccgtgggaatctgaatgggattcttacggagggcttttttgctgctaacacagtgaaggtttcacttttggatgaatcgttgtgcctgagattgaaataatctataaacctattgacaataatcgcgattagtgataagttaatcgtataaattattaaataatcgcgattatcaagaaactatattgtgcaaaatgcacaattcatttgtgtgctttttttagaaggaggatttgagatgagactggaaatcgggaatttctatgtgcggaatatcatctttggagaaaaattatcgtttgaaagtgggattctaacgatcaataagggcgaagcgcttacctatatcagagcagacgagcgcatcacagaggcggaactttatatcgcaaaacctggggatccgatccggatatgtccggtaaaagaggcgatcgagcctcgtgtcagaccggatgggagaggagttttccctggatataccggagatctagagcgggctggaaacggtaccgtacatgcacttaaaaattgcagcgtactcgtcgtaggcagacactggggaggtttccaggacggtctgattgatatgagcggagaaggacagaaatatacttactttgggcagttgaataatatcgtcctggtggcagacacgaacgaggtgtttgagcagagagagcagcagaaaaaaaacgacgcgctcaggagagcagggcataaactggcggaatatattgcacaatgtgtaaaagaactcaagccggaggagacggaagtctacgatctggatgccatgatccggagaggtgcggatgtggaaacccttccatctgtggtctatgtgatgcagccacagtcccagatggaagaactcggatataacgaccttgtgtatggctgggatatgaaccgcatggtgccgactgtgatgcatccaaatgagattttggacggggctttggtgtcaggaagtttcatgccggtttcctccaaatggtccacttatgattttcagaattgtccgaatatcaaggcactttacagagagcatggaaagaccatcaatttccttggcgtgattatgtcgaacttaaatgtggcgttggagcagaaagagcgggcggcgctctttgtggcacagattgcgaacacactgggagcggatggcgctgttgtggcggaggaaggatacggaaacccggatgccgattttgtaggctgtatcgttgctcttgaggatacgggagtcaagacagtggggatttccaatgaatgtactggacgtgacggacagtcccagccgcttgtcacgctggatgaaaagtgcgatgccattgtatcctgcggaaatgtatcggaactgattgaacttccgccgatggagattgtgcttggggaactggaggctcttggaagagacgggttatccgggggatgggcggccgatgagaaactggggccttccgtcagagaagatggatcgatcattatggagaacaattccatgttttgtggagatcaggtctgtggctggtccccgaaaacaatgaaagaattttaaggaggtgcggcaatgaaaaaggcgattttatatatcaatcagttttttgggcagatcggaggagaagatcaggccgattttgctccggccataagagaagaaaagataggtccggcgctggagtacgcaaaaacactacatgcggaaattacacatactattatctgcggcgataattacatgggatctcatacggaaacggcagtcaatgaaatccttgaaatgctggctgataaagagtttgacctgtttctggcagggccggcgttccaggcagggcggtatggcgtggcgtgcggtacgatctgtaaagcagtaaaggacagatatcacgttccagtgctgacttctatgaacgaagaaaatccgggagcggaaatgtttaagcacgatatgtatattttaagaggcggtaatatcgcttccaagatgcgaaaggatgtaaagacggtcactagtctggcaaacaaaattctggatggagaagaagtcggaagtgcggaagaagagggatatttcggacgtggtattcgtagacaggtatggagaaaggatgccaaaccggcgtctgagcgtatggtggagatgcttgtaaaaaagctaaatggggaaccgtttgagacggaacttccgatgccaaaactggatcgtgtaccgattgctccggcagtcaaagatctgaagaaagccagaattgctctgttaaatacaggaggcattgttccagttgacaatccggacaggattcagtcagcgtcggcgacccggtggggtagatacaatatatccaatacagaccgtctggagagcggcgtgtacaagacgatccacgcaggatttgacccggcggcagcagatgcggatccgaatgtggtagcacctgtagacgcattgaaagtactggaaaaagaaggtgcttttggaagcctgcatccgtatttttatacaactgtggggactggtacgacacaggcggaggcgcagagaatggcaagagaaatcctgccgtatctgatggaagaccacgtagacgctgtaattatggtttctacatgaggcacttgtactcgttgcggcgcaacgatggtaaaagaaatcgaaaaaggaggacttccgattgtacagatgtgcaatctgattcctgttgccaagacggtaggaagcaacaggatcgtgccgacaatctcgatcccgtacccgctgggagatccggcgacttccaaagaagagcagtggaaactcagatatcacaggacaaaggtagcgctggaaagtctggctacagacatcaaagagcagacagtattcagagtataaggaggcggattatggagaaaagaaaacagaagaacagcgtgttctatatctctctgatactaatcgcgatcatggcggtctggtcggttgcctttaatgaaagttttacaaaagtttctgatgcggcgtttgcgtttttgacaacagatttcggctggctctatctcctggcaatgatcgtatttctggtgttcgtattgtacatggcatttggccggtatgggaaaatccggcttggaggagatgactccaggccggaatatagtaacctgacatggtttggactgcttttcggctgtggcatgggggtggggcttgtattctggggagtagcagagcctttgacacactacctgaacccagtgggcgtggagagtgcaacgccggaagcagcggattttgcaatgaaatctttctttatgcattgggggattcttccgtgggcgaactatgctgtgatcggtctggctctggcttactttatgtttcggaagaacaagaaaggtttagtcagcagtatcctggaaccgttattaggcgaaaaaatgacaaaaggatggctgggaaaacttgtggatattctggcggtttttgctacagtggcaggtatcgtaacgtctctggggcttgggacgatgcaaattaatgcaggatttaataaattgttcgggattccgaccacattacttgtacagattggaattgtagtggttgtttcgattctctatatcgggtccgccgtatccggtattgaaaagggaatcaaggtgatttcagataccaatctatatgtagcgatcggtctgttgctcgtatgttttctggtagggccaaagatagagatacttgacagctttgttaatggcattggacagtatatcggagattttattccggatgctctaaaagtcggggcatacggggataatagctggctgggaagttggagactgttttactgggcgtggtttatcgcatgggctccgtttgtaggcgtttttattgccagaatctcaaagggaagaacaatcagagagtttgtccttggagtcgtccttgtaccggcatttgcgtcctgcatctggggagcggtatttggaagtcttggaatcaatctgggagagacgggggttcttagtttggatgtattaaatgaagtggcggctacgccggaagttggactttttgtagtccttcagaaatatccgcttggttttgtactttgcattgtggcacttgtatctctctgcgcgttttttattacgtcggctaattccggggtatacgttctgtccatgctgacgacagatggggagattaatccgccgaacagtaaaaaaattctctggggaatgatccagtcggtgatggcggtcggtcttctgatggcagggggattaaaaccgctccagacaatctcattggctgcggcatttccgtttattctgatcatgtttgcggcgtgtgcggcatttataaaagcaattaagaaagaaaaaaattgataaccctcctgaaaaatattacggcctttttgcaaggagaccgtaatatttttcgtattctataggaaagccctcggggtagaatgggcacaccgcaatcagggatattaccgctttgtggtattacggcggtgtgcaaagtgtttaagcccggggatggaggagaaagagacattgaggtgggattgcctacttcgcttctatgagaagggagaaacgatgggatatctgattgggtggacgaggcagactgctgaagtcctcaaagaattggaaacgacaggggaataccgggtgaaagaggagtatatccggaaaaagaacggagatatcgcaggttattatctggaactgtaccggtggtatacggaaaaaagcagggcgtatcttccggcggccgtggagggagaatttccgatctggttttccctcaacagtgattaccgactgcagaagacggagggaacagtgatcatcagagccagaatccccggggaaatggcgcttgtcatcgacgctggaagatgggacagcaggggaaaccatatgtatatctgcaaaaatgccaaggacagggctgactttgaaaagcttttgaacacctacgggatatatgacgagaccattctggcggacaggaaagggattttctatccgatgctcagaaagagaatgatggagagctgggagaggctctttacgatgccgccggacagaccggaaaatggatacgctactacatgggtattaaaacaggaatggattgaggaaatcatactttaaataaaaataaaaatcctttattatagaagaaaaagaatttacaggagggatttttatgtcagaaattacttacagagacgcaagagtagatgatgcagaacagattgtcgctttctacaatgaggtgggtggagagacgagttatcttagctttgaagcggacgaatatccaatgacagtcagtgaacagaaagacgaaattcgttccctggaagggaacaagacaaaccggatgctgcttgctatggacggggatgagatcgcagggatcgcaacgatccattcttcccataagatcaaggcacgacatgacggcgagcttggaatcgtggtggcaaagaaatatcagaagcagggcatcggaagtgaactgatccggatactgattgactggtgcaaaggaaacggtgtgacgacaaggatcagtctggatacccgtgcggataatattccggctgttgccctttatatgaaattcggctttgaaatcgagggatgccgcagaaattccacgcttctcaatggcatgtactacgatctttatgtgatgggaatgatgattgacgaagcataacgattcagctatgcagctcagatttgcggcttgcgccgcttttccgctgctaatacagctaaatcttcgctcatggcgaagcgccatatgtccggggacacggaaaatacagcgcaagcttgcttgcagatggttttcccgtgtccccggccgcatggctgaatcgttcacatgaaaattcctgtaaaaacccttgacttttacgaatggacgtaatacaatgacaaatgcgtgtggaaatacgtgatatttttgcgtgcaaaagaatttttaagcaaacctattaattattcgtaggaggtgaaaggaatgccaacattcaaccagttagtaagaaaaggacgtgaggtttctgtaaagaaatctacagctccggcacttcagaagggatacaattccctgagaaagagacctgtcgacgcatccgctccgcagaagagaggagtatgtacggcggttaagacagcgacacctaagaagccaaactcagctcttagaaagattgccagagttcgtctgtctaacggaatcgaagtaacaagctacatcccgggagaaggacacaaccttcaggaacacagtgttgttctgatccgtggtggccgtgtaaaggacctgccaggtacaagataccacatcgtccgcggaacacttgatacagcaggtgttgctaagagacgtcaggcacgttccaaatacggtgctaagagaccgaaagacgcaaaaaaataagtaaaagtttttaagtaacaaaatcgttatcgtatcacaggactatgaaattagtaggttgcggattgacatacacgggtatgttccagccgcacgaacgcaaactgtgaagcgagtactgatgatttaatccaattatgattaaggagggaaggaccgtgccacgtaaaggacatactcagaaaagagacgtattagcggatccattatacaataacaaagttgttacaaagcttatcaacaacatcatgttagatggtaagaaaggtgtagcacagaaaattgtatatggcgcatttgagagagttgccgagaaagctgacaaaccggcgatcgaagtatttgaagaggcaatgaacaacattatgcctgtactggaagtaaaggcgagacgtatcggaggtgccacatatcaggtgccgatcgaagtacgtgctgacagaagacaggcgttggcacttcgttggctgaccatgttctctcgtaaaagaggcgagaaaacaatggaggaaagactggccaacgaaattctcgatgctgcaaataacacaggagcatctgtaaagagaaaagaagatatgcacaagatggcagaggcaaacaaggcgtttgctcactatcgtttctaggatttccctggaaacggttctgccggatttggcaggaaacagtcgatcttattaatttaggaggaaaaagtcttggctggaagagaatatccattagagagaacaagaaacatcggtatcatggctcacatcgatgctggtaagacgacgctgacagagcgtattctctactataccggtgtaaactacaagatcggtgatacccatgaagggactgctaccatggactggatggagcaggaacaggaaagaggtatcacgatcacttcagctgctaccacatgtcactggaccttggaagaaaagacgaaaccgaaggcgggcgctttagagcaccgtatcaatatcatcgatactccgggtcacgttgacttcaccgtagaggttgagcgttccctgcgtgtacttgacggtgccgtaggtgtgttctgtgcaaagggtggtgtagaacctcagtcagagaatgtatggcgtcaggcagacacatacaatgtacctcgtatggctttcatcaacaagatggacatcctgggtgcagatttctacaacgcagttgagcagattaaaacaagattaggtaaaaacgcaatctgtcttcagcttccaatcggaaaagaagacgaattcaaaggcatcatcgacctgatggaaatgcaggcatatatctacaatgatgacaagggtgacgatatcactgtctgcgagattccggaagaaatgaaagatgacgctgagttatatcatacagagctcgttgaaaagatctgtgagctggacgacgacctgatgatgcagtatctggagggtgaagagccgtctatcgaagatctgaagaaagtgctgagaaaagcaacttgtgaatgtacggctgtcccggtatgctgcggatctgcttacagaaacaaaggtgttcagaaacttctggatgcggttcttgagtatatgccggctccgacagatatcccggctatccagggtgttgacgaagacggaaatgaaattgtgagacattcttctgacgaggaaccattctcagctctcgtattcaagattatgacagacccattcgtaggtaagcttgcttacttccgtgtgtactctggtgttatgaactccggttcttacgtgctgaatgccacaaaaggcaaaaaagagcgtgtcggacgtatccttcagatgcacgccaacaaaagagcagagctcgacaaagtatactccggagatatcgctgccgcaatcggattcaaattctctacaactggagacaccatctgtgatgagcagcacccggtaatccttgagtccatggaattcccggaaccggttatcgaacttgcaatcgagcctaagacaaaagcttcccaaggtaaacttggtgaatcacttgcaaaacttgctgaagaagacccgacattccgcgctcatacagatcaggaaacaggtcagactatcattgctggtatgggtgagctccatcttgaaattattgtagacagacttttacgtgagttcaaggtggaagcaaatgtaggtgccccgcaggttgcttacaaagaatctttcacaaaagcagtagatgtggacagcaagtacgcaaaacagtccggtggacgtggacagtacggacactgtaaagttaaatttgaaccaatggatgtcaatggagaagagacatacaagtttgaatcctctgttgtcggcggtgctattccgaaggaatatatcccggcagtaggagaaggtattgaagaggctatgaagtccggtatcctcggcggattcccggttgttggtatccatgcaaatgtatatgatggatcctaccatgaagtcgattcctccgaaatggcattccatatcgctggatcccttgcgttcaaggacgcgatggcaaaggcagctccggtacttcttgagcctattatgaaggttgaagtaacaatgccggaagaatatatgggtgacgttattggtgacatcaactcccgtcgtggacgtatcgaaggaatggatgatcttggcggcggaaagattgtacgcgcatatgtaccgctttctgaaatgttcggatactccacagatcttcgttccagaacacagggacgtggtaactactctatgttctttgaaaagtacgagccagtaccgaagaacgtacaggaaaaggtattatccaataaaaaagcctaaaaaggcttgaaaattcggcggatttgaaatataatcaaatgtagctgagtaaacttttaaatttaagaaattgccctgcttgagggtagaattaaggaggattattcaaatggcaaaggctaaatttgaaagaacaaaaccacattgtaatattggtacaatcggtcacgttgaccatggtaaaactactttaacagctgctatcacaaagactcttgctgaaagagttgaaggtaacgctgccgtagatttcgagaatatcgataaagcaccggaagaaagagaacgtggtatcacaatctccacagctcacgttgagtatgagacagagaaacgtcactacgcacatgttgactgcccaggtcatgccgattacgttaagaacatgatcacaggtgctgctcagatggacggagctatccttgttgtagctgctacagatggtgttatggctcagacaagagagcacatccttctgtcccgtcaggtaggtgtaccttacatcgtagtattcatgaacaaatgtgacatggtagacgatgaagaacttcttgaactcgtagagatggaaattcgtgaactccttgacgagtacgaattcccgggagatgacacaccgatcatcaaaggttctgctctgaaagctctggaagatccgaacggagaatggggcgacaagattatggagcttatggatgctgttgacagctatattccggatccggaacgtgacacagacaaaccgttccttatgccagtcgaagacgtattctctatcacaggacgtggtactgttgctacaggtagagtagagcgtggtacacttcatgtatctgatgaagtagaaatcgttggtatccacgaagatacacgtaaagtcgttgtaacaggtgtggaaatgttccgtaaacttcttgacgaagctcaggctggtgataacatcggtgctctgcttcgtggtgttcagagaactgaaatcgaaagaggacaggttctttgcaaaccaggttctgtaacatgccatcacaaatttacagctcaggtttacgttctgacaaaagatgaaggtggacgtcatactccattcttcaacaactaccgtccgcagttctacttcagaacaacagacgtaacaggtgtttgcgaacttccggaaggaacagaaatgtgcatgcctggagataacgtagaaatgacagttgaactgatccatccagtagctatggagcagggacttcgtttcgctatccgtgaaggtggacgtacagtaggatctggacgtgttgctacaatcattgagtaattgaagattgcgataaataaagggattgccgaaaggcagtcccttttatgatactattttgatactaaaattgagtttaaacggtcggaaacctcactttgcttattcgggtacagatgcccgtaagtgttatttaccatttgtacagtgtccccgattctgtcagctattaaatgcggggaaaagcccaattcaattaacagtgaaacatgggaatgccttaaatcgtgtatgcgaatataaggctcatttgccgccgctgagcatcttcttattgtgttactgataaaagtttttgtaaaggggaaaatgcgctggtgtggttgtattccgtatattttcccaatgtacgcttttaactcctccataatagcagtcggcatatttactgtacggattccgttttcagtctttggtggcgtatagatatctttgccgcctttccgttgcatggactttgtgatgctgatagtatttgcattaaagtctaggtcagcagggtgcagagcgagcagctccccgaagcgtatacctgaataaaaaagaatctgaatagcggtatgagccattgtatcgttaatatattgcaggacattttgatactgttccaatgtccagaacttcattgatcttgtccgtttccccatatgtccggctttgtcacatggattttgaggaagattatagtactttactgcataattcattatcgttgtgagtgtgttctgtattcggtcaagatatgcgtcagaatatccggcctgtatgtgtgcgttttgccagttcctgatatcaaccgccgttatttcatttattggcttgtctttaaagtacggaagaattctgtttttgaaaatattcttttttccgtaaacactgttttcccgtagtctgtgactgatatcctctaaatataagtcatataaagactgaaatgtcatatcaggcgttccttgcagtttttccaggaattgccgctcccagtccttggcgtctcgttgccgtacaaatcccctctttaatttctgcctacgttttccagtgtagtctgtgtaatagaatttgcaataccatgtacctgttttttcatccttgtaagttggcatctttatcattctccttttcattaccggccggggcatggatcaggaaatgatataagctgttagtcttttttgactgataggttttgctcaattttgagcattattcggtgtttttgcggtattcgggatttccggctaaatcttctgcatattctattattttgcgttgcccttctggtgaaatgctccaaaaataatagagtaaatcttcttctggtatatttgtaaaaatatttgcatcatcgttttccgcaatgatttctttaatcatatcgagtaactttcttaaaatctcagctgaatccttttgtatatcttcttttaggtcaaggaatttttgccattcttttagtgcggctcgctcagcggtatcaggagattcggtggtatcatatgccatgaattcatcgatgcgcatatcgagtccctttgccatctttccaattaattcaagttttccagtgggactatcgcgcttaataaaagaatatagagtggtaggggctacatctatactctgcgcaaactcttttaccgtaatatttttttcgtccagtaactgttttaatcttttaccaagtgccatctttttaaacctccaataatattaaaacacgaaaaaaagtatttgtaaatacgaaaaatagtattgacaaataatacgaaaaatagtaacatgatattgcgtaacacgaaacaaagtaatgcgtataaaagtaataaaaagagaggtgataaacgaatgagaatcagcgatgcaaagtttgacattgcacttgctaacagcggcttaaccatcggacaggcagcagatcgggcaggaatcagcagacaacgctacgctatgattttgaatcagaagcgagtcacgccgcaggctgcggggaagatcgctaaaggcataggcgttgatgtgacagaaattatcgaagcagaagattgatacaccggccggggtgtggatcaggagacgaaaggaaaggagacgtgacgatgacaaaacaggtgtacacggcaaaggacttgcaggagcttttaggagtgtctgagagtaaggcgtaccagtatataaggcagatgaacgaagaattacagaaaaaaggatttttgaccgtcaggggcaagattccggctgcttatgtacgcgagcggttcttcttcggtggggaaatgactgatggaacagctattgaatgagatacagccgggtatgcggctgacaagagcgtttttcaagaaagtcctaggctttgaaatgacttggcctggatgtgcggatgagatgctttcaaggctggaagaactgggttgcagcagggcgcgggaatattatgagactgttcgagcagaatggaagcagagacacgagcaacagatgaagaatgttgcggcgtggtatttaaaacaaaattttaataggcgggaggtgagggagtcacggaaacggcaagaagtggaacaactgaaagcggacttacagcagaggagcgacaaagagctattgatcttattgcagaggctgaggaagagcggagagtagacggtaatatagtttatgacaaaggaaagcccaggcagctcaagaaggctccggagatcgctaaggccagtagcgtaataataaaagaaccggaatggctggtaccggggtacataccaaagtacggaattacaacgatagcaggagaaggcggtgtcggtaagacatcaatctggtgttctttggtagcaagcattacgacaggaaaacaatcttttcttctgggagggcaaattccatttaacgataagccggagaacgttcttgtgttatctgctgaggattcatggtcttatgtgttaagagcgcggttggaggccaacggggcagatctagagcgtataagttacatatctccagaagatgacaggttcgttgatctgaattttgatggggatcttctacgggatgttatcgagactgttcgaccaagtgctgttatatttgatccactgcaggcttttgttccgcctaatttacggatgggagacaggaatgcaatgcgaaagtgcttttctccgctgattggatatggcgaaaagtacggactaacatcgattattatcgcccatgcgaacaaacagtctggcgtgtggggaagaaaaagaatcgcagacagttcagacatatgggattcttccagatcggtgctaatggtaggcacaacaaaagatagtgacgtccgttatatatcacatgaaaaatcaaattggggaaagttggaaaaaaccgtcttgtataccctcgataaatgcgtcccggtatttaaggcatacactccaaagaaagaccgagaattcatccaagaagattcacgggaacgtaatatccggccagtggtggaagatgcgaaggatttcattattgaaacgcttacagagcataaacagatggaagtttcggaactggacgagttggcggcggctaacagtatcagtaagaacgctttgaaagatgcaaaagcggcactcaagaaagaaggactaaccagagtgtggaatgttggatatggaaaaacaaaaaaattcgttatggagcttaaagacgctgaaaaatccaacgagtaaagagaaaatccagtatttaaaaggggttgctttatttgaggataatcaacgaataaacgagaaagacgcttatttactggttggcaccaacgagtaaagcaaggccagtatttacaaggaattgagctttaccggtggaatttccaggcgtatataggacggtcaacgagtaagaaaggagaagcaaaaaaatgactaacgaagaaatgatgaagcaggttattgaggatgacaataaagagtttaagaagtatgcagaggataagctgcgcagagtggatatcctgcgtgagatgggatacacggcagaccaagctataaaacttatgacatatttctgtttggaagagattgtgaatgttttggtatcgccagaagctgagacagtggccgagtgcctgggcgcccttgccgggtgtgtatgcgaggttccactgaccacttacgctcccggatatacattcttccgaatcggcggaagcgtggatactgacacattgtaacaaaaagaccccatagggagcgggaactccccacagggcagatgtatctttcacggctgcggggctgtggaaaggatacaggtacataataacagagattcagaggaaaggacaagtgaaaatgaaaaaagatatttataatttacaggttgaaatacaagggatatcggccattgtcggcactatcaggttacaatttgatgaaggcaatggcaggatgcaagatcagtacatagacctgtcactctgcggtgtgatggatcatctggatcgaattgtggaagatttagaggagttggacgagcggcttgtagaaaggggggtgatggcgtgagcgtgaaggttaaagtgtcatatgaaagtggtaaggatttggaaaggttgatacaactgctttctccagagattaaggagtggaaggtgaaaccacaacgaggacagtataaacgggcctatattgtacttaggtcgtctacaagtggagagtagtagaagcgacggctttaaaaggggttgatctttcacggaagttaatgtatgatggttatatcaatattgaagtaccgcaccaatacctcctttctgtattggtgtaagctcaggagggcgtgggaaatgacttaattccagaaatggaagaaagctgtttcctgcgtcttttttatatttcaatattgactacctccgtaagggtgcggcatcaccttataaaatgcgatatagtcgccggcgggcgttaaacggaaaggagtcgataacatggacgaagaaatgaagaatatgggtgcagaaggcattgaagaagcacaggctgccagtgcagaagaagaggcaggagcacggggcgaacaggacgcagagaatcaagggcagacggaaaagaaatacacggatgcggacgttgatcggatcgtagcgaagaagatcgctgccgagcgtaaacggttacagaggatgttcgaaggcgaacagcaagaaagcgagatcgaaaaaagggaaagggacgttacaaggcgggaactgatggcagatgcaaaggatgcgctaattaatgataaccttccttcttctcttgcgaaaattctggattatagcgacaaagaagcttatgagagaagttataaggacgtttcaggcatattccgtgaagctttacagaaggtagttaagacggcttttgccggagaggttccacgggcagggggatcgttaagggaaagtcaggcaatagcacttgcttcggcatttgcaccgccgaaacgttaaaggtaaataaatggcgattagtctagttacaaagtttcatccgtatgtggatgaaatgtttacaaaagaaagtaaaaaggcgctcctgacaaataacgactttgaatggacaggagcgcatacggtaaaggttcataaggtgaatacagtacccatgacagattacgaccgagacggcagtaaggttggtaagaaaaccggagaagcggaaacggtcgtttggtcacgctatggggcgctgggatctgttggaaacacactggaagagttcacgctgacaaaggacaggtcgtttacctttgtggtagataagctggacaaggatgagacaggcggggtactttcgggagcttccgcactggcaagacagcagcgcgaagtcattatcccggaagttgatacctatgtttatgggaagatggcaacgggagcaggtactaaaaaaacaacggttacattaagtcctgaaaatatctatgatgagatcatcgaggggaataacgccctcgataacgcagatgtgccggatacaggaagaattctcgtagtgacaccagacacacatcttttgatgaagaagtgcccggatatcatcatggaaacgtctgtcagcgcagagatgcgtttacagggagtcatcgccaaccttgacgggctgacggtcattaaagtgccgaaggtacgtttgccggagaatttcggctttatgatcgctcatcctgtggctactgtagcaccgacgaagctggaagagtacaaagtacatcaggatccacctgggatcagcggcgagctggtagaggggcgcatcgtatatgatgcctttgtactggataataagaagatggctatttactacgaagagaataagccatcagcataattgataagagcaccccgggcgtttttctcctagcgtctggggtgttttgaaaggtggcgtatgtgatggaaaatgaacagcttgtagcacgagtgcaggcaggcgaaaatacatcagacaatatgcttcggctttgggaacagaatagcggactggcctacaagatcgcaaagaaatatacaggatttgctgaactctgtgacctcatgcaggaggcatatctgggactgtgtgaggctgtgagattctttgactgttctaaaggctccgcatttgtaacatatctcggatattggataaaaaacaagatcatacgttatattgaagaatgttgccagacggttcgtcttccttcgcataccgcaggcatgatcttgaaataccagaaggcaagaaccgagtatgaaaaacgcttcggggaagagccgtcaaaagcggaaatctgctcgattcttggcatagggtatgaaagatatgagcagttgcaaaaagatattaggatcgggcaaatagggagcctggatgcccctgttgagggtgaagaaggacctatgtccattcttgatgtactctcctcttctgaagatttagaagaggatgtaataagggcggttgatgcggaacgaatggcaagagaagtgtggattgctgtagatgatcttccagagaagcaggccgcggccatccgtttaaggtttcaagatgggatgacactgaacgaagcaggcagcgtgatcggagtcagtacagaccgggcaaggcagatacagaacgaaggaatccgaaaattacgtcagagatccaggcattaccattatcggcggtattatgaagaatatctgtctccggctccgatccatcatgtaggattaagcaggtttcgccagacgtggacaagtgaggttgaacgggaggcgttgggctattgatgcagaaggagtattcggacatttcggacaccctaaaaaggggaaagcgaagaagtagtaaaagatttctcgaacagtaccgaaaagcatggcacataggtctttcagcagaagtgcgaaaagggaatgtggaaagctcgatttcggccatccaagagcttatgaaatacaataaggcatatgagcaaaaaggcagcttaaaacatcttttggaggacggtagagaacttttagaacagcttgaggaagaacgaagattttctgagaatataatgagaacaatacgtgacataatcgggaaagtggaagatccagaagaaagagaagtactttactgtgtatatgtaacctatatggaacctatgacatgggaaagaatagctgaccgggtgggatgctccaaaactcgtgttatgaaaatccatagcaacgcacttgtgagcctatcagacttgattccatgaacaaaagagagacttcttcggctggagcgtcactcccagcatctcttttgcccattgcataaagcatgtggcgcatgacgacgcatttttcacctcgaagaagtctctctatggtatgtataatataacatttttattctcgtttgtaaagaatctctttgtttctcaaatacttattccatgaagaagagatcgacaaggctttgtagaaatgaaaaccttaaaaaacctaatgttcttgagtatatagcagagcgccaaaacttagaaaaacttagtgtttccgtctatatagaagaacttgccaaaacttaacattttccgcatatatagcagggtgtcctaatgatactgaaatagtatattgtacatggtttgtgcttgtggtagtatatagaaaggaacaactgcgttgcagggtggctgacctctattctacatagaatgggggtggtgctgatggacaataacaagaatcattttgatttcaaagaccttatggcctttggtatgttcattctgtcactgctgacattcatttatttgatttgtcactgatgatataaggcatagaaaaaccaccccgaaactttggccggtagcagggtggcaattctatgtgtcactaatgttttaaggtcaaccactttgtgggcggttgttcctttttctatttacaatatagcacattggtgggttatgttcaagggaaattagaggaaaccgttgtgattcttggtgatactaaaacgatactaatattttgcgtaaagagtgaaatagagcatatttctattagatttaggctctataagtactgaaaacactgagaaaagtacatgaaaaatctatgcgtaaagtgttgctacaatcatcgagtaattgctaaaagcagattttataggactttctgaaatttcagaaagtcctattttgctaaagtcataatcttgatttcaattaaatgacccttttcttttctgactgtggcagataagagtaagtagggataactctacccgtatctaatcgtttgaaatcttaatgaggttactgaggtatggtcttttccccgtaagtacatcatcataaaatttctgctttgtgtcgatatattcgatactattgtttatttcctgcaatttttccaataatatcttttttctatgatgaagcattagttttctttcggggatagtttttttcccttgcaggcataatgctacatactctttcatttccgcaatgctcataccacatttttttaagcaggaaagactttttatccatgcgatatcttcatcatcaaaaacacgataattgttactgtttcttttgacgtttggtacaagtccttcgttacagtaaaattttaaggtttcataaggcatattcgtttccttacatactgctttcatagaatacatgttttcaactcctcaaattttttcagaaatttcaaaaaatgcttgaccggtagttactaccgagttttacaatctgattgtattctgaagaacacaagatgtcaaggaggttatgattatggagtatataacattaaataacggagtaaaaatgccaaaactcggttttggtgtattccagattgcaaaggaagattgtgaaagatgtgtgttagacgctataaaggtaggctatcgtcatatcgacacagcacagtcttattttaacgaagaagaagtcggaaacgccatcagcaaatgtggattgccacgaaaagatttgtttatcacaacgaaagtatggattgacaattatgggtatgaacaagccaaagaatccgtcttgaaatctatggagaagctgaaaatcgattatcttgatttagtccttttacatcagccgtttagtgattattatggtgcttacagggctttacaggagttatacaaagaggacaaaatcagagctataggcgtaagcaactttgcacccgataggctgacggatatgattgctttcaatgagataccgccacaggttaatcaagtagaagtcaatccattacatcagcagataccagcacaggaaaacatggtaaaacgtcatgtccaaatggaagcgtgggcaccatttggcgagggaaaaaacaatatgttcgataatcctgtattgttgaatattgctgaaatgtatcagaaatcaacggcacaggttatgttacgctggctcatgcaaagggatattgtcgctttagcgaaatcaacccatatcgagcgaatgaaagaaaatattgaaatttttgacttttttctttctgatgaagatatgaagaaaatttcagaattagataccaaggaaagtttgtttttcgatcatcagacaccggaaacggttgatatgtttgttggaatgattagtgacagaaaggggaaaatttaatgcgaaaacgaatcggctttttatagctgttctttgctgtattggtcttacagcttgcggtacagataaaagggataataccgacacactatcttcccaaaatgaacaggctatatctgtttcaagataagaggtgctaaagttcgtacagaccttatgttttgtacaggcttttcccgattctataattcagttcttttgcagaaagaggggattatgaagctatcttcttttggagaagtcatcaaagcaatgtaactataaaaattttattttcagaagataaaaaactattgacgaacacatgttcgactgctataatacgaattacagaacagatttaactggccagaatctggtatctgtaagagtttcggcaaagcaggatttcagcagagcgactctgtcgggcagcacagagctgtatcaacggttttctttcccttatccgtgaggctgatgatgattttgcgattacccggagggtgaagatagggatgagtttgatgtcaaataaagagttgaaagtaagcgcgcagcaaactgaggatgcagtctgtttatggaatgcagtatgtgaaattactgagcgaggaaacaatgcggagattaaacgaaagaaggacgggagttttaccgtatatgaagtcaaaaagaagatagtggcagtttgataaatcggtatcgaacgaaggactgataggagtcagaaatcaacagagtgaaaaatgtggtttccggctcctttttatgatccgcaggattggtagtgtaacagagaaaagaaaggaaggtgtgaagatggaagcaggggaagtagttcaattaatgaagttaaacgattttacacaatttaagaatcaggacgtcttaactattataaaaggctgccacgaaaaaacaagaagtacttttttcggagatgccaaaaaagttgcagatgttgataaaacgtgggtgaaagtagcaatcaatcttctactatttgcgatcagccagacaggcaacaacatgtacggtacgacagagggaatccgggacatgaaatacaaggataaagtcggcaggctatttgaagggaatccgtcgctttggaaggatgtgtttcagagatacttgtcccacattggtgtgagtgtaaatgaacagttgatggagagtttttatacagagacttccaaattaaactttatcatgggaatgaaagagcagcaaatggaggaatgtattggactttgttttgcgcttgtccgaatttactatgaaaaagcattttctttatattgtcagaaatgggaggatgtcttaggaaatgaaatcgtaagttcctacaccggtgaacaaactctatatgaatatgtagaatcaccagttctggaagatgcggtgcgcctttacgtagaaaatgcaattcatactgttacagacagtaaaaactgggtttcccaggagaaaagaaaccggggcattgccacagcgacacacgatgtatttgtcgtgcatgaggtaagagaggtctatcatagcgagtatgatcaggggagggccgtttggagctggctccaggatcaggaagtgaaaagctgtatccctgaaatgaaaaacattccggattgtcatattcacaatcagtcttatggaaactggtacgatgctccccgcccaagtggagggtgtgtgacaggggacacgaaaatttgtctgagtgatggaagagagattcccatttcacagattcgggaaggtatgaaagtgctaagtgaaaatggaacggtttctgttacttcggatgaaaaagtaatcaacaggcatataacctgtctatacggaatcaatgatattccgccgtttatgtctttggaacatgctgttttgacggaggagggatggaaaagccttgaccctgaaacgacgaacagcatcaattctttttaccatgcgacaaaattgcaggtaggggatatcgtatatacgctcaagggcaaggaaattgtaaggaaaataacgaagcagtatgcggatattcaaagcagggaaacttttaccggatatgatctgcatttcaggcagggataccagtcctattatgccaatggaattctggtgctgttgaattatccagagatcacgattgccagaataaaaagggttctggacagtatgagttttcaaaaacaaaagaggttccggcacatgatagagcagaactatgatattttcagtgacatgtttggagaattatctatgtcacagttacaagaggaggttttgaaatgaaaattaaaaaagtactgacccagcagttaaatgtcctttctcttcctgaaatcaggatagaggcaaaaagtaatgatatggggctggaaagaaagtattctattttgggtggggttttatatattgatgaaaaaccggttcatcattatttttcaaaaaatatgttcttttatgaagatggagaggagcaggggagcattttccttgcccaccacggtctgacagcagatgtgataatcagaaaaaatggaaaaaccacattatgtaaagcgtcttccctgctccattatgaaatgacctatcaggctgaggggaaagaaaagaaactggatgcggcatttggtatgggaatagacagtagcaggaagtcttatttttactgtggattgaaacaaaacggagaagagatcataccggttccttctggagaagaggagcagaaaaaccagggaatcctttcggtatcatacgatgaaaaaacaaggaatctcatcaccaactggaagaccgacgcctatgcgattttaaaggatgataaggggcagcctgtttatccggagtttcatatcctgtcaatacaaatgatctttgattccttgtacagaacgtgcgaggctaccgtacaggagggggaacagcatatttgttcctacgaggcttctgagatttcgattcacgacagaggaacaaccccggagtgttttcaaggagattatcggattgcctatcgtacggaggagacggatacggtcattgagttgtatgatatagactgcattgtggaagaggactcatcgggcagccgaaaaaaatattattactgtggtataaaatggaacggagagacgctgattcctgttccggagacccgggaggaaagaaaatcccagaatttccttggaatgttcaagatggggacaggatggatgctgcacctggatgggatccgtgttaatgaataccttgagaatcaggccggttctaaagagaagttgtatatacattccatcaccctttctggttctcagggaagtattatagaaaacagaagcagggaggtttcatatactgcaaaggggaaacttgttgtgccaaatggattggatgaggcaagaaagagattcagacagaacgctgtgatttcagagagcctgaaaggcagatgcagggaactgcacatggataaaaaacctctaacattagagcagctttgcgggatcagaccgccttccgtcatcatatcgactcaggacgagcaggggaaaatcgtggaaacaacattcgatgggcagcagtactgttcgtataaaacatcagaacttcttatggatctggttaattattatggcggagatatctcaaactcagataaaagtatgaaatttgcggatatttttgggaagacaacggccgcaagcctggaagcaatcaatcaggtaagcaggaatatcattacggaaattgaagaggctgaagctccggagcataaactcaggaaggggtatcttcctgaatttctacggaaactggctcccatcatactgaccagtacacttgcaaaaagaacggatgcggagattataaaagggtttggcggaagagaaaaagaggatgaggctctcataaaatcgaggttctacctgtcttacattccagaggaggtgaaagacggggacacgagcaagaaggaaaatgataacaagaagcaagtgttatcttcacagacggagtatcatcatctgacggccatcattgataagtacgtgtatttgtcaattaatccggacctgaaagattatttggaggatcctactacaaattatgagggtcagaaggaaaatcagacggcccgtgagtattgggcagagcggatgtactataattatgtggagacaatacagcttctacatatgaattacgcgatagatccagcatgggtaacaaatattatcaaggtactgggaattctggattccggaaaccatgacataaaagatagtatcaatggtactgttttgacggactccgatggaaatgtttttcagtcctcctactctctggcactgtatgccaagcttgcggattacaatatgattcagatgattgacacgtttaaaggagcggaagattacgagaattattgtaagttgttaatagcactttatggaagcttttatgataaatttaaaaataaagagattaccatccccaaagatgtagaagaagcaatgcagaagtttttaaaggaatcaaaagagatttttgtacaatggtctgttcttcaggctcaggagttaatgcagtttatgatagcaagtggaagcatgtcctccgctctcctgacgtacaatcccacagttcccgcggtttctaagtttttctctgctgtgaacatactggttggagcagcctcgtttggaaatatttttatgaattgggataatctgactacatttcagaaagcagaatccattttgtctgtgcttcaggcgggattttcaatagccagaaattttgtactgtggagaacggtcaatactatttttgatacggcggcatctcctgctgagaggatgaatgcgttttaccgttatcaggttggaggaggaagctttgatacattggagagtgtttcctttcacagtggagatccctttgatctgaagagtaatgtggaggagaatgcgacaagatacgcgagaaaggtaaacgagggagagtattcaacaatgacgctggaaaagagcagccggtgttttgtggtgacagaagttattttccaggcgtttaatgtagctcttatgggaattgcgtttgtggctgaaattatggaactaaataaaatgttccagaatccgggatcttattccgatgtggagaaagcgttgtctgtgatcaatacaatatttacaggggttgcggtggttcttggggcggcagaatttgctctgggctttaccgctttggccggttcctttgccgtggcgacagtacttccgattgttaatactgtattaatgggagcaatgtttgtcatttccattgtgatgctcattattcataaagatccggtggcgccgattacactgctgattcaagaaaagatttccggtgcggttcaggggttggcgaagccaagtcaggaatggatcgatgctaatacaccaaagcagtgtttcctgggagcgtaggagaaagtgattttatatgagtaattccagtaaggtgttctccgtttgacaaagccatgatacactgctagaaaggctacagcctttctagcagaagcggatgtaaggacagcgatcgtcaaatgtggctagcggaatacccaaaggttcttaatctgtccgctgatccgatcatagtcccaaagcttttcagagttctccctgctgttgggatcgttcaccttgatttgcccgtcctgatatgcggtgaggacaatgaaatgtccggtagtggtaaagtccccagggcctaacacggcgacaatcgggtttccaacctggagattatctatgatacgttgttcatccagaggaatttccgtaacgtcaagtcccaaggaagcgccaccttcggagaagagggaccagtaagaaccgtttccatccgaagcgtagccgtgggaggcggcaaattctgccatccatgccggagtgcggtcggtattcccggtgaggtagatagtgaccatggaaaggcaggtaggtccgcagccgctgagtccgaagagatcccctgcgtactgctgatatccccagcgctggtcccattgcatgagaagtgggacagtactggtattgaggtcacttaagtcaatgggcggggtcttggatttcttcatcggatactcaaagacgaagtcttttgtttcacggttccggtcatacaggtcgatcagggactggggatagtcgctgatatcatatccgtgggaggaggcgtagtggctgatttcatcccgcgcggagccatggaagagagaagagattggagaaatgacgtcaagtcccgcacctgctctgttcagtatataggatgccaaagtgcatagcaaaaggataagacacagcatcggaagaataaaatgaagcagatgtccggtacgcttttttcttgatcggccgtgtttttgttgtcgtgcatgtatgtttcgataggtattcatggaaattcactcctttttctgttacaatttgtgagtttacaatcaaaaagcgtgtcggaaaatcgaagccgattgtcctggcacgcttttactataccaaaaggcaatagaatgttttctcggatttcggaacagaaatcctctttttctcacacaaaattctaacgatttcctgatgaatacgggagatccacctgaaaaattacgtggttgtcatggctttcggcagaaattttaccaccatgaagttcgacgatctccttggcgatggcaagaccaaggcctgcaccaccgtttctggaggctctggaagagtccagacggaagaattgctcgaagatccgttccagtttttccggcggaatggtagagccttcgttttccacgatcaaggtcaggattcccatatccacatagaggcggatctttatgactgattccggaaagctgtagttgacggcatttctaagcagattatcgaggacacgctgaagcttgtctggatcgcagagaaaatagagatccgcaggagcctggacggatgtatccaactgtttctccgcaaacatcggggcgaactcgtataatgtctgttccaacatccgtgtcagattgatccggctcacatccagagtcagatgagtcaggttgaaccgggtgatgtcaaaaaattcattgatgagatcttccagacgttctgctttctccagcgcaacgcctaagtatttctcctgcagggcaggggagatctccttttcatcgtgcagcagcgtcaaatatccgatcacggaagtgagaggtgttttcagatcatgggccagatagactaccagatcatttttgcgctgttccgccgcttcggccgctttctgactttcaatgagattcagccgtacctcattcatatgcagagcagcttcccgtaaatcagccgacatggtaactgtatcttcctggtgtttccaaaggctgtctgaggcagtcagaagctcatccagataggtgcaggatctggacaaataccggtagccgcaaataagcgctccggccaacatataaaagatcaaaaagatcacgtgaaactgattgataaaagtggtaatctgataaaaccattcataaccgtaccagatctgcgtatgataataccagtacacgagaaggaataaaaaaccgccgatccctacatagagcaggtaggagaaaaagaagcggcgcaaaagctgtttccgcagttgttcagaaagttgattgcctgtctgtttattcaatttgataccccactccccatacggtcttgatgtatttaggcctgcggccggaatctttcatcttttcccggagccgcccgatgtgagccataaccgtattattattatccagaaatttttctccccagacctgctcaaacagctcttccgaggatatgacccgtcctttattctcgcacagataccacaaaatagagaactcccgcggagtcaatgaaagcgtgcttccgttgagggaacatttgtgggaatcccggtcaatggtaagtcccctgatgtcgatgcgggaatcccgctccggctccgcggcagatgatgactggacgtctgtcgggagcggatgattgtaccgttcatatctgcgaagctgtgtcttgactcgggctaccagctccagcggattaaaaggcttggtaatgtagtcgtccgcgccgatggtaagtcccaggatcttgtctgtgtcctcggtccgggcagtcagcatgatgacaggataaaaatgttccttacggatctcctggcagagtttgtagccgtcaatatccggaagcatgacgtccaggaccgccaaggagagatcttcctttttgatacaatccagggcatcttgtccgttataacatttcagaacttccatcccttcgttggaaagatagacttcaaccagatcagcgatggactgttcgtcgtccacgattaatattttccttttcataacatttacatctcctgtgttaagtactgttaaaatccttgcacaaaatgagacaactgtcaagtaggcagagggaaatactgattccatagaaaatgataacgaaaacgagaaagtggtacctaaaacagtgaaaaaacatagttgttttgcacaaaatatgaggaataaaattgtgaaaaatcacgttaattaagaaaaagagactttagtccttttggggagaagaatttacgagtaagatgcaagtagaagaagtgtagaggggacaaacaaggcttcttgatctgtcaaaagggcagatgatcctgcataacagggaaagtgaggtaggatgatgaagtattcagaggatgcgagcaagcagtatcatattcaggttgggaaaggagatgtcggacaatatgtgattcttccgggagatccgaagcggtgcgaaaaaatcgcgaaatattttgacgacgccgtgttggtggcggacagccgggagtttgtcacatacacaggatatttggacggcgtgaaagtgagtgtgacgtctacgggaattgggggaccgtccgcggctattgctatggaagagctggcaatgtccggagcggatacctttcttcgaatcggaacctgcggcgggatgcagcttgatattaaaagcggagatgtggtgatcgcaaacggcgcaatcagaatggaagggacgagccgggagtatgcgccggtggaatttccagccgtggcggacgttcatgtgacctatgcactgatgcgggcggctgaggagctaaagcagacataccatgtaggaatcgtacagtgcaaggactctttctatggacaacattccccggaacggatgccggtgagctatgagcttttaaataaatgggaggcgtggaaacgactgggatgtcttgcttccgaaatggaatcggcagctctttttgtaatagcaagccacttaagagtccgggcagggtcctgtttccttgttatggcaaaccaggagagagaaaaggaaggactggaaaatccggttgtacatgatacggatatggcgatacgagtggcagtacaggcaattcgcaagctgataaaagaggataaacaggcaggaaaataaggaggaaacgctatgacagaaagaaaaataaaagaattgattgagatcgccatcgggcagcttgcatattcctatacgccgtattcccactttcgggtgggagccgctttgcttggaaaaaatggaatgatctataccggatgtaacattgaaaatgcggcgtatactccgacgaattgtgcggaacgaaccgctttgttcaaggcagtcagtgagggggtacatgattttgaggcaatctgtattgtaggaggaccgaatggaaggatcgaggatttcacacctccttgcggagtatgcagacaggtgatgatggaattttgcttgccagaagagttccaaattatattggcaaaggggacagaagactatcggatttttaaactgaaagatttcatgccaatgggatttggacctggaaatctggaagaaaggcaggagaagaatgagacggcaaaaacggatatttgttattgtaattgattccctgggaatcggcgtcatgccggacggggagaagtttggagatattggagttaatacactggggcatatttcggaatcagtggaagattttcagattcccacgcttcagaaactgggacttgcgaatctgacaccgcttcggcaggtgccggaagtggcacgtcctcttggctatcaggcggtattgaaagagaaaagtaacggaaaagatacgatgaccggacattgggaaatcatggggattgagacaaaaaagccgtttaagacttttacagaacatggatttcccaaggaactgatcggagagctggaaaaaagaacaggacataaagtgatcggaaacaagagcgccagcgggacggagatcatcgaagagctgggtgaggaggagatcgcaaccggacatatgatcgtatacacatcggcggattcggtaatgcagatctgtggaaatgaggagacattcggtcttgaggagctgtaccgctgttgtaagatcgcaagagaacttactatgagagaagagtggagggtcggccgggtgatagcaagaccgtatatcggaaagaagaaaggcgagttcgaaaggacaagtaaccgacacgactatgcgctgaaacctccgatgcggacagcgcttgacgtactccaagatcatggatttgatgtgatctctgtaggaaagatccgggacatttttgacggggagggaatcacaaaagcatataaatcgaagtcttccattcacgggatggagcagacaaacgagatcgcggggaaggatttccacgggctgtgctttgtcaatctggtggattttgacgcaaaatgggggcaccgcagggatccggaaggctatgcaaaagaactggaacagtttgataaagggctttcggtacttctggaaacgctaagagaagatgacctcttgattatcactgcggaccacgggaacgatccgacctataccgggactgaccacacaagggaaaaggtgccgtttctggcctattccaagagtatggaaggcggcggaaggttgtcggagcaggatacatttgcggtgattggggctactatccttgataactttggactctccatgccggagggaacaataggcgcttccctgctcggagagctaaagtaaggatctactacagaaaagaagctaccatcacgctgtgataaagggcagcggcaaaaatgaaggaagaggaaaatagcaggtgtggcggagcatccgtagaaaaggagtgaaaataaatggagaaaaaattaaagacctgtcttacaagtatccgggggaaaacggatttcagccccaaggtggctctgattctagggagcgggcttggagattatgcggacgggattcatatcgaaacgacgatggattacacagaaatcgaaggatttccagtttctacagtgaagggacataaagggcgctttgtgtttgggtatgtaggcgaggtgccggttgtcattatgcagggccgggtccactattatgaagggtacccgatgactgacgtcgtccttccaaccagactgatggggctgctgggtgcgaaacagttgattttgaccaatgcggccggaggtatcaatgaaacattctgtccaggagattttatgatgattactgaccacattgcggtcggtgtgccaagtccgctgatcgggccaaatctggatgagctggggccaaggtttccggacatgagtgaggtgtacagtacccggattcggactgtgatcaaagaggcggcgtctgcctgtcaaatgaacctcaaagaaggcgtctatgtgcagcttaccgggccgaactatgagacgccggccgaaatacgaatgtgcagaagctggggcggtgacgcagtcggtatgagtacagcctgcgaggccatggcagcccgtcatatgggcatggaaatcggtggtatttcctgtattacgaatctggcagccggtatgagcaaacaaaaattggatcatatggaggtgcaggagagtgcagaccgggtttctaaggactttaaacgcttgataacccgcatcattgaaactatctaaaaagaagacagaaagaatacgaaaggagggagattatgaatatcgcaaaccttcctaaattggatctccactgtcatctggacggttctctgacaaaggacatcattgaggggcatttgggaagagctgtgtctgatgaggagctgacgatatcagagcaatgccggagcttaaccgaatatctgaaaaagtttgacctgcctgtgcagtgcctccaggatgcggcagggctttcggatggagcctatcgttttgtagaagagattgcaaaagaaaagatcgaatatattgaagtgaggtttgccccgatgctctcagcccatgacggactgccctgtgcccaggtcattgaggcggtgagggacggtatggagcgggccaaagaagcttttcatgtcaggtatggtatcatcacatgtgccatgcggcaccacagtgaggaacagaatcttacaatgttacggtgtgccagagagtatctggggatgggcgtatgtgcgctggatttggcgggggatgaatcggcgtttccgacaagatgtttccggcccctatttgaggaggccagacgtcttggtatgccgtttaccattcactcaggtgagacagggaatgtggaaaatgtccgggaggcttatgaactgggagccagacggatcgggcacgggatcgcgctttggaaagatacgaagctgatgaaagcctatgcagaggctggaatcggtgtggaaatgtgtccgacaagcaacttccagacaaaggcggccgccggatgggaagcgtatccgctccggcagtttgtagacgccggaatcaaggtgagcatcaacacagacaatcggacagtcagcggcacaactatgacaaacgaactgacaaaagtatacgagcagtacggccgggacgatgagctcattttcacgttactacgaaatgccgcccagacggcatttgacccggaaatcaaagatatcctagaacaaaagtgggccaggacaggggaggaatagaagatgcaaaaaaagatggaagcaaaagagattttaacccatgtagatcatacgttacttacacagactgcaacctgggaggagatccgacagatcctggatgacgctatgaaatacgataccgcttctgcttgtatcccggcttcctatgtgaaagcagcggccgaatatgtagatggaaaacttccgatttgtaccgtcataggatttccgaacggatacagcaccagggcagcgaaagtctttgagacgaaagacgccatcgcaaatggggcttctgagatcgatatggtcatcaatattgggcacttaaaagacggaaagtacgaggaaatcgaggatgaaatccgccgaatccacgaaacgtgcaatggccggatcttgaaagtaatcattgagacctgtctgctgactgaggaagaaaagatcaaaatgtgcgagattgttacgaaagccggcgcagaatacatcaagacgtccactggattttctactgagggagcgacgtttgcggatgtgaagctgatgaaaacccatgtagggaagaacgtcaaagtcaaggcagcgggaggcatttcttcctttgatgatgcggaagagtttattcgcctgggtgcggaaagactgggaacaagcagactggtcaaactgatgaaaaacagtccggacaagaagccggacattagaaaacaaaaacagtgatgaaaaaatggatggtccctaaatggggatgtgacagacaggcataccgaaggtacgcctgtttgtctgcaaaggcaagagattgccggtattctgacattgttccgttggctgagacatgatacaatagagaagatagataaaaattacaaaatgttagtaatattgtctgataagagtaaaaacggaaaatgactttcccatggaatttggaggaattaagatgaatacaaaagatatgaaaagtttggagtttgaacttaataatttatatcagaaagttagaatttattcccaaaagaatgattatatttacacaaagatttatggtgcctggattaaagaatataatcagttgttggataaatataatacctttactaaacttcacatcagtcatctctcttacgcatcccatgacttatcctctacgcaaaaaacagtaagagccgaaacagtggaatggtttttgaatactgtgaaaaacctgattgaaaaggtgaagtcagaaatcaatgaagaaagagaaaaaatgacggaagaaaaaattccggctcatcagatgagaaaatgttttaaaatcggatctcaaagatgcccgaagcggcccgattatgaaaggaataaggtctttattgctatgccattttcagacgattatgtagacagctatttatatgggattgtgccggctttgaatgcagccggatttcagcactataaggcggacgaagagattacatgtaaggatatcatgtgtaaaatttgtgagcagattcaggcgtgcagaatggcgatcattaatatatccggactgaatccgaatgtgatgttagaattagggcttgcatacggattaggaaagccagtgtatattgtaaaagataaggcaacaaaggctattagtgatttgggaagtatcgagtatattgagtatagtcatgcgacggatcttaggaataaactggttcaagcttttgaaacagaaaaagcaatatagagaaaacagaaaaagcaggtgggcagatgtcactagaagcagtgaaacaatatttcaaagagcaggacatggagagtcgggtcatggagtttcaacagtccagcgctacagtagaggaagccgctgcggcgattggatgtgaaccacgtcagattgcaaagacgatgtctttttatgtggatgatgcgccgattctcattgtcctggcgggagatacgaagattgataataagaaatacaaggcaaaatttcagcagaaagcaaagatgattccccgggctcaggtggaaaccgctaccggtcaccaaccgggtggtgtttgtcctttcgctacaggacaaagagtcacggtatatcttgatgtatctctaaaacggatggaacgagtgttccctgcagccggaagtggccaaagtgccgtagatttgacagtggaggagttggagaggtattcgggctttatggagtggattgatgtgggaaaagtgcagtaagcggagaaaatccacttgtaaatcgcagggggctattttataatagaagaaccacaaaggaaaagaaggaggaaaacccgtgaaaaacgaattagtaatcgtgcttgactttggcggacaatacaatcagcttgtagcaagacgtgttcgtgaatgtaatgtatattgcgagatctattcctaccgaattgatattgaaaagatcaaagcaatgaatccaaagggaatcatcctgaccggcggcccgaatagctgctatgaggcagattctccaacatatacaaaagaattatttgagcttggtattccggttctcggactttgctatggggcacagttgatgatgcatgtgctcggtggaaaggtgacaaagccagaggtcggagaatatggtaagacagaggttctgattgataaaaaagattccaaagtgtttgaaggagtggagtcttctacaacttgctggatgagccattttgattatattgagcgggtggcgcctggatttgagattgcagcgcatacggcggactgcccggtcgcagccgctgaaaatgcagagaaaaagctatatgcaattcagttccatccggaagtacttcatacagttcgaggaaaagaaatgctctacaattttgtacgcggtgtatgtgcatgttctggtgattggaagatggatgcttttgtagaaaatgcggttgcagatattagagaaaaagtaggagacggtaaagttctgctggctctgtccggcggagtggattcttccgtagcagcaggtctgctttccagagccattggaaaacagcttacatgtgtgttcgtcgaccatggacttcttcgcaaaaatgagggggatgaagtagaagcagtattcggaccaaaaggaaactttgatttgaactttattcgtgtcaacgcgcaggaaagatattacagcaaactagctggcgtgacagaaccggaacagaaacgcaaaattatcggtgaagaattcatccgtgtatttgaagaagaagcaaagaaaattggagctgttgatttccttgcccagggaaccatttatccggacattgtagagagtggtctcggtggagagtccgcagtaatcaaatctcatcacaatgtagggggacttccggactacgttgatttcaaggaaatcatcgaaccgctccgggatctttttaaggatgaggttcgaaaagtcggattggagcttggtattccggaagatctggtattccgtcagccattcccgggaccaggacttggtatccggatcattggcgaagtgactgcggagaaagtgcagatcgtgcaggatgcagatgcaatttaccgggaggagatcgcgaaagctggactggacagggacatcaatcagtactttgcggcgttgacaaatatgcgttccgtaggagttatgggagatgagagaacttatgactatgcggtggcgcttagagcagtgaagactattgattttatgacagccgaggcggctgatattccgttcgaagtactgcagaaagtaatgagcaggatcatcaatgaggtaaagggagtcaatcgagtattctatgatctgacgagcaaaccaccaggaacgattgagtttgaatagttggagcagagcttcaaagcctttattttcaagggttttgaggctctttccttttagaattgcattttgattgcatttttttattcaactgctctgtgatagattgctgtatgctgattgctggtgtaatcggcaacactggttgttgccggagtataagtgagaacaccagttaattttttggcaacttccacgttggtgttgggatataaatgtccataggttcctaacgtagtctgtatcttttcatgccccagacgttctttaatcaataaaggattttcacccatactgatgagcagggaagcatgggaatgtctgagtgcatgaatcttgatacggtgtacgcctgccaatccagcaagtttttctaatgcccgtgggagggtgtgcttactggtgggaatcccattgtagcttagtacaaggtcgcagccctttaaaaccttttgctgtacttcctgccatgctttcaattctttgatggtatctgtgtcaatatagatagtgcgaatactggcttgtgtctttggctccacaaatttgtattcgtccattgttttatagtacagcgtttttgttatacttaaaagtccggtttcaaagttgatgtccgaccattgcagggctgcggcttctccgattctcattccggtcataaacaggagccagtatgaaatgaaaaggtaatgttcgtaataatctcccttgtagagcagggaaattaccttttgaaattcatccagtgtccagaaatccacttttgttttcttgctcttgatgtttcctatcattcgtgatggatttttctttgcaagaccgagaacaactgctctgtcaaaggcaatagagagcataccctgtacaatacggatatagtttggactaaattcttttgcgagttcaagctgccagttctggacgttaatgggttctatctcatccaccgtcattttgtaaaagtatgaaaaatgcttctgaatggtagaacggcggttcagataggtgctttcctttacttgtgttttataccaaggaagataagtttcctcaataaactgttgaaaagatagctgctgtttcttttctgttaattcctctgtggatgtcagcataagttttgaatatgcttctctggcttctttttttgtcttgaatccacttttgtatttctgaatttgttttccggtaatcggatgaaaacctaagtttgctctaaaataataagttccgttttctgctttcttaatagggtcttttgccatgatttcactccttacataaatgtgcaagaagtacaatcagtttgatttatcagtaaaagtaatccctagcaattcttccacagcttctctgggaaccctgtccagtttgcgtgactgatagtaggtatgcccttttgaaatcataagtttttttgcttctcttatgatgtctgctgcgaatgaagttccataacccagttctattaagtctttttttgttactgtaatcatgttcctcctttccatagaccagatatggaaccctcaatatctgtctatattatatcagattttgtggcaaaagtaatattaagattgtatttcctgcaaatagttatttgattttgaatgaaaaattctaattcaaaatggtgtctaagcaagccgaacagctttcgctaaagctcatgggaatctcacccctgcatggttctcatccagccgtaccctttgccagcggtgctacatcatcacacggactaaggctgtacggaagtatcattatcacgatagaaaggtcatggcggcagctctgcggtaagctacttatggaacgctggcaggaatcgctatccggtatcatccctcctttggtgggttacggcgtgccagcccaacggctctctttctatcgaaacgtattcggctgctttatgctgcgttgattagacgctttctttttcaaggaacaatccggctttgtcagcctgttaaaatgcactggtgataatgcactttaatagactggcaagctctgtctgggaagcatgggtttgtccacgcttccacaggcgagcgttatttctagtttggttccctgatttcaaaagataaaatctttgcaatcagacgtgtttccatccggcggcgtagggtttcatctacaaccatgtgggtatttccatattcgtctttcatgggacgcatggaacggctggcaataaaaccgctgtaatggcgtacaatctggttgactgcttcaatatcgccgtccgtagctcttacaatcacaggaaacggaatcatagggtgctttgctgtcatgcttcgtcctccataaattttttgataaattccagtccggcgtgtcttcttctctggatggtagaacggttgacttccagaatttttgagatttccgtatcgtcaaatccaagaaaataatatcgcaggataacgtcacgtttctttccatccagactttctaatgcttcggctaacaggctgttttcaatgcggacagtaaatccatccatttcaaaagtatggaagtgggatggataggtgtcttcggaagaaaacagattgacggtgtaatcgtccatatcacagaacagggtttcccgtttacactgtctggacaacgctttgagatagtctttgcgttcatcctccatagcgactttacagatataatcaaactggttctctatggttgtctgaaattcagatggcttcatcattgctcaccccctttccagccttgaaagggagcgagttgataggaatttctgcttctttcccccttttcgctcttagtcccgacaggacaggaggtgcagttgcattttgaaaagaaaaatttaaaaactttttcttccaactaaaaaagcacgcaaacagacgatatttctgtttgtgtgcttcgatagttctttctatgtattctgaaaaaccacattgagggtcagacttttctagtgtaggtggatggctttttttaacggtttaccgaatgtagatatatttaagaaaatattttgcatagcggcttcctcctgtaagccgttgtctgtataaagtagtagattttaaaaatcatctatatttcaggcaaaaaaagacggcggcttttgttaaaccgtcgtctggaaatgatgatgtgatttttgacgcagggaaagtatgctgccaaataacggttttttttatttccgtttcggcagcatagttttatctttgatacgcataataggaactgtacaactatacaatacgtttttctatacctgtcactattacaacaggaacagtaaaatgtacagaggtggtgtattatgcgtaaaaaagaagataaatatgatttcagggcgtttgggcttgccataaaagaagcccgtaaaaaacagggattgacccgtgaacaggtgggagcaatgattgagattgacccacgctatttaaccaacattgagaataaagggcagcacccaagtttacaggtgctttacgaccttgtatctctgctgaatgtatcagtggatgagttctttttatcctctgatagtctggcaaaaagcagcagacgaagacagcttgaaagcaaaattgacaattttacagacgcagaccttgttatcatggaaagcgttgcagatggcattgtcaaatacaaggaaatggaagataaataatttctattgcctacaagaataagattgaaattaaaatgagccgatagtctataagctgtatagcttataaattatcggctctgcgtctaagcgtctggctctttgataatggctgtaattccgttttttattgtcactaaattttcttttttgcattttggacaaaagagagggaaatttaccagttccgtgtctttgcgtattttagttcgtgtcttattgttacagacaggacaaagtacccatatttgttgtttttctataagaatcacctaccttataaacttctaaaaggaataggatggtttaattgtaatttatttgagtgcttgtttcatccaattatctaaaaagaaaagttgtttgtctgtatggaaccaatgctctccatctttcattacagtaaggtgggcgttgtgatggtctacaaagatatttatggtttttttagtaattagattgtcattttcaccgtagagaatttcagttggaattgtccaatttataggatgttctctaacgtagcataaatatttccatgaaagggtttcgccaaaatcagttggtatttcgcttttttcacggagctttttttctgatatattcgcccagttcatcatatctagaataagttgctccatatccagcacaggagatatgaataatgctttttcaattttacaattttgtaaggtgttcattacaaagtaggctccaatgctattcgcaaggataaaaattttatcatattgtttatatgcggtatcataagcatgtttaagcggttgttgtaccaaccatggaacatcatatttataatctattccgattatatcaaagcctaaacagttttttttataattttcagcttctgtatgggttcctccctttccgtgaacatataatatagcttttttcataatatgtaccccccccccaaaaaaactaatacgaataataaataaactaatctaattagtattttatatgagataaacattattgtcaatagatttaatgattcatctaatttgattattgactgtactaatgcaattagctaaaataaaagaaacaaagggagatgtaatttatggcagtcacaaaagctacaattatacaaactgcggctgatatagcagataaagaaggacttcaaaacgtatccttaaaggttattgcagaagcattggagattcgtactccatctttatataaccacataaaaaatctggatgaacttcttagagaagttgcccatgatggtatgcgtagtatgaatgcaagaatggttaaagcggcaataggtcatgtgggagataaggcgttaaaaattattgctactgaatatcttaattatatgattgaacatccaggtgtttatgaaattatccaatgggctaattggaatggaactgaggaaacggcagcaatctataatgaatatatttcattacttaatgcatttataattccttacaatcttgaaattgaaagcagtagggaagttttgaatatgattactggctttattcatggttatactactttacaattaagatatgctttttcaaatcctgaaagagtgcagcacgaactatataatgcaatggatactttattgttgggtgttcatcaaaaatatggaaatatatttagtgaagaaaaataatataattgatgtaaagtttgagcgtgcaaatctttgatagaaatgcacgcttttcaaatttacattttttgatgtcttttcccaatatgacggttaaaattatgcaccattgtattttccgataaccttattataagtaatcataagatactaaatcatttatggcaatacgggtagcagcatggcgttctgagctggcttcgggttcttttccatatccgataactaagatattgactggttccaaattatcgggaagatgaaactccttttttacaatatctggcttgaaataacatacccatacagtaccaagcccaagttctgtagcctgtaacatcatatggtctgttaagatagaagcgtcaatatcagtggtctgtttctggtcaaatggacgcacccatgctttctcatggtcagcacatacaataattgccaatggagcatgataaatattagctgcctttgcaagtttatttaactgctctttttcctgaacagcaatcaattttactggctgtaaattagctgctgtcggagccacatgagctgcttctaaaattttatcaagtttttctttttcaacaggtctgttatcatatgctctaacagaatatctttttttagcaagttctaaaaattccattttcaaaatctcctttgtattgtgattcaggtcaacctatactataattatacctatatctaaaaatagagcaagaacgcactatttaggaatatactatccaaaaagaaagtaaggtgatattatgagcttaagttgtagtggatataattgtccggttgaagcaacgattcagctaatcggtggaaaatataaggctgttattctgtggcacttgatgggaaagactttaagatatagtgaattgcataaacgaatgccaaaggcaacagataaaatgttagcacaacaattacgggaactagaaaaggacggtcttataaacagaaaagtatatcctgtaataccacccaaaacggaatattctttgacggattttggaaaaagtcttacaccaatattagatgagttatgtaaatggggagaagattatttgaatgaaactcaaactttagaaaaataggcagataacaaaaaaattacctgcctattgtacacaaaattattttacaatcttccagttttccccgttcttttccagtacaaggttaaactgtgatacctgtgttgtcatggtctggttatccagatatttcaccgcaagggaagccgtcacctgatttccatttcggttgtagactggattcaccagttcggagaaaacatattctttccccacaggtttcagcacgtcctcattcacataataggtcagttcctttgcggttgctgtagggtacagtttgaaaaaggtggtgagaaattcgttgatttcctccgtagtgatggaatccactgtaccgtcactttgtaccgcttttggggtgtagccggattttacgggaacactggtgatagttggattctggataatcgtcaggtttccagagctgtccacatagaccgtcacctgataggcggaacggacatttttactggattctccctctgtgatacgctgttccaccgtgtaggtcacttgataatgctgctccttttcttctgtgatttcccatatctggaagtcagtcagggcagatgatacggggatgtcttttcggacggtatctacattcagggcttgtagctctccggtgagatacccttttaaagcatttgtccggttgtcaatggaagcggcggactgttcccatgaatagtagatttctgcgaaattctccacaaagttttctatcttgtgggtgtcgaggatttgttcctcaatcactttcgtttcatggacagtgtgaatgtctatcgccgtgaaattcttatagacggcaaacaggaagctcactgccagcagcacccacagggcaatcacggttttcttgtgggtattgactttgtagactttcagcttcttttctttctgctttttctggttttcctcttttctaatctgaatcatatcggttcatcctttcttattgtttgattcgtccggctccggcaaggtgctgttgccagtaggagcctgtcaggtctgcgtagccaatgggatttccggcatggtacatccggttatttcccacatacagccccacatgggtaatgtaggttccggcgttgtaggtggagtggaaaaagaccaaatcccctgcttttgcttcggacagggggatatgctgcgtcacattgtactgttcctgtgctgtccgtggcagggcgattcctgccttgccatagcaccactgcaccagtcccgaacagtcaaaggaagtggagggggaatcgcccccgtacacatacgtccagccctcatactttaaggcttcctccatgatagcctgtaccgtttcatcatcaaactgtgccacggtcagatattgcgataccaataggacatagaacatattcccgtaggaataccgccagcccccgtttttctctaccgcaacagggttggtgtaggtgactttctttccgccggatttgtcccttgcgaagctctctgccagttcaaaggtgtattttttcccacgtcctgccacatagtgtaggaaaccgctgccgtagttgtaggactgaatcacactgtttaagtcacagccctttgtttctgccgctgcgagcagttccgagaaatacttgcagccctgtttgatggattcctctgtactaagggagttcgggggaagccccagagattccgaggactgcataacatcttccagtgtgccgccggattccacctgaatgatggcgagcagcacatttaagtattcctctatgccatattcccttgcatacttttccagcataggcttatgggcgaggacttcctgtgatacgctcacgcccccgtagataaggtttccgccgcttccgccgtcttcctcatccgagaagacaatcaccaccaaaaggagcagggagaacatcatcacgaacacgccggaacaggcgaagaaaaggtgtcttaacttcatggtttctcccctttcttctgtttggaagccgctgttaccgtttttatccactcctttctggcggtggtacgccggatagtaaagttcgattcttttaccacaggggcagcccgttttctttccggtatcacaggagccgtatcattctggacaggtcttgccggacggggagcagtcggtgtagtagttgtcttttgtctttcctttggtttgtctggggaagccggagggactatctggcgttctgcccttacaggcggtgtctgttcatggtggatggaagccgcttttaccaccggaaccgaagaccgttctgccacagttcccccatcaggaacctgtccccgttccctgatggatggggaagctggctgcatggctggttttcctgcatgatgtcggaaatcttccggctgctttgcagtaacagggcgttcatggacaggagccgcccctttgggtgcttcggaagctgccttttgcggctgttttgcctgttccagttccgccctgcgttctgcaatggtctgtctgcggctttctgcctgtgcgttcagctgttcggctctggcagttcgggtctgggtcacgctggaagtaaaatcccgtactccctctgatacctgtgttttcccgtggtaaagggcgtactttgcattgacaggcaaatcctttgcctgctcccgaagctgtccggcagtatcggctatcttatctttggtatctgccaccgcacctaccgcagagccagcccgtttccatacggattcctgttccggtgctgcctgtccgtctggtctgctgtggtctgtctgcgtccgtttggaagagccggagtgggaagcagttctttggtctgagccagcctgttttcctgcgtggtatgcagccgttccagccccaagagccgccacagaacgtcctaacttatgctgtaaacggtgcatatgggcgtgcatgagcatacggggtcttcgcatgatacggctccccatgctttgggaatcgccgctctgtaaggagaacatccccatcaaatcccccagcttgaaatagattccggcaaaggtcactatctgcaagaacgccgtcaggaagaacggatattccccggacaggttgtagagcatggtggaaatactgaacgctaccgtgataatcagggtgattccggctctggtaaggatggtattgaacagttttgtaatggcacgttttgacatcccctcaaaagagggaaccatgctaaggaggaagctcacaggcaggaacatggcgtagatgataaaaagtacctgtgagaaaatcattatccccatgagcaggaatacaaaaatggagatgccgatattgaagataaataagaagaagacggttcccaagcggttgatggtctttgtgatggtaaggttcgtgttttccctgtcttcgatttcctccaccacgatttcttccctgtcctgcccgttgttttcgtctggactggttgatagtaggctttccacacggtcagccccaatgctttccacatccgagttgccgtattgcagcaggagccacggctgcttaacctgaatggaaaacaggctgtcccgtatcaaatccacactgtcttttccttgactttccgagtttggcagcacaatctttgtaccaagggtcaggctggcattgctgatgtctgcggaaaattcattgattttcccgatataatcaggggcataggcgataaaggcagcggacagcacgaacaccaccacgaagttgacaacggcatggatggcttttgtggtttcccgtttgataagccctgtgtaggcaacgtaaatccctactgcaagaatgagaagcagcaggaacccgatataaaatccctccgaggacaagccgcctgtggtaacgcctgcaagggtctgcatatttttcccaatggagtcagccgtagaggaaatgaagtccagcgagtaggcttcctgaatcagatagcccgtggcgttggaaaggtacaggctgattgtccagataaaatttgtgatggcatacagcccgtacatcacctgttttccgataccgtccaaccagttccacgggagccagtcccatccgctgtccacataaaaatcaagctggtagttgtccagcggatatttgctgtattcgttggcagcgtccaccgtatcatccaccagtccggcagcgtgggcggctgtgccgaagactgcaagcaataggaggatgagcaggagtgccagaagcacttttcctgctatactcccgattttttttaaagagttttgtccctttgtccgacaagggacaagagctgtcccctgctggatgggctttcttatcttcattcctccacctcttttcttacgggcggtctggtatcaaaggcgtggaacaggtcttcaaagataggatggaactgtatcacacccacacgcccgtacaaatcactgataaggcactgcccgttttccaagtcacggagccgcttctggttgttttcatcttcggaatccaccccgaaaaaggcgagggtcttcttgatttcgttgatgtctgtggaacggaacgcaaatttcaagcccagattgtttttcagcttttcatccagcaaatcgtccgtgttctgggtgacaaagtaaacgcctgcgttcatggcacgtccggcacgaaccagcttcatggagagggtcttgccctgtgccacctgtaagaagctccatgcttcatccaaatccacaatcttaaacacgctgcggtcagtgtggatgaagtcgagggcaaaggtactgattacaatgagcattgccacggaaagcagctccattgtggtgtattcttcaaacgaggtttccttatccggcagcaccaaatccgccacctgaatgatgttgagctgcttttcaaggctgatggactgtgtgacgtccccatccgaaaagagcaggtgtgcaaaatcatagtctgtaaaggattcgatatggtcggctatgctggtgctgatggcggttccctccgcccgtagttcctcaatcactttgaaaagcccccgttcttcactgtttgtcaccgcacggatggctttccgaagaacagggaatttctccccgtcacggctggaaatgccggttaaaaaggtcaggatgtcgattgccagtgattcagaatcttttgggttctccataatcacatacgggtcaagtaagcccctgttctgttcctccgaagtcaggtttacgatattgatttcatgggcgatttccggcagggtttctttccagcgtccccgttccgctttcgggtcaacaatgagtgcctgtgccccaaacaatacggaataatagacaatcatgttgttgctgaatgattttccaccgccgagggagccgacaaaagcggcagcaagggcgttggtgacggagccttttaccccctgactggcaagggcaggctttaagtacacgtttcttcctgtatcaaggctgtacccgatataaataccctccgtttctcctaacatctgggttgccccgaagccaagaccagcgaggaagtcgctggtgacatactggatgtaatcgttcagataccgtttgctggcagggagaaattccccatgcagccccagcatatccccaaaggggcgaaccagtttcacgttcaaatcgtcataaaaatctttcacctcattgcagcggcgtttcagttcttccaagtcgggagccgtcacacgaaccacataggacagcttatacatggattccttgctctggtctaaggtggattccagctcattcacgctgtctaaagcatccaccacgtttgtactggtttcgctgtcattctgccatgcgtggttgtccaaatctttcagctcttttttcttgttccgcaccgtggagagggctttccggtttgtcacaatctccacattcatagaggtatcaatgggaaaggtgaattgctgctgctgatagtaaaagatttccgaggatgggaagtccagttcccccacaatgctgttgatggtaaagtaggcggcatatactgttccgccttcctgttcaattttcagataccgttggttttcctctatcagacaacgggtgggtttgatgaggtcatagtatttcaccagcgtttcctcttgaaatcgcttcttcggcaggtaatactcataatcttcgtaggcggttccggtctgcccgtataaatgctcaatcaggtagccaaaatcgtctttatcaagccgccggactttgaagcggcgtgagattttattttccagcagtttttccatcttctgaaaccgccagatttcttcattgctcatggaaacaaaatcccccatgagcttgtggttgacttcgtggaggaagtcggaaacagcggtctttgcttccctgcggaactgtttcatggtgacttcctgctcattgacaagcagcttaaagccgataaaaaagcggtagtccacctgattttcccctatcatggaaatcagggcttcggtctgtgcgtcaatctttgcacaggcaacatcctttagcttacctgtcacttcctgtttggagcgttcctgtgccgcccgtatgctggattcggtgctgatttgcagggcgtgaatcttcccgtccctgttttgggcgataagctgccggaaggaatcgtgtacctgatatttctgttcggggcttaaaaaggaatagttgtagggaagcagctcatagtaagcgaagcactccccgtcatggttgaacgcaaggttattttcgatatatttaatcggatatgccataaatatcactccttactgccgtgatgggctgtgccggatattccttttccagcttcacgggctttcctgcataggtcagtttcgggcgtaccagatatgccagtacggatttcaggaagccataaggctttttcccgtcaaaggtcttctggcacatgaaccaagtgagggcaaagggtacgccgaagtatttcaaaaatgccccgtcaatgaacgaaaggggagggaggttccccaagagcataactgcaaacaccgacaccacgaaccacgccatctgtgtgaatgtgatggggaatggcagcttaaaatcattgatggaatagagtaccttttccaccgaccagatactggtatagcttcgtattttcttcatgttgtctgtcctttctaaaagatggggcagcaaaagccgcccctgaataaaaaatccgcctgtatttcccaaaggagatacagacgggtctaccgtaagatttcatatacgccgtggttcgtgacaacaaaggttccctccaattccatgtcacgcccataggctgcatagtcgatatagctttgtaagtgtgccggaagttctccaagctgtccgctttcttccagatagtagcgagccacatccgccatatcgtcacagccggaatggcagataatatcgtcttcatgctcacagagttcttcgatactgccaaagtaggattgcagctctgatagttcctcctgaatgtactctggtaagtcctccaccatttcacacaggcggttgacttcctcaatgggggtatattcgtcaatctcaaaaggcagctcataatcatggatggcgtattcctcatattcatcattcaaaccgatacgttccttgacttcctcaaagtccacaggcggcgtgaaccatgccctgttgtggtcaagcatttttgtaacacttatggctaataaaatcggtggattgcagtttggaatctatcggaactgtaagttatgttgaaccgccgtatgccgaacggcatgtacggtggtgtgagaggggagagaaaatctcccctactcgatcgaaaagaaatgtaaaatcaatgtaaaattcatgtaaaatcgtgttaatttttgggatacctattgcgtaattccgccttttctagtaaatatataaatagaatgttaaaaataagttagcattttgtaaaatcaaagaggaaaattcttttttatggaggaaaagagaacatgaagttgacagacttttttggcctgctggggggacttgctttatttctttacggaatgcaaatgatgagctccggacttgaggcagcggccggaaacaagatgaaacggattctggagagactgactgctaaccgctttttaggagttcttgtaggtgcgggggttacggctgtgattcagtcatcttcagcgaccacagttatggtggtagggtttgtaaattcaggaatgatgacactcaggcaggcagtgtggatcattatgggagccaatatcggtacgacaattacgggacagctgattgctcttgatatcggggcgatcgctccgttgattgcgtttatcggagtagcgctgattatctttctaaagagtccgaaagtacataattatgggctgattgtagcgggacttggcgtactttttctcggtatggagatgatgagttcatcgatgatgccgcttcgtgattcagaagcgtttgtaggtctgatgacgaagttctccaatccggtgcttggaattctggctggtgcggtatttacagcgattattcagtcttcttccgcatccgtcggtattttgcaggctcttgcgtccaatgggttgatcggacttccaagtgcggtgtttgtccttttcggacagaatatcggaacctgtatcacggcggtactggcgtctatcggaacaagcaggaacgcaaagcggacgacgatcatccatctgacattcaatttgatcgggacggtgatctttacgaccgtctgtatcctgacgccgctgaccgctctagtggaaagctggacgccaaccaacgtggcagcccagatcgccaatatgcatacattatttaatattgttactacggttcttctgattccatttggaaactatcttgcatcgtttgcggaacgggtgctcccggacaagaaggaagagacactggaagggatgcatctggagttcattcgtccggtggatacaaagagagagaaccatatcggtacatccgccattgttctgacaggagtgcgcaaagaggtaggcagaatgcttcagatgacaaaggagaacgtaagcctgagtttcgacgcagtgctggagagttcctctgagctgctgaagaaagtggatgagaaagaggagtatattgattttctcaacaaagagatatgtaaatatatctccaaggtcattgtcaatgagacgaaccgtaaagacgcgaaatatatgagcgccctgtttaaagtatgcggcaatctggaacggatcggggatcatgcgacgaatctttgcgagtacacgcaaatgatgggagaaaaagggatctctttttcgcagacagagatggatgagatccggcagatgaaagaggcgagtctgagcgcattgaatatcttaagtgatattgagaagggagataaggagctcgtgaaacgcatcgagaaagcagaacagcagatcgacgacatgaccgagatgttccgccagggacagatcgaccgtatgcagcagggcaggcaggacgaggaggttagtattctctactccgaaatgttgacggactttgaacgaatcggagaccatattctcaatatcggacaggaaatgggacttggaaaggtcggagcgtaagctttgtttgaaggaagtccagattttgcaaactaaaatagaaaaatgaaacggaaagagatcactcttgcagaattcagtaccctaggatggacagaactttgcaggggggtctttttttaatcagatgaaagattatgtttgattcatttgtctgaggacaggggtaactgaaatcccaaaagacatattccaagattacaggtggccaccaaggatcctggtaggcttggcttctaatcttccctcaacacaaaaaaaggaacgataataatcgttccttttcatctatgcggatagcaggacttgaacctgtaccccctcgcgaggactagaacctgaatctagcgcgtctgcctattccgccatatccgcttgacaaaagatactatatcatataattgttgtttttgcaaatattttttgcagaattcataaaattttttttcgattcctgataaggaagagatactgccagaacaggtggagcagagcccctcccagaagaatgaccgcaagataacagagaatccgcagaggattcggaagggcggccgtcaaatctgaaataatgatctgtgacattggataataagggctgatataaaagaggtcgatggtatgaatgcgcccaataatgagattgagtatggtagccgcgccgcaaagggcggcaaagagcactgccatcagacggaatcctctccacgtgtagtcggaaattcctgaaaaaccgcagatgatcccaatggtgatgagtaggatatgccacagataagagtgacaggtgagaaacgggagaggatagtgcattccgcttgtgtcaagaaatgcgccgattccactgagcaggccaatatccatcaagaaggtacaaaaaatccttttgacgtgggaggcatggaacacaggaaacagtaaaaggaggtacatcgggacggagcaaagctggaacggaaaataccaccagttgtaatgaccgccgccaaggacgaatgtcagtgtccactgtttccagatttcgcttgcacccatgaaaagtcctgtacaaaacagaaaacgttctaatcgttccagcccccgtatatttcgcatgatcgttgtcctcctgtttgattttactattttagtatgaatttattttaccacaaatatgtaaaaacaggcttgacaattttgaatcagtgcaatatagtttgaatatcaaagtatttgaagttcaaaataaaggtttggagaaaacagatgataggaaaaatatgtgggacggggtcgtatatcccgcctaaaattttgagcaatgacgatctctctgagatggtagagaccagcgacgagtggattcgggagcggaccggcgtcagaaaccgccatattgccggggaggaaacgtcgtcttttatggcgtctgaagcggcaaagcgggcggtggagaatgcgggcatcagcccggaagagattgacctgattcttgtcgcttcctcttccccggatgtgatctttccgagcgtggcctgcgaagtgcagaaggcgatcggggcggttcatgcttcaggatacgatatgcaggcggcttgtaccggatttgtctttgcgtatcagactgcacaggcatatattgaggcggggttttataaaacgattctgttgatcggaagtgaagctctttctacgatggtagactggacggaccggggcacctgtattctgtttggagacggcgccggcgccgccattttatgtgcggccgaaggaaagacgtatcttccggcggcgcatatggatggtagaaaaggggaggcccttgtttgtagaagccggttttcggaccgtttcctggagaaataccaaaataccgggaaggttcctggagatacctatatcagtatggacgggcggggcgtatttcagtttgcggtgaaaagcgtgccgcaggttgtgacggaagtcctggaaaaggcattacttacaacggatgacatcgactggtttattcttcatcaggccaatcaaagaattgtggagtctgtcgcaaaaaggctgaagacagatattgagagatttccgatgaacctgcaggagtacgggaacacctcctccgcaagtatcccgattcttttagatgaaatgaaccgggacggaagactgaaaagaggacagaagatcatcatagtcggattcggcgctggtcttgcatggggcgcgtccatcctcgaatggtaaatggtaattcccggcatgggccggattacatagaaacataaaaaagaaaagtaaaaggagattattaccatgttagaaaaagtaaaagaaatcgtagcagaaaatcttggagcagatatcaacacattgacagaggagacttctttcaaggatgatcttggagcggattccctggatctttttgagatggttatggctctggaagaagagtacggcaaagaaatcccgacagaagatctggaaaagcttacaacaatcggagaagttgttgagtatctgaacaaataataagaaacaggacgtattctgcatggccatccgttttgccgctgtttttgccgggagagcggatggcagaaatatattgctgtaaaatgaaggaagggattttagaatgaagacagaaattacagaaatccttgggattgaatatccgatcatccagggaggaatggcctgggtggctgaacataaacttgcggcggcagtatcgaatgccggcggacttggcctgatcggcgcggccagcgctccggcagactgggtaagagaccaggtcagaaaagcgaaagaactgactgacaaaccgtttggtgtcaacattatgctgatgagtccgtatgcggatgaggtagcgaaggtcatcgtggaagaaggagtaaaggttgtaacaacaggtgccggaagcccggaaaagtatatgaaaatgtggaaagaagcgggcgtaaaagtgattcctgttgtggcaagcgtggctctggcaaagagaatggaacgctgtggggccgacgccctggtggcagaaggcaccgaagccggtggacatatcggtgagaatacgacgatggtactcgtgcctcaggtggtggacgcggtccatattccggtgattgctgccggcggaattgcggacggacgtggagtcgcggcagctttcatgctgggagcaagaggcgtacagcttggaaccggatttgttgttacggcggaatcccaggttcacgacaattataaaaacagtatcatcaaagcaaaagatattgactcccgtgttacaggacgttcgacagggcatccggtgcgtgtactgagaaatcaaatggcgaaggaatatatcaagaaagagcaggaaggagcttcttttgaagagctcgaacagatgacgcttggcggtttaagaagagcggtcgtagacggagacgttgtgacaggaagtgtgatggcaggacagagtgcggccatgttcaaggaagtccttacctgtaaggaattcatcgagaagcttgtgaaagagacagacgcactgattaaaggagcgggattctatgagtaaaatcgcatttatttatccgggccagggagcgcagaaagccggtatgggtcaggatttttatgaaaacagcaaaagcgcgaaagcggtctttgacaaggcgtctgagattctcggcctggatatgaatgcactgtgttttgaagaaaatgataaactggatctgacagaatatacccaggcggcgcttgtgacgacctgtcttgccatgacaaaggtggtaagagaaaaaggtatccatccggatgtgacagcaggattaagtcttggagagtactgcgcgatcgctgaggcgaaagcgatgtcagaagaagacgcgatccgcacagtccgcaagagaggaatcctcatgcagaataccgtaccggcaggcgagggagctatggcggcggtacttggcatggaagcggaggtgattgagaacgtgatcgcaccgatcgagggcgtgaccatcgcaaattacaactgtccgggacagattgtgatcaccggagtgactgccggggtagaacaggcagcagaagagctgaaaacagcgggagcaaagagacttgtgatgctcaacgtcagcggcccgttccattctccccttctgaagccagccggggaagagctgttaaaggagctggaaaatgtagaaatagggaagcttgagattccgtatgtaacaaacgtgactgcggaatatgtggagaacgaagacgagatcaaagaacttctcggaaaacaagtatcctcttccgtaagatgggagcagagcatccgcaaaatgatcgaggaaggtgtggacacctttgttgagattggaccgggtaagacgttggcaggatttatgagaaagatcagccgtgacgtttccatgtacaacattggtacatgggaagatgtggacaaagtggcagaggcgctgaaataggctcagatccgggaaggatctgaaatatggagatacataaggagtatggagtatgacagagcagaaagtagcagtagtgacaggagcatcaagaggcattgggaaggcaatcgcgatggagcttgcaagaacgggagcgcttgtgattgtcaactacaacggttccagggaaaaagcggaggaagtaaaagcacagatcgaagcagaaggaaatcaggctgagatcagacagtgtaatgtcgctgattttaagtcctgcgaggacatgttccaggaaatcatttccgcccacggacgggtggatatcctggtaaataacgcgggaatcacaagggacggacttttgatgaagatgagcgaagaagactttgatgctgttgtagacacgaacctgaaaggagcgttcaactgtatccggtttgcttcccgacagatgttaaagcaaagaagcggacggatcatcagtctttcctctgtcgtaggggtgtatggaaatgcgggacaggcgaactatgcggcatccaaggcaggcattatcgggcttacaaaggcatgtgcaaaagagcttgcttcccgtcatatcacggtcaatgccatcgcgccgggatttattgagacagaaatgacggaagtattgtcggagaaagtaaaagaagcagcgaaagcgcagattccgttcggtacattcggacagccgaaagacattgccaagacagcagccttcctggcatcggatgacgcgcggtatatcaccggacaggtcatctgtgtagacggcggaatgtaaaaagcgaagaaggagacgaaatatgaaaagaagagtagttgtaacaggattgggagctattactccgattggaaacagcgtaccggaattctgggaaggaatcaaaacgggcaaggtagggatcggtgaaatcaccaaatttgatacttctgactataaagtaaagattgcggctgaggtcaaggattttgagccaaagaactatatggatttcaaggcagccaagagaatggaaccattttcccaatatgcggtcgcggcggctatggaggcaagcaaggatgcgggaatcgacatggaacaggaagatccgtttcgtgtaggcgttatcgtaggctccggaatcggaagtctgcagacggtggaaagagaatacacgaagatcgtggagaaagggccgaaccgggttcatccgttgatggtaccgctgatgatctccaatatggcggccggaaatgtttcgattcagcttggagcaagaggaaaatgtaccaatgtcgtgacagcgtgcgcttccggcacccactgtattggagacgcgttccgcgcgatccagtacggggatgcggaagtgatgttcgcgggcggtacggagagtgcgatctgcccgaccggagtagcaggattcacggcgctgacagctcttacgacgtccactgatccgatgaaagcatctattccatttgacaaagacagaaatggatttgtcctgggagagggagccggaatcgtggtactggaggaactggaacatgcgaaagcaagaggagcaaagatctatgcggaggttgtaggatatggagcaaccggagacgcataccacattacctctccaattgaggatggaagcggagcggctcgcgcgatgacagacgccatgaatgaggcaggagcaaaaccggaagagatcacctacatcaacgcacatggaacgagtacccaccacaacgacctttttgagacaatcgctatcaagtccgctctcggagaggctgcaaaagatgttgttgtcaattccaccaagtccatgatcgggcatcttcttggagcggcaggcggagtagagtttgtgacgattgtaaaatctgtggaggaaggattcattcaccagacgatgggaacagaacatgttgacgaggaatgtgatctgaactatgcagtcggtgctccggtgaagaaagaagtacagtatgctatgagcaattctctgggattcggcggacacaacgcaacccttttgattaaaaaatacgaagaataggagaatgtaaaaatggaactggaacagcttttaacactgattcaaacagtttcggattcgaagcttacagaattcaaatatgagacagaaacactttgcgtcaagatgggaaaagaaagtagtgtgaaagtcgtaactgctgacccacagatgatggcagcagttccggcggcttccgtggtagcggaagctccggatacagaagaggagaaagcaccggaaggaaagattgtggtatcccctcttgtaggtacgttctatgcagctccgtccgaggacgctgctccgtatgtacaggtcggagatgctgtaaagaaaggccaggttcttgccattgtggaggcaatgaagctgatgaatgagattgaaagcgaatacgacggaatcgttgaggagattttggtggaaaatgcccagggcgtagagtacggccagccgttattccgcatcagataatagaggagaaacaatatgaaacatctgggaatcaaagagatagaggaaattttaccgcaccgtcacccgtttttgttggtagactatatcgaggattatgaaccgggtgagtatgcgacaggatataaatgtgtaactttccgggaggacttttttcgcggtcacttcccacaggagccggtgatgccgggggttctgacgatcgaggcactggctcagatcggggcggtagcgattttaagcaaagaggagaataaaggcaggatcgcgtattttggcggcattaacaagtgcaagtttaaaggaaaaattgttccgggagataaagtgaaactggagacaaagattatcaaacagaaaggaccgctgggagtcggtgaagcgattgcgagcgtagacggaaaagtggttgtaagtgcggaactcaccttcatggtcggataggcacgaaaaagacaaaaatgaggtcggaggcagatatgatgaaaaaggttttgattgcaaacaggggcgagatcgctgtacggattatccgtgcgtgccgggagatgggcatcgaaacggttgcggtatattcagaagcggacaaagaagcactgcacacacaacttgcggatgaggcagtctgcattggtcccgcaccatcggcagagagctatctgagcatggataaaattttgagcgcgacgatgattaccggagcagacgccattcatccgggatttggatttctctccgagaacagcagatttgcagagctttgtgagaagtgcaacattacattcatcgggcctggggcagaagtgatcgaaaagcttggtaataagtccgaggcgagaaatacaatgatatctgccggggttccggtcattccgggaagtacggagccggtatttgatgaagagacgggagtaaaagaagcggaccggatcggatatcctgtcattgtaaaggcagctcttggcggcggcggaaaaggaatgcgtgtggcgaagaccagggaggagtttgctcaggcgttttcgacagctcagaaggaggccaaagcagcttttggggacgatatgatgtatatcgagcactttgtagaacatccgagacacattgaattccagattctggcggatcgttatggaaatgtcatccacctgggggagagagactgttccattcagagaaaccatcagaagatgatcgaggagtccccgtcggcagcccttggtgatgagctgagaaacaagatgggggaggcggccgtcaaggcagccaaagccgcacattatgaaaatgcgggaacgatcgagtttttgcttgaaaagaacgggaatttctattttatggagatgaatacaagaatccaggtggaacatccggtaaccgagtgggtgacgggaatcgacttgattaaggagcaaatccgcattgcgtccggcgagaaaataaaaatccaccaggatgaggtaaagctgaccggacacgcgatcgagtgcaggatcaatgcggagaacccggcaaagaacttccgaccgtcaccagggaagatcacggacatctaccttccgggtggaaaaggagtgcggattgactctgcgatttacagtggatatacagtaccgccgtattatgattccatgctggcgaagctgattgtccatgcgaagacgagacgggaagccatcaataagatgaagagtgctttgggggaggtcatcattgaagggatcgacacgaacatcgattatttgtatgagctgattaatcatccggattatcagagcggaaatgtcgatatcgagtttgttgagtgtttgtgggggtgaaaagacatgaaattatccaatatgttcaaaaagacagatcggaaaaattatattacgatccatacgtcagagaaaaagggcaaaccggaagttccagaaggactgctgaaaaagtgtaatgcctgcaaggcagccattgtgacggaggacgttcagaacaacgattatatctgtccgaaatgccacaactattttcgggttcatgccagaagaagggtggagatgatcgcggacgaggggagctttgaagagtgggatgctgacctgattgcagggaatccgctcagttttccgggctacgaggagaagatccaatcacttcaggaaaagaccaatctgaaggaagcggttgtgacagggaaagcaaggatcgatggacaggacgttgtgatcggcgtgtgtgacggcaggtttatgatggcgagcatgggctgggcagtcggggagaagatcgcccgggctgtggagcgtgccacaaaagagcggcttcctgtgattctctttgcctgctccgggggagcaagaatgcaggaagggattgtctctctgatgcagatggcaaagacgtcagcagcgttaaagaaacacagcgacgcaggacttttatatatttctgtattgacgaatccgaccacaggcggtgtgacggcaagttttggaatgcttggcgatattacccttgcggaaccaaaagcgttgatcggatttgcggggccacgagtcatcgagcagaccatcggacagaagcttccggaaggattccagaaatccgagttcctgttggagcatggattcatcgaccggattgtggagaggaaagagatgaaagacgttctttcttctatcctcagtatgcatcagacaggtacgggagtggaaagttggaagcaggaagtctgccgggaaacagaggaggaaaagcgtgccccgtataagggactgacttcctgggagagagttcagatttccagaaagaaagagcgtcctgtggggagtgattatatccgcacgatgtttacggatttcatcgagtttcatggagaccgttattttaaagacgataaagccatcgtgggcgggatcgcgaaattccatggaattccggtaacggtcatcgctcaggaaaaaggaacgtccaccaaggacaatattttacataactttgggatgccgtctccggacggataccggaaagcactccggcttatgaagcaggcggagaaattccaccgtccggtgatctgctttgtagatacgccgggggcgttctgcggtctggaagcagaagaacgggggcagggggaggccattgcgagaaatatctatgagatgtccggcttgaagactccggtaatatccattgtcattggagaaggcgggagcggcggagcacttgctatggcgacagccgacgaagtctggatgcttgagaattccatctattccattttgtcgccggaaggctttgcttccatcctctggaaggacagcaaacgagctaaggaggcggccggagtgatgaagctgacggcgaaccacttaaagagtatggagattgtagaacaggttattgcagaaccggaagattttacaacggcgaacctgcatgaagtgacagacagactggataagaatctgaagaaatttatatgcgagtacatggagatggatacaagcgctctggtagaaaaaagatatcagagattccgtcggatgtaagaaaggaacagaaagtgaatacaaaatggccgccgattcagttaggcgagaaacaaatcagaattcctctgattcagggaggtatgggcgtcgggatcagtttgggaaggctggccggcgcagttgcaaaagaaggagcggcagggatcatttccaatgcgcagatcggatttagggagccggattttgaggaagatcccttccgtgccaacttgcgggcaatggagagcgaatataagaaggcaaggaagacctctccggacggcgtcatcggcttcaatattatggtagcgttaaaccactacgaagaatatgtccgccatgcggcgtccctggggtgtgacctcattatctgcggggcgggactcccgacggaactgccacgtctgacggaggaaacgggtgtgaagatcgctccgattgtctctacggacaaatcggcgaaagtcatcctaaaatactgggacagaaagtacaaaaggataccggatcttcttgtgatcgaaggccccaaagcgggcggacatctcggctttaccaaagagcagcttgagatctttgatgaagagacatatcggtcggaagtacaggcaatcttaaaaacggtacagggttacggggaacaatatgggaaaaagattccggttgtcctggccggaggcatcgacacgagggagaaagtggaaactgccatggctctcggtgtagacgggatccaggtggcaagcaggtttgtgacgaccgaggagtgcgacgcagatatccgctataaggaagcatacatcaaagcggcaaaagaggagatcgctatcgtaaaaagtccggtggggatgccggggagagcaattttaaacccgtttatgaaacgggttatggacggggagaaattcaccccgaagaaatgtctgggatgtctccataagtgtgagccggcgaagattccgtattgtattacggagcggctcgtggcagcggcaaaaggcgaggtggaggaagcgcttcttttctgcggagaaggggcgtacagacagcaggaaattacgacggtaggagacgtgatccaatcactgatgggagaagaaaagagacaggacgaaagatagacaggtaaaggagcagaaaaagcgtggacgcatacagggcaatcaatgaaatcctggttcatttgttcaatgagatctgggaactggaagaaaaggcagtcatcacagatgagtacaaagatattacgaacaatgacatgcatattatcgaggcggtgggacttggaaaaggcaacaatatgacggccatcgcaaagaaactgaaaattacagtcggatctcttacgacatctatgaacagtcttgtcaacaaaaaatatgtggttcgggaacggagcgccgaggacaggcgggttgtcaatattcgtctgacaaaaaaaggggagagggcataccaacaccatgcggatttccaccggaaaatgacggatgcggtcgtttctgcccttcaggaagaagaaattccggtactcgtaaaaacactggacagcctttctgccttttttaaatcttacagggaagaagattgatacagtttcattttgaaacaaaaaacagccgcaggcagctttttagagctgttttgcggctgtttgcgaaacatcaggcagaagcctttctgtttcggtagattttattactggaaaatccatggcctttgacttcattgacacgggaaataatcataaaggcttccggatcgatcttatttacttcctggttcagcttggaaagttcccggttggagatgacggtcataatcacaggctgatccacatggagatatccggtctctccgtaaagcaaggtggagccacggtcgagcttctggacgatcatttggttgatctctttatgctttttgctgacgattttgacctgggtctgggcgtgtccggtcagaagcaccttgtcaaggacaacggtgtagatcaggacgagcagaataccgtagatgatctgctccttgtcggagaagagcatctggagtatcaggatcgtaaagtcaaatacatagagcatcacggacactggaagaccgaatttcttgttcaggaccagtggaggaatatccatacctccggtagaggcgccggcccggatgacgatgccgatggcaaatcctatcatcagtccgccggagattgtggagagcattcggtcgtttgtaatctggccaagctgcgggatattttcaaatacacctaggatgatcgggtagaagaaactgctgatgagtgtggtcagagcgaacatctttcccagaacgacggccccaagaaggaacatgacggcattgaagcaaaagacaaaagcggaaatcggaatatcaaaataatgttcaaacgcgattccaagacctgtcgttcccccggtgatcagatcgtttggaagaataaagacggcaactccaagggcatagatggcgttgccggccaaaatagtaagaatgttccaagcttttttagatacactctcattcatacataccagtcctttctatgttcagataggaacaagtatacaggatgacaggagggggaacaagagatttcacaaaaatggagaaatcttatcagcatgatgaaactgtgctatactaaagggaaagaaacggacgggaaggagaaaatgagatggaagagatcagaaagcttcaggagatgatcgacaaaagcagtaatatcgtattctttggaggggccggggtttctacggagagcaatatcccggatttccgcagtgaggacggtttatatcatctgaaatatgatgttccgccggaaacgatcatcagccacaccttttttctgagacatccggaggaattttaccggttttataaagagcggatgctttgtctggatgccgagcccaatccggcacatcgaaagcttgccaagcttgaggcggcgggaaagcttacagcagttgtcacccagaatattgacggcctgcaccagaaggcgggcagtaagaccgtgtacgagctccatggcagtatccgccggaactactgtatgaggtgcgggaaatattatgacgcagagtatatccgggacagcgaggggattccgagttgcggctgcggcggggtgatcaaaccggacgtcgtgctctatgaagaaggacttgacacacggatcatccagaattctgtggaggcgatcgccggagcggatatgctgatcatcggcggcacctcacttgtcgtttacccggccgcagggttcatcgactatttccgtggaaagtatctggtactcatcaacaaggcggaaaccggacgcagcgtgcaggcagatcttgtgatacgggagccgatcggacaggtgatggcacaaatcacttgcaatcccggggaaaattcgctaaaataatgaagttagcatgttgttatcaagttaggaaacaattcatataaaggagaaaatgtatgtgcggatttgcaggttatgcgggagagagagagtacgacacttccgtaatacggaaaatgacggataagattcggcacagaggaccggactcacaagatgctttcatagaaggaaaggtcggactggggtttgtacgtctgagcattatcgatctggaaggcggatctcagccgatgttcaatgaggacaagaatctggtgttgatttttaacggcgagctttacaattttcaggacattcggaaagagctggtcgaggcaggacatgtatttacaacgcatactgattctgagatcctgctccacggttatgaggagtggggaaaggaagggctgctcggacgcctgagagggatgttcgcttttgtcatctttgaccggacgaagaagacgcttttcggagccagagaccatttcggaatcaagccgttttactattatcacaaggacggaacgttcctctttggatcggagatcaagtcgtttctggctcacccggatttccagaaggagctttttgaggagaagctgccggactttatgacattcggatgtattccgggagcggagacgtttttccggaatgtgtacaagcttctgccgggacattacttcacatacgaggagggaaagctgacagtaagcacctactgggagccgacctttgatatcaatgagaatcaaaccatcgagagtgtggcggacaagctggacggtgtgctggaggattctatagacaaacacatcatcgccgacgtaccagtctgctctttcctttcaagcggcgtggattccagctatgtggcatatgagctgaaagacaaggtagatctgacgacttttacgattgactttgtggagcagaagtacagcgaggcgccgcacgccaaagagcttgcggacgagcttggcatccgcaatattgggcggaaagtgtctgccgacgagtatttccatgacgcggagaagattcagtactacatggacgaaccgctggcgaacccaagcgcgaatcttctgtactatatcgcgaaccgctgtgccgaggacttcaaagttgccctctccggggaaggcgctgatgagatgttcggcgggtacaacatttaccacgagaatatttctcttggcaattatcaaaagcttccgaagtggtttagaaaagcggtggcaaaagccgtatccccgcttccaaaattcaaagggaaaggcttcctgatccgtggcagtaaggacgtggaggagcgttacatcggaaacagcaatgtcttcaagtacgaggagagagattccttcctcaagaagaaatataagagcagaaatcctctggatatcgcgaaagagttttatgacaaggttccggatctggatgacgtgtccaagatgcagtacctggatttcaatatgtggctgcgccaggagattcttctgaaagcagacaagatgtccatggcgaattccctggaacttcgtgttccgttcatggatatcgaggtgtttcagacagcccgcacgattccggccaagtgtaaggtaaacgatgccaacaccaagcttgcgtttcgagctttggcagaccggaagttcagcaagaagagcgctgagcgtaagaagctcatgtttccaagtccgcttccgaactggatgagggaagatcagtactatcagatgatcaagaaagagtttgaaggcgagaccgccgccaagtttttcaaccagaagaagattctcgcccttttggaagagcacaaagaaggaaaggtgactcattcgattcagatctgggttgtctatacattcctgatgtggtaccgtgcgtacttcattaacaatggagagtttgagaaaatcgaggccgactgtgcccgctaagaatcataaataaaaagaaccgcttcgtcttcagcaaagaaactgcaggatgaagcggttacgtttttgtatggatcgtcttatgatagccttggaatcgtcactccgaatccggtgtttggatggatgagagaaaggatcacatctgtcagaaagaagcaggccagactgacacagagcacagtcttaaatcctcccggaagtttctggtaccagcggtttaatttcggagcagccagataaaggatcagaagcccacccgtgccaaagaggaggagacccttcagacagacaaacccttttagatgaatcagggaatcccggtagtcccaccagcgcatctgatagacttcccaaaggattgttccggtcacaaattctatcgttccggcaatcagcattgtcatcagaaaaacatgatgcggctttttggcaaaacgacggagcaaaaagagaattaacacgccgccgaacccgtagatgggaagccacgggccgtagaggacgccgcggtttacaagagcatgatctaaatatacatgcagaaggacttcccacagccaccctgcaaaagaaaatgtaaagaaaaacaggatgtaggaagagaatgaataatggttcatactctgttcaatcaactccgtcttttctgccgtataaaaatgtttcgccagtatatatttatgtaacataactttttcgcccctctttcctttcctgtttctgattctattgtaaagcataaaacggaaaaacagtgaaagccgctcttaggatattttgaagatttttcatggaaagttaagaaattatgaagaaataccagaccgttgaatattttgtgaaatcccttttggggatgatagaaatatgttatattaagaaaagcaaagaaaggaaccggaggatgaaggtatgaaatttttgagtatttttgatgttatcggtccgaatatgatcgggccgtccagttcacatacggcgggagcatgttccatggcgcttctggcatgtaagatgtgtccggagccggtaaggaaggttgtctttacactgtacggatcgttttccaagacttaccatggacatgggaccgaccgggcgcttctgggggggatcctcggctttcatacggatgacgccaggatccgagatgcctttgaatgggccgaaaagatgggagtagagtatgaatttgtcatcgatgaagaaacgaagacagatcatccgaatacggcggatatggacattacgggagtgaacgggtatcgtctgtctgtcagaggtgagtccatcgggggcggcaagatcaagattgtccggatcaacggaatcgatgtggagttcacaggtgaatacagcacattgatcgtcagacagattgacaagccgggtgtggtggcgcatattacccagtgtctgagcaaagaggaagtcaatattgcgtttatgcggctattccgtgaggataagggcgccactgcctttacagtggtggagtcggacgagcagataccggaagaaattctggcggaaattcagaagaatgaacatgtacaggatctgatgcttgtacagatgtaggaggggtaaatatggattttatttcaggacagacacttctggaagtgtgtgaaaaagaaaagcttccgatatcggaagtgatgaaacaaagagagatcacctgcggcaagatgccggaaaaagagatcagggagaagctttatgaagtgctgcgtattatgaaagaggcagtggaggagccgatccggcaaccgaaaaagtccatgggagggctgataggaggagaggcaaagctggtggcagaacatgagggaacggcctcctctgtctgtgggactccactctcgagagcgatttcctacagcatggcagtactggaagtcaacgcgtccatgggactgattgtggcggcaccgacagcgggatcagcaggagtccttccgggggtcttgctttccataagggacacgaagcaggtggatgatgagatgctcttgaaaggcgtgctgaatgcttcggcagtcggatatattctgatgagaaatgcttccgtctccggcgcggaggcaggctgtcaggcagaggtaggagcggcgtccgcgatggcggcgagtgcggtcgtggaaatgatgggaggcactccacagatgtgtttggacgcggcgtctatcgccatggcaaatcttcttggcatggtgtgcgatccgattgccggactggtagaagcaccatgtcagagcaggaacgctatcggtgtggcgaatgcactgacctgtgcggagcttgcgctaagtggtgtgaagagcgtgattccatttgacgagatggcagagtcgatgtaccatgtaggaaagagccttccgtttgaattgagggagacagccatgggcggatgcgccggaacaccgaccggatgcagtctaggctgtgagatctgcggcagataaagaaaagcgcaggagggagtttgcatgggataaggacgggggagcatcctcccccgttttgaaatttggaaagaaggggtaacgatgaacagacaaacaaaaccattaaaaccgtaccatggtgtgattgtactgcttctgaccgcggtctgcgtctttgcgatcgggccggctcttagcagcaggatggggctttacgggacattcttcagtgagcttttgatgctcggcatcgcggtaggatgtaccgtattatttcgcggaaatctgaactatgtattcccggtccataagccgacatttcccggactgtttggcacgttcttgttctggatgggaacgatggggattgccatgattctgacgatggtgatgacatactttttcccgcagcaggttctggggacgagcgaggggctgtcctacgcgtttttcagtgttccggctctcgtctcgattctgatcgtatcggtaacgccggccatctgtgaggaggcggtcttccggggcgtggtatttaacagcttctggccaatcggaaacaagtggattgtcattgtgctgacgggatgtatcttcggggcatttcacgggagtatttggcgttttctgccgacagcgattcttgggatcgcgatggcatatctgttggcggagaccggaaatatggtttacaatatgcttttccatgcggtcaacaatctgttgccgctcgtactgctctttggcttacagtgggtaactgagtgggtgtacagtacagatgaggcagcgacctatacacagacgtctgcgggcggtcaggtgtattctctggcggcgcttggaatttatgttgccgggaccggagttgcccttctactgttgtatgcgggaaattatctgattcatatgggaagaaaaggatacgaaggaaaactctttggaggccgccggaagaagcatctttatattctgatcggagtatcagcgggcggcttcgttcttggatgcctgcttgtcattgcggccgccgcggccggaacgatcggccgtatgatgcactagtcacggttcgtggagcaaggatggaagaagaggagtcgaagattatgggattgaaacaggattttgtactgagaagactggaggatcaggggcggtttctggcaaggctgattcttggaaaggatgaggcacactatgagcttccggaatacgaggccatggacaaccgggcggacgcactttacaggaaactgctggctcttgtggataacggagagatcaacgaggcggaaaacatccttctggatgaactggataccggagatttgaacatgtttgagatggcgctttgcttttatctgtatcttgcacatctggatgaagattttctggaggagcaccgatacacgagggaggaaatcggagaaggcatggaagctctggcggaagactttggggtgagcggatttgagatcagtatgggaaaataaaggaggaattgtccgggtgatcagtttcactaaggcaggacacgccgaaaatgagagactgaaatccctcattgcaggtgagggccttccctgggccggataccgtgcggggacggcgccgggaggagaagccctcctgaaagttgaaaaaatccgggactgggttcgggatggatggggaaaagacgcctatctctttatcggagccgcaggcattgcggtacgtagcatcgccccatttgtaaaggataagcttaccgactcgccggttcttgtgatggatgaggacggatgttttttgatcccgctgctttccggccatctgggagggggcatggagcttggcggcaggattgccaaatgcagcggcgcaaggcttgttgtgacgacggcgacagaccggaaaggaaagtttgcggtagatctctttgccagggcaaacaggatcaagcttaccggcagagtacttgcaaaagagatttccgcccggatcttacagggagagactgtaggcttttattcggatcttccggtggacggggaagcgccggaggaactggacatcaagacaagctatcagcagcttttagagggaaccggacagaagagtcctggtattgcggttctgacaagggagccggaagaaaagagaaaccatatcttatatctgtatccaaggatctacagtgttgggatcggatgcagaagaggagtcggaaaggaaaaaatcgaggaggttatctgtcaggtttttagaatttacggatggcggatttcacagatctttgcacttgcaagtattgacagaaaggcagatgaggaaggaatccttgcctttgtaaagaaacatggacttccgtttctgacttacacggccgaagaactgaatatggtagaaggagaggtatctgcttctgattttgtaaagaaaacaacaggcacggataacgtctgcgagagggcggcccttcttgcagggggtggcggcagcctgatccatagaaaagaaacttttgaggatatgacactggcggtcgtgcagatggaagcgcggcttacatgggatgtaagaccggggaaaaaaggtggcggccgggacggcagcggaaagggagaagactgatgaaacatattttaatctttgcgggaacgaccgagggcagagaattgatggaaaagatcaagcatttccaggtggaggtgtttgtcagtgtggcgacagagtatggaaaagagtgcctgttaaaggagccggaaaaagagcggaccgtgagtacaaagcacggggaagtacaggcagggaaccttaatattattgcgggccggatgaaagaggttgagatgaagcgctatatggagaagcaggcgattgatctcgtagtggacgcgacccatccgtttgcccgggaagtgacaaaaaatatccggacagcctgccgggaagcaggaatctcttatctgaggcttttacgaaatccatcggagaaagatgagggaatctgctatgtttcttccgtggaggagggagtacggttccttgataagacggagggcaaaatcctgattacaacgggaagcaaggagctttcaacgtacacaaagatccgggactatcaagaccgttgttacgcgagagtcctgtcgaccaaggaagctgtggaggagagcgtgaagcttggatttgagggagatcatctcattgccatgcagggtccctattccgaggagatgaatacagcactgcttcatcatgtacaggcggactttttgattacgaaagaatcgggaaatgccggagggtttgaggagaaagtaagagcggcggtgaagacaggcacgacccttgtggtggtagagcggccggaggaagagggcgaaagctttgaggaagtcattgagagggttcgtcaatggtcgttacagtaaccgggggcagcggaagtggaaaatccaggatggcggaggagatttcccaggcgctttgcggcggacgaaagctctatatagctacgatgattgtctgtgatgaggagagcagaaaacggatggaacgccaccaaaggcagcgggccggaatgtattttgagacggtagaacgaccattcgggcttgaaagactgacatttaaggagaaggagcggctgattcttctggaatgtatgtcaaatctgattgccaacgagctgtatggtggtgagaattttgccatgcgggatccgaaagagacgaaagagacgatcatccggggcatcggacacttgagagagcatgcggagcacctggttgttgtaagcaatgaaatgttccgaaacggaacatatagtgtagagatgaatgattatttgaaagtggctggtcaggtagaccggtatcttgccggctgttcggatattgtgattgagtctgtgttcggaattccatatttctggaaacgggagaagagactgtggttagtgaaaggaaagtggttatgggacaaagaggaatgattcacgtatactgcggggatgggaaaggaaagacaagcgcggcgttaggattgatgatccgggcagcagggcgggggaagaagatcctgtttgtccgctttttgaaaaacgatgactccggagaacttgccgttttggaacagatttcctccatatgtcagcttcggatgccgaaagtgcccggattttactggacgatgacaaaggatcagaaagaagagctgaaaagagcatacacaagggtctgggagagcatcgaggaacaggcaggggagtttgacgtgctcgtaatggatgaattcacctccacattccgctatgggctgattccaaatgagcgggtgctttcgtttcttggaaaggaaggagagcggccggaaatcattttgaccggacgggatccggacgggcgtgtccttgagatggcggactacatttccgagatcaaggcggtacgccatccatttgaacaagggattccggcaagggaagggattgagtattagaggagggcaaaggaaatgagactgatgcatatttcggatctccacttggggaaacgggtcaatgagtattccatgctggatgatcaggcctacatcctggatgagatcctcagaatcgcgaaggaagaagaagtgcagggagttttgattgcgggcgatgtgtatgacagaccggttcccccatccggtgcggtgaggattctggacgacctgctggatcagtttgcggaccggaatgttccggtctttttcataagcggaaaccatgattccagggaacgccttgcttttggggcggcgctctttgaaaaaagcggcgtgtatatggcgggtgaagagctctgcaaaaagatccgctggaaggatgaatatggggagttaaatatctggctgatgccgtttttaaagcctgccgaggtccgcatggtatactcggaaaaagagatcagtacctatacggatgcggtacaggcagtgctggaaggaatggagattgatccggacgtccgcaacattctggttgcccatcagtttgtggcgggggcggtccagtgcgagtcggaggagatttccatcgggggactcgaccaggtggatgtctccgttctggagagatttgattatgtggcgctggggcatctccacaggccgcagtctgtagggagagagacgatccgctactgcggaacgccgctgaagtattccttctctgaggtccatgaccggaaatccgtgactatcgtagagatgcgggaaaaaggcgacgtggagatccacacggtggagcttcggccattgcgggatctgaaggaattaaaggggacctacttacagcttacgagccgtccattctatgagacacaggatgtaaactcctatttccatatcattctcacagatgaggaggacgtaatggacgctctgggaaagttgagaatgatttatccgaacttgatgaagttaagttatgacaatgcgagaatccgtaccgagtcacggtacgatgagatcgaggcggtggaaaggaaacggccggaagaagtggtggaagatttctacctgctcgtaaacggaactgagctttcccaagagcagaagaagctgacaaaagagatcatggaagaagtatgggagggtgaatgatgagaccggaaaagctgattttgtccgcgtttgggccgtatgccacccgccaggagatcccgttttccaggctgggaaagcagggactctatgtgatatccggggacaccggcgcggggaagacgacgatttttgacgcgattacatttgcgctttacggggagccaagcggctgccaccggaaggcggacatgatgcagagtaagtacgcgaaggacggggaggaaacctatgtggaacttaccttctccgtggggaatctaagttacagggtccgccggaatccggaatatcaaagacctaagcgccggggtgaagggtggatcacccagaaagcggacgctgagctcattttgccggatggtaaggtggtcacaggatcacggaatgtgacggaaacatgcgaagagatcctgggactaaaaagggagcagttcactcagattgccatgctggcgcagggagaatttcagaagatgctcttttcccagacggaggagaaaagccggattttccggatgctgtttcatacggccccataccaggtatttcaggaaaagatgaaggagaaagccgcaggatttcgaaaatcgtatgagacgctggaacagagtatacaacaatatgcagacggcgtgaccgttccgaagggagaagaggaactttgggcagcatgggaagaaagccggaaacgcccggataagggagagtggctggaaatgctttccaatctcatcggaacactggaagaagaaacgaagaggctggacgcgcagatccaaaaggcagaagaggatgtacagcagtatagtgaccgggtgcgggagacggagcaggagcttggcgctaagcaggaggaaaaaaagcagcaggagactcttgaaagattaaagcgggagcagggcaagtgtgtggaaagacgggaaagagcaaaggaacagtgtgcgggtaatgaaaagcttcaggagcggatcgccagagaatctatgcagcttgccggctatcaggaagcggagaacaggcgggcaaagtggagccaggataagcagaaagaggaaaagcttctttcctatctggaagaggccagaaaggcacaggagcaggaacgaaaggaactggaacagtgccgggaggagattcttgcgattccggatcaggaagaggcaagagcatcgctgttaaggcagcggcaggagacagaaaaccggcatgaaaatctgcgtgcgtttttacaaagcttaagacagtatcaggaagcagaaaagcagcagaaagatgctcaggcagagtataggaagatccgtgagaaaagtcttgccatgcaggaggagtacacggccttgcaacgggcttttctggacgggcaggcaggtatcctggcggagacgctaaaggaaggaaagccatgtccggtatgtggttccctgcaccacccggagaaagcaaaaaagccggatgagatcccggatgaacaggcgttgaaagagaaagagaaagcgcttgccatggtgcaggaagaagagaaggtaaagagccggagggcgggcgagatccagggaagagcccaggcggcggccgcaagtctgaaagaaaaggcagcgattctctggccgggggaggagccggaatccttgggggaagcctaccatcggatgaaagaggaagggtgtctcttagaagaaaagcagaaggaactgttgcgccgtgagaacgagctccaagtgaaaaaggagcagaagcagagactggagaagcgaagaaaagagctggaagaccaggctcaggagcgtgcacagaggattcttggactggagcgtcaggcggctacccttggagcagggcttgaggcggaagaaaagcgtctccgggagatccaggcgacccttacttatggctccttccgggaagcaaaagaagtcatcgtcaggatggagaaagaaaagcaggagaaagagacggcgcttgaggaggcaaaggcagcgtgccagagtgtggaaaatgccatttccgcctgcgaagcgtctattcggatctggacggggcagcagaagaaaagggaggcgtcagaggaaagcctgcggttggaaaaagaggagcttacgaggaacagacaggcatccatgcagcagaagcagaatctgatgatgaaaaaggagcggctgatcccagccttgagtgcggatcagacggcatataggaacatgagggaggcgatccggcagcaggaagaagccgagcggcaataccggattgcgggctctctttccgatacggtcaatgggacactcggtggaaaggaaaaggtcatgctggagacgtatgtgcagatggcgtactttgaccggattcttgtccgggcgaatcgaagacttctcgttatgaccgacgggcagtatgagcttgtccgcaggcagacggcagacaatcgccgcagtcagagcgggcttgagatggacgtcattgatcactataacgggacaaaacgaagcatccataccctgtcgggaggggagtctttccaggcatctttatctctggcgctcggactttccgatgagattcaggccatgtccggaggcatccgtatggaagcgatgtttgtggacgaggggttcggaactctggatgacgaggcgcttgagaaggcggtccgggctcttgcgtctatcagcgagggcaacaaactggtaggtatcatctctcatgtggcggagttgaaagaccgcattgataagaaaatcctcgtggagaaagaaaaggcaggggagagcagggcctatgtcgtcataggatgatactgcctctttcccgtcctggaaacggagacactgctgtcggccgtccccttgaccgggcggttgacagcatgtttgggcgatggtattatggactggaatcaaacaatcatttaaaagtaccttggaaaaggagtaaaagggaatccggtgagaatccggaacaatacccgttgctgtatgaggggagcgttctctggtaagcccactgtgcggatgcatgggaagggggagaaaggcaaagatccttaagtcagaatacctgcttttaaatgtgtcggaaaggttacgggattatgacaagtacgagacaacatggagccatcaaagggaaaaataaaagacggatatggaagagtgggcagaaagaaagctgcctgttttttcatatccgtttttcatgtcattcgtcagagtcagacccgctcgggaggacaatatgaaaaaagcgattttgacggtgagctttgggacaagccacctggatacactggaaaaaacaatcggagccatcgaaagggagcttgcggaagcatttccggaccggacgctctaccgggcgtttacaagcggcatggtcatcgaaaaattaaagctggaccataagcttgtgattttccgggtggaggaggccatggagcagatgtaccgggacggcgtccgggaggtgctggttcagccgacccacatcattcacgggctggaatacgaaaagatgagaagtcagcttgcgccatatcaagaacggttctcgcaggtgcggatcggggctccgcttttggaagcgacaaaggactatgaggaagcggcgggactgattatagaagacgtcagaccgggcgacggggaatcccttgtacttatggggcatgggacggagcatcataccaatgcggcttacccggcgcttgactacacattctgggcaaagggctataaaaatgtgatcgtcggtacagtggaaggatttccggagatggatgaggtgctcaaaaagttgaaagagcagcagacaaagcgtgtacttctcatgccatttatggtcgtagcaggagatcatgccagaaacgatatggcaggagaggacgaggactcttggaaatccattctgactgcccgtggatacgaggtacgtccggtaatcaaggggctcggagaaattcccgggatccggcagatgtttgtccgtcatgcaagagaagcaaaggaaggatccggtgagtcggtcagatgaaatgcgaagatacagttatcaagggacaaaaaaagctgagaaaaggatacaccacaggaacatgtgcggcggcagcggcaaaggcagcggcctggatggtgctttccggcgaggagatccgggaggtgaagctgacggtaccggcgaaagtaacgctgtttcttgaagtggaagagatcaggcgggaaaaggacgtggttttttgtgcggttcgtaaagacgccggagatgacccggatgttacccatgggattctcgtctgcgctgaagtgcgaaaagagactaagagccatgcaaagctgcgggaagtgcaggttcgcctgaaaggaggagagggcgtcggccgggtgacaaagccggggctggaacagcctgtaggcgaatacgcgatcaaccggacgccgcggatgatgattgcagaagcggtgaaggagatggcagaggaacagggattctttgggacgcttacggtgacaatctccatacctgagggcagagaaactgccaaaaagacaatgaatccaagacttgggatcgtggacgggctctcgattcttggcactacggggctggtggagccgatgagcgaacaggcgctgacacgaacgattgagctggagatgaacatgcgaaaagaggatggggcaacggtgctctgtctcgtgcctgggaactacgggagtgagttcctggaagaaaaacttggcatccgcccggagtatgcggtcaaatgtagcaattatgtgggtgatgcccttgatatggcggttgtactgggctttcagaaggtgcttttagtagggcatatcggaaaattcgtcaagcttgcggctgggatctggaatacccactcacggattgcggatgggagagtggaaatttttctctccgtgctggcggagcttgcctgggagagagggaagagggatccggagggagcgttagacctgctttccctcgtgccggagcttcgggagagtgtcacgacggatgaaatgcttgttatattggagagaatcggaatgagagagtccattttggagcggatgatggagcggattacctggaatctgggacagaggacaagaggacatattgagaccgggcttgtgatgttctcaagggagcggggccttctggggcagaccggacctgtggaagaactgattggggagatacagacaaaggaaaaaggaggatggcgatgagcggaatcttatatgggacaggcgttggaccgggggaatccggacttttgacattaaaggcagtgcgaatcatacaggcaagtgacttgattgtggtaccggtatcggcggaagactttcgtaggccgtgtcttttggaggaagagtctatccatctgaaacggtgcaaggcgtatcagattgtgcgggaagaagtgccgaagatccgggaaaaaccggtgcttggacttccgatgccgatgagaaaagaaaaagaagcgttaaagaagatccatgatgaaggagcgaagcaggtggaagcctatcttaatcaagggaagcagatcgcctttctgacgattggcgatccaagcgtttactccacctatctgtatattcacaggcgggtgctgcgggacggatatgaggcgaggatcattccgggggtaccgtctttctgtgcggcggcagcggctttgaaccggggacttgctgagaaccgggaggagattcacattttgccggcctcgtacggaatcgaagagggactgacgcttccagggacaaagatcctgatgaaggcaggaaaaaagatgccggtgatcaaggatatgctccgggaaagtggggagtggtttgcgatggtggaaaactgcggaatggagggggaacggatctatgagaatccagacgatgttccggaccattccagttattattctttgattgtgataaaggagggatcctgatggtacattttgtaggggcagggccgggagcaagcgacctgattacggttcggggagatcggcttctaagagaagcggacgtggtgatttatgccgggtcccttgtaaatccggagcttttgaagggatgcagaacggattgcgcggtttatgacagtgcctatatgacgctggaggaggtgctggaggtgatccgggatgcagaacgccggggagagatgacagtccggcttcataccggagacccgagtatctatggagcaattcgggagcagatggatgcgctggatcggatgggaatcgcttatgacgtctgtccgggtgtcagttctttttgcggtgctgccgccgcattgaatctggagtacactttgccggaagtatcccagtcagtcattataacccgtatggagggcagaacaaaggttccggaaaaagaatcgatccgaagctttgccgcccaccaggcgacgatggtactgtttttaagcaccgggcttttggaggaactttccggggaactgattgtgggtggttacaaagaggacaccccggcggccattgtctataaggcaagctggccggaagaggcggtttaccgatgcactgtgggcacactggcggcaacggccagggagaagggagtcgcccggacggcgctgatcgtcgtcggacgggtgctggacacaggaaaagacagcgggtatgagcggtcgaggctttatgcgccggaatttggtacgatgtttcggaatggatccgggaaagaggggaaataagatggaacagaaagtctatgtcattgggatcgggccgggagcctatgaggagatgacgattcgtgccgtgaaggcattaaaggagtgcgatgtgattataggctacacggtttatgtggatcttgtgaaagagcattttcccggaaagcgttttcttaccacgcctatgacttgggaggtaaagcgctgtgaaatggcccttcgggaggccgaggccggacaagtgacggctatgatctgcagcggtgacgcaggggtgtacgggatggcaggactcatgtacgaaatgcgtgagcatatggagcttggcggggtgaagatcacggtgattccggggattactgcggctactgcgggagccgcgcggctgggcgcgccgctgattcacgattttgcggtgatttcgttaagcgacctgttgacgccatgggagcagattgaagagcgtctccgggatgcggcaaaaggagactttgccgtctgtatttacaatccatccagcagaaagcgtgcggattatctacgccgtgcatgtgatattatgctggaatatcgaagcccggatacggtatgcggctatgtgcgtcagatcgcaagggaaggagaagaacagcatctgatgacccttgcacagttaaaggacacaacaacggatatgtttacaacagtgtttatcggcacgtcccggaccagacggatcggggaggcgatggtgacaccgaggggatatcactatggaacgaacgattaatctgatcggaatcggaacagatggggatcgcagtcttactcaggaggcaaagcagttgatcggggagagtactgttctcatcggggccaagcggatgctgaaaagtacgaagaagtatcagaaagagaatgtactctgctatgagaaataccggccggaggaggtcttacatattttggagacagtaccggacgggaaggtttctcttctattctccggagatccgggatgttacagtggagcagaaaagatgacagaagagctttgtcgggcaggctggagggtgaggatctgtcctggcattgcttctgtgattgctatggcggcacgttgtcaggttccatgggacagagccgctttcgtaagccttcacgggacagaccagaatgtgattcatgcgatctccacacatgagcacacgtttattctgctgggaggaatgatgacagcggaaatttttttggaaaagatggcatggtatggactcgatgatctaaaagcggcggcaggacggaatctttcctatgaggacgaggtattttacagcggagcggttcgggatatgacaccggagatgctttcaggactgacagttttatgggtacatcatccagaatatgacgccagggtggggcgtcatctggaggacagggaattgattcgtggaagcgtgccgatgacgaagtcttccgtccgggccatggtcattgcggcacttcggcttcaggaagattctgtcgtctatgacattggggccggaaccggcagtgtggcagtagagactgccatgcaaggcggaggaatacgggtttatgcgatcgagcgtaatccggagggcgtccggctcgttcaggaaaataagagacggtggagaacggacaatgtgaccgtagtggagggtgacgcaccggaggcgcttcacgatcttccggctccgacccacgtgtttatcggtggaagcggcggcagactgcgggagatgatagacgtctgcctttcgaaatctccgaatgcgcggattgtcgtgacagcggtcagcctggagacggttcaggagatggcaggacttcttcaagaggagcggtggaaggagacggatgtgatacagatacagacggcgtgcagcagaaagttgggagattatcatatgatgatggggcaaaatccggtctggatggccgtgctgcaagggggaggagaggacagcgatgaataatacaacgggtcggattctgattgccgggaccgcaagcggctgcggcaagacgagcgtagtctgcgcgctcctgcgggcctttcagaaaagagggctttcccttgccgcctgcaaatgcgggccggattacattgaccctctcttccatgagaggattctgggaattccgtcagaaaatctggatctttttttccatacacccaaggtacagcggcggctgtttcagaagcatggagaagggaaagatctggtagtggcagagggcgtcatgggatactatgacgggctgcgttgctcggatccggaagggagtaccagcgagattgcggcggctcttaatcttcccgtcgtccttgtccttccttgccggggaatgggacattcggtactgccccttttgaaggggtatctggattacgagagaaccaggcaggtccgggcggtggtcttcaatgggatgaccgggcggacatataggcagcttgccccggtggcagaagcatggcttgcaaaagaaggatatgacgtccggctggcagggtattttccgattcttccaaaagccgctcttccggggcggcatctgggacttttgcttccgggggaagtagaatctttggaaaagaagctggatcttctggcagatcaggcagagcagacactggatctggatttgctgtataggatagcaaaagaggggacagatgcaggagacagagaagaccttcttatggaaacagggaagtctgccggaaccgtccgcccgccagtacggatcgcggcggcaaaggacgaggccttttgcttctattataaagacaatctggaacttctgcgggaacttgggtgtgagatcctgtatttttctccgattcacgacatggctcttccggacgggacggaagggatcttgctgtcaggaggatatccggagctctacgcagaagagttggcaaaaaacaaagggatccgtcaggatattttcaagagtctggcggctgggatgccatgtcttgccgagtgcggcgggtttctctatctgaaagaggaactggaagcagaggacggaaacttctaccctatgactggatttctggaggggagaggctaccggacagagagcctgggaagattcggctatgtgacgttggaagcaaaatcggatcttgtgtatctgagacaaggggagacgatccggggacatgaatttcattactgggactgtacagagaatggaagccgttgccgtgcggtgaagcccgacggaaagcgaaactgggactgtgtggagcaaaaggaagcggtgtttgccgggtttcctcatatcagttatgattcctgcccggactttgcaaagcggtttgtgaaagtttgtctggaaaggagaaaaacgtgatatgcaaaaagaaaactggaatgatgcaatcaaggacatcactttgccggatgaggaggtaagacaggcagcgcttgccaggtggaaccagcttgccaagcctttgcatgggatggggaaactcgaagagaccattgcaagaatcgccgcgatccaggggaccatccacccgttgattgacaaaaaaggaattgtggttctctgtgctgacaatgggattgtgaaagaaggagtttcccagacaggagacgaggtgacggccgtcgtagcggggaatttcctttccgggcagacgagcgtctgtaagatggcaaaagcggcaggggcggacgttctgccctatgatatcggaatcaggacggatgtgaaggggctgacccgtactccgtataagatctcctgcggcacgaacaattttctgcgggagccggccatgacaagaaaggagacgatccaggccatccatatcgggatgcagatcgtaaaggaacgaaaacaagagggatatgaaatcctggctaccggagagatggggattgggaatacgactaccagcagtgccgtagcctgttcgcttaccggggaaccggtagaagtaatgaccgggaggggagcaggactatcggacaagggactcacccggaaaaaagccgtgatccgagaaggacttgataagtggcggccggatccgtccgatgtggtggacgtcctttccaaggtaggaggacttgacctggcgggtcttgccggcgtgttcttaggatgcgccaaatatcagatcccggcagtactggacggctttattacttcggtggcggctcttgcggcggcgaggattcatccggcagtacggaactatctatttgcttctcactgctccaaggaacccgctcacgcaaggattcttaaggagcttggcatggaagcgccgctgtgtcttgagatggcccttggggaaggaacgggcgcctgcgcgctctttccgcttcttgatatggcgatggccgtctatgaggagatgagctcttttgacgatattcagattgcacagtatgaggagtttacgacatgagatggattcattctttagggatcgcgttttccatgtattctaaaatcccggtcccgaaagtgcgctggacaaatgaggcgatgcagtacacattctgcttcttcccactggtgggagtggcagagggcgcgcttttgtgggggatgggcatggttctgtatggtttgcgggacaggaacagacttccggctatattcgtggctatcgtccttacgattctgcctcttcttgtgacaggggggatccatatggatggcttcctggatacgacggatgccagacgttcctaccaagagccggagaaaaagcttgccatcttgaaagacccgcacaccggggcgtttgccttgatcggtcttggcgtctaccttttgtggagcgtagctgtctggtctgtggcagatcgggccgtgcttccggggatggcctgcgcctttgtcctttccaggacactaagcggtctttcggtgacgctttgcaaaggagcaaaaaaggacggactgtcggcggcttttcacaaatccgccagggaacggccagtatgcgtttccaccgtatgctattttgtcgggtgtgcgggtgtcttatgtttgacatcgggtgtgctgatacttgcgttgcttaccctgactttggcggtcgtttttggttggtatctgtggatggctgacagagaattcggaggaattacaggggatctggcaggctattttctccaggtctttgagctggcggctcttacggtgctgacagcggcatactggttcccggcatgttagatgggaaccggaaacaaataggatacatgaaacgaaagggaaaaaacagatggagatactgatgttccggcattttgcgacagccgggaacctggaaaaacgctatattggaacaacagacgagccgatccttccggtgagcagtgtttccggtgtgccggaagttgagattgttctgacaagtccgctcttacggtgccgggaaacggcaggacttctttacccgagattggatccggttcttatcgagggattccgggagtgtgatttcggagcctttgagggaaagaattacagggaactgatcggggatcaggactaccaggcgtggatcgattccggcggcatcctcccgtttcccggcggggaatccatggcttcttttaccgcacggacaaaggaggcctttcaaagagcggtggaagatctgatggcaggagaaatccggcgggcggcaatgattgctcatggagggacgctgatggcgattctctcctcatgcggcatcccgaaacaagaatattacgagtggaattgtggaaacggatgtggatatcgggtccgtatcgaggaagacttgtggaaaacagggaagaaagagtgtaaggtggaagaacagctatgtgtattttaacggcctgtacggcaggatttcttttggatcagcttttgggagatccggcgtggatctatcatccgatccggatgattggctatctgatctcctggctcgagaaaaaactgtatcgggagggcggttctgccaggacgcttagaagaagaggaacgatgctctgggttctaacggtggggatttccaccactgttccgtgcctgcttttgtttgtggcgtcccgcatccatccggtttccgcctggatgcttgagacattctggtgctggcagcttctggcagcccgttccttaaaagcagagagcttgaaagtacaagaagcccttacttacggtactctggacgacggcaggagagccgtctccatgatcgtcggtagagataccggacatctgacggaagagggagtggtgaaagctgccatagagacggtggcggaaaatacgtcggacggcgtgattgcgcctctcttttatctgatgatcgggggagcgggcctgggatttttctacaaggcggtcaacacgatggactctatgatcggataccgcaatgaccggtatctggactttgggcggacggcggccagaatggacgacctgtgcaacctgataccagcacggatttccgcgattctgatgatgggggcgaccggaattctgggaatgagcgaccgggcgcattatagtttgcaaaatgcctggaggatttaccggcgggaccgacacaatcacaagagtccgaatgcggctcagaccgaggctgtctgtgcgggagcgctgatggtacggcttgccggaaatgcatggtattttgggaagctgtatgagaaaccgtccattggggacgccatacgaagtgtagaacgggaggatattcaaagggcgtgccaccttttgatgggaacgtcatggcttggcctgctcttctttgggctggcgaggttgttgttcctatggtaaggcaaaaagaaagcgaggtgaacgacatgcaggatcatggcggcgatatctatacaaacgacggattgtttgatttttctgcaaatatcaatcctctggggccgggagaaaaggttatgaaggcattgcaggaaagcattttgaaagtgacggcctatccggatcctctttgcagaaaactgcgggagtcggcggcaaaacgggagtcagttcctcctgactatattgtctgtggaaacggggcggcggatctgatttatacgctggtacttgcggaaaaaccaaagcaggcgcttctgtgtactccctctttttcggaatatgagaaagcgctgcgtacagtcggctgtaagattcgtttccataaaaagcgggaggaggatcatttcacactgacgtcccggtatctggaggaactgaccggggatctggatctggtgtttttgtgttccccggacaatccgacgggacagtgcatcgatgagatattgcttcgggagattatagaacgatgcgagaagaatgggatccggcttgtactggatgagtgctttttcgattttacagaggatgccccttggattcaccatgagttttttgtgaaagatcaccggatgctctttttactgcgggcctttacaaagatgttttccattccgggagtccgcagcggatatggcgtctgttcggataccgcattgttagatcggatgaaagaagcaaggcagccgtggccggtgtccatcccggcacaggaggcgggagtggcggcgcttaaagacgacctgcttccggcggccacaaggcttttgattgcggaagagcgaagacacctcatggaagaattcggccgactggggattcgttactatccggctgatgccaattacattttattttacagtgagatcgattggtacgaggagatgaagcaggaaggatttctcataagggactgctgtaattaccgaggacttggaaaaggatattaccgcatcgcggtcaaaggaagagaagacaacgagaggctgcttgcagcatttcgcaggattctgaaacgatataaaggagaaggaacatggcaaagccgattatgatacagggaaccatgtcgaatgccggaaagagtgtgctggcggcaggtctttgcaggattttcaaggaagacgggtaccgggtggcgccgtttaaatctcagaacatggcgctgaattcttttattacagaggatggtctggaaatgggacgcgcccaggtcatgcaggcagaggcggcggggattgctccgtgtgtggagatgaatccgattctgttaaagcctgccagcgatatggggtcccaggtgattgtgaatggaaaagtccggggcatgatgcctgccagggagtattaccggtataagaaagcattgattccggatattctgaaagcttatgagacgctctcggaccggcacgatattgtggtgatcgagggagcgggaagtcctgcggaaatcaatctgaaacaggacgatatcgtcaatatgggactggcgcagatggtaaaggcaccggttcttctggtgggggacattgaccggggcggtgtgttcgcacagcttgtcgggaccctggcgcttctggaagaacaggagcgggagatggtcaaaggatttgtcatcaataaattccggggagatgtggagatcttaaagccgggactttcggtattggaggaacggaccggaaaacaggtgcggggtgtgatcccatatgtaacgttggatctggatgacgaggacagtttaagcgagaggcttgagaatacaaaagggaagggaagggttgacattgctgccatccatcttccgaggatttccaatttcaccgatctgaacgtcctttcctgctacgaggacatctcggtgcgttatgtccggagtctttcccagtttggagagccggatctgatcgtactgccggggacaaaaaatacgctggaagacctgaaatggctgaaagaaagcggtctggcggcaaagatccaaagagcggcaggtcgtggagttccggtcatcggtatctgcgggggataccagatgctgggagatatcctcgttgatcctgcgggatcggaggcaggagacggtattccccgaacaatggaagggcttggcttacttccggtacggacgatgtttaccggacggaagcgaaggacaagggctgagggaacgatcacatgcaaagagggattctgggcggaccttgagggctgtacgctggaaggatatgaaatccatatgggagagactactttgacgggcggagaggcatttacgaagatttctaccttgcaggaggaaggctgccgtctggaaggatgtgcgtacggttcggtgtgcggcacttatgttcacggattctttgattcgggtgacgtctctggaatgatcacccgccgtttattggaacggaaaggatatcgtcagggggagtgcaggcctctggatcttagagcttacaaagaggaacagtacacaaagcttgcaaaggtgatccgggagaatctcgatataggagcggtctaccggattctggaagaaggagtataacaagatgagtatggaattggaacaggttctgccgggagagatcgagcgcaggagctttgagatcatcacggaagagctgaagggaagaagatttgacgtaggacaggaggacattatcaagcgggtgatccacacaacggcggattttgaatatgcagatactatgaccttctcaccggatgcggtgaagtgtgcgcttgaggcgcttcgagacggtggaaatacagtcattgtgacggacaccaatatgacaaaggctgggattcaccggacgtccctggaaaaactgggagtggaagtacactgctacatggcagatccagacgtggcgaaaacggcaaaggaacaagggcttacaagggcatatgcaagtatggaaaaggcggctcgtatggcaaaggagactggaaaacaagtgatcttttccgtggggaacgcaccgacggcgctgatagctattgaaacactcatgcaaaagggagaaatttacccggcccttgtgatcggcgtcccggtcgggtttgtcaatgtcgttgaggcaaaagaacggattatggccgcaaaggttccgtatattgtagcaaaagggagaaaaggaggaagtacggttgcggcggcgatcctgaatgcattattatacaagatagataacgagcgataaaagaaggataaatatatgaagacacacataaagatcggcagcagggaaagcgcgcttgcggtaagacaggcggaaattgtaaaagaaattctggagaagaaagctccgggactgacggtggagatcataacaatgaaaacaacaggagatcgaattctccataagagtctggaaaaaatcggaggaaaaggtctcttcgtaaaggaactggaccgggcgcttctggatgggacgatcgatctggcggtccacagcctgaaagatatgcccatggagattccaagagatcttccggtagtagcatatacaaaacgggaggatccaagggacgctctgatcctgaaagcgggaaaaatcagcttaaagcagggaggcgtgatcggctcctccagcagaagaaggtccttgcaggcggcaaagctgtatcctcgctgtgtgtttaaaaatattcggggcaatgtccagacccggctgtttaagttggagcacgaagactatgacgccacgatactggcacttgcaggactgaagagacttggcatggaaggctgcgtttcccggatcttttccgtggatgagatgatcccgtccgcaggccaggggattctggctgtccaggggcgaaagggggagaagattccgggggttgaggcattggatgatgataagagccggatagcggcaaaagcggagcgaggatttgtccgttacctggatggaggatgcacatccccggtggcggcgtatgctgagattgccgggagagaggttcggatccgggggctttattatcacgaggagtcggggcagtttacggcgggcacgatctcgggagaggcacaccagggagaagtgctggcaaaacggctagcgaaaagcttgaaagggagattttagcagatgaaaaaggaaaaaaaggggaaagtatggattgccggggccggaccgggggatgcgggacttctcacggtacggacagctcatctgatgcggcaggcggatgtaatcgtctatgatgccttgatcagtgcggagattttaagcctgattccgccggataccaggaccatctatgtggggaagcggtcggaccatcatcttgttcctcaggaagagattaaccagattctcgttcgggaggccgagctgggtaatcatgtgctgcggctcaaaggcggtgatccctttgtatttggcaggggcggcgaggaggctcagatgcttagaaatgccggtattgactttgagattgtgccgggtgtgacttccggtgtggcagttccggcctatgcgggaattcctgttacccaccgggactatacgtcctcctttcatgtcatcacgggacataccagaaagggaggcttaacccgaatcgattataaagcgctggtaaggctcggaggaaccctgatttttctgatgggtgtgacggcgcttcctgagatctgcacgaaactaagagaggccgggatgccgggggagacgccggcggcggtgatccaggacggaaccctcgcctgtcagaagagcgtacggtcagatctgatccatcttccggagcatgtcctggaggagaaaatcaaagcgccggccatcattgtagtaggtcaggtctgtgccctgggggatgaatgttcctggatgaaaaagcgtccccttggaggcaggcagattctggtgacacgcccggaagaacgaaacaggagttttgccgaaagtcttcgtagtctgggagctcaggtcatcggcctcccggccatccggacaaaggaactgaaaaaggaagaagaccgggagcggattcgtaaggcaatctcccggatcagtaaacgggccgaggcgggaacagcgtggattgtctttacaagtgctgccggcgtggacgtatttttttcttttctgaaaacagaacggatcgatgtgcggagtctctggagggccagatttgccgtgatcggtacaggaaccgggaaagcattggagagaaaagggattctgccggatcttataccggatgtttacgaggcaggggagcttgggaatacgctggcaaaaaaggtgacgagaggggatctggtggcggcatttcgggcaagggaagcatcagaagagctgtttccaccgatacgtgaacagggggcggactgtctggatattcctgtctacgagacgttcgctggagtgacacctgcatgggtggaaagaattctggcacagtttgaagagggaaagatcgacgcggtgacatttacaagcgcgtccacggtgcggggatttgtgaacatgatggatggacggatgaatctgaagcatgtccgggcactctgtattgggcgaaagaccgaagaggaagcccggagttttggaatgtggaccatcacatctcaggaagctaccgtggagagtatgatcgaaacgcttctcgaggcggaaacaatataaaaagttctaacgtgcaacattcagaaacgtatctggatgttgcctttttttatttctaagagcggttcggctcaaaatcaaacgtttattgtgtaaaaaggttacattggaagagaaaattaactagtaaaatagaaaataatttactgtaaaaagatgtgcaattaataaaaaaacagagaaactattatatataatgcacaaaaaaagataggtaaaaatgtaaataatagagaaaataagcgggggggggggtaaaaagatatttactttactaagtaaaaatagtaaaataaaactacctaaaagaagtgaaagggaggaaacaacatgaaaagaaaacttgcagtcgtttgcatcatggctctgtctgctacagcgatcctttccggatgcggcggaagcgacaagtccagtgacggaaagacaaagatccgctttgcgacatgggatgtagcagaagacgtggacaaacagcaggaacttgtggacaagttcaacgaggagcatgatgacatcgaagtgacactggaagcatatgggagtgactttgatacgaaaatcagtgccggaatgggatccggggatactccggatgtgatgtatatgtggaactatccatcttactatgatgggctggagccgctcgatgagtatatctccaaagagggagatgagtacaaatccaacttctatgatacgctctgggattacaacacaatggacggcagtatttatggtattccggtaggtttcacgacacattgtctcttctataacaaagacatctttgatgaagcgggtattgactacccgacggcggactggacatgggacgatctccagaaagcggcaaagacaatctctgagaagacagacgcgaaaggattttcgttccagatgaaaccggatccatacgattttgaaatgtatctgtggagcaatggcagtgcgtactgttcagaggacggaaagatggacgggaacctcaattctgacaactccaaagaagtttttgagatgttccagaagatggaaaaagacgagtacgcgacagccacggaaaaagatggtacagatgaattccgtgccggcaatacaggaatgtatgtgtatggctcctgggcgatcgatacactgaatgaggacggagtgaattatggtgtgacaacaattccggcatttgcagacgcgggacaggattctgtcagcatcttaagctcttccggactttctatgtccaaagacagcaagcacaaagacgccgcatgggaattcattaaatactggaccaacgaagagtgtaataaagcaagaatcggaacggaacttccggtactcaacagtgtggtagaatcagaaggcatcatggatcaggaagaatatgcgccgttttacaccatgctggagcagagtaagggacatacaccggcaagtttccttatggacagttggtccgaggtttccgaaaacctgtccttaacgtttgaacagattttcaatccgagttccttacaagatgcagggaaagctcttgacggagcagtaaaataaggtgatacatcagcagggaggagatacttcctccctgaatttaggagagatttcatatgaaaaaaaagaagttttttaaaacagcgactccttatttctttatcctgccatggattgtcgggttccttgtgtttacgttgggaccattgatcttatccctgattatgagtttttttgattggccgttgacaggagagaaaatgtttgtcggtcttgggaactacatggaaatgttcacgaaagacgatcaggttctgaaatctttggggatcagtttacggtatgccgcaatctttgtgccgctgaatctgatcatggcgctgttcctggcgatgctgattactcagccgcttcgtggcgtcaaagtctatcgtacgattttctatattccggctgttatctccggtgtagcagtgtccattatctggagctggattctcaacagtgattacggagttttaaactatctgttgtctttgatcggaatcgaagggccagactggctggtagatccggcgtgggcgttgtttgccgtgatccttgccagtgcgtttggcgtcggaacgatgatgttgattttctacacggacatgaaaaatatttctactgagatttacgaggccgcgtctctggatggggcgggtcctgcaagaaagtttttcagtatcacgctgcccatgatcacaccgaccttgttgttcaacctgattacatccatcatcagctcgttccagcaggtaacgctcgtgatgctgctgaccggaggcggaccattgcagtctacctatttctacggtctgatgacatacaacaatgcgttcaaacatcacaagatgggatatgccagcgccaatgcgtgggttatgttcattattatcctgcttctgacagccctggtattcaagtcttcctccgcatgggtgttctatgaatccgaagtaaaggcggacaacaaaaagaagaaaaagggaggtaaatcagtatgaagatgtcaaaaaaatcaaaagtgattctttatatccttttgaccatcgtagccgtttacttcctggcgccatttgtctacatgctgcttacgacctttaagacagaaggagaggccatcgcgtatcctccaagtctttttccaaaagagtggcattttgaaaattacgctgaggcatggagctcacagccgttcggaacctattttctgaactcagttcttgtaacggtgctgacgacggcaggaacgattttatccagttcccttgtagcttatggattcgcacggttcagattcaggggcaaaaacattttatttatgatccttcttgcgacaatgatgattccgtgggatgttactatgatcccgcagtacatggaattcaatctcttcggatggatcaacaccctgctgccactgattgttccgacctggttcggatcggcctattatgtattcctgatgagacagttcctcatgggaataccaaaagactatgaagaagcggcgcgcctggacggcgcgaacgcattccagatttactggaagattttcatgccgatcctgaagccatgcttgattatggtgggggtactcaacatgctgaccgtatggaatgactaccttggaccattgattttcctgcaggacagaaccaagtacacactggcgcttggtcttgcatccttcaagggcgtacacacaacagcgattattccgatgctgtgtattacggtggttatgattattccgccgattctcgtttttatttttgcacagagatatatcgtggaaggaacaagtggttccatcaaatagcagtttcataacaaacaagcagtcagatagatacgcttgcaaaggcaggcgttttgtctggctgccttggcatattataacagacaaggagtagaaacagatgacacagagaagaaagaaaagatgggagaatcaggagctgacggcgatcggaagaagagaggcgaggacggctttctacgaagattctttctccaggatcagcctgaatggaaaatggcagtttctgtatctggacgcgccggaactttctccggcaggatttgaagccccgggggcaaaagagggatgggataccatcgatgttccttccgtatggcagcttcggggatacgggcagatgcattatacagatgtattgtatttgttccctgtgaatccaccttatgttccgacagagaatccgacgggtatctataaaaaaagcatctgtcttgatcaggagtggctcaaaaatgatacgattctgaaattccacggcgtggacagtgcctttgatgtatgggtcaacggagaacatgcaggctacgggaaaatcagccgtctgccttcggaatttgatatcacttcctatataaaagaaggagaaaatgacatcactgtgcgggtataccgttggtcagacggtacctatctggaggatcaggatatgtggtggatgtcgggcatttaccgggatgtggagcttataaacgagccaaagcaggctgttttggactgccaggtgggagcatctttggatgacgatatggagacagggcttttttccgtggatctcactttcaagcagagtgaggccagaggaagctggatgctttcttatgagggggaggaagtaaagaccggaacctttgagaccaaagagggaacagtacatgtgcaggaaaagcttccgaacgtccacagatggacggcggagacaccgcatctttacgatcttcttgtgacgcttggggacgatacgatacgggtacggcctggatttcgccggattgagatccgggatcagcagtttctcgtaaacggtcaggcaatccttttaaacggtgccaatcatcacgactatgacccggaagaaggacggactgtcagctacgagaaagtgaaggaagatctgcttctgatgaagcagcataatatcaatgcagtgcgctgttctcactatccggcaaacgagtatttctatgatctgtgtgacgagtacggcctttatgtgatcgatgaggctgatctggaatgtcatggatttgaatggacaggaaattataaatggatttccgatgacccgtcctggaaacatgcctatgtggagcggagtattcgcatggtgaaacgagaccggaaccatccttgcatcatcatgtggtccatgggaaatgagtcaagttttggctgtaatttccgtagtacggcagaagagatccggaagttggatccgacgcggctgattcactacgaaggggatttcgaggcggaagtgacagatgtatactccaccatgtatacgaggatcaagggaatgaaacagatcggcgaatccgagatgaaagggaacaagcctcatgtgctgtgtgagtatggccatgccatgggaaacggaccgggaggactgaaagcctaccagaacctgttccgtaaatataaacgtcttcagggaggttttatctgggagtggtacgatcacggaatccgtgcgaaaaaagacggagagacatattataactacggcggatgttatggggattttcctaccaatggaaacttctgtattgacggcgtgctgatgccggacagaacgccgtccccggcgcttctggaatataagcaggtcattgctccggtagaaatcaccaaggtggcgggaagccggacgaagattgagattaagaatcattatgatttcttatctttagaccaggtggtgctttactggtcgctggaggagaacggaaaagcaatccaggaaggaaacatcgagacgttatccgctcttccgcacgaggcggagcaggtggaaatcccactgactgtctttgcggtgaagaaaaatacggactactatctgcggatccgtgtctgtcagaaatatgagacaaactatgcgccggcgagacacgagattgccatgaagcagtttgatcttgggatccgacaggatgaactggaagtaagaataccgcaggaggagctggaggtcacagaagagaatggaatcctgactgtaaagaatccgcgtatctgtgcgaaattccacacagtattcgggaatctggtttccctggaacgggatggaaagatgtatctaacccaaggaccggtgatgaacctgtaccgggcgacgattgacaacgatatgtacaaaaaggacgattggatgaacaagtattttatccagaaaggcagcgaacagacggaaagcttctcctgggagaaaaagggcggtgcggctgtgataacgatggaaaagtattttggatgtctcaatcagtcctggggatttcattgtacttatgtatacaccgtctattcaggaggtcaggtaaaggtgcagcttaccggaaagacgatccagaacggaaaggaagagccggagttcctgcctcggatcggtgtggtgatgaaagcggcaggatctttacagaagacagcgtggtatggcctgggaccgcaggaaaattacccggacagcaaggaggctgtctccatgggcgtttatgagagcacggtggacggcatgggaacaaactatgtctttccacaggaaaacggacacagggagcaggtgaagtggtttaccatttccgacggagatcaggcgctcctttgccggatgcctgaggggcttgggatgaatcttgccaattatacggacgagagcctggagaaagcacgtcacccgcatgaaatcgaacgaagcggtgacgtcatcattcatcttgactatcaacattctggacttgggagcaatagctgcggagaggaacagctcccggaatataaggtaaaacgtcaggatttttctatgacctttaccttagaaatcacaaaagcctgtcaggccgcggaagaaacaacgagacaatatctggattagaaaaggggaaaacaacgatgatcagagaccgattttcagagaacatcaaaaaagacatgagcacagaggaatggctgatttgtcaggatacatacgacccgcaggagaatctgaaaaatgagagcctgtttgccctgtcaaacgggtatcttgggatccgcggaagcttcgaggaggggacgcgcgttaccctcccgtacctctacgtcaacggtgtatttgacaaatccgagacatttatgagagagcttgccgccctgccgaactggcttggcgtccgtctctatgtggaaaaggagctgatcggtattgaaaactgcgagattctggagttttccagagtcctcgatatgaagcatgccgtactgtacaagcaatatgtgctgaaagataagaagggccgtgttaccaaagtggaggggcggcgttttgtcagccgtcacaatgtacaccggatggcaatcgagctgtttgtgactccggtaaactacgacggcatcattgaggcggaaaacatcatcgacggaaccatcgtcaatttctatgacgtgccacggtttaaagtaaaacatatgtatcttaccgccaacgaaacgctcggagaacacggcgtctatatagaatctgctacgagagaccgtcatctccatgtggggaccggatgcgtgctggaagcttacaaagacggcagacccgtgatgagaaaccgcatgttccatgcctttggggagcaggcagtggaatttggagatgttccagtgacagaaggggagacagtgcgtctggtaaaatacgtctccatgtacacggagagggaatgtccggcatatgcgctccatacgacgatcaaagaggaggtcgaccactttatggaggacggtctggaaacagaacttcgtttccatgagaacgtatatgacgcaatgtgggaagaagcggacgtctgctttgaaggcgatccggagctgaaccgggcggtgcgttttaatatttttcacctgatgagtacaggaaacgagacggacgaccgggtgagcgtaggagcaaagcttctgaccggagaagaatacggcggacatgcgttctgggatattgagctgtttatgctcccgttcttttcttatgtgttcccaaagatggcacagaatatggagaattaccgttattatcttctggatgcggcaagagagaacgcaaagaaaaacggttataagggcgcgcagtatccatgggagtccgcggacgatgggacagagcagtgtccggactggaccattgagccggacggcacctgctaccgctgctatgtggcaatgtacgagcaccatgtgacggcggatgtggcctatggaatctatgactatgtacgcattacaaaggatctggacttcctctacggaagaggagcggaagttctcacggagacagccagattttgggcgagccgctgtgaatatgtgacggaaaaagaccgctatgagatcaatcaggtgacaggtccggatgagtggcatgagccggtgaacaacaacctgtacacaaattattttgcaagatggaacctgcgctatgtgatgtccctgatccggacgatgaaagaagagcgcccggacgactacgaagcgctgatgaaaaagaccggacttaaagaggaagagctggaattctggaacaccgtacagagcaagatctatcttccgagaaaagagggtaccaacctgctggagcagtttgaaggatatttccagttaaaggatgtggtgatcgaccagtatgatgaaaacgactggccgatccgtccggaggcattaaagacctgtaaagccagggagacccagattttgaaacagccggatgttgtgcttttacttcacctgctgggagaagaatttgagccggaattgatgaaagaaaattatgattactatgagaagcgtactctccatggatcgtcattaagtccaagtatttattcggtcatgggactgaaagtaggagacgattctaaggcgtaccgatatctgaaacgtgccgcgctgatcgaccttctgaatttgcagaagaacacaagagagggaatccacgcagccaatgcaggaggcgtatggcagacgatcgtcttcggatttgcgggcgtatcgattggaaaagacggtattttaaacgtgaagccgaacatgccaaaagagtggagcagcctgaaattccgtcttcactatgacaacgcgtggctggaaatccagacagacggtaataatcaggcggaagtacgaagacttgacggcgctccggtgggcatatggatcaacggtgagaaaaaagagatttaggagggaaccaagatgaagtatcaggccgtgatatttgacctggatggcgtgatctgttccacggaccagtatcattaccaggcatggaaagcagttgcggatgagctgaacattccatttgacgagacggtcaatcacagactgcgcggcgtcagccggatggagagctttgaaattatcctggaaaaatacgacgcagagatgagccgggaggaaaaggtctcctggatggaaaagaaaaacacgatttacaaagagctgttaaaaaatatgagaacggcggatctctccgaagaggtaaaaaccactttggatacgctgagggcgcagggacttctacttgccatcgggtcttccagtaaaaacgcaggctttattctaaagcagatcgggcttggagattactttgacgcagtatcggacggaaacaatattacgaagtccaagccggatccggaagtgttcttaaaagcagcaaagtatctggggaaagagccaaaggactgtcttgttgtggaggacgcgaaggcgggcgtgcaggcggcaaaagccggaggaatggactgtgctgcagtcggggaagcggtaaagtgcaaactggcagactatcagttgtccactttctcacaacttctggaggcggtgaaaaattctaccaagggagcgtgtacgaaagaatggaaacagaatttttaaagaacatcttaaagagtatttccgtgtccggatatgaagagccgttgcagaacattgtccgggaggagatgcaaaacgttgcggatgagatccgggaggacgagatgcacaatctggtctgcgtcgccaacccggacagcccggtgcggattctgctttctgcccatgcggacgagatcggactgatgatctccaatattactgaggatggcagacttcaggtagtggacagaggaggcgttgtcgttcctacttatccgggacaacaggtgatcgtaaagacaaaggagagggagataccgggcgttgtggaggcatatcggggactttttgagaaacaggggatgagtacaaaggatttgaaaattgacatcggagcgaaagaccgcaaggatgccctgcgctatgtgaaaccgggagatccggtagtgccggacactcatatccggacgctcgcgaatgggaggattacgtccagagcgctggatgaccggattggcgtctacattattatggaagcattgaagcgggcaaaagaacggggatgtacgtctggtatttatgctgcctctacgaccggagaggagacgacaaagaccggggcatactggtgctccgcacggatccatccaacgcttgctgtagtagtggatgtgacgtacacaagcgactgccttggcatggacccggcggaaatgggccaggtggagcttggaaaaggaccggtgctctgctacagcccgatcgtggcgaaagaactcaatgaaaagatggagcgcacggcaaagaaggcgaatattccggtacagtgggaagtagccagcagattaagctatactgacgcggacaaaattcacttttccaatgaaggcgttccggtcgtgcttgtgtccgtgccgcttcgctatatgcatatgccgtgcgaggtggcggatttatcggatgtggaacattgcattgaattgattgcccatttcctagcatgatacgggacaaaaggtgaaagccgctgaatcgtgaaagtgaaaaggacataaaaaggacggttgtgactaaaaaacagatgtgttagaataaatagaaatgcataatcagagggggattcaagaaatatggctacgataaaagagatagctgaactcgctggagtctctgtcacaaccgtctctcgtgttctgaattttgacgatacattgaatgtgcaggatgaaacgaaacgtagagtatttgaggcggctgacaggctggagtatcagatcaaggataaaaagaggaagaagaaaaagctgaaactgggacttttttgttcttattcaccggaagaagagctggaagatacgttctatctgtctattcgcattgctgtggagaaaaagctggacaaagaagggtttaagaaagtgattgtcacctcggaggatacggcggataatgtggcgaagctggatggtatcatctgtctggggacattcagtaaaggtattgtggagagaatccggggatttcataagccggctgttttcatcgacgcagtcggagacgtggagctctttgattccatcgtggtgaatttaaaacatgcagtcacgaaggtgatggattatctggtggacgcaggccacgaaaagattgcttttatcggaggacgagacgtggattccgatggaaaagagatcgtggacatgcggatgccgatctattcgcactatttagaggagaagaatcttttccatgaagaatatatccagatcggaggctttacgccaaagcacgggtatcgaatggggaaggaattactggccttagaggatcggccgacagccattttctgcgcaaacgattcactggcaatcggatgctataaggcggttcaggaggccatgctccgggttccggaagatatcagcgtcgtcgggtttaacgatatttctatgacaaaatatcttgttccgccgcttactacggttcatgtgccgatggattttatgggcgaagaggcagtgaatatgcttgcggagcgtatctatacgaaccgggaaatcagtatgaaagtttctgtacctgccaaactggttatcagagaaagtgtaagtaggagaaaggatgaaaacaacatatgaaaacacataaagtgagaaattccctgctgctgcttctgacagcattgatctggggaacggcttttgtggcacagagcgtagggatggactatgtaggtccctttacatacagttgtgtccgttccctgatcgcggggatcatgctgatcccctgtatcgcctttttaaacaaggtgaatccgaatcaggaggaaaaagaaatctgccgggatgagagcaggagaaaggcttatcagaaaaaacttctgatcggaggaatttgctgcggactggcccttggtgtggcaagctgtcttcagcagattgggattcagcatacgacggtaggaaaagcaggatttattacgaccttttatattatcattgtaccgattatcggactgttctttaagaagcggtgcgggctgaatgtctgggcgggcgtcgtattagccctggcaggactgtatttcctctgcatcacggaaggattttctataggatacggcgatacaatggtttttttatgtgcgctggcattttccatccatatccttgtgattgatcacttcactgagctggtggatggggtaaagatgtcctgtatccagttttttgtggccgctattgtaagcggtgtggggatgctcgtgatggaacagccggatattcacaatattctggcggcatggctgccgattctctatgccggagctctctcaagcggtgttggatacactctccagattatcggacaaaaggggatgaatccgaccatcgcgtcgctgattttaagtctggagtcggtgatttctgttttggcaggtatggtgattctggatgagcagttaagcagccgggagatcctggggtgtgtactcatgtttatcgccattgtgctggcacagcttccggagaagaaaaaagcggtttgatacagcggcgtgacgattcagccatgacagctcggatttgtcgcagcacagcttatggctgaactattcttatagattttacgtaaattttacataaatttgaaaaaatattgacactccagttccttttccgatacaatgaaaaatagtgcggtatcagagcaaacgctgcacgaggaataatatcaggaggaacattacaaatgaaaccggaatatgtctttatgctgctcggaggactcggcctctttctgtgcgggatgcagatgatgagcagcaatctggaggcagtcgcaggggaccgtctaaaagggattctggagaaactgacttccaaccggatccttggagtacttgtcggagccgtcatcacagcagtcatccagtcgtcatccgctactaccgtgatggtggtgggctttgttaattcaggactgatgactctcagacaggctgtgtggattattatgggagccaacatcggaacgacgattacaggacagcttgtcgccctggatatcggaaccatcgccccactattcgcgttcgcagggattgcgcttggtatgttttccaagaagcgcaatgttcagaatatcggaagcatcattgcgggacttggggtactctttatcggacttggtatgatgagcgacgccatggtgccgatgagggattcggaagtctttgtcaatgcactgacaagtttttccaatccgattatcggaatcgtagtaggagcgatttttacagcagtgattcagtcatcgtccgcttcggttggtattttgcaggcgctggctttaagtggtctgatcgatattcacagtgcggttttcgtactgttcggacagaatatcgggacatgtattacttctctgattgcatccgtgggaatgaaccggaatgcgaaaaggacgacagtgatccatttcatgttcaatatgatcggaaccgtcttattcgttatcctttgtcttgtgactccactgacagatgcggtggcaggtctgacaccggctcatccggcgtcacaaattgccaatatgcataccttgttcaatgtagtgacaacaattattctgataccatttggaacagggctggcgtctctggctgagaagatccttccggataaaaaggaagagatcagagtacagccggacgacgaccagtggctgaaggagattatgagctcccaacatgtacttggatcttccgcgatcgcaatcagcagtctgatggagaatgtcggcagtatgtacagccttgcaagagaaaatgtgctgaaggggtttgatatgattctttccggtgacgacacccggtttgccgaggtggaagagacggagaataccattgatctttataatatcagtatctccagacggctctccaaggtccttacgattgagcacggacctgcggagacaaagcgcctgaacagcattttccagatcacggggaatgtagaacgtgtgggggatcatgcaatgaactttgcggagcacgccgtttttatccgggaaaagggactgaagctttccaaagaaacgattgaggagctgaaagaaatgcgggagcagtgccgaaaagcgtttgagcggatggaactttccgcccagacagacccgacccagcttctggtggatgcggtcagctttgaacgtgcagtagacgatattacagagcggtgcagagataagcaggtagagcggattaataaccgtgcgtgtgagattgagagcgcggtactctattccgagatccttatcgactatgaacgaattggcgatcatatgagaaatattgcggaagcctatgcggagcagaatatataagacaatatataattaagaagaaatacggtgcggacgccgaaaaggaagagggagatgcgagtttcagaaaagaaacggcatcttccttttttcgtgaaatttttctcaattttgattgataaaatcttgacgacttcttcgtcaactgatataattgaaccaaggtttgaactttagtctaaaacagaaacaaaaggggaagaaaagaatgacaccactggtaacgaatattcagaaatattcgattcacgacggagatgggatccgtacgagcgtattttttaaaggctgcccgcttcggtgcgtctggtgccacaatccggaaacgcagaagtgcacgaatcagcttctgacaagtaatgagaagtgtaccggatgtggatactgcgtgccggcctgtccgaatcatgcgatccgtatcgtggacggaaagtctcagacagatatgtcgctttgtaaggtatgtgggaaatgcaccgaggtctgtccgcagaatatccgcgagacagcggggagagagtatacggttccggagcttgtaaaagagctgagaaaggacgagatgttttacgaagaatctggcggaggcgtgaccctttccggcggagaggtcatggcgatggacatggattacatcgaagcgctcgtaaagaaactgtaccggtttggcattacagttacaatcgacacatgtggatatgcaccgtatgagaattaccagaggattcttccatttacagatacatttttatacgacgtcaaggtgatggatcgggaaaaacatcgaaaatatattggagcggacaatacgctcattctggaaaatctggagaagctgagcgcagacggggcaaggatttatatccgaatcccaacggtgaaggaagtcaacgggacagatgaagatatgcggcagattattgactatttgctggagaagaaaatccgcgtcgcacagatcaatctgctcccgtaccataataccggatcgagtaagtacgcgagactgggggaacagtatgagggaaacggtcttacggctccttccagagaagagatggaacactttgttggcttgtttgaaaaagccggatttcataatacaaaaataggaggttaatgtaatggaagaaagaggcatgaacgcaagaatcaaggcattgagaaagctgagtgaaaacacacaggcacatatcgacatggaacgcgcgaagagtgagacagagacttacaaaaaatatgaaggagagctgtctattccggagctgcgcgcccaggtattgaaagactatttctccacaaaatccctttacatcggggacggggagctgattgtcggagaaaagggaaatgagccatgggcggcgccgacattcccggaactatgctgccacacagtcgaagacatgcatgttatgaacgaccgtgacttaatcagcttcaaagtgaaagaggaagactacaaatatcaggaggacgtgattattccttactgggagaaacgttctatccggaagaaaatcctggacaacatgacgccgcagtggaaagactgctatgaggcggggatctttaccgagttcatggagcagagaggaccgggacatacggtaggatctgtgaagatctacgaaaaaggtttcctggattataaagaggacatccagaaagcactggaagcactggacttccagaacgatccggaagcatttgaaaagcagaaccagttacgcggaatgtccatcgcatgtgatgccgtcatggttcttggaaagagatatgcagaatacgcaagagagcttgcggagaaagagaccgacgaaaagagaaaggcagagcttttacagatcgcagccaactgtgacgtggtaccggctcacaagccgcagacattctggcaggcaatccagatgtactggttcgtacatttaagcgtaacaagcgagctgaatccgtgggacgcttattcaccgggacgccttgatcagcacctcaatccattctacgaaaaagacgtagaagaaggaatcctggacgacgagaaggcgctggagcttctggaatgtctctgggtgaagttcaacaaccagccggctccgccgaaggtaggtatcaccttaaaggagtctggaacatatacggatttcgcgaatatcaatacaggcggtatcacaccggacggaaagaacggagtcaataatgtcagctacctgattctggactgtatggatgagatgaaacttcttcagccaagttcaaacgtacagatcagccgaaaaactccgcagaagttcctgaaacgtgcctgtgagatctccagaaaaggatggggacagccggcgttctacaatacagaggcgattgttcaggagctcttaaatgcaggaaaatctctggaggacgcaagaaaaggcggaacgagcggatgtgtagagacaggggcgttcggaaacgaagcgtatatcctcaccggatacttcaacttgccgaagatttttgagatcacactgaacaatggtttcgacaagcgtaccggaaagcagatcggacttgagaccggaaaggcaacagactttacttcttacgaagatttgtatgaagcgtacaagaaacaggtgaaacattttatcgatatcaagataagaggaaacaacgtcatcgaaaagatctacgcagactacatgccggttccgtttctttccatcattacaaacgactgcatttccaaaggaaaggactacaacgcaggcggagcaagatacaataccaagtatatccagggagttggtattggaaccatcacagactgcctgtcatctgtaaaatacaatgtctttgataagaagacgatgacaatggcgcagcttatggaagcgctggatgataactttgagggacacgaggatattctcaaccttgtaagaaacaagactccgaaatacggcaatgacgatgattatgcggatgatatcatgcaggatgtcttccactattatcagaaggaagtatccagccgtcataacatgaatggcggaatgtaccgtgtcgatatgcttccgacaacctgccatgtatactttggtgaagtgatgggagcaagtgcaaacggacgtcttgcggagaagccggtatccgaaggtatctctccggaaaagggagcggatacaaacggaccgaccgcagttgtgaaatcctgtgcaaagatggatcacttacagacaggcggtacacttctgaatcagaagttcaccccgaatgtcgtagcaggagagaatgggcttgatcagatggcgaacctgatccgtacctacttcaatatggacggacatcatatccagttcaatgtcattgataagcagacgctgattgaggctcagaaacatccggaagactacaaggatctgattgtacgtgtcgcaggatacagcgatcactttagaaatttaagtaaagcgcttcaggatgaaattatcgagagaacagagcagagctttaactaatgtttgttatagagttgtcgaaatcaatcattctctgacaaacagacaatcataaataatatttttcaaggctgtcacacgaaaagaataagtgtggcagcactttttatttaatctgaaacagggcggttcggactctggtttttgtgatgatgtgcatagtaaggctgttacgaaaattaatcaattcttcatattgtttttatggtatttatcgtttctgggcgtataatagaaccatgagagtggaaagagaaaacgaaagaagacacgagaaggagatacagaatgatagaacgacttgccggaatacgaaggaaaagacaggaagaggatacggagtatgagccggagcgtcttccgatccgaaggtgtataccggattatcatatggggctttatgaagaggagattttagaacgtgaggagggcggatggacgaaccttccggtggatcctccgtcaaagacgacaaaggagattattcacgacaatatttttacatattttaacttgatttttgcgattcttggtctgcttctgatccttgtgggcgcgtttcgggatctgacatttttgccggtgatcattttgaatacattgatcggtatcgtccaggaggtccgggcaaagaatgtactggacaagatgacgatgctgcatgctccgaaggcgacggtagtccgtaatggccggaagagggtgattgcggtggaggatctggtgatcgatgacatcgtaatctttaaggcgggcaatcagatctgcgcggacgctattgtggagcacggtgaggtccaggtcaatgaatcccttctgaccggtgaggcggacgagattacaaagcacaaaggtgatatgttgatgtcgggaagtttcattgtctccggggagtgtcatgcgaggctggagaaggtgggcgcggattcctacatatcccgcctgactttggaggctaaggcaatgaaagatggagaacagtcggagatgatccgttctctggacaagctcgtcaaatgtgtcggcatcgctatcattccgatcggtttcattctatttatccagagtttctttttgaatgacgagggctttcgttccagtgtgacggctatggtagcggcagtgatcggtatggtaccggaagggctctatctgcttgcgagcgtggcccttgcggtaagtgcggtgcgtcttgccaagcagaaagtactgcttcacgacatgaagagtattgagacactggcacgggtcaatgtactatgcgtggacaagaccggaacgatcacagagaatacaatgaaagttcagggacttcgtgccactagacattacaataaagaaacgatgccgccgttaaagggtttgatcggggattttgcacatgccatgagcagggacaatatcaccatggaggcggtacaggcctattttcaaaagagtactgggagaaaggcgcagaagatcacgtcattttcctccgaatataaatatagcagtgctacctttgaagagagctcctatgtgcttggtgctccggagtttgtcctgcgggacgattatccggcatatgaggaagagattgaaaaggaagcttccaaaggctatcgggtactggtgtttggaaactgtgaagagacaccggacggcagggcgcttcgtgggaaagtgacgccacttgcctatattatgcttgcaaacccgatccgaaaggaagcgccgcagacctttgcttattttgaagagcagggggtagaggtcaaggtcatctcgggtgacaatccggtgacagtatctgaggtggcaaagaaagccggtattgcgggtgcggatgactttgtggatgcggccacgctgacgacagaagaagagatccgtcaggcagttcagaagtatacggtctttggacgtgtcacaccgtcccagaagcggcagtttgtcaaggcgcttaaaagtgcaggtcacacggttgccatgacaggggacggagtcaacgacgtactggcgttaaaggatgcggactgcagtattgctatggcgtccggaagcgatgcggcggcgcaggcgtcacagctcgtgcttctggagtcggatttctcctgtatgccaagcgtcgtgttggaaggacggcgggttgtcaataatatccagagatccgcaagcctttttcttgtgaaaaatatgttttccttcctacttgcgatcttttcggcggtctttatgattacttatccactggagccgtcgcaggtatccctgatcagtatgtttacgatcggtgtaccggccttcttcctggcgctggagccgaacaagagtatgatcaaagggcatttcctgacgaatgtctttttaaaggcactcccggcggcgctgacagatgtactggcagtcggggcgctcgttgtttttggagaaacattcggcgtcaacgcaacggatatttcaacggctgcgacaatgcttcttgcgatcgtgggatttatgattctctaccggatcagccggccgatgaacaagattcgtgtagcggtattgctactgtgtatctgcgctctgctgttctgcagcacggtgctgaacaagctctttgccattaccggaatgtcggcggaatgtattatgctttttgtagtattctctattgctacagagccggtgcttcgttatctgaccatgtttgtcagaaagctgaaatatttttatgaccggattcggagaaatctggttttgggtaaggaagcaaaggaagaaggataggaggggtgcttatgagaatccagggacttcagaagctgacacttttggattatcccggaaagacagcgtgtaccattttccttggaggatgtaattttcgctgcccgttctgccataatgcggcactggtgacaggagtagaggatcatgaaaatttctctgaggaggagctgtttgatttcttgaagagacggcaggggattttagacggtgtctgtatcagcgggggagagccgctcatctgtccggatttggatgagcttctgaaaaagatccgggatatggggtacttgatcaaactggatacgaacggcagttttccggagcggctgatccgtcttgtggaagaaggactgatcgaccaggtggccatggatctgaaaaattccagagaaaagtacgcacggacagtggggcttgggcagtttgacgttcggcccattgaggagagcgtggagtatctgctggaggggcatgtgccgtatgcgttccggacgacagtggtacgggaattccaccagaaatcggacttcgaggaaatgggacggtggattcggggggccgcgacttattatatccagcagtttgaaaattccgggggactgattcgtgagggcctgcatgcctacgatgaaccagtgcttttacaggtaaaggcgattatggagaattacgtaggcgaggtagaaatccggggaatatagagaaaaagaaaaaacaacatcttgttgaatgtttagtgttaaactgctaaaaacaactagatgttgtttattgcgttgacggtaaaagaagaaaagtgatataatggggacatcgacacgaatgggaaaggaagtatgacaaatgtatcaggtagtaaagcgggacggccagattgcagagtttgacattcataagatcggcgctgcgattcagaaagcatttgaggcatcaggaaagaattttcatcctagtgtcattgatatgcttgctttgaaagtaacggcgaattttgagccgaagataaaagatggaaagattaaggtggaggagatccaggatagtgtggaggaggtcttgagtcaggcaggatatgcggacgttgccaagggctacattctctatagaaagcagagagagaaaatccggaacctgaagtccgcgaccttaaattataaagagcttgtcaacaattatctgcaggtcaacgactggagagtcaaggagaattctacagtgacatactcggttggagggctgattctgagcaattccggagcgattacggccaattactggctgtccgaagtgtatgaccgggagattgcagaggctcaccgcaacacggacattcatctgcatgacctttccatgctcaccggatactgcgcagggtggtctctacgccagctcattcaggaggggctcggtggaattcctgggaagattacttcagctccggccaaacatctgagtgttctttgcaaccagatggtgaattttctcggtatcatgcagaatgaatgggcgggggcccaggcgttctcatcctttgatacatatcttgctccgtttgtgcggacggaccatttaagctataccgaggtaaagaagtgtattgaatcttttgtgtacggtgtcaatacaccgtcccggtggggtactcaggctccatttacgaatattactttggactggacggttccggatgatctgaagaagaaaccggccattgtaggcggcagggagatgaactttacctacggtgactgcaaagaagaaatggacatgataaacaaggcgttcattgaagtgatgattgaaggcgatgcacagggcagaggatttcagtacccgattccgacttattccatcaccaaagattttgactggtccgatacggaaaataaccgcttgctttttgaaatgacatccaaatacgggacgccgtatttttctaactatatcaacagcgatatggagccaagcgacgtccgcagtatgtgctgccgtctaagacttgatctgcgggagcttagaaagaaagcgggcggcttcttcggaagcggcgaaagtacaggttctatcggtgtggttacgatcaacctgccccggatggcatacctcgcaaaggatgaggaggacttctttaagagactggcacatatgatggatattgcagccagatcccttcacattaagagacaggtgatctccaagcttctggacgagggactttacccgtacacgaagcggtatcttggcggattcggaaatcatttttctaccattggtctgatcggcatgaatgaggcaggactcaatgcgaactggctaagaaaggacatcactcataaggaaactcagaaatttgcggtgaaggtgctgaactttatgagaaaccggctttctgattatcaggaagagtacgaagagcttttcaatctggaggcgacaccggcggagtccaccacataccggttcgcgaagcatgacagggagcagtttccggatatcatcacagcatccgaggggaatggcactccgtactatacgaacagctctcatcttccggttggattctccgatgatatcttcgacgcgctggatatccaggatgagttacagactctttacacctccgggacagtattccatgcgttcctcggcgagaagcttccaggatggaaagaatcggctctccttgtacggaagattgcggagaattataagcttccgtattatacgatctctccgacttactccatctgccaggatcacggctatatcgacggggagcagtacacctgcccgcattgcggcagaaagacagaggtctacagccggatcaccggatattaccgtcctgtacagaactggaacgacgggaagattcaggagtttaaggataggaaagagtacgacattggacattccgtgatgaagaaaaagaaaacagaggcacatgtctaagaaaataaagagaaccggcatacgaaagatagcatcgtatgccggtctttttgtattggcgacgagacaaatttccagtctgccagggatcctggcggccgcttacaattcggtctgcgacttttgacccttttggtagttgctgtcggatgccgaaaaaaacataggttgcaaatttgtaagataagaagcagaaaatgtaagatgattcgatggaaagcaggaaacgggtttcctataatagaaagcagaaggaggaatctgggatgtcagtcataagaaaatgggtgtcggcggcaacggcaatggcagaagtttgttttcttctggctttgtctgtggccgttgccgtcataggactttttatttttttaaagcgctgcttttgccgatcataaagtgatcgtttcttaaaatttcataggctttttcgtactgatcagaccgcatgtagcggatcatctttttcagattttcattggctctgctgatgtgaagaccattccggacggaatacaaccccatgcggatgacctcgttaaggtacatttcgtagatacgattgatccgctcattgtcaaatacgctgacaatctccatgtgcatctgggtgtccgccagttcccagtggtagatatccccggcacacgcacacatccgaacgacacgctcctcgatccggtaggaaaactcatcagctctgccgcttgtaaagatctcccggaacgcggctccctccagaagctcacgaagctggtaaatctcctcgatatccttgtctgtgatctcttttacaataatcgatttataataatcccggacaacgagaccctcggcatgaagcgtctttaaggcggttcggatcggattccggctcatattcagttcttcggcaagcatcgtttccgtgagttgcattcccggcggataagtcagattgagtatccgctctttcattgtatgatatgcctggtcggccagggaaattttctcagccacgcagatcacccctttgtatactaataactttattgtatacaaatagaaacaaaattacaaggaaaaatggaagaaatgtcataagaatgattgacaaggacgatgcatagtgatattttataggtatgaattgtatacaaatgatttgagtgtatacaaaatgattcttagcggaaaaggagtgtaacacatatgaaattaggatttatcggatgtggaaatatggctggcgccatcatgggaggcattattaaaaaccaggtatttaagccggaagagatcattggttccgacgttttcgtaccgaccagagaaaaggcaagagaccagtacgggatccagattacagacagcaacctggaagtagtagaaaagtcagaagtgattgttcttgctgtgaagccacagttctatgagtctgtcatcacagaaatcaaggacaaggtgacagaggacaagatcgtaatcaccatcgcgcctggaaaaacactggcatggctggaagagaaattcggcaagaaagtaaagatcgtaagaacgatgccgaacacaccggctatggtgatggagggcatgacagcagcatccccgaatccatacctgtctgaagaagaagtgaagtatgcgtgtcatattctggaaagctttggtaaggtagaggttattcctgagcgcctgatggatgcggtcgtatccgtaagcggaagctccccggcttatgtattcattttgatcgaggctatggcagacgcggcggtagcggacggaatgccaagaccgcaggcttacaagttcgcggcacaggctgtgatgggaagcgcgaagatggtattagagacaggaaagcatccgggcgaattaaaagatatggtatgctcccctgcaggtacgactatcgaggcagtcagagtactggagagaaccggattcagaagctctgtgattgaagctatgaaagcgtgcgcggatattgcaaagagaatgtaaaaaaggtatactgtagaagtacatgaattgagacggctcagttgtaaaagtacagctgagctgtttttattccatttgaaaggacatggaatgagatatgcagtgtggtctgacgtggacatggctgctgatcagatacaggagaaaggagctgggaggtaacaatggaagagaagaagaagcgggtcaaggaccggattgtatctgcggcctgggaactgttttatgaaaagggatacgacgcgacgacggtggatgatattatccgtctgtcagacacgtccaagggatccttttactattattttgatgggaaggacgctctgttgaatactctgtcgacagtgctggatgatctgtatctgtctttgaaagaggagatggatccgtatatggacagctttgagaagctgatgtttctcaattacagatctcacctgtttatggagcggagtatcaaggttgatctgctggcgtccctgtattctacccagctcatctcgaaaggagtgagaagtcttctggatcagaatcgggagtactataagctgatttcctccgttatggaagagggccagaagcgtggggaaatcaaccggagaaaaagtgtctccgaacttttgaaatactattctctctgcgagcgggcgcttgtcacagactggtgcttgaacaaaggcagctattccttggcagaatacagcaaggaatatatgccgattatgatggaaagtttcaaaggaaaacagctatgataaacaatatggagagaagagaggcattgcggggggcctgcatcgccgtgatcggcgggattttctggggactggcaggtgtgttcgggcagtatctttttgcgtacaaaggtctgaacgcaagatggcttgtcagtgtccgtctggtgctggcgggtctgcttctgcttactacggtgtatctgaaacaaggaagagagatgtggaagatctggaaggataaaaaggatgtattctggctgattttatttgccattttcgggatggcaggatgccagcttacctattattcctctgtggaattatctaatgccggaactgcgacagtactgcaatacacagctccggctattattatgctctataccgccgtgcgagcgaaaaagatgccacgtcttatggaaataggagccttggtactggctctgttcggaacttttgtccttgcaacccacggggatccaaactctcttgccatctccgatgcggcacttgcttgggggctgacttctgccgttatgatggcggtctacaacctgcttccactgcaactgatgaaaaagtatggcacattctgtgtgatcgggtgggggatgttgattggaggtatcctgatgtgcgtgtttacgaagccgtggcatgtgattggaacatgggatttccaggcagttggcgcaatggccatggttgtggtagtcgggacggttctgtctttttccttttatatggagggtgtccgtatcatcggagccaccagggcaagtctctttgcctctgtggaaccggtaacagcgacggcggctactgtcctgataatgcatactgcctttacgttgccggacttttttggaattctctgtattatggcagcggttctgatactgtcaattaagaaatagatgaacaccccggagttaccactctggggtgttcgcctgtcaatcgtggatcaatgatactctttaaacggattgctttattctatctttcaggcaggcgtttacggatctgcggtccgaccaggatagcaagtacgattttcagcgcgtcgcccgggaggtatggaatcacgcctgtaaagagtccctgtacaaaggtcagattcatctgaaatgtgagccatgcggttccgaagaggtaagtaatcacggagccgaggatcatccctgccagaatgaataagatacgataacggccggaagccttatccatgaaaatcccggcgatcacgatcaggaacagaaagccggccagataaccgcctgtcgggccaatcagctttccgagtccgccggaaaatccggagaataccggaagaccgcagattccaagaagcatgtatacgacatagcttaggaacatctgcttccatggcagaagaaacagtccgaaatagaggaccaggtttgtcagggaaatcggcaccggacttaccgggatcggaatggacatcggtgccagaatacagagtacggctgtcattagcgctgttgacacaaggtaacgtgttgaaacagaagcctttgttgttgtattgttcatctcaagttctcctctcttgttgtctaggtgatagtataccgtctcaggaaataattgtcaaccaaaaataaaaactaagtttacaattagaaacaaaggtttccgaagccttccgttgtcaatccgcccctgcctgtggtatagtgaaagcacattgttaaaggaggaatcatatgaaatatcggattctgttggtggaagatgatgagacgatggtggatatcttaaagagaaatctggagaagtggggatatcttgttcatgtggctgaggatttccagaacgtaatgcaagaatttcaggactttgagccgcagcttgttctgatggatatttcccttcctttctataatggatactattggtgtggggagatccgaaaggtcagcaaagtgccggtgatttttttgtcctcctctggggacgacatgaacctggtgatggccatcaatctgggggcggatgattttgtggcaaagccgtttcggatggaagtgctgacggccaagatccaggcggttctccgcaggacgtatacttttggaacagccagtccgtccgtgctgacccacaagggactcaccttgaatctggacacttcggtgttatcctatggacaggaaaagctggagcttgggaaaaatgaattcggaattttacggacactgatggaacatccgggcaaaattattgagcgaagtgtgctgatacgtaatctctgggagacggaaagcttcatcgatgacaacacgctgaccgtgaatgtcaccagactccggcggaggctggaggatatcgggctcaaaaactatattctcacccggaaaggtatgggatactatgtggaagaataactattttgcagcctacatccgggcgaagcgtgacatggaagtactgttttttggtattcttgcgcttgaggcagtgatctattctctctatggacttccgtggggaccgtcattttatacgatgatcctttcggcggccctgttttttctgatttgggggctggggtacgcttcctaccggaaaaaatgtatccggcttatacagatgcaggagaaagaggagattgaaagcaactattttccaaagacaaccgacaagatggaactactctatcaggagttactgagaaagcgtgaaagggcgtggagcatccaccatgccgttgagcaggagaagagaaagcaggaggatgcctactatacgaagtggagccatcagatcaagacgccggtgtcggtgttaaggcttttgcttcaggaggaagatccggacacggagacgatgcgtcacgagctgttccagatcgaacagtatattgcaatggcgctggattatcagaaactggaaaagggtgtgaaagatctgagtctgggacatttccgggcggcggatctggtgaagcaggcgatccgcaacctgtcggaactttttattcataagaagatttccattcagatcggggaagatctcgactttacgatcctgacggatgaaaaatggttcgtgtttatgttggagcagattctcactaatgcggtcaaatatacgaaaaaagggtatgtatccgtgtgccgtcagggtgagggggagattgtcattatggataccgggattggaattttaccggaagatctgccgcgggtgtttgagtggggatacaccggttacaatggaagactggacaaacggtccaccggaatcggactgtcccttgtgaaatcagcggccgatcttctgggacatccggtcaagattgaatccgagccgggaaaagggacaaaagtgtgtatcgatacgaggaggccgaagctgaatacaggctgacagaaaggagagcgaatgaagaagtttactgagcaaagagtcttgattggaagagctgtgatcggactgattgggatgctgtttctcatagctggcatttttcaaggagaatttcatacgacatggagtaaggcagtccgaatctgtttggagtgtatcggcattggataagaggaaacttccgatgaagcggagatggatccagcttgccagcgctttgatctataacgcgaatctaaaagggtttggggaggccgctatttatcaggggaaaacaaagggcgtctgtgttccgggcttaaactgctattcctgtccgggggccattgccgcctgtccgcttgggacgctgcaaaatgcactgagcagtgcgccagttcgtttcccattttatattctcggctttttgattctttccggattgttcctggggagaatgatttgcggctttttgtgtccctttggattgattcaggaattgctttacaagatcccggtgccaaaatacaggaaaaatcggataacccggatactttcctggctgaaatatggaattcttgctttgtttgtgatttatattccactgtattttgccttccggaacggatttccactgccgtcattttgcaaatatatctgtccggcggggacgctggaaggtggactgacattggttcttggcaatccgtctctacgggcggcggcaggtgtgctctttgactggaaagtactggtgcttttgctgtttttggtaagcacctgttttgtttatcgtagtttttgccgttttttctgtccgctcggagcagtttattcgctgttctcccggatttccattctgggaattgaggtggatgaggggaagtgcactcactgtggccagtgcgtgcgtcagtgccgcatggatatgaaagcggtcggagatagggaatgtattcagtgtggagaatgtaaacaggtctgccatgttggagcgattgaatggaaacacaggaaatggaggaggttctgatgagaaaaaaaagaatgggaatgttactttgtatgatattgatggcagcagcgctttctgcctgtgcggggaaaacggatgacaagaagcagggtacaaaaacagccggcacgaaaaaggacgaaagcaaagaggagcggacagcaaagggggaatcggagaaagggatgacagctccggactttgaggtgacgcttctgagcggcaagactgtcaaactgtctgattacagggggaaaagggtccttttgaatttctgggcgacctggtgcggcccgtgcgttcaggaaatgccagcatttcagcggctgagcgaggactatcctgatgatgtggtaatcctggcggtcaactgcggggagagcaaagaagaggtcgaaagctttgtacagaagaatggttatacattcccgattgcactggatgaaaatttggaggcgtctaatctgtatccggcaacatccattccgttgactctcattgtggatgaagaaggagacatcgtctattcctcctatggagccagcgacgcagatacgatgtacgcgcactataaagaagaactgggactgtgacaatcttacaccgacgtaagaatacgaagagaaagtgtaagccgaatcgatggcggacactttcttttttctgtacaataatgacagaacaaaaagaaagggagtcgatgattatggcattattggaagtcagacatctgaaaaaaacatatacaaaccggtttggaacaaaccaggtggaggcgttgaaggatgtgaccttttcgatggaagaaggagagtatacggcagtgatgggagaatccggatccggaaagacgacacttctgaacctgctggcgtcgtttgaccggccgacttcgggtgatattatcctgaacggcctcccattccggaagatccaggacaaggatctggcagtctatcggaggaagaacctcgggtttgtattccaggatttcaatctgttggatacgctctcagtcagggacaacatttttctccctctcgtgcttgccggggaaaagacagaagaaatgaaaaaacggctgtcacctcttgtcaaggtgcttcggatctccgatctgctggacaaatttccgtacgaaatttccgggggtcaaaaacaacggacggcgatcgcaagagcactcattacagaacccaagctcattctggcggatgaaccgaccggggctttggattccagggcctcctatgaattgttgcatatgtttgagcagatcaatcaggcggggcagacaatccttatggtgactcacagtacgacggccgcaagtcatgcgaagagagtactgtttatcaaggacggtaccgtgtatcatcagatttaccggggagataaaagcagggatgagatgttccggaagatctccgagactctgactgtgatggcgtcaggagggaaagagtatgcataatgctttgtattttacactggcaaagtcgaatctcaaaaagaaccgggcaatctacctgccttatctgctggcaaatgtactgattgtcagtatgtactatatcctgacgagtatccgttctatgatgcagacttacgagacgacacagggctccaatacggatctgatgcttcggttttgcacggtggttgccgttatcatggccttcatcatcctgttctatgtcaatagttttgtgattcggcagaggaagaaagagatcgggttatactgcgtccttgggatggagaagcgccatctctccgtgatgatgctatgggaagtggtattgacctctcttgggggaattgtgggcggaatcgtttcaggcgccctgttcagccagcttgcgtttctcgtctttttagcgcttcttagaatcccgtcggatttgcggtttgagattccactgggtgcggtaggaaacacatgtgcagtatttggcgtcttatacctgctcgtcctttgctacaatctgctctcgatcctgcgaaccagtccgatttcctttttgcagggagcgaaagagggagagagggaaccgaaagtgaaaaagattcctgcggtgcttggcgtgatctttctggcaacagggtatggcctcgcactgtttgcagatggcatttacgagacaatcaaagtgttccttcctgcggtgctgctggtgattttcgccacatatttcctctttttggcgggcagtatcgctttgttgaaatggatgaaacggcgggagcggttttactaccgtccgaaaaatttcattaccgtatccgggatgctttaccggatgaagcaaaatgcggcagggcttgcgacgatctgtattttgtccaccgccgtgattgtgtcggtttccaccagcttcagtctgtacctgggggaagaggacatcctgaaactgcagtttccgagagattatcatgcaagttgtatactcgaaaagggcgaggaagagacggcggatcttcaggcgggaattgagcatcaggcaaaggagaacggcgtcgccatgagagacgattttggttataaacaactctggatggcaggacttgctgcgggagaaccaggagaatttaccctctccgacggggagcagatttctccggaaaatctgtatatttttgcttttttgaccgaggatgactataacaaaaataccggagcagacctgaatcttggggacgatgaggtggctgtctatgaaaaagaggaagaaagcgtggggcagtcgttgaagctggatgaactgagctggaaagtcaaatccaaagtcgaggatcccggagtctggaatcaggcactttatctgacagagacacattacatggcggtcattgtaccggatatgtcggctctgcaggagatccgggatgtatacaacgagaagtatgcaggaacacagacaggctaccgggtcatcacctacgaatattattataatatagaaggaacgaggagtcagaaagcagatttcatagagactctccgagatacattgatccaatacgttgaacatccgatggcagtgggaaatgtagagctgtcaaggacggactactatgagcggttcggctccttcctctttatcggactgtttttgtccatcctcttcttgctggcggtatctctgattatctattataaacagatcacagagggtctcgacgacagagagcggttccagattatgaagaaagtcggaatgacggacgacgaaatccgttctaccatccggcggcagatcctccaggtattcttcttgcccctggcaatggcggctctgcacaccgcggcgtccttcccggcactggtagacctgatgcgggcaatgaacctcatcaatcaagagattttcgtacggtgtaccatcggcgttgtacttgcctttgcggtcgtgtactttattatttatacaatcacatcgcatacttactacaaaaaggtgcagcaaaatgaataaaaagaaaagggctgatgcagaatgtgcgtcagccctttccaatggtgctgtaaaaaataccaattccacttattatcagggcgaactgcccaaatatttgacattatgacatattatttggtcattctgccattcaagctttcttttccaaacagtataattacagacgaagaagagaagtactatttgttttcagaagaaccggttttatgttttcgatatgcagacggagaatatccggtcgcattgcggaacatttttgaaaatgcaagagaatcttcatatcccacagcatgggcaatatctttgataaaaatatcggtggaaccgagcagctcctttgcctgctggagccggtagttcaaaagatatttttgtggagacatgcgcagctttttattaaaaatataaaaaaggtatgatcgtgtgatgccaatatagtcggcgatatcctgaatatggatatttttgccgtaatgaaagtggatatactgtattgcatgctcaaaataggtttcaggcaggtaatcatggtgatccttcgtataatctgaggacatctgataggagtctgtcagtaaggaaaagagggaaaagagcagactgacgcgtttcagctcattggtaatggtcagttggtgtgtttttaacatttcccggatgatggatacatatatctccggatctttaacacagtcgcggatatatgggcaatccccaaagccggcctgttgtatatactgtgccgatttattcccttggaagctgatgaaggcataggtccagggattctgggagtctgggtagtagcgtgatactgtatcaggggggatgagaaaaatctggccttgtttcagatgatggatctgatggttgatttcaaaatatccgcttccctccagaataaaatgcatatggtactgcggacgctttttcggaccccatacataaccaggtgaaggctggtggataccgcatcttgtcagatagagatcgtttgtttgatgttcaatctggtcaagacattgaaaatccacacggtcatagtatacgtttgtttccatagcaatgagtccctcctttgaaagtgcagctcaaagttgaatatagcatataaagatttgatagaaaagtcaaggcaaggagagaaaaatgagaataacaagtaatataaaagcaaatataagacagacattaagggaccttccggatggcagacaggtatatgacatcatactggatcagattccatcccaggaggatgagatcaccattagttgtgaatgggatttcccgatctgtaacattgcgggaagatggcatccaaattgcagatatgacagaacgctgaaagcggactgggcacatggggaaatttctatgagttctgtgtcagcgccgttgaatgtatttttcagtactgacgggcgaaatattaagaccatagctgtctcagaagcagagaaaaaagtcaatatgaatgtgggagtccatgaggaaaatggaacgatgaaatgtcgtgtgaaagtttttgccggagcggtagaaacgccggcatacaaagtcaggattcttctggatgaccgggacgtccggtatgagcaggcgattggggatgcggtagactggtgggaaacagactgtggatttcgtccggcatttgtaccggatgaggccagagatccgatgtattctttctggtattcctatcatcaggagttcacggaagaagacgtcgaagcagagtgccggcgtgcggccgagcttggatttcggactgtgatcgtggacgatggatggcagacggacgatacgaaccggggctacggatattgcggggactgggaggtcactgaaaagaaaatcaaaaatatgaaagatcacgtagatcgtattcacaagctggggatgaaatacctgctgtggttcagcgtaccttatgtcggaatgtattccaaagtatggaatctgtttcataataaactgattgcagtggatgaagagcaaaagacgggaattctggatatccgctatccggaagtgaggtcgtatttgaaaactatctatgtaaatgccgtaaaggactggggactggacggcttgaaactggattttatcgatgaattttatgagagagcagataccccgaaagtgaatgaagatatggactgtatctgcttgcagacagcccttgatagacttcttggggagacgatggcagagttaaaacagataaaaccggacgtccttatcgaattccgacagcggtatatcgggccgtttatcaggagatatggcaacatgttaagggtctgtgattgtccggaatcggggcttgccaatagggtaggaagtatcgatctgcggctgatgaacagatatacggcggtacactctgacccaatcgtctggaacgaaagagagacaccggagacagcggctcttcagatcatcgatacgcttttttcaacgatgcagttttcggtgaaaatggaatacctgacagcagaacaccgcaatatggtggagaattacatggatctgatgaggagatatcgaagactgcttcaaacgggcccgattaaagcagaagagccgcagaatctctatccgcaggtcagtgtcagagacaacgatacggagattacagcagtatactcagcgggaagagtcgttactatcggaaaacagcagaaagaaaccatcattatcaatggtacaaaggcaacagaaatctatatcaaggcagaaaacgaaactcctgccaaagtgattcaaaaagattgttatggggagattgtggaagaaaaggacgtgattcttgctggaattacagagcttccttgcacggcggcgggacgattggaaattatcaaacaaatgtgaaaggtggaggtcagtatgaaaaagagaatgagaagacttgcggcagttggtctggtaactgtaatgacaggttccatgctgcttggatgcggaggagaaaaggagaaggaagatggaaagacaagtgatggaaaagtccagctccgtttcgcaacctgggatgacgcaaccgcattggacagccagcaggaatgtgtcaataaatttaatgagagccaggataagattgaagttgtactggaaggatggggatctgattttgatacaaagatgacggccagcatgggagcgaaagacgctccggacgtgatgtacatgtgggattatccaacctattcagaaagtctggaaccactagacgagcggattgaggctgagggagaagaatacaagaataatttctttgaggcactctggccgtacaattccaatgatgggaagatttacggtgttccggtcagtgtcgtaacatcttgcctgtattataataaagatttatttgaccaggccggagtggaatacccgtcagatgactggacctgggaggatgtggaaaaagcgtcaaaagaaattcagtccaagatcgacggtgtcaatggatttacctttccgattggcacgctgccttatacattggaaatgtacttatggagcaatggaactgcgtttgtggatgaggacggtaaactggatggtaatatcaatagtaagaaatccattgaagtgtttgaaaagttccaggatatggaaaaagacggcgtgctgtatgcgtccgaagaaagcggacaaagcgaaatgctgggcggcaagacggcaatgtatgtcgatggaacatggccgatcaagcagtttgaagaagaaggactcaattatggtatcgcacagattccgaaatttgaagggaccgaacattccatcagtgtcatcaatacgtctggtatcgcaatttccaaaaccagtaaacacaaagatgaggcatgggaattcctgaaatactggacaggagaagagatgaataagtaccggatcgaaacggaactcccggcattaaaatcggtagtagagtctgaaaatcttagagaaaatccaaactgtgctccattctacacagcgcttgataactgtgcaggctatgcaccggcaagtttcattgcggacggctggaccgagattgacgccgatgtacagcttgcatttgaaagtatcatcaatccaagcagtttagcggatccgaaagaagctttgaacgaggttgtagcaaaccacgaatagttgccgtagatcagcgattgatatcgattgtgcaagagaaagagggggatcttccccctctgaatcataaggagagagttacatgaaaaaatggaagaccataacgccctatctgtttatcacaccgtggattatcggattccttgtttttacacttggaccactgatcttttctctgtgcatcagcatgtttgactggccggtagtcggggagagaacttttgtagggcttggaaattatataaaaatgtttactgaggacaagcaggtgctgaaatctctggtgatcagcattaaatacgcggcaatttttgtaccgcttaatatctgtattgctctgttccttgcgatgctgatcagccagccgttgaaagggatcaaaatatatcggacgatattctatattccggctgtagtctccggtgttgcgacatccgtaatctggagctgggtgctaaacggtgattatggtgttttgaactatcttttgtctttcatcggcattgaaggaccaaaatggcttgtagacccttcgtgggcgattctggcggtcgttatcgttagcgctttcggagtcgggactatgatgcttgtattctatacgaatattaaggggataccggcagatctttatgaagcagcgtctcttgacggagccggaccggcacggcagttttttagtatcactctgccgattatcacgccgacattattgtttaacctgattacctcgattatcagttctttccagcaggttacgcttgtcatgcttctgactgcgggcggaccgatgaagtctacctatttttacggactgatgacttacgagaatgcgtttcgccatcacaaacttgggtatgccagcgccaacgcctgggtgatgtttgtcattattctgtgcctgacggcattggttttcaaatcctcttctatgtgggtattctatgaaagtgaagtcggcggttctaataataagaagaaaaggaggaaaaagtaatgagaatgtctaaaaaaacgaaggtaattctgtatgtgatcctgacattacttgcagtttactttttgtttccttttgtatatatgtttttctccacatttaaaacagaatcagaggcggtagcatttccaccgaaattccttccggacatctggaattggcagaattatgtggacgcatggaatgcccagccgtttgcgacatttctgaaaaattccgtgacagttaccgtactgtcggcgctgggatccatggtatcggctgcacttgtagcctacgggtttgcaagatttcaattccggggaaagaatgtactgttcatgttgctgctttctactatgatgattccgtgggatgttacgatgatcccacagtatatggagttcaacgcatttggatggttgaatactttaaagccactgattattccgtcctggttcggatcagcatattatatcttcctgatgcgccagttcttgatgggcgtgccgaaagattttgaggaggcggcccggatcgatggggcaaactcattccagatcttttacaaaatttatgtgccgattatgaagccgtccctgattctcgtcggtgtactgaatatgctgtctgcatggaacgattatctgggaccattgattttcctgcaggaaagatccaagtatacactggctctaggactggcttcgttcaagggggtttactctgaatccattgttccgatgctgtgtatcacagtgattatgatcctaccaccgattttgattttcttatttgcgcagcggtatattatagaaggaaccggaggggcgatcaaataacacggaaagggaatcttttgctatgaaaagattctcttttttggtaaaatataagaaaagtacatggaaaaaggagacgaatatggcgattagatttcatcagacttcaaaagaatttcatctttataatgaaaagatcagttacatcattaaaattctggaaaacgggcagttagggcatgtctattatggcaagcgcatcacagatcgggaggatttcgggtatcttgtcgagtatgtgtctagagatatggctccgtatccatttgagggcaggagcaatttttctctggaacatttaaaacaggagtatcccgcctttggctccggggatacgaggtatccggcttttgaactggagagtggggacggcagcagggtagtggatttcaaatatcagtcccatgagatctatgccgggaagaaagggattgagggtctgccatcagtctatgtggagaatgaaaatgaggcggatactttggaggttgtgttggaggatgcttttttaaaaacacgtatcatactgtcatatagcatcttttcggaccgtccggtgattaccagacatgcgaagtttgcatgtgagaaagaagatggcatcactcttctgaactgtatgagcggttgtctcgatttgccggatatggagtacgagatggtggagctggcgggagcgtggggcagagaacggtatccgcagaccagaaagcttggctacggtacacaggccgtgtacagtatgcgggggtgcagcagccaccagttcaatccgtttcttatgttaaagcggtcaaataccgatgagcaccagggagaggcgatcggatgcagtctgatctacagcggtgattttctcgcccaggtggaggtggacaacttcgatgtgacacgggttgtgatgggaatccacccgaatgaatttcgttgggagatggcaaagggtgaatccttccagaccccggagatggtgatggtctactcggacagggggatgaaccagatgagccggacgttccacgatctgtaccggacccggcttgcgagaggcgtatggagggacaaggcaaggccgatcctcatcaataactgggaggcgacctattttgattttaacgaagaaaagattttgcggattgccgaaaaagcaaaggagattggcgtggagctcttcgtcctagacgacggatggtttggaaagcgcaataaggataacgcttccctgggtgactggtacccgaatcttaacaagctgccgggaggtattaccgggcttgccagaaagattgaggagatggggatgaaattcgggctctggtttgaaccggagatgacgaataaggacagtgctctcttccgggcgcatccagattggctgctggcagacattcgccggaattattgccacagcaggaaccaatacgtgcttgatttctccaaatcggaggtggtggattacatttacggacagatgagaaaaatcttaacggaggctccggtttcctatatcaagtgggatatgaaccgggcgttctcagaagtcttttccaatggaaatgatagggcataccaggggaaggtgcggcataattatattcttggggtgtacagtctttacgagcggctgattcaggaattcccggacgtgctctttgagtcctgtgcaagcggaggggcccgctttgatccgggaatgctccactatgctccgcaggcatggacgtcggatgatacggacgcggtagagcggattaaaatccagtacggtacatcttacgtctatcccctgtccagtatgggaagccatgtgtccgcgtcaccgaatcaccagatttttcgcagcacgtctctggaaacgagaggaaatgtggcgtactttggaacttttggctatgaactggatatcacgaagcttacggagaaagaactggaacagatgaaggaacagatcacctttatgaaacagcaccgggatctcatccagaaaggggaattttaccgcctcgaaagtccgtttaaaggcaatcaggcggcctgggaggtggtcgcaaaggatggaagcgaaggactgatggcgtattttcgggtacggcagccaatccagggtaagctggaacgcatctatttcagcggtttggaagagacaaaagcttatgaagtgcgggaatgtttcggggagaagacagatttcggcgttcattatggggacgagctcatgtatgtgggatttagcgtttcagactgctccagcgggcttgtgggagtagcaagaacgggacagggagacggatactccaggctcttccatttccggaaagtaaactaagtaaaaaagagaaaaagcagaccgtaagaaacggtttgcttttttttgcgtaagaaactataataatacaggaacaattttgaaagaaaggggaaagatgatgctgaaaggaaagacagtggttcttgctgtgacaggcagtatcgcggcctacaagatcgcgtcgcttgcgagcactctgaaaaagctggaggcggacgtccatgtactgatgactgagaatgcggagaatttcattcatccgattacgtttgagactctcaccggcaataagtgtctgattgatacatttgaccggaattttcagtacagtgtggagcacgtgtcccttgctaagcttgcggacgtggtgatgatcgcgccggccagtgctaatgtgatcggaaaggtcgcaaatggcattgcagacgatatgctcacgacgacggtgatggcctgccgatgcaagaaaatcgtcgtcccggccatgaacacgaatatgtttgtcaatccgatcgttcaggacaatctggacaagcttcgccacttcggctacgaggtggtagatcctgccaccggatatctggcgtgcggggatacgggccagggcaagatgccggagccaaagcttcttctggagtatattttaaaagagatccagtatgaaaaggatcttgccgggaagcgagtactggtcacggcagggccgactcaggaggccattgatccggtgcggtttcttacgaaccattccacgggtaagatgggctatgcgctggctacagtctgcatgaggcggggagccgacgtgactttagtcacaggaccgacccagatagagaagccaaagttcgtccggatgattccggttcgtacggcaaagcagatgtttgatgctgtgacagaacatgccggtgatcaggacattattatcaaagccgctgctgtggcggactaccgcccgaagtaccaaagtgatgagaaggtaaagaaacaggacggagagcttgctatcgagatggagcgtactgatgatatcctgcaataccttggcgaccacaaaaaagaggggcagtacctctgcggattttccatggagacagagcagatgatggaaaactcccgcaaaaagctgaagaagaaacatctggatatgattgtggcaaacaatctgaaagtagagggcgccggattcggcggcgacaccaatgtcgtcacgatgattacggacgatgcggagatttcactcggaaagatgacaaaggaggagacagccgcacatatcatcagccagattttaaaggaacaagagaaacgaaaatagggaaacagaacatgatttctgtgccgtaacgtattgtatctcgtaagagaatgataacaaggaggcaatcattatgtatcagacaggaaaaagcaatagtagaaacagcgcactcagcgtaaggagcatgacccaggtggcattattcggagcaatcattgtgcttttggcatttaccccttttctcggatatattccgcttggatttacaagggcaaccatcatccacatcccggtcatcatcggatctcttctgatgggaccgaaaaagggagcggtacttggacttgtttttggagcgaccagctttataaataacacgatgaatccgaccgtgacgtcctttgtattcaccccgttttacagcctgggagagttcagcggaggaatcggaagccttgtgatctgcttcattccgcggatactggtcggtgttgtgccacactatgtgtataagggcgtccggtctttatccaaaaatgaaaaagtttcgtcagcaggattgattctggctgggatgtcgggagcccttgtcaataccctgcttgtgatgaatctgatcttcgtgtttttccgtgacgcctatgcgcaggcaaacggggtcgcagtcaatgcggtgtacgcatttattctctccgtcatcgggacgaacggaattccggaagccatagtggcggcagtatttacactttgtatcggaaagattttgatgaggaaaaatatcagagacagactgggagtttaaagtatgattttagcgattgatataggaaataccaatattgtgatcggatgcatggagggagacaaatgcagttttatcgagcggctctccacagtccgcacgaagacggaactggagtacgccattgacataaaaaatgtccttgatatctaccaggttgatccggcagctctccagggcgggatcatatcgtctgttgtgccccagattacaaagattttccagcttgcggcagaaaagatcctgaaaaaggagattctgatcgttggggcgggtatcaagactggactgaatatccgcatggataatccggcttctttaggcggcgatctggtggtgaacgcagtggcaggaatcaaggagtacgaggcgccgatgctgatctttgacctcggcacggcgacgacagtcagtgtcatcgataaggaccgccgctatcagggcggcatgatctatccgggtgtaggggtctccctggattctctgaccgcaagggcggcgcagctctccggtatcagtctggaggcgccggagcatctgattggaaagaatacgatagaatgtatgaaaagcggtgtgatttacagcagcgcagcggctattgacggtattatcgaccggatgaaggaggagcttgggggcaaggcgacggtcatcgccaccggaggtcttgcaaagaaaatcgttccgcattgcaggcgagatgtgattctggacgacgatttgttgttaaaaggactttcgattttatattataagaataaaaaataaggttccaccaaaatccggcggagtataaaggagagtaccaaagagggggatgcagatcattgaaaaagaacaagtacgaaattgatatgtgtaacgggacgatcatggacaagctgatttcattttccttcccactgatgttgacaagtattttgcagttgatgttcaatgctgtggatattattgttgtggggaggttcagtggaagccagtctctggcggcagtgggttctacgacggccctcatcaatatttttacgaatctgtttatcggcatttcccttggagccaacgtgcttgcggcccgctactatgcggccggacgagacaaggagatgtcagaggccgtccatacggcgatctttctggcgctgatcagtggtcttatcatggctgtggtaggcgtcggcgcctcccggtttgctttgacgctgatgggaacgccggacgacgtgatcgatctgtccgtcctctatatgcggatttacttcatggggatgccatttttcatgctgtataattacggggcggcaattttacgggcggtgggagatacgaagcgcccactgttttatctgattgcggcaggacttgccaatgtcgtactggatctgcttcttgtcattgtgatccccatgaatgtggcaggagtggcggtaggaacagtggcatctcagatggtgtcctgtattctggtgcttcgatgtctgtaccggacagagggaagctatcagctccgcttctccagactgaccatcaaatcggagcatttaaaaatgatctttcaggtgggagttccggcgggcatccagagtacggttattaacttttccaatgcgctgctgcagtcctcggtcaattcttttggatcgacggctatggcgggctatacggcggccaataatattatcggattcttgtactctgcagtcaatgcggttactcaggcgtgcatgagctttacgagccagaactacagtgtcggtaagccaaagcggatggatcgggtgcttgtgaactgtattatcctgacggtcagcgtctcggcggctatgggaatcggagcctatgcttttggagggcagcttttgaagatttatacctcggaggctgacgtaatccggtgcggcttggaagtgctttccatcaccactgtgccgtattttctttgcgggattatggatcttttccctggagctatgcggggaatggggcactccggagtaccgatgatcctttccgtgattggaacggtaggaacgagaatcgtatgggtttatctgttatttccgcaccacagatccctgtattttctgtttatttcctatccggcgtcctggattcttacgatcatcatgcaagcagtctgcttttattttgtgcggaaacagtgcagaatggagatgcatattcttggcggcgagtaagagaaagggctgatacgaaaacagatacataggaagtataaaaaagctcctttcgggatgatggcttttttccagtctctcgaagaggagcttctattatgagatcttaggaaggatctgtagtggtcttgatattgttcccatattttcggaagatgtaccgaagcatcagaatcgcgcagacgccaagaatcaactcggctgtaaactgtgcataagcgagtccgtaaagtgggaagatggcgtttaaaatcagcagcgcggggatttccagcaccagtttgcgcatcactgcgaaaagcagagcatattttccgaatccaagggactggaacacaccgactgtcagaaagtccagactgaggaaagccagtccaagactgaagccccgtagaaatctgcttccgtaagcgatgatggattcatttttcataaacaggctgatcagttcacctgaaccgatatagtaaagcaaggtgacgacagccagggccgggacaaccagcttaatagcaaagagaatcgacgctttcatgcgttttcgatccccggaggcaaaattgtagctgactaacggcatgatcccctgagagaatcccatggacacctgcattggcaccatgtagattttgtaggagattcccatagcagctactgcgtcggcgccgtacgcggaggtgaaattgttgagaattgtcatcccggttacgttgagcaaattctggatggaggctggtatgccaacgccgcatacttccatgacaatctcctttttgatccggaatttccgcggattgatacagacaaacgtatttccacgtttcacatataggaggacgaagaaatacagacaggcaacacagttggataaaaaagtagcgcatccggcgcccgcagcccccataccaagtccccacggcataatgaaaatcggatccagaatcatattcaggaaacagccgctcatcgttccaatgctggcgtgcagagcagctccttccgagcggacaaggtacgccatcacgacatttaagatagccggtgcagctccaaggaaaacggtccagaagagatagccctgcgtggcgctcctggttgtggcgtccgcaccgatcagggacaggagcggattctgcagcaaacagcacaatattccgaagagtacgccgcagatgagcgaacagtaaaatccaaaagcagagcttaacgatacaacctcgtagtctttccggccaagagcgcggctcatcatgctggacgtaccgacgccgaaaagattattgacggcgttgaaagcaagcagaaccggggcagcaagagagactgctgcgttttccaccggctgattcagcatccccacaaaataggtgtccgccatgttgtagagaaccatgacgagagaacttaaaatcatcgggatggaaagctttgcaacggccgacggaatggacgccctctcaaacaattctattttcttatcatcgtgcatctgaaaatccctcctattctgtcggaagccacaaaaaagcggcagatcaccgaattcgtaattgtgcacaatacttttagtatagcacaaaatcggccggaaggggagaaaaaatcccttggaagatgatcgggaagtatcgacttcgactcctttctgtgatatcattatgtttatgcaacgatagaatagaaaggggtattctcgtggaagatacgtctgaaaatacaagactttccaatcagatttgtcttggtctggtcgcccacgtagattcggggaaaacgacgttggctgaaagtattttatttcaaagcggacgcatccgcaccatggggagggtggatcacaaagatgcgtttctggatacctatgagctggaaaagagcagaggaatcacgattttttccaagcaggcgcagacgaatatcggagagaagcaggtgactcttttggatacaccgggtcatgcggatttctcggcggaaatggagcggacgctccaggtgctggactatgcggtgcttgtgatcagcggaccggacggcgtacagggtcaggtgcgcacactttggacattgctggaccggtaccggattccggtctttctttttgtaaacaaaatggatcagccggggacggaccgggcgaagattcttcggggactgaaagaagagctggatgaacggtgcgtggactttggaagtgatcaggacaaggacctctttttggaaaacatcgcggtatgcgaggactcgcttctggagagttatctggagaccggagagattgaggaggagacggtacggattcttgttcgtgagagaaaactgtttccatgctgttttgggtccgcactgaaaatgcagggcgtcgaagaatttctcggggttcttgacacatacatggcgataccgcggtatccggagaaattcggggcgaaggtctataagatcgcaagagatcagacaggaatccggctgtcctatatgaaaatcacgggagggacgttacgtgtcaaagatgttctttccgggcagcaaaaggattatcctgataagatttgggaggagaaagttcatcagatccggatttattccggatctgcgtttcagagtgtggaggaaactggggcaggaagtatctgtgccattgcaggtcttgattctacatggtccggtgagggaattggtgtcgaaccggatgctcaggtgccaatactggagccggtgctttcttatcaggtactctttccggatggagaggacctccacctcatgcttttgaaactgagagagattgaggaggaagtgccggagcttcatattgtatggaatgaacaaacggaagaaattcacgtccaggtcatgggagaagtacagattgagattttgcagaacatgatttcagagcggttcggcgtccgcacggaattcagttccggaagtattgtatataaggaaacaatcacaaagagagtggaaggcatcggccatttcgagccactgcgccattatgcggaggtccatctgattctggagccgggggagcggggaagcgggctggtactggagaatcaatgcagcgatgacatgctggataaaaactggcagcgcctgattatgacccatctggcggaacggaaacatccgggcgttttgaccggatcggagatcacagatttgaaagtgatattggcggccgggagggcgcatataaagcacacggaaggtggtgacttccggcaggcaacgtaccgggcggtgcgtcagggactgatgaaagcagaaagtattcttctggaaccggtgtacgattttgtcctggaagtgcctcaggaaaatgtgggccgtgcaatgacagatatccagaagatgggcggtacatttacaccgccggaacagagcattgaccagacaatcctgagggggagtgttcctgtatccgaggttcaggactaccagatggaagtggtagcatacacaaaaggtcagggtcggatgtcctgtacactgcgggggtatgaaccatgtcacaatagcgaggagattgtagaggccacaggataccgtgccaagaacgattcgaacaatccggccggatcaatattttgctcccacggtacagggttctatgtggaatgggacgaggtcgaaaaacacatgcatgtggaacgtgttctgaaagaagaaaagccggaagtaaaaacggaaacaacaccaagatcttatacgctgacttccagttatgggtggggagatgaaaaagagctggaagaaatttttaagcggacttatgggtccgggcaggagcggaaatacgggtaccagaagcagaggacggctgctttggcaccgaaaacagtttcagccagaaaaaaggaggagtcagaagaatatctcctggtggatgggtacaatattatctttgcgtgggaggaactaaaagagctctcaaaggtgaatattcaggcggccagggacaaactgatggatatactcagcaattaccaagggtataaaaagcagacgctgatccttgtttttgacgcatacaaagtggaggggcagatgggtgaagtacagaaataccacaatatttatgtcgtctacacgaaagaggcggagactgcggatcagtatatcgaaaagacagtacataagatcggcaggacgcatcaggtgacggttgcaacttcggatggtctggaacagattattatcatgggtgcgggggcaaggagattgtcagcaaaagggctgaaagaggacattgagcaggcgaacatcgatatccgggaaaattatctgggacagtacgagcggaaagggaaaacgtacctttttgaccagctttccgaggagatgactgatttcatggaagaaattcgaaaaggacgcaaacagttccagggtttcaaaaaatagtcaaaaaagagaaaaaggactgaaccaattaagaaaatggttcagtctttttagtttacggtaaactgtgcagtaagagtaaatgaggaaaactttgcaaatactaaagaaaaaccacagtaagggaggaaccgatttatggaaaaaagcgtgacagggagatcgctgagacagtttcagacttttttgattcaagaagagaagagtccggcaactgtccaaaagtatatgcgggaattacagaggcttaccgtatttttagatggtatgaagatttccaaacagaagatacttgaataccgggaaagactggtggaaatatatcagcctaagaccgtcaataccaagctgtcagcagtcaatgcgtacctcgaattttccgggctttcagcctgtaccgtaaaacttctgaaaattcagcggcaggcatttgcggatgaggaaaaagaactgtcagaacaggaatatcgtcgtcttttacaggcggcaaaacgtaggtcgaatcatcgtctgtactatgtgattcttactattggagggactggaatccgggtaagcgaattgaaatttattacagtggaggcattgaaaaacaggaaagtacagattcatttaaaggggaaagaccgtaccattttgctcccccaaaaactgcggaaaaagctgaatcagtatgtaaaaacacagtctatccatcaggggccggtatttcagaccagaagcggaaaaccattggacaggagcaacatctgtcacgagatgaaggagatctgccaggaggcggacgtggatcgaaaaaaagtctttcctcacaatctacggcatctgttcgcccggtgcttttatgcggtggagaaaaatctggcgcttctggcagatattctcggacactcttcgattgaaacgacacggatttatgtagcggagggggctagaaaacatgaacgaatcctgaaaaagatgcacttaataatctgaaaataccacagaatggttatttttgcggtagaaaatagataccacagaatggttattccgtggtaaaaaaatacataatgagacattcttatctagcatgtttcattttaatattataaacgtaagaagtcaatagtttttttgcatacaaagaagcccgtttaaattttaagaaagcgggcctttttacctgtacgcttttttttaaagaaagaagggtgaatcgtcagattcagaaggacaaaacaagggaaaagcccttgttttcttgttgttttgggtctgttaccacggaataaccattctgtggtatggcggacgcataaaaaaagcaggtgggatggcaagtgaaggaaatgataagatgtctggtttgcagaccagaaaaagtaacttttggaatgaaagaatttctgatctgggaaagagacctggatgagaaactgatgtgccgcacgattccttatgacactatggtgcttgcctatccggaagcgtacgacgaaaagaccggagagatgacagcgccggagattcaggagattaccggaagtatgaaggggaatttaattatctgggacagacagcgcacgatgtttcgggttgagcttttcgactacgaggaggacgtagggagcatctttatgcggctggcggatcagattccctttgcatttctgggatctacaccctggatgcagattcaggatgatcaggactttgcggaaatgctgaggatgatttctttatataagaatttgaattcacaatgttatgactgaatcgtcctttatcttatatatgcggatgcggcagaaactatgatacaaacaaagatagcggattgaaaatccgggaaaaggagtggatgcctatgaaactgaaggacgggctgattctgcgggaagtggcggggcagtttgtagtggtgcctacgggaaagagagtgcaggaagtgacatccattgtatacatctcttcttcgggcgcatacctttgggattacatgaaagaccatgaatttcaaaaagaagatcttgtaaagaagattctggaacattacaccggggtgaccggagaacaggcggcggttgatattgagaaatttttgaagacgcttgccgacaacaacattttagatgatggaaaaattcgggggcaggtttttgtaaaaatgccgaaaggaaccgggaaagatggggtatgagtttgaaccggcctgtagcagaatggaatggctggatcctttctacaaggcagtctgggaaaaagcctttgtggatgctattccgatttccggaacctttgaattgactcccaggtgtaatttccgctgtcggatgtgctatgttcatctggaaccgtcggaaatcccgaaatatgggaaagaattgacggccagggaatggatccgtatagcaaaaggagccaaagaggccgggacgacatggctttgcattaccggcggggagccgctgatgcatccggaattcgagacgatctggagagaattgtcgcagatgggattttttattactcttcaaacaaatgcgtccatgatcgacggaaagtttgaaaaattgttggaagtctttcctccccggcaagtcaagatcaccctctacggcaccaacaatgatgtttacgagcaggtctgccggattcccggcgggtttacgaaggtagatagggggattcagaggctaaaagagatgaggattccgatccagcttgtcagtaccattattcggcagaatgaggacgacgtgaaacggatggcgttctatgcctattgcaatcagcttccgtggacaatgacggcgggagtcaaatcctcagttcgaggtgctgaaaatgaagcagggggtgtccgtattcaagaaaggctggacgaacaaaaaaagaaagagattcaatatttgctgaagaacaggcctgttgagattgaacgaaaaccatgtacctattgtaaagattaccggataggctactggattacatggaacggagaaatacggttttgcagctttatgaatgaaccgcatatcaagataagagagcaggcatttcgggaggcgtgggaaaagctgatccggtacgaagaagaattggactggccggaagaatgtaagacctgcaaggcacagaaaggatgtttcaaatgtgccgggatgttgaatgcggaatgtggaagtccgcataaggtgacggaagagttttgcgacagagtaaaaagatggcttgatgaagggaaaggagaatggaggatatgacacagacagtatatgtaccagtggaagcatcgggtgtaaatacttatgcagtaaatataccatcgggtgctgatacaacaagcggatattatctcagctataatgttgggggtgaaaattcaggatttacgggcattagttggtatttagataaacctggaaacccgttttcgggatttcaaggaataagtaatgagcaagacataatcgaatattacgagagcaaccaaaatttgaatgccgtattttcaacgtggatcaatcgagttggcgaggttgctgtcagtgatttttgcaatgatttgatgcatggtgaagcatacagtaatggatgtataacaatggctcgctagcggcaaacaatatggaagtaaagtataagattattgaaataacatttgtttcacaatttagaatccattcattggatgagaaatttatatcagaaagtgagcagaatatagattttctaattaaggagtttgatgaggaagattcgggaagtttattcaggaaatataaaatacagcctaaaggccagtacataattacctatgaaaaagaaatagccattgttgataaggaatggaagacagtacagtgtctgccccaaaattatcaagaatttggagaccgtttcaagttttgtgtaaactcgaaaaaactgatataagatatgtcattagttactccgggcagagctgattccttaaagtggaaagcacagtggtggataggaaagcaggatggaatgtggacttatatgtggttttgaaggtacaggaagatgtatctgaataatcctccttagctcagtcggtagagcatgcggctgttaaccgcagtgtcgttggttcaagtccaacagggggagtttcctttatataggaagaaaaaggctccgtggtcaagcggttaagacatcgccctttcacggcggtaacacgggttcgattcccgtcggagtcacttcttgggtgagtttaacttaagaaaagatgccaacgtggctcaattggcagagcagctgatttgtaatcagcaggttatcggttcgagtccgatcgttggcttgttcctttagaggggacattaagattgtggacctttagctcagctggttagagcaatcggctcataaccgatcggtcccgggttcgagtccctgaaggtccactttaattaataaaggtaaatatttggcccggtggctcagttggttagagcgccgccctgtcacggcggaggtcgtgggttcgagtcccatccgggtcgcttataattgatataattgtatatgtatttggggtcttagctcagctgggagagcatctgccttacaagcagagggtcataggttcgagccctataggccccattcacacgtttgtgtgagaaatgccgcagtggcggaacaggcagacgcacaggacttaaaatcctgcgggacttatactcccgtaccggttcgattccggtctgcggcagtacttaaaagtgagagaaacattgaatttatagcgtttctcttctttttttgcttccaaaagtttgaacacctttgaacactttatgaggaaatccccagtttttgaaaagcaaagcggtcattcttcctcttgttgacgttccgtaaatagtgaagtgtggttgccgtttcgctatgtcccattaaataacttaaggttgtgagattgtttccgtcaaaggcagttgaggcattgtagaaacggattttatgactggaatggtaaggaacgccagcttctttgcaatacttctttaaacgacgattgaagctgtttgttgtcatgatttctccgttgggttcaaagatatacactccatgcggatttaattctctggctttctgaagaatcttgattgcttcatcagtcaaaaactgtttgcggaaaccatgagaggtatttcctttcatctggttgactacctttacttctcttttggaaaaggttaaatcatcattcaatatccgctcgcaggtagcttgtctgtgcagatagaccattctgttttcatagtcaatatcttcccagcggattgcttttgtttccccgatacggataaacagataaaaggatagttgtatcgcaagggaataaggttctgtgatacagctaagataatgcagcagcttatgtgtatcgtcacaggaaaatacgttgtcactttgtacttccacaggcttgtaggtaaactgcttgaaattcacatcagaaacgggattgtgggagatgatttcttcctcaatggcataactcatgattccatttaagacagaacgggcgttgctgattctcttgtgggtatgctgtcgttcttttgtggcttctctgaaaaagcggataagggtaatcggtttgatttctcctatcttcattttggcaagagccgtgtctttgaaaaatctgttccattcagaaacatactcttgaatcgtttttgcctttacggaagtgtaatctcttttgtataaaagccattccctatatagttcttccagtgtgatattctcacggttttcgattttttgcttctcaatataaaacctgatgatttctttttcaaggttctctttactcttcctcttaatcggacggcggttgttgggtttggtgtcatctggtaaataggtacgccagcttttttcagattccgagtaataaatttcatatttgtgattctccaagattttcttatttgccataatttcaaaatctttgaagacttcatctgctgtcatattagcacaagcggctaatgtgttcaataacgtaatatcggaagatgtaacagggttattcatcagaatccccccttacacccgtagtttcttttttgattttgatgtaggtaacactgctgtcctttaaataagaaccagtagctaaaaaggattttgtatcatatatctgccgtgtgtactctttctgaaagatgatattttcgttctgtaattcgtgaatcatatcatcagtcagcatgagtcttgtttctttcggcattttcagattttgtgacttgaaaaaagcctttttcttatgctcctttacatcaaggtctttcccaaaatatttgctgagatagcgaccacggttctccttgctgtctacatcaatacggtttatcttaataaatccatgcgaccataaatcctgtaatttttcttttgctatgtacggaaaatcaaagaaaataacatggtagtggattgctccacgtttctgtttctcccacgttgcaatatattttaatgtctggattttggtatggtataaagaataatttaatcgctggataaaatacttaaattctttgttggttacggtaatatcttgaatattctctttgaatgtcagcgttacaaatttggttctgttattgaaattacaatccacgatacgggcaatctcccaacgtgtctgttcatagtgcttctgtttgcgtttcaggctgtcatattgcttatgagccgacatctcatcaaaggttttacgtttgcttgttttctctaaatctgctttttctgttgcatgactgaaaataggattctcatagatatatacttctttggtggtaggagtttcaatgattttcgtattgtatacaaaacattcctttgctttgctcacgaaatccacctcgtatcctattttgtaatgtgttttcttcctgttttcggaagatgttgttttatatatcaagtctagtcagaagaaatatctgccccttccaagtcagacagccagcacctaagacgttgtccggcactgcctgtctgacaggaaagaacctatttcattccggctatcttgatattatttgcttctgctttgacagaaagacgtccgttatagagactcgcccatgtatgtaatccctcaaacatgacagggacttgccctttctgttccagttcttcattggaaatcagcggactggacgtttttacacctactttgactttttcaaatttcagctttggaaagagaacggtatagtagaagccgagcttttcttttgtagaaaaatctacccagtcggaaacttctacaagctggaactgttcttccagtttgttcggatttaaaatgaaatcacttcctcgaatcatagtatcacctccttttgaaatatctaaaaatcagatattaagataatcatataataaaccaaaccaaatgaaatgtcaatagaaaatatctgaatatccgataaaaagattgacaaggggaaattgatgaaatataatgtgcttagaaaggaggacgctcaacatgaacaaaatcaaagaattgcggaaagaaaagaatatcacggttgcagaactggcaaaagaactggggatttcacagagtatgctgacaaactacgaaaacggaaatggaacgccaagagatgaatctatctgggaaaagctgtcacagatatttggagtgagtaaaagccatgttatgggattgactacggatattgaaacggcaaataagaaaaagtcgttgaaagtggtggtggatatgtcacagcctgtttctgtccagccgaagaaccagaccgaccttgacgtgctgatgaaactggatttaatagacagtgatgatatggaagaagtgtcggagttcctcgacaaactcttagcaaaagagaaatatgaggggcggagagaatcaaatatgaagtatgttgccgaataggaatgatttctaagccgtccgcttgcccagccgacccgccgccctgttaggaaccgtcgctctgggcaccctgcgggacgctggttagcagaaaaacacgaacaagggaatatggacggtagactatgcttaaagtcggtacagtgcggaaaagggtatgtggagatgtgaaagtcctacatacctttttgcttgtatgctttataaaattagcttatactgtatagtagttgagtaaattggaatttttaggagtgagaatagtatatggacagttggtttactgttgaacaaatagactgcaatacatttgctatcagcgaatataagcattgggaagaaacgcatagttatcttctatgtggagaggaaagagccgttctgattgatacaggtttgggtatttccaatatccgaaaaattgtagataccttaacggaactacctattatggtaattaccactcatgttcattgggatcacatcggtggacacaaatattttaagtttatcgcagtccatgaagcagaaaaagaatggctatcggtcaaatttcctattcctttgcaggtagtaaaacatagtcttatgtgtaagccatgcaatttccctttagattttaatatagaccattatcagatttttcaaggtgtcccacaaatgcttttatatgacggagatagcattgacttaggaaaacggaaattggtagttattcacactcccggtcattctcccggacattgttgtttctatgaagcggatagaaaatatttgtattccggcgatttgatatatagcggttgccttgatgctttctatccctcaacaaatccacaagaattttggaagtctgttagaaaaattcaatctttagagataagtcgaatttttccgggacatcatcatttatctattccagtcactataattgacaagatagagggagcttttcatagtttgtcaaataaaggaaaattaaaacaagggaatggtgtatttagctatgaggattttcaaattcatatttgaaatgcaaatcccagtttgtgagagaaaaacgtttgaacactttttgaacaccgcagacgtgatgaagtcctcaaagcccctttctatcagtatttgtgattgcttaaaatggttcgattccggtctgcggcagtaggtaaaagtgagagaaacgttgaatttacggcgtttctcttctttttatgggttgtgaacctgttgagctcgcgaagcgtgcgaaatataaaccacccgctatgcgagcaatgtcgtcaacctaagatatatcccaaaataaaaaatgtctaaaaccacttgacaaaatgctcaaaaaatgttgcatcgcattgattacattttcaatgggaggtgtttttatgaatacaaaacttttaacgtccatcttacaatcttccaatgagcttatcacatcggtagatttcctgacaaggcatcgtatcggtaatgcttttacacgttcgggaaaacttcctttctccaacctgatttactttgtattccagtcggttcataaatccattcccataaactattcccggtttttagacaattttccatctgagattcctccatttgtatcaaaacaggcggtttcaaaggcaagacaggggatttctcataaagcatttcttgaattattccatctttctgtaaagcagttctatttgaggccagcagatttacgcacatggaataacttccatatttacgctgttgacggaagcacaatacagattccagaatcaaaagagaattataaggtgtttgggggcaatccaaacaagacagaaatagtgacaccccttgcttccgcatccgttctttatgatgtgttgaatgatattctggttgacgtttctcttcatccttatcgttacaacgaacgagattcggacaaatcccacgtggattttctgcccgggtttccaaacagcgtcatactttttgacaagggctacccttccgaggacatgtttcgctatctaaactccaaaggaatcctgtttgttatgcgtgtgccaaaaacatttaagaaagctatggcagaacagaaagacgctttgtttacatatcctgcttcccgtaataaagaatcccttactttaaggtgtattcactttttactggaagacggaagcaccgaatatctggtgacaaatctgatgcctgaacagatggtcgagcagaattttccagatttataccgtctgcgctggggagttgaaagcaaatacagggagcttaagaaccggcttgaagtagaagcctttaacagcattaaacctgtcagtatccggcaggagttctttgcagcgatgtatttatctaatctggctgcagtcataaaattggaggcggattcaaggatcattgtgtctgccggcaacaggcgtgattaccagtctaaccgcagctatatattaaaccgaataaaaagctgtatcatacgtcttttgcggtcgtccttgcctctatgcaatgagatgatatgccgaatagtggaagaatcttccaaaatatgttcgattatccgccctgacagaaagtttggcagataccgaaaacatacacgccggagatattacagccatatgaaaagctgtatttaaataagaccacgaccagaaggatataggactgtttaaaaatcagcagtcctatttgtgatgcgattatttgcaacaatagacttaattacttggtatcatgcttttttttgaagcaaatactcttaagttgacgacattgcctgtttgacgggcagtcatgattttgcttcaaaaagtttgaacacctttgaacactttatgaggaaatccccagtttttgaaaagcaaaacggtcattcttcctcttgttgacgttccgtaaatagtgaagtgtggttgacgtttcgctatgccccattaaatttcctttcatctggttgactacctttacttctcttttagaaaaggttaaatcatcattcaatgtccgctcacaggtagcctgtctatgcagatatacgattctgttgtcagagtcaatatcttcccagcggattgcttttgtttccccgatacggataaacagataaaagaataattgtattgcaagagagtagggttctgttatacagctaagataatgcaatagtttgtgcgtgtcctcacgggaaaatacgttgtcactctgtacttccacgggcttgtaggtaaattgtttgaaatttacatcagaaacgggattatgggagagaatctcctcctcaatcgcataactcataattccgttcaagacagaacgggcattgctgattctcttgtgggtatgctgtcggtcttttgtaacctctctgaaaaagcggataagggtaatcggtctgatttcctctatcttcatcttggcaagagccgtgcctttaaaaaacttattccattcagaaacatactcttgaattgtctttgcctttacagaagtgtaatctcttttgtataagagccattctgtatataactcttccagtgtgatattctcacggttttctattctctgcttttcaatataaaatctgacgatttctttttcaaggttctctttactcttccttttaatcggacggaagttgttgggtttggtgtcatctggtaaataggtacgccagcttttttcagattccaagtaataaatttcatatttgtgattctccaagatttttttatttgccatagtttcaaaatctttgaagacttcatctggggtcatattagcacaagcggctaatgtgtgcaataacgtaatatcagaagatgtaacagggttattcatcagaaagcccccttacacgatgtttcttgtatgctttataaaaattagcttatactgtatagtagttaagtaaattataagttgtataggaggttcaaccaatgaaaaaggtaataggaatcatcagttgtgctataaaattcttattagttgtattttgaaatatcaatgataataaaagaaataactgccgtctctatcatttgaggagcagatggcactacctctgtgtatattgcaggaaagttaaatagtgatttaattaatttccttatgcttacaggaataatattatttgcaatagttataattgcctatttgataaagaaaacattaaattgggattgactgagcagagcaagggatacttcttgaacgaaagctcaagaaggtgaggaactcaataacttggaatttgagagggaattgaatatgaataaggaatggtctgatcttaataaaacaatgcaagcacaaataagaaagaatgatacttataaaatgggtattgatactttatttagtttacgaagtcagttaatggaaaccttagtatctttcaaagaggaattaagcagagaagcttttaactcaattcccttcataaatgctgatggttatcatagtaagacgattgcttattctatttggcatattttccgcatagaagatatagttgtgcatacagtgataaatgaagatgaacaagtattttttgcaggcaattatcaagagcgtatcaattcgcctatcattactacaggaaatgaactcattaaacagcagattgcagacttttcaaaacagcttaatctgaaagaattatattcatatatttttgaagtacgggaaaacactgagaaaatgcttgaacggttatcttatgatgaattgaaaagaaaaatacccgaagaaagaaaaggatacttagaatcgttgaatgtagtaaacgacaatgaaaaagcaatttggctgattgattattggtgtaataaagatattcgtggactaattcaaatgccgttttcaagacattggattatgcacacagaagcctgtttgcgtataaagaacaagatacattcataagcaaaaattttagtttgtaagagacaaatgtttgaataccgcagacgtgatgcggtctccaaagcctctttctttcagtatttttgatgatttaaaacggttcgattccggtctgcggcagtaggaatgaaaacaagggatatacaaaaggcggaaaagtccaggaaaatcaaggctttccgcattttttccctttgtaggggatagacaggggaatgaagcaatcttgccccttttttgcccctcgccctaaatgatcttgagatcacgaatctggtcattatcacgctctttgagcttttgggtgatatgcagatagatccgttttgttactcggctattctcatggctaaggcgccgggagatcgcatcaatagtcactccactggccaatagaaaggatgcgtgcgtgtgccggagcgaatgtgcggtaagtttacggccaagtacctcaagcgttatctttttgagatatttgttgtaagtggcatagttgaagcagatacccttgtcattgcaaaaaaacaagttggaccggtagccgagccaaatgctttccttgcggataaaaatattgatcttccggcaaagctgaaatagctctggctgcatatacacatcacggattgagcaaaatgatttaggtgtagtaatgattttgttgttgccgtcaaaggtcttggtaacatggatgcattgattttcaaaatccacatcttttcggtccagggaaacagcttcgccgatccgaaggccggaaagcacaagaaactcagtaaatagcttccagcgctcatgatccattgtcttaaggacagcctctaactcatagtcctccatgtacttatcctggatcttgactttgtgaggatcgtctggaaacggttttaatttacgaagaaaattcacatctttgatataatcgttctcaaatccccagttaagcagagtcatgagccggacacggcgctcattcagtcggctgttatgctcgccggatgcaataaaacggtttttgatgtagctggcagtgagattgttgaccagagtatcttctccaagtatttccaaaaaagcctgacactgatagaaatctctgcgataggtcgacagcttcacggttcgttttttataagcgaggtattcggatacaagtttttttaaagtgattttctccggagcagcaggtgcggcctgacgctccgcaataattccggccagcatctctgcagcctgtttccgggcagatgcattgttcttctccagagtgacggaggctttcttttcttttccggtcaagtaatccttgtaccgttcaacaaatttgtagttaccagattttgttttttcaacccacataacatcatctcctttgtattttgggtataaaaataacagccagcaagaacatgtgttccgcttgcggtggctgcccgaagatgatacaatatttttgtcttaattcggagtatcatctacggatatattccatttccgctctggtgttggcgcgccggagcggtttttatgtacaaatttgagcacataagttgacaattatagagcatactagtattatataagtaagataacttgtgaaggaaaaacactgggtccccaaatggggtaggtacattgtactgagcattcccatgtgcctggggttatcttattttttattttgcttttttaactttccacaaatttctgcggtttcttttctatttcggttactatgaaatcaacaaattgttgtgagtaggtaaaagaatgctgatttccaatcacatgctcgtaagagtattttgggttttgctttatgttgtaaaagtctataataagatttaaaacatattgtgtaaaaccggaatcatatccgagttttatgtttttcttttttaatctttcctgtacagaagttataacatttttataagaatacttatgagtatccgatggggcttttagatctttaacaatagacaccttggcatctgtatgtgaatctattcccacaacaaaatcagcttcactctttttcttagtgatataaagattctgccggatattaatagcgaacttgtcagaattatattctgcacttaatacgtcgatttcgtttgattgttttattaacttttctgctatttcaggagaatattttatcttaatttcttcattagacaatggttcatatcgtgcagagagtgtaagaaagttctgcgcaatatattttgttatgtccacgttatgaaaacgctgtatttcattcacaaaatttaacacacatgcttgaaacaggggagcatatttgacttcataatcttctataatataatgagtgctgatatttctaagctcaatgattttctccaagttcaatcggatgcgagtgtttttgtcggtgtagacctttttcactacattttccacgcttaaagttctgtctggcttatcagaaaagtaaatgttttcgccgcgctttaacaaggttgctttcagcattaattcccaagcattcacaataaaaaatgaaaaaccttcaattctatatttgatggtaggtttattatagatttcaagtcccataataaacgcttctatggatttttctgttaaacgttttggttaagtcttccataatactcaccttcttccttttgtgaatgccccggacaatgtgatatgataccctcaagtaggacactaaaatataaaaacctacttgggggtattttatgtccagaaaaagcaaaatcaaagcaacagaaaaagtaaagattgtagaacgttatctaaatggggaacttagccaaaagggggccgcaaaagcttgcggtgtaaataaacggagtatccaagattggattaggatttataaaacagatggcccaacgggattactggaacaaaagaaaatcaggcaatatccaaaagccttgaagatacaggcggtacaggactatctttctggtctggggtcaatggatgagatatgtctaaagtacgggatatggcaacatcctcaacttttgaattggataaagatgtataatgaaggtaaagaattaaaagaacttaccggaggtacatctatgaagaaagccagaaaaacaacgccgcaggaacggttgatgattgtgaaagactgcttagatcacgataggaactttggagcgatggctattaaatacaactgttcttatcaataggtacgaaattgggtggataagtatgaaaaaatgggaagtgcaggcttggaagacaggaggggcaaacgcgccggatcgcagccaagtcgtacaccagaagaagagttaagggatcgtatagctgaactcgagcgaaaaaacagagacttacaaatggagaatgacctattaaaaaaagtaagggaactggaaagggggaatcgctttctttaacacataaattatacgaatatctggcaataaaagaattatccgagacaaaaggttattcaatcaaaaagatgtgcgaatatctgggagtaactcgatccgcttattatcattggctgaaacatccaaaaagtgataatgaacttgaaaatgagcatatagcagaaaagattaaggaaatctatcaattacatccagatatgggatatcgccgtataagggacgaattggatgtgaattatggaatcccagtaaacgataagcgtgtttttcgtatctatcagaagataggagtacagtcttccatcaaatggagaccaaaaagttgcataaaagcagacacgaatcctgctcacatcgcagaaaatttcctgaatcgggattttcatgctgataaaccaaatgacaaatggctgacagatgtaacggagtttaaatattataaaggtatcgagacacgcaaaatttatttaagtgccattttggatttgtatgacagaaggattgtatcatttaaaatcagtgatcataatgataataccctggttatggatacttttgatgaagcagtgaaaaaagagccagaagcccacccattgcttcattcggatcgcgcatttcagtatacaagtcaagtattttataatcgactgaagaagcatcacatgaaacagagtatgtccagagttgcgcactgtattgataatggaccgatggaaggattctgggggattttaaaaagagagatgtattacgggaaccgatttacagatcgggaagaactaattcaaaagataagagactatattgattattataacaatcgacgcctgcaacgcaagttgcacgtaatgacaccgatgaaatttcatgaatctgcaacctatgcaacgtaaaattgccgtcagccgaaatcatcggctgacggaaggaaaatttgttatttttcattgtcctcttgacgggtagcacaccaagacgggtggtgctgattttttttgtttcaaaaaattgatgaagctggatttgatagacagcgttgctatggaagaagtggcgggattcctcgataaacttttatccaaagacaaatatgaggggcgaagagaagcaaatatgaagtatgttgtagaataggaatgacttccaagccgcccgcttgccctattaggaatcgtcactctgggcaccctgtgggacgttggttaggggaaaacatgaacaagggaatatggaaagcaaactgtgcttagagttgatacagtgtggaaaagggcatgtggagatgtgaatagttctgcatatttttttcttgtgtgttgaatatatttagattatactgaatagtagttaagcaaacgggaagttattcaaacagattttttatataatccctcttgcgttttgactaagttaaatgattgaagccataaatttaaggagagtagttatggaagtgagaataaatacactaacgccagaactgtttctggatttatacacgtcagttggatgggaagcgccatgtattggacaagttgaaaaggctttaagcaatactattgcaacatttacagcttatgataaaaaacagccggtaggaatggtgcggttgattggagatgggggtatgtcattctatatcaaggattttgttgtaataccagactatcaggcaatgggagtaggaacgttgctaattgaatgtttagaaaattatataagagaaaatatcaatcctgattgggctgtcagtttagaattgattagtacgaaagatgcactcttgttttacaagaaaaagggatttgaagaaagaccttgtgaatgggatgggccgggaatgttcaaaatgattagatgaatcccagtttttattggaacaacgtttgaacaccgcagacgtgatgaagtctccaaagccccgttctttcagtatttttgatgatttaaaatggttcgattccggtctgtggcagtaggcaaaagtgagagaaacgttgaagttgcagcgtttctcttatttttaattataattgttccatcttacagtagtataatggagtaaaaagatgtgcagatatcagaaagtcggtatatctttttttaattgcgtaactaaagaaatagaattatactgtgggaaatagaagttaagaaaaggtttgtttgccggaggttggagatgatgaagcgaatggcttactcggtacagttttaaaaatgggctgcagattgtatctgggatcattgttggcttatattatagaatagtgcctgattggaataagaggagacaagttttatgaatagagcaaatttgggaaacatctggaaacaggaagaagaaatcgcatatatccatggctgagatttttcgcatattcagggcagatatgaagaagaaaatgatttaccgtgggattatgaaaagattgtcaggcggtattaaaaaaagacttaaatatgatggattaaatttaatttttaatagacatggagattttgatgacaagaagttgtttcggatattacatccaaatgaggtatttattacagaacaggtaggcggagataataatagggatttagtggaaatggtattacctaaaacgtgtaaaccatttccacatctgaatttggaagaacagcgtcaaaattttgaagatgccggatttgaaattgttcgggcagaaggccaggattttctgacattttctcttgtgtagagtacataaagaattgaaataattatgctcttttattcgcatgagataatgagacaataggaggggaaattttagtatgaactatcaagagaattcgttgacttacgaagagtattgtagccttagagaaagtgtagggtggaagaattttcctaaaatacaaatacaagaaatattaaaaagaagtttatatacagttgtggcctataagaattatcaagcagttggaatgggaagattgataggcgacggattatattatgtgatagtggatgtagtagtacggccagactgtcagcaaatggggatcggcagtaaaatatttgaaatgatagtggaatatgtagataggcaaacgccggttggtgggcgcaccagtgtccaattaattgccgaaaaggggaaagaggccttttatgagaaaagaggatttcaaattattcctcacaaattttgtggttctggaatgagaaaaatcatacataaataatgggaatgtaaggaaaatcttagaaatgatttatattttatccataaatcggtcatattcatctgatataattcgtatcgtaaaaagggatatcgacgatatttagatgaacagagtggtgataaggaggtatttttttgttgacaggtttcttaaagaccgaaaaagacggaaatgtttgtgtattatcagctctgaacgggggagaaaaaagtgtgatcaagccgggacagtatctatatattaatgttgcgagaggctggattccggtggagctgaaatattcggagagagaaaatcgcctgtattttgagcatcttcccaacctttccgtaaacggaagaatggcactggtaaaataagaaaaacggattagattcttgtatgaaatcagtcagtcatggtacaatatagtgaagacattgctggttttgacaagatagcttcaaaagctaaaaatagcagccggctgatgaacagccggctgctcgttgtttgtacaggagaagcatagtgagagttcatgcaaacaccctctgaagagaagatttcagatatgatcatcatagcaggggtcaggcagaagaaagggcagggcaattgtggaagaaaaaagaaagaaaaagatcttatctccagacgatattaaggaagaagagcaaagactcctggagagcgccgaggatgaggagattcaggataatgaggcggatttcgcagactcgaaagtgtatggcgacagcgcaggggattcgatccggatgtatttgaatgagatcaaccggattccgcttttgactccggaggaggagcaggagcttgcgaagaggatcgctgatggggatctggaggccaagaagataatggaggagtctaatctccgtcttgtagtttcgattgccaagaagtatgtgggacacggacttcagttgatggatctaattcaggaaggcaatatcggactgatgagagcagtggagaagtttgattatcagaagggctaccggttttcgacctatgcatcctggtggatcaagcagtccatgatccgcgcgattgcagaccagtcgaggacgattcgggtgccggtacatatgtctgaaaatatcacaaaggtacgcagggcatccaaggaactgatgacagagcttggaagagaggctaatccggcggagattgccgcgaagctaggggataaatccgaggaggaggtacgggagattctggcctatgccaggacgccggtttctctggaaacgccggtgggcgaggaagaggacagcagccttgagaatttcatcgaggacagcaatgcccagcagccggaaacggcggcaatttccacgattgtcggagaagagatcgaggagctcttgaatattttgccggagcgcgagcaggaagttatccgtatgaggtttggtatgaacggggagcgtgtttacacattagaggaagtcggacagaagatgaatttgacaagagagcggatccggcagattgaaagcaaggcgcttcgacgactgagacagagaatgagggagaaaggacagaacgaatattttgaataaatatttcgactgatcaggtgaacaaatatgaagaatgacttgttaacgattggcggattgactgtgcacggatacggtctgatgattgggatcggatttattgcagcctatctgatgaccgaataccgtgcaagaaaatataaaatgaatacagatattgtattctctctgtttttgagctccgtggtcttcgggcttctgggagcaaagctaatgtattatctgacaatcctggatcagattatcaaagatccgggcgtcatcgtggaccagagggatggatttgtggtctacggagggatcatcggaggtgttattgccggatatgtggtttgcagagtgaagaaggagcgtttctggagatattttgatctgattgctccggcgattgcgttggcccagggattcggccggatcgggtgtctgctggcaggatgctgctatgggaaagagacagattcttcttgttctatcacattccactcatctgatattgcgcccaatggcgtggctcttataccgacacagatttattctagtattctggattttctgaactgtattgtactctgtttgattgcaaggagggcaaagaaagagaagacagtcgccggatgttacctgcttttttacagtaccgggcgttttattctggagtttttccggggagacctggagaggggaagtgtcggagttatatcgacttcacagtttatttctatttttatttttgctattggagcagtgatgcttcttataggaagaaagcagccgattgtgcaggaaatgaaggattattaaagaatagagttccggtttctctgtaaaaagaggaggcggagcttttttgtccccaatttttgaaaacatgccaaaaggaagtcaaaaaaggcgaagaattatgggcaaaattcattaaaaggattaaaaatttttttgttatgtggtagaataggaggcataagattgagagaggagagcttaaaagatggcagataaaagtttaaatttcttagtttgttgtgcgaatggggccggttccagtttgatggctcagatgtcgctggaaaaggtactgaaaaaacatgggattgaggctgcgacggttcatcattgtccgatttccgagggcaaagagactgcgctgcagtatgatgttgtgatctgcgcgcagcattttgcggatatgtttgcggaggcagagaagaaaggtgcgaaactggttgccctgcaaaatgtgatttctgcttctgagattgagacgaaactgacagaggcgggaattatcaaatagaataggagcggagtatttctgaaaaggtagagtaagtattataaaaggagtatagtgatatggagaagtttgcggggaaatcaattttccgaaaggtagctatcgggaaaatatttttctatgagaaaaacacggcagtggtaaagagaacgaagatcgaggatgcgaagacagagctggatcgttttgaacatgccaaggagacggcgaaagcgcagttacagaatctgtatgagaaggcgctgcaagaggtaggagattccggagccgcgatttttgaagtgcatatgatgatgattgatgatctggattataatggatccatccagaatatgatcgaatcccaaagtgtcaatgcggaatatgcggtagccatgaccggggataatttttccactatgttcgcagagatggacgacgactatatgaaggcgcgtgcggcggacgtgaaggatatttccgagcgtcttgtttcggttttgtccggtgtggacaatgatatgggtaatctggatgagccggtgatcctggtggccgatgatctggcgccgagcgagacggttcagatggacaagtcaaagcttcttgcattcgttacagagcatgggtcttccaattcccatacggcgattctggcaagaacgatgaatatcccggcgattattggtgtcccgatcaagaaggaatggcacggacacatggcgatcgtggatggttatgcaggatgcgtcattatcgatccggacgaggaagaaatcgaaaaagcacagaaggcagttgcggaagaggaggagaagcagaaacttctcagggctttaaagggtgaaaagacgatcacaaaggacggaaaggagattcatctgtacgccaatatcggaagcgtagcggatacagcggcagttctgatgaatgacgcggaaggaatcggactgttccggagcgagttcttatatctggaatctgacacatatccgacggagaatgagcagttcaatgcatacaagaccgtagcagagaatatggctggaaagaaagttattatccggacattggacatcggtgctgacaagcaggtggactattttgaactggataaggaagaaaatccggcgcttggatatcgtgcaatccgtatttgtctgacgagacaggaggtcttcaagacgcagcttcgggcgttgctccgcgcaagtgcgtatggcaatatttccatcatgttcccgatgattattgctgttgatgaggtcaggaagatcaaacagattctgaaagaagtaaaggacgaattaagagagcaggggattccgttcaaggatgtagagatcggtgtgatgatcgagacaccggctgctgtcatggtaagcgaacagcttgcgcaggaggtggatttcttcagtataggaacgaacgacctgacgcagtacacactggcgattgaccgccagaatccgaagctcgacgaattctacgatgcacaccacccggctgtgctgaagttgatccagatgacgatcgagaatggccataagggaggcgcatgggtaggtatctgcggagagcttggagcggatctcgagctgacggagacattcctgagaatgggcgtcgatgagctttccgtttctccgacgttcattcttccgataagaaacagagtcagaagtctggatctgtcacaggaatcatagagacaaatcatacggcagaaagtacacgatatatcatggatgaaattaaaacagcagctttccacaaatgtggggctgctgttttgatgtaacagaaatcttttctgttttgccgggaatcaaccgacagtgaaagaacgatatgggaaaagaatgttacttgctcatatgacgtttttcttccaggtagtcgcgggcggcctgcacctgttcagtacttaaatacagctttcccttgactgtgctgacaagttcttccgcttttagtttctggatcgtacgatttaatgtcttaacggagataccgatttcctcgtaaagctgttggcgggttttcgggatgatgccggattgttttttcacttcgttgagatatttgacgagataatccaggagcagatactggggcgggtagaatagtttactgccccggttgtatgaggaacggtagagcttataggctactttccgggaaacgagcctcagaaaatggatgtcatgtgcaatccagttttcaaagtcttttctggaaaaatagagtactgtacattcggttagcgtctcaatcgtcacggaagtacgttctttttctgccaggatggtgacttccccgacaaagtcgataggatcgttccgctctatcatgtagacattaccattttcaaactcgttgattacacggtgggagccctcgcagacaataccgaagtattctaaaagctcatccttttgatggatgatggttccttccgggtaggtgtgaatccagtaacgttcgttcaactcctgcggcataaatttcaggtagttattaagctccggcacacgggcgcaaagttcttccagcgtcattcctgttccttctttcgacatttttttacagtatactacaaaaaagtatggaaaacagctcatttgtcctttttttggaaaaaaagtctatgctaagatgacggagtagaaaatttaggaggagaaagagagatgaagaaggagacatttcaatatccgtcattaaaagcaagaataaaaaatgaataccgtatcatttttgctgcatttgtgtttattttgattgcggacgctattgggcagatcgaaattccgctgggaccgggaaaactgattttattccctattttttatgccctgattttgggtgtgctgtccgggcctgagatactgaagttttttaaaaagaaagaagtgaaggcggcgtcaaaactggtgatcgttgcaatctgcccgtttatcgcaaagcttggaatcaatgcgggcgccagcattgaggtcgtactgtcggcgggaccggcacttttgttgcaggagatcggaaacttaggaaccattttcctggcgctgccgtttgcgcttctgctggggctcaaaagagaggccatcggcgcgactcattccatcaatcgggagtccaatcttgccctggttacggatttgttcgggccggattctccggaggcaagaggaagtctttccatctacgtcgtcggcggtatggtcgggacgatctattttgggttccttgccacgatgacggcggcagcgggaatcttccatccatatgcgcttggaatggcatccggagtcggagcgggaattctgatggcaagtgcgacggcaagtatcacggctgtctatccggatatggcggcggagctttccgcacttgcaagtacaagtgagacgctgtccgggctgacaggaatctatgtggcaatttttgtagggattcccctttgcagaaaattatatacctggctggagccaaaatttgccaaattaagacacgagccaagtgaagtattgatgagaaaagaagaaaaagtggaggaagcatagatgagatatatcgagtgggctgtcatgtttgttgttgcaggtcttggaatcggccttgcgaattttgttggattcgatgtgaattttatggattcgcttccgggtattctgattcttcttgccatctctcttgtggcagtagtgatcagtaagcttgtgccattaaagcttccgattattgcatattgttcgattttgggtcttttagtggcctgtccgatttctccggtgagagagggggtcatcgaaaagaccgatatattgtttgagcggttccatgggaaggggaatctgaaagtattctattctcttcgctctctgatttcctgctcagaagatctgatagagagagcggcaatacgggccagggaaaaagggacgacattgcaggctcatatgaatgagtatccgggagagattaccccgtttttgtcccgtttccagaaacgtccgtatgaatttctggatgccaaagggattctgggaccgtggtttttgggagctcacagtctgctcttatcggaggaggaaaaggatctcatgtgcgacagacaagtgcgaatttgtcattgcccgttcagtaactgcggaaaagctgtgccggagacgccgtcgcttctcagaaggcagattccggtggggatcgggacggatggggcggcacatggaggattaagtctctggaatgagatgcgaatcttccgttccgtgatgaacgtgacttgtggagtaccgcttgcggagccggctattatgcctgcaaagaccattctggatatggtgacgaaaggaggagcggcctgccttggggaagagacgggaacgatcgctgttggaaagagggcggatctgattggaattgacttggacgcaccgcatctgtggattcacggggtgatttccaacactcttgtggagagcgtcagtgcagaagatgtaaagaacgtgattgtaggcggtaggatgttgatgaaaaaccgtgaaattttgacgcttgatgaagagaaaatacgccgggaagcccaggcatttactaaaggagtataaagatggagtatctgattattatagtgggaaactttctgattggaggcatgatcgggttgaccgggatcgcaggatttctcctgccgatgctgtattccggatttttggggatgtcgtctgcgcaggggcttgcactgagctttttcgcctccctgatttccggaattttaggcgcctacaactactaccgtgccaagaacctgaatctgaagcctgcggtctggatcagtatgggaagcttcgtaggcgctgtgggaggtgtacggctcaatcttctcatggaggagggaattgttaagaagatactgtatctggttgtactgctttctggaatctctattttacttcggaaagatgaaaaggaagagagaaaaaaaagccggccaggacaaaagatgcctctttggttctggctggcttttggagcggtgactggtctgatctgcgccctctccggggcaggtggtccaatcctggtcatgccgctgctcgttgtctttggcgttccggtcaagacagcggtaggaatcgccctttttaattctatttttattgcggtcccatccagtatcggatatgccatgggatgcaggcctggggatcttcttttgcttctgcctttaagccttgtaagccacgggattggcgtctggattggaagcaaaaatacctccctgattcgtccggatgtgctgaaaaaaggtgtagctgtattttccgtcctgctggccattctgaaattgattaccggttagcggatccacggtagcggttcaggcaggcgtggatctcctgaagccttggaagagcgtagcctcccggaatataagaatgtctgaaaaacccggaatacccgttttgctgtaactcttcatagagcatagcggcgatttccgggattgtttttttcccgtcagagtagtgatcttttgcgtagccaagaaggaaagcaagggtcgccgtctgctcgtaatctttgatctgttccacatagcgcaggtcaacctcttcttttccaatcgagaatacatccttggagcgctggcggattttgccgtcccggcggtccgcctgttttttagatggccatgcgaagatccgttttgccgaaggcatccgaaatggagccggggaagatggagagagcgggtaatcccggcagagctctttcacctttgatgtaatatcgacaggatggtagcagtccatctggatcaccgtgtccgcaatgtgaaagaaagcccccgaacttccggctaccaggatcgtggagattccggctttctcatagagatctccggcacgctccagaaacggagtgatgggttctttttcccggctgatgacctgctgcataaacgtatcccggaccataaaattagtggcggaggtgtcctcgtcaatgagaaagagacggctgtttgcctccatgctctccacggttccggcggcctgagacgtactgccgctggcatccagagtggaaaatgtcgtggtatcccgcttgtttggaagatcattgatgaagagggagatatccacgtttttgacaacacgtccatcctcggaacggagcttgacggcggtggcgtcggtgatgacatattccctgccgtctcctgcgatgtgtgggtagactccggtttccagtgctttcagaagggtggattttccgtggtagccgcctcctacgataagggtgatgccccgtggaattcccataccgcttagttttcctctgtgcggaagcgtgagagtcacccgaagcgagtccggcgaggagaagacgacgctgtctttcatcgggagatcggatacgccgctctggcgaggcagaacagacccatccgcaacgaaagccgcaagatctaggcgggaaagttcctgccggatgaaagtctgatcctcggcaagctcaaaggtctccgtcagctttttcttgtcgcacgtccgatagagacaggagtgctccacacaggacggaaggaagtcaaagaggatcttctcaagctctgtagcgttaatggttcgcccgttggcaggaaaacctacatggaaacggaaaatcagtactccgtcgcctggtgtgcggatctcgcaggctgtccgggagaggatttcctgaccgcagccgcttacggaaaggagaccgctctttccggaacctttcgcctggaaactgaacttgtggatctgggaggcaaagcgccgcagtaaatgatcctcaaaggcggtcttcgtttcgggtgtctggtacagatcttttgggaaccggtggacggaaaacgggatctggatcgtcacgtgagatggagaagcaaaagggtctccctgcacatgatcaatggagagcgtatagtctccaaattcatacagtcctttcaacgatttgtatgcaggatagcttttccggtgtatggataatagttgtttccttaaatctgatgcatgtttcataaattcaaaactcctttctgtttgattatagcaaaaaaaagaggtttgtggcataataaaaacgaaacagttcagccgtgtgacggcggatccggctgttatggctgaattgttatataaaacagaaagccctctatcagggagagcaaaagaaaggagtctggagaaatgttcatcagaaagcatgtatatttttacggtagagtacagggagtcggatttcgctggcgggcggtgcagacggcaaaggacctgcatctgaccggatgggtgaggaatatgtataatggcaatgtagagatggaagtgcagggaaacagtgtgatgatagagcgtctgtttcaggaattacattctgaccggtttatccgtatcgaaaaaaccgagatgatccagattccgacggtagacgatgaggctgatttttccgtgcggggctaaaaggagagacgatgagaaaatgttatacgacagatcggatgatggtaaggttggcggatcctgagtttgccgatatgacggcggagttttttttcagaaaccgtaagatgctggaacgttatgaagagcggcgtccggaggagtttttttgcccggagtttcaaaagatttggctggacatccaaagggagaacgcaagaaaaggggagtggtactcctactatctctttgaaaaaagaaaaccccacacggtgatcgggaccttatctttgagccggatccagtatgggaacctctgctccggggtgcttggctaccgcatcggcggagaacggcagggggaaggcttcggaaccgaagccgcgaaagaggggacgaggatcggatttgaggagctgtcacttcaccggatggaagcggatgtgatgacggaaaatagggcgtctttacggattctggagaaatgcggatacaaaaaagagggatatttccgggaatatttcaggatcaatggtaagtgggaggatcatattcatatggctgccatacgtgcttgagaaagaacaaaaaatcacgatttttctgttgtaaatcgaagtgagattgctataatagaaaagagactggcagatgaaaaagagaggaaggaatatggggaaacaaggaattgtaaaagagggagtattgattacctgcgcgatgctcatcgtttctgcggcggtatacttttttctggtgccgagcaagatcgtcgtgggaagtatctccggccttgcgatggtacttgcagagcttctgcatatgcagatgtcgacgatcacatttatcttaaatgttgtactgctgatggcaggttttctctttatcgggaaggaatttggggcaaagacgatttacacgtcacttctactcccggtatttttgtggatttttgagcggctctttccggttacggaatcgctcacggggaacagtgtttacgatctggtctcgtacatactgattattgccctgggacaggcaattttatttaatgtcaacgcttcgtcaggaggtctggacgtcatcgcaaagatcatcagcaagtataccagagcggatattggaaaggcggtcaccattgcgggcatggttacggcagtgacttccatcctcgtctacgatattgggacgctggtggtcagcgtgctcgggacttacgcaaacggacttgccgtcgattactttatcgatggatttaaccggagaaagaaaatctgtattctctcagatgaatatgagaggatacagaaatatattatgcaggagctgatccggggcgtgacgatctatacagccaagggcggctatgacgggaaggaaaagacggagcttgtcacgattatgacgccaagcgaatacaaacagcttttgaactatcttcaccggtcagagatccaggcatttgtgacagtttacaatgtcagtcaggtgatcggcaagtggaatattaatggagacagaagaaaaaagtcggaataaaggaaaggaagagtgaatgatgcagtgtactagaaaagtaacagatggaatttattgggttggagcaaatgacagaagactggcgaaatttgaaaatatgttcccgattccaagaggagtgtcctacaattcatatgtaatccttgacgggaagacagcactgatggacacagcggacagctctgtggcagagaggtttatggaaaatgttgctgctgtgctggacggacgggcacttgactatctggtggtacaacacatggagccggatcactgtgccaatatcgcagccatcattgagaagtatccagacgttaccgttgtggggaacgccaagacgatgcagatgatcggacagttttactccggaacaaaggcaaagcatacacttctcgtaaaggaaggggataagctgcctttaggtgagcatgagcttacgtttgtgactgcgccgatggtacattggccggaagttatggtaagctatgagtccaaagagaagattctcttttccgcagacgcatttggtacttttggtgctttaaacggcgcactctttgatgacgagatcttctttgatgccatctggatggaggatgcaagaagatattatacgaatattgtcgggaaatatggccctcaggtgcaggcgcttttgaaaaaggcggcagggattgagatcgatatgatctgtccgcttcacggaccggtatggagaagtgatctggatctgcttctcgagaaatatgatcagtggagccgatatgaggcggaagaggacggggtacttcttgtctatggatctatgtatggcaataccgagaatgcagttgaagtgctggcagcagagatggtggagcagggcatgaagaatatcaaggtctatgatgcgtctgtgacggattgttcttacctgattgcggaggcattccgttatagccgaatcctggtggcagccccgacttacaacgcagggctgtttgcgccggtagagcatttcctcaatgatatgaaagcactcaatctccagaataaaaagatcgcccttgtggagaatggtagctgggctccgatggcgggcaaacacatgaaagctatcgtagagaccatgaaaaacatggagattgtagagccggtactgacactgaaatccgcaatccagccggcacagacagaagacgtcaagaaactggtagaagaactgctgaaataggtgcaggatggagcggagattccccggtaaaactggttcgcagaattacaggtaacagttcagccatgcacaaagtcacaaaaattcgggttcaatcttatttgaaaaggaaggtttttgtgtactttgtatatggcattctactgtgagtgaggatttattcgtgtatgtggcggtataatccccatagcggagaatctaggttgtcatgtgaattgttacaatttcagggcagaaattgaaaaaagtagttgacaaaacaaaggttatcgtgtaaaattatttttgttgctaaggacaatagatacctgaagcgacaagacaattttacattgtgtgggtttagctcagctggatagagcgtttggctacggaccaaaaggtcgggggttcgaatcctctaacccacgtacaaaaggagttctgatggttcagaactctttttttcgtctgtggaaatttcttctaccggcagagtgcatcagcactctgccggtatttctttttttaaaacaccgcatgttcttgatataacggcgaggtttcttttgtcgcacagtttcgcctctgtacctttttccggttttcttccatcttatattaatagaagaatgaaaaacgggcaatgtaatggtgaggaggaatcaacatgaatgaaaaaatgatattggatataacagaggaaaaaacttgggaatttgagacgtatctgtacgagcgggagaatgccggggcaacaatcagcaaataccggacagatctgaaatgctttttacaatttcttggagaggacaaaatcgtggataaagcacggcttctttcctataaggaatggctgatcgaacgctatgcggtcagcagtgtcaattccatgctggcagcgctgaatcagtttctagagttttgtggatacgggcagatgaaagttaggcgagtgaagacccagaagaatcttttccgtcaggaggagaaggagctgaccgcaaaagagtacagaaggcttgtacgcgcggcccgatccgcagggaaaattcagcttgcgcttatcatggaggcgattgcggtcacaggagtcagggtcagtgagctacgttattttactgtggagcaggtgaaacggggaagaattgaagtgaggaataaaggaaagtatagaagaatctttcttacgacggatattcggaaaaagcttttgtgcttcgcgaagttccgaaagatcattaaaggctgcatcttcgtgaccaatagtggaaaacccaaagatcggagcaacctctggagtgagatgaaagcgttgaaagaaaaggcaggagtaaaaggtgagaagatctttccccataatttgcgccacttatttgcgagagtatattatcagacaacaaaagatatggcagggctggcggacgtcctggggcacagcagtctgaatgtgacgaggatctatacctccagcaccggggagatctaccagcggcagttagagcggcttacgatcctacagatctgagtactgtatgggaaaataaaaaaccacataatgtcaattatgtggtatcacaatttcagtcttacttatcaggccatatcattctcaatttcataacctattctagtataaatgtccggctgcgtcaatcaaaattctttaaaaatttgcatcataaaaagactgacaacttacatagtaggaaaacgaactcattggacagcgatatttagcttcaacgggaatgaatacgggaaaacgctgaaaacagaacaccacataattgacattatgtggtttttgcactctggaaaaagaaaatatcagaatacaggagcaaaaaagaacggaaagaccagaatttttacagagaacaggaaggagaggtaagaggatatgaaagggaagctgaaatgtgtggtagcgctgatcttatgtatgtccctgatgttcgggaccagtctgtcgacactggcagatacggaaaccacaggacaagcgaccacgcagacagaagagacggcaagcgtggaaggcgcgaaggaaacaaaagaggcggacggacaggaggaaagtcaggagcaacaacagacagagcaggatgaaactttacctaataaacaaaaaatccaatctaaggttaagcaatatccagaatatatcaatagtcagcaggtaggacaagagtatggacatccgcaccaatcggtaattggaacagactttagaatagaaaatggaaaatacatctgtatatggacggcggaccatgaaccaccagcatacggaccaagaaatcagcattatgtaaaaatattagatcagactaaagacatttatgctattagtgcaatccgttgcgatttgtatggaggcgagacgccgggagaaacctactaccctgtatattacatgaatgcagaaacggacaaatcatatctaaaagatccgatgtttgaaagtgtaaaggaaaaccagaagccaacaaaggtttctgatatcgaggaaacaaataatttgacaaatggttattggacattaggatcatatgacggaaagattgaaacagagagtgatttggataaggttacagatacgaatagaaaggtaaagcctgaagaacagaagattgttacccaaacaatatttatctggcatgaggaagagcagaaaatatcagattttacgtttcagaagatggatgataaaacaaagcaaccgatgcaaggggtggaatttcaattatttgcttctaaagaagacggagaactgggagagctgataatagaagtaaaatctgatgaaagtggaaaggtaattttcaaaaacctgaaagctggcacttattatataaaggaaacagctccaaatggatatatgggatccgcaaacttacaatggaaacttgttattgatgagacaggaacaggtaaattgtacaatgtaaatggtacagagattaaagcatttggggataatgagtatcccattattgaaaactattccgttcagcagcatttgcggacacaaaaaactgcctccttggtagattggaaaaaaagaatttataagattgatttatatgcatggcatgacgttcaggtagatatcccggcaaatattgtgctgacagtggatatatcgggatctatgccttggatgttagaaacaccaagtggcggaaaggttacaattcaagatattagagatggaaatgactataatttacagactggtggaaatggctgggatgactacaagtattattatttcgattcaggagaaaaagaatataaaccaattggattcaactcaaaagataacaactggcatattattaaatccaaaagtaatggagagaaaacgtgggatactactgcgataaaaaagggaacagaagtttatattagagggaaagatgatcgtacaaaattaaatgctatgttagattctatagatgcgtttgtgaataagctaaaagcttcatcaccaaatagcaacatcgcaatcgttccttttgcaggagaggtttattatgcagacacatctcttcagaatatttcttcatatgacttgtctgattttaaaagaaagttagtattacatggggatacgaaccagggagcaggaatttcagcggcgacgaaattgttaaaaaactctaataatacaaacccaaactatattgtactgtttactgatggagcacagacaaagggagaggcagaagatgctgctggtgccgcaaaacaggctggaatttcgatttttgcagcagggctttataacgaaaaaaatgcggcaacgcaggaagaagtattgaaaaaatgggcgtccaaagatccggaagatggatcatcatatgcatatacagcgacaactccggagggattggaagcagcatttagtgaaatctttgcggagattaatttatcaatcaagaatacagtgataaaagatattgtcgataccaatagatttgatattgtgacagactcgagtggggaaatcttggctacgaatggagcatacggacacaacgggaaattaaatggaagtacaataacatgggatggggtttcaatcggatattcggattccgaagaaaatgcatggcatcagacaatttacatcaaggcgaaaaattcatacatcggtggtaacggggtgacaaccaatttgcaaggatctggcgtgacagcatcaggtgtgtcggtatcttttccgcagccaaaagttaatgtattaattcgatacacattgcaggatgcagaggataccatttttgccggtgagaagttggaaaaatatttcgatagtaaaaaggatcaacttatcactccgaagtatgacgataaatcttttgatatgacgagcgatgtgaatattacggtatcttactattatgatgcggagtgtacgcagccagtagaagcaaatggaaaagcagatggaagtgaagatgcattacgagctcaatatccggcggaagatactacttattatgtagaggttcaggtaacgcctactggaactgcggttagtggaatggagtctaatccggatgattgtttaaccgcgattaatacagcaaagaatggtgctgtatgtactactgctaaatatgagataaaggtagtaaccggatccattcaaattacaaaggaattggaagaaaacgctaaaaaagatgcaacatttacttttgaaattaccaaaacggacgataacacaaaatggtaccgggcaatctacattcgggcaggagcaaagagtgggaaagctgagattttaagcggactgccaaaaggacagtacaaaatccgtgaactatcaacaattagatataaaaatactaaggtagaacaggatcagaatacaagttgtccgattcaaattgagggaactaatacaaacgtctatatcggatgtgagagtgcaaagtatccatcaatgacagatttatcagcaaaacatgtaggacttacttttacaaatcaatacaacgaaaatgggaaactagttgattccgacgcatttttgaatagagcggtaaaagatgagaatggatggcattttgagcaggttccgatttcaaaagaagtattgaaagacaaaaacagagcgtagccgagggggattagagaaatatgaaaaatcgaaatgaaaaacaatttgttctttctatcctgcttgtcgtggtaatccttggtatcgggactactatcgcattatctactgcaatttcgaaacctgttgtaaatagttttcaggctgcggatcatgaaacgaatatcaaagaggaaatagacgggctgaaaaaaacgatacaggtaaaaaatacagcggataaaagtgcggcgtttgtcagggtacggattgtgatctctcctgcaaaggcacttggacaagatgattacatgattcaaggtcaaaattggactgaaaatgcggagcaggatggattctattattatactaagacacttttgccaggtgaagaaacagaggatcttatttttgaagtaaaaaataaagaagaggtgacagaatccttcgacgtccttgtatacgaagagtcctgcgtggcgacatcaacaagcgatagcttgactatagagcagataaaagaggcatttaaaaaagcagatggaaagactgatcagaatcagggataaaggagaagatcaatgttgaaaaggatttgcggaatcttatctggtatcatcgtgttggcgctggcggtgctagcagggctcctgattatcccaaaactgatggggtatgaagagatggcggtgttaacgggaagtatggaaccaaagtatccagtgggaacactgatttttgtcaaagaggcggatccgaacacactggaagtcggggatgtgatcacctatcacttggatagtaataccgtcgtaacccaccggattgtagagatcgacaaggaggggcagacagtgacgaccaaaggcgatgcgaataatgctaatgatgggaatcctgttccgtattccgaaattgttgggaaagaacattttaagattccatatcttggatatgtcagcatgaatatcaagacaccgaaaggaatcttggcagtctgtgtggtattgattgctatgatcctgctgacttttctgccggaaatcttttcgccggaggaagaggaggccctgaaaacaaaacgaagaaaaagaagaaaatgattcttataacgggaaaccgtatgggaataaaaaaagaaaacaaaaaggtaaaggagagttaagagtatgaagaaaaaagttgtagcggctatgatgtcagttgcattggtggcagcggtaggaattggaggaacactagcatatctgtcttccacatcaaatgatgtaaagaatacgtttacagtagggaaaggatttgacgatacagacggtcaggctttaattgttgatgaatggctgttggatggaacagcagatgatcgtacacaggaagatcagacatacgaaaacatgacgcctggttatgtagaaaaaaaagatccaacagctagattaaaggccggatctgtagaatcatatgtttttttacgtgtaactggagttaatgccttggaaaatatcatgaaatcaaatgcagatggagacgatgtacaggcatacgacattagtggatgggatacgacatattggatgaaagttgcggatgaaaacggaactttattgcacgagactaagttgggcgtagaaggtgatggatattatgtcgcaaatacaggcaacactgtaaatctggaagatactactccagagggagagtacattcagttaggaaatccgatttttcagaccgttactatgaatccagatgtagctgaagtgacagaagatcttggtacaaaaattggagagataacagtaaaagcatgtgcggtacagtacagtgaagatcagatggatagctggaaagacgcatttgactcagctaagtggaattaaaaataagatcaacaggaggaagacctatgaaaagaaacaaagttgcaaaactaatggtagttgcagcgttggtaggagcaataggaataggtggttctctggcacttttaacagctcggtcagaggcagtaacgaatacattcacagtcggaaaaggattgcatgatacagatattacactggatgaagcccaggttaatgaaaatggagaagaaatagacggagcagaaagagtccaaaagaatatatatcaaaatcttgagcaaggtgatggattagataaggatcctacagtaacaataaaagatacggcagccgactgctatgtttttgtattggtggatggattaaaaaagaatacatccatttacgacgtggatataaaaaagagctggatgaaagtagaaggtattcctaaggaaattcaggatcaagttccagataccgctgatttatatgtgtataaggcagagcaatcaactccgacagtagttagaggagggcttacagccgaaaaaggaattgtttttgacggagttaagattaaagatgacgcagccttattcgaacctgtaatagaagaaggtacgattactggatataaggctaaaaacctggatcagattattgtaaaagcttgtgctgtacaggcaactaataatagttatgagaatgcgttgaagttagttacatttgctaataccagtaattaagaggagaaaaaacatgaacaaaaaacgagttacggctcttgcgggttcccttagcctggtggctgtcatcgggatcggagcgactttagcttattttaccgatcagacagacacccagaacgtaatcaacatggggcatgtagacatcgatcttgtagagcatgagatcacacaggacgaggatggtaactgggtttatgatgagacgaaaccagtgacatccgaaggactgatttttaccgatgtgtatccaggagaaactgttgccaaggatccaactgtgactctggcagagggttccggggatgcgtatatccgggtaaagatggagatcgatatttctgactctactttgacaccgaacgatgcggctgcactgaaagcaaacattgataaagaaatcgcaaagagcggcaaatggtatgaagcgacggacggatattattactacaataccgcattgacggaagaggattcttccgcagtcctttttgataaagtaacacttccgggcgcggcatggaaaaacaatacggcaagacagagtttccaggtcaaacttgaggcggaagccatccaaagcaaatacttcacaccgcagacaggagacggtatgattaccggatggatcgatgaaactcaagctccgattacagccgaagcctacacggaataagtcggacattgaggaggggattccaatgaaatccaggatctgtagtctggcaggtatcctgctgatggcggcggtcatcctggtatttctgccactgaccgtcccccgcctgtttggataccagatttacggtattctgacagacagcatggaacccaattacccagcaggatgcgtagtttatgtcaaagaaacagacagcgccgggatccgggtgggagatgtcatcacctttcagatggggacggatacggatcttgtgatgacccaccgggtggcagaaattgacgtggaaaagcagcaatttatcaccaagggggatgccaacaggtctgtggacgtcacgcctgtggcgttcgaccgtctgatcggggaggtggtatttcagattccaatgctgggaaatctttcttcctgtctgtatacgggaacaggaatcatggcctgctcaggtctgtttgtgacagtagcagtcctgtggggaatcgcggagaagtttaagttaaaggagagtgcaaagtgaaaagaaaaatcgtactgatgggcgtggcggcagctctcactgcaactgcattgatcggaggctccctggcgtattttcaggcagacgggcaggaagttcagcagcagatgaatacccggacactgagcatcagtctgaaagatgccggatccgggacgctgccagaggagacggtgctgtttgacgacgctatgccgggagcggatcttgagatggagcaccgattggtggtagagaacacaggagataccccggtttacacacgggtaacgcttcagaaagtctggggagagtatgcggatcattcctttaccaaggaatttgacaaggacagttctcttatccggctggagaccggggacgattggtacatcatggagaatacggatgggaacgacgagacgctctatctgtattaccggacgccactggaagagggcggacagaccgcaccgatcttgaaggggcttcgaattgcggagagtatcactaacgagtatgccaataaggggattttcttggatgttcaggtagacgcagttcaggtttccgaatccgagagagcacgccaggacgccattctgacggaatggggtgtgtggccggagtttagcggagcgggggagattatcagcatagaagaatagtggacagaaaagtcaggaggccattatgaagaaaagaatagcaggtctgtgcatgacacttgccctagtgtttggaatgtccatgggagtctatgcggcagacacaccggttgcgacctttgacggaagcggccagattaaatacaattacgactataaggaggatttcggagatgcctttgaaggaatgcttccgggggacgaaagaactcagcagatcatccttcggaatacctcggaaaagccgacggacttctatatggaagtagaagtcatcaaagccctggaggaagcgtccaaagcttcaggggcggcctataccttttctttgacggttacgcaggtaggggtaaatgaaggaataccccaggtgatttacggaggagaaggaagcgggagtgcttggattggcggtcgggacagtgaaaacggactgggggacgtcaacgaggtgctggaggaatacggctccaacggaatcaaggtagccaacctggaccaaggagaggaggcggtcattgctttaagtgtgatgctggacggcattaccgggggtaatacatatcagggcgtggatggaacgattcagtttgcctttcacgcaagttatgacacaaatgcaccggaaaccattactgaaacgatccggggagaagatcaaatcatcaaggagacagtcaaaggagaagaaagggttattgtgcgggacggcggttctcccacagaccgggttaagacaggtgatccggcggtgatcctgccgcttgcggcggcgatggcagtctgcgcggcggtgattgtcgcgctccttagcaggaaaagaaaacagcatgaggaagaatccagatagaaaggcaggaagacgaagatgaaaaggaaaaaactatcaggcatgattgcagtcggctgtctatgcctttttacgggaggatttccggtccgggcggcatcgagcgcatcctatatggtgacgatccgtccgggaagcgtggcacgtttcagcgagtcgtttctgaaccagtaccgggcggcaggagcattggtgacggaaaagacaggaagcattaagatccaaatcccggcgggtggtacgatcccatacttgccggatgcgggggatctggtttacaaggacggaaaagaagggcgttataccatgaatacggactggtatccgaagaatctcacagtaaccgggaatgagagtctggttgtgaaatatgacgcattaaacgatgctgtagagtaccgggtgcgttatgttgatgaccgaagcggcgaggacatcgccacgcctctgatttcccagggaaatgagggggagagctatacgttctatccggagaaagtagcaggatatgcgtgtgacacggagagccgggaattaaagctgtcctccaaagccggggacaatgaagtgacgttccggtatgagagtacggtagaaccgaatgtgaatcaggtcgtgattccgggggagaccatcacggagacggaggttgtacctggtgatacgacgatcatcacagatggcggcacaagggtcacggaagccggaggcagtacatccgagggaaccgacggggcagccatgggagacgagggcacaggtcaaaacgtggttacagccgggggacagactcagggtcaaactgccggagagcaggagaccatcgaggagaatgacgttccaaggggcagacagccggaaaacgatgaaaggggcacgaatagggatactcaggagattgaggcggatgaaacgccgcttagtaacaaagaaggaaaagcagacaaggatctcaagagctatgttattgggggaggagcagtcgtcatccttgcgattgcaggattgttgctttatacaagaaaacacagattgcgataaaagaaaccgggagatgttctaatgggtggagtatctcccggttttattatagcgattttgttataatatgtacgatttcctgtgacggatccccaaaggcagacaccgtcagtctttggtgtacaggtgtgtttttcggtaagtgcttggagagaccccggtcatttttttgaagaccagggagaagtactgtgaggtatcgaatccggtgactgcggcaatattctggatggattcattggtggaggacagcagttgttttgcttttttaattttttcctgtgagatatactcggacaggctggttccggttaactgtttgaacagccgggagatataagtttcattgtaatttacgacccgggagatggtggccaggttgagggagtccgccaggtgctgttcgatgtagagttttattttctggaccagaaggttgtttttgtctgtttttttggagttttgtatctcaaacaggtgccgggaaattgtttccaggtagtgggaggcttctttccaggaggagaaatcatgcaggtagtatagctgatacagagcgattttggaggccagtcgttcttgaagttgatataagtctatatagttcagcaaaatcagagcgacagacatgtagattttaattgcccgaatatcgtgcatacttcgaatgatgatacactcctgacatagttttttgagtgcgcgcgagtattctgcttcaattccctggtagagggagaaagtcagttcctgtagcaggtggtcgatctcagttcggtcgatggtccgcttctgaccggatgtcagaagagaaggttcatcgtccaggatatttactgacgaataaattagcggcgctttggtaacaaaggaatcggcataccgttgtaaagtaaaaaagtgacggtagatctgatcccagggtgaagctgccgggtagaggacaactgtgagccgacgatgcagggtcgtagtgcagtagtcgctgaaatcatttgccagagactccagaaatccggaaacggaacccaagtcgttactttccaacgtaacggggctggacgaatcggaggcggaagaagtaactggtgaaagtacaggttggaaaagccagagcatcgttccgtgttccagatccaacatggaaaaggagagcttattgacgcaaagtcgttgcataagctggagatactccagggtgttcccggagtgaatctgatggctctcccggaaagagcgatgatggatctgggtgtacatcaggtagacaggacgctgcagatccagcgggaatttggaccatgcaatctgcaaggactgttggattttatccatgtgttcccccgagaaaatttctttcaggatcgtttgctccagcaagtgagaaagcagcagagagttctgacttgcggtggacaatagatgcagtttgtccgcctcctgttttatttcatcgacagcagagaagatctctgataaaatgacctcatctttttctgtcttaagaagataacgggagtgaggcagcttgtctgctgcataaatatgctcaaagttatcaaaggcagttagaaaaatgacgcggaagtccgggtcggatgtccggatgcgtgaggccgtctcaataccggaaagtccaggcatcctgatatccagaagtgccagatggattttcatggtttttgaaagttctaaggcttccattccagagtaacatttatagacttcgagatcctcaggagcgtgtgctcctaccaatgcggcgaggtagtttacgatgtaatgctcgtcatctacaattaatagtctcatcatggatgttcccctttctaaatttaccaagtatgatggaaacacgaagtccgccaagcgtggaacgtgatacatggagagaatcgtgggtgttggaaaagataatcagtctgcgttgaatgttcaggattccagacatttccacatttgttccggtgctttggacttctaaaagcgcattggagagattgcacagtttctcatcagtcagttcttctccgttatcttcaatatcgatctgcagcacttcattatccgggtgaaaatgaacctgcaaaagcccgtctttcatcttatttgccagtccgtaattgaaggcgttttccagaatcggctgtaaaatcagctttggtaccgggatgtccgcatagcccgcgggcagttcctcaaaatcaatctggattcgtccggaaaaacgaagcccctgaatgtaggcatagttctgggcgtggcggtattcttccgagagcttaacatggtccatattgtttcttgtcagataccggaaataaactccgagtgcgttggcgacactttgggcgtcctcgatattttcggtttggatcatccgttgaagcataaaaaagctgttgtatagaaaatgcggattgatctgagcctgaagctgtttgagttccgctttctgcaagagtagtttttgagtgtaatccttttcgataagcagctcaagcttttgggccatcttattgaattcctgatacagataggcaaaatccgggctgtggacgttggcgatctggactttaaaatttccggtttccatttctttaaacgcattgatcagatgtgataaaggtcggtgtaccaggcggtaaatttccacaaaaaagatgatgcatgcagcggagatcaacagaataaaaaacatattcagtaacggggtgacccgggtggcgttaagaatgtcgtctgtcggaatcagcctggtatactgaaaggaaagatacggcatttcataggaaaacgcataatagcgagtcccatcgatcgtcataatgggttgccccgtggcatccttagaagcttctatttgttgcagaagcttcttttcttgatctgcggacagggatgtgagggcaaattcatcttccatggtaaaaagatagttttccgcattgtaggacatattattcttgagatactcttgcagatcattgatggacaattcaaaaattacaccataggtggcggaggatgatggcatcaggcagcaaccaaggactggcgttttggtcagcggattttcatagtaagagaatgtacgggattcttgggcggtatttttcagagtttcaaaggtttctgatgtgagagtggagaagctcccttcatcgtagcctttggaattgtacatgattccaagatcaccaaagaaaatatgggctgaggagcaaaagggcagagacagggagacagaggaaagctgctcccgtaagagtcgtacctgtgaagcttcctcataggtggtaaaaccggaatacgcattggagaaccgctgcaggttggactgacccgcaagggtaaaagcggaagcataaatagtatacagagaattatttaaatgtgcgataaaggttgcgttgttggaatcaatagaggaaaggatctgccttttcagcgtctgattgctgaactgaattgtgccaagccagacgatcagcagcggaaatacaagagataaaaacaggatgacgatctttttaagtaaagtatttttgcgtttcatggtgatccactccttatattctgataataactgtagtatatcacatacagaacataatttaagttttaaaacttataatattctgtggtttgtataaaatctattcatgtttgcctaaatgtgtcgataaattataaaaatacaaaataattatatagatcttttactggacggcgaagataatgaggacaatggaatttatagatggaaaggagtaaagcaatgagaaaaagaaaacgagtgttggcagtactgttgacaggatgtatgttgggtactatgatgaccggctgcatgaagcagagcagcgagggtgattcctccaacaagaaaaaagaggcggtgaaagtgccggaggggctctgggacccgtatgaggatacggtgacaatcagtacggtactcccggaaaatgcgggcattcagtttgccgagggagacagctacgacgacaacccatggtaccgggcctatgaggagcggtttaatatcgatgttgtaaatgactgggtaagtaatgattacacgaccaagctgaatcttacaatcgcggataaaagcattccggatgtcttctgcgtggacgcacagcagcttcgccagttaaaagaagcggacatgatctgggatctgacggatattttcgataagtatgcttcggacctgctgaagggctatatggagcaggaaagtgatacgtttgagacggggaagctggacgggaaactgtatggaataccgcagctttcctacggaatcattgaccagccaaatcagatctggatccgcaaagactggaaagaaaagttgaatcttgccgacccgaagtcaatggacgatgtattagagatcgcaaaagcatttcagaaggaatatggcggatatggtctgacagaggaccagaatctggactgctttaagattctggcaccggcatggggtgcgaacccgggaatctggattgaaggagaaaatggtaaattggcttatggatctgtgcagccagaaatgaaagaggcattgcaggcttatgcacagtggtataaggaaggaatcattgatccggaattcacgacaaaagatctggaaaagatgcttcagggggagatcagcagttctgtaggcgtaagcccgtactatcagtattggggatatgatccgggtccgaatgtcgtacagaatctcggcgcagatgctatctttgaaccgtacgagattccttccgcaaacggtggggaagtaaaagcaagtgttacgtttgcaaactatggctatattgtagtgagcaagggatgtaaaaatccggaagcagtcctgaaacttcttaacttctatgcacatgtcatggatgaaggagacgaggaggatgcggattttatcaacgaattgtttggaaatgcctatacgaacattccatatgcactgagagtcattaatccaaataccgattacaaccagtttgtgaaagtatccggggcgctggaaaaaggattggatgaagatccggcggcactggggaaagacggtgtgaaatattccaatagtgtggactttattaaagagggagcttcgaccggagtgggagattacctgcagcagggcggcccgaaagccgcctaccggatttccaaggaaatcattgacaacgagcaatatattaaggatgcaatgtggggaccggcgaccgagacgcttctgagtgcgggaagtacacttgatgatatcctgacagaaggatttacaaagattatcgtaggagaggagagtattgactactttgatactcttgttgacaactgggcgaaagctggcgggacaaaagcgacagaagagatcaatgagacttacggaaacaactaagaaggtggcttatgaaaaaattaaaaagacaatggcagtatcatctgatgttgcttccgggtgtgattttgatctttatttttgcgtatattccgctttatggagtgatcatcgcgtttgaagattacaatccggcacttggatttgcctctccttgggtcgggatgaaacatttccagtacatctttagtcagccggcatttttaagaacaatctggaacacattttttatcgccgtaatgaaactgatagggggcattgtcgtaccggttatttttgcgctgctgcttaatgaactggtgtccaaccggttaaagagaattttccagacactgatttatataccgaactttctttcttgggtcattatggcgggcgtactgatggatattctcgcaaataacggaatcatcaatcagtttctcggatttttcgggatggacgcggtaaatttccttgggaatgcatcggtctttccgtggactatgattgtgacggatatctggaaagggtttggatttggaactgtcgtttatctggcggcgcttacgagcattgatccggggctttacgagtcggcgattctggacggtgctaccaggtggcagcagatccgatacatcacgcttcctctgctgatgccgaccatcattctgatgcttgtgctggcgctgggaaatgtactgaatgcgggatttgatcagatcttcaacctgtattctccgatcgtatatcaaacaggagatattattgatacctatgtataccggcttggtatccagcaggctcagtattctgtcggtgcggctataggcctgttcaaatcggcagtatccgcagtacttgttctgacgtcctatattctggcggataaatgtgcgggatacaagattttttaggaggaaggaaatgcagtataagacaagagcaaacagaatttttcacttcgtaaatattttcattctggcggtcgtctccctcctctgtgttctgccatttatcaatttgttggcgatttctttcagcgacagtgcggcagtagcggcaggaccggtcggatttaccccggttgattttaccttgagcgcatatgaatatgcgctcaaggggggcaaatttatacgggcacttttcatttcttttgagcgcgtgttccttggtgtggggctcaatctgatcctgatggttctcacggcctatccgctctctaagacgaggaaaaaggtggccgggagaaacatttacatggtctatttcgtaattaccatgctggtgtccggtggaatgatcccaacctatctcgtggtgacggggctggggttaaaagatacgatttgggcgctgatccttccgggggcgctcccggtatacaatatggtcattttaatgaattttatgcgtggaattccggaggagatcgaagaggcggccgcaatcgatggagcaagtccattccagatcctgacgcgtgttctgctgccgatcttgaaaccggcgttggcaacggtggggcttttctgtatcgtcacacattggaatgactggttcagtgggatgatctatatgaacaacccggacaactatccgcttcagacatatctgcagtctttgcttcagaattttgaacagttactgcggacgcagagctctcaggatatccaggcgctccttgcacagatggacgcaaggaccgggcgggcagcacagcttttcctcggtgcgattccggtcatggtaatctatccgttcttacagaaatattttaccaaaggacttgtactgggaagtgtgaaaggctaaaattatccaaagaggtgtaagatgagacaggtctatgtaaaagagtacgggattactccgggaaacgacagagcccttttgtggaaggtacggatgatgctggatgagcttcagggtacgatggggatcgagtttgtgtttgagtcaggtacctatcatttttatccggattatgcggtggaaaagactctgtatatttcaaaccatgatgaagatgtaccaaagaggatcgcgtttgattttagtggatggcgcaaggtaaagatccggggagagggagcggtctttctgtttcacacggatattttgccgtttcacctggacaggtgccaagagattctgattgagggaatcaccattgactatgagagaacgggatattccgaaggagagattgtggagctgtctggaaaaagaatggtgcttcggatcgaccggaaagagtatccataccgggtttttcacggggagctctattttgaagaagaaggggcgtatcacccgctgtattatggctgtctggagatggacagaaggagaaatgccccagtctatcaaggaagggatattagttttaacagaccgtatccctcctcctatggagcggtgttccgggaggcaggggagaatttggtagaggtgacgttgacagaggaccagcagtttccggagacgtccagggaaggaaacagaatgattttgcgtcaccatctcaggacacatccctgtttttatattacccgaagtgaaggaatcacactacgggatatcaccatttaccattgcacagggatggcagtgatttcacagtttacaaaggatatcacgatcgagagggtgtgtcttgtcagacatccacaaaaagatcggatctttacggcgacggcagacggatttcatttcgtgtatgcaggcggaaagatccacattaagaactgtgtgctggagaatcaactggacgatccggtcaacattcatggtatctacggaaggatccacaaagtgaccagcaaaagagaagtaatcgtggaattggtagaaggtatgcaaaaaggggtattgctggggacggcaggggattatttcgcagtggttgacaaccgaacaatgttggagcaggagcatgccgtgatcgctgagattacctggatgaattcggattatcaacggattgtttttgcggaagatatggagaatctgattccgggatttgtggtggagaaccagtcctgggttccggatgtgctgattgaggggtgtacgttccgtaataatcgcgcaagaggattgttgctgacaagcgcgggggacgtcctcgtcagggacaacacctttgaaacacctggggcagcaattttgattgagggggactcgaactactggtttgaatccggggcaaccagacatattgttattgagggcaacagattccatcagtgtgcatatgtcagtgcctggggcaaggcgcctattcaggtttcgccaagcgctcttgtctgggagaaggataggaggtatcatcagtatctggaagtacgggggaatgtatttcagtgctgcgatgaccgtcttgtaaatgcggtcaatttaaaaaagctggtatttcttgacaacaagatagaacggacaacggtatttgaaccgataaaagggcaagcattggaacttgacggggtattggaagtggagacagacatcaataaggagcaacagatatgaacatggaacagaaaaaaatcaatattggattaatcggacttggcgcaaggggaacccttttgctgcacgacgttttgctggagcatgaagacgccgtaatctgtgcggtctgtgatgtgtatgaggacagatgcgaaaaggcggcccagtatattcaggaaaaaactggacaaaagccatttcagacaacaaattataaggagatctttgaaaggaaagaggtggatgccgtccttctttgcagttcctgggagtcccatatccacctggctatcgaagcgatggagtgtggcaaggcagtgggatgcgaggtcggaggagcctattccattcgggaatgttggaggcttgtagagacctatgaacaaactaaaacaccgattatgctgatggagaattgctgttatggccgggatgagatgatggccatgcatatggttcaccagggcgtgctgggagaaatcgtacattgtgccggaggctatatgcatgatctgcgccaggaagtggcgtttggaaaagaggaacgccattacaggctgagaaattacattcaccgcaatacggaaaactatccgactcacgagctgggaccgattgcccagatacttgggatcaatcggggcaatcgtatggtttctttaacctccatggcgtcaaaggcagcgggactgcaccattatatagaaaaagaaaaatcagaagatcaagagctgatgcagatggcttttcatcaaggcgacattgtgacgacactcatccaatgtgcgaatggcgagaccatcactttgaaactggatacaactctgccaagatattattccagaggattctatatccaggggacgaaagggttattcaacgaggagaatggatctgttttcctggagggagagcacgaatcttatgattttcaatggaaggagcagtggggaaatattgagagctaccgggaaaaatatgaacatccggtctggagacgctaccaggaagagggaatcaaacgggggcatgacggtatggactggctcgtattctctgatttcgtggaggctgtcagagatagaaagccaatgccgatcgatgtttacgatatggcggcatggatgagtatttcgacgcttgcggaggaatccattcttctcggaagtcagccgatggcaattccggacttcacaaatggagcctggatggtacgaaaataagtaatattctcagttttttcagtggggggacatgttccgatatataggaacacgtcccccgattgttgacatagatactatctatatatagacttcttatagtcaatctctattttacagtaaatttggagtagaagtataatagatatattatgatatgtatttagaacgagaaaggcggaggatacatggagaaaaagcaaagtttctgtgggatttgttcggcaggatgtccgatggacgtctatgtggaagatggaaaggtcgtggagatcgaagggcacacggagaatgggaagagtcggggactttgtgccaagggcgcggcgtcgaagcagtatctatataatgaggagcggattttgtacccgatgaagcgcgtgggagaaaagggaagcgggcagttcgagcggatttcatgggaggaagcgtatggcctgattgcaaagaagttatcagggattcgtaaggagtatggtgcgaagtcggtggtcttctatgcgggttacccgaagtggtaccggccggctcttttgcgttttgccaatgcctttggttcgccgaatttttgtactgaatcgagcacctgtttccaggcatctgccctggcatggaagtctatatatgggaatgggatctgtttcccggatctgccgcatacgaagacgctgcttttgtggacgagtaatcttttccattccaataccccaatggggaaaatgtaccggagccttaagaagcggggagttacgatcattgcggtggatccgagaagtaccgtcaccaccagagaggcggatatccacctgaagattacgccggggacggatggagcgctggcgcttgccatggctcatgtgataatagaagaagagctttacgataaagagtttgtggacaaatacgtttatgggttcgaggaatataagaattatgtgagcacatttactccggaacgagcctgtgagatcaccggggcggatgcagagctgatccgtaaagcagcaaggttgtatgcgtgtaacaagccttcagggattcagttttcagtgtccacgattgtgcatcacatcaacggattccagaattaccgggcggtattcagcctgatcgcgctcacaggcaattatgatgtggagggcggtaatcgtgccatgccggaaccggtctccccgtgcaatgagtttggaaaggtgaagaggtacgatggggaggaggcgatcggggagaaagatttcccgatctggtttgatcttccgtgtcaggaggcccagtgtacaaggatcgcggattatattctggaggaggaaccatacccggtgaaggcggtttttgccatggggctcaaccaccggatgtggccccagccgaatgaactgcaaagggcgcttggcgctctcgatttctacgtcaatgtggagctcttctggtcggagtcgtccaggatggcagatctggtccttccagcctgcacgacttttgagagggaagaagtgaagactctgcgaggcggtatgtttgcactgaatgaacgggtggtggaaccgctcggggagtcgaaaaacgacatcgaaatcataatggagctggcaaaacggataggacttgaagacgaggtactgtcatccgactacgagtcttatatggattatatcctgaaaccttcggggctgacgcttcaggatcttcgagaacatccagagggaatgaaagggaaggtgttgatccctccaaggattcagacgtaccgggaagaaccgtttcacacgaagtccgggaagattgagctgtattctctggcgcttgataaataccgggagagcagagggtatgaaccgcttccggtataccacgatttccgggatcagagggacgtagatcgggaaatgtatcctctgattttaagtaccggggcaagaaagccgcagtttttccatgccagactgtaccggctgtcgtggctgtctgccctggagacgaatccggcggtggagattcatccggaggatgcaaggaagtatgggataaaggacggcgaccgggtacgggtatcctccccggcaggagagatggaagggattgcggtaagctccatcaatgggaatccaggtgttgtctatatctaccatggcaatccaaaaggtgaggcaaacaatctgatccaccggtcgtactttgatccgtataccggatttccggggtacaagagctatttctgtaacatagagaaactggatcaaagggagagaaagagaaaggaagaagcggaggtgacgggagatgatggggcgaatgaaatttaatgccgagcagtgtgtgggatgctatgcgtgccacatggcatgcctggacgcccaccacagtgcgaaagagattcacgccagaagtttccgggggatcagcaaggtcatggacgaagaaaagggactttcttatgagatctgtccggggtgcacgcagtgcggagcatgtgccagagcctgtccccaggatgcggttttccgggaggaagactatggcgtctatctggtggatcgggagaaatgtattggatgcggcgtttgtacgaaagcttgcccggatcacctgatctttgtggacgagacagggaaggctgcgaaatgcgatggctgtattgcacgcagaaaggcgggccgtgagccagcctgcttggcggtctgctgtctggacgccatcaccgtgggggaataatagatgagagcaaacattgcaggatatattctcgcagggggaaaaggaacgaggatggggggaatggataaactttttctgaagtaccagggaaaatatctggcgctctggacaatcgaggcgcttttcatgctggacacatggtatgtgtctgtggcagagattcctaaagaaccgatgggaaaggccagatggatccgggacgtttatgaggatatcggcccaatgggcggcattttaagcggtctgatccggtgccgggaagaagcacttcttgtagtgccatgtgatacgttcggggtggatgcttctatgggaaggagactgctggatgcttatgagagaaccggccggcccgtctttttccaggatagaaacaagatattcccgtttcccggaatttacacgaaatccatgcttccagctatggaacggcagagaaaagcgggaatttaccggatgcagagtttgtttgatctggaggatagggggaagattactttgttagatggaagcagtgagctggggcggctggtcaatctgaatacatggcaggaatacgagtccctgcaaaggaggagcaatgagcgagagatgcgttacggtacaagaggcgcagaatgatattcgaatgatcgtttggaaaagcagggagacggaggaagtcaccctgctggaagccggagggagaatactgtcagaggatttgcgggcagggaaaagcagcccgccctttccacgatctccgtatgacggatatgccctccgggcagcagatatccagggtgcaaataaaaagcagcccgtctgtctgaaggtggtggaaaagctttgtgctggaaaatatccaaagcaggtcatcggttcgggagaggcggctcggattatgacgggagccccgatcccgaatggagcggatacagtggtgaagcaggaagatactgactatggagagggtattgtgcagatctatcgaagccagaatccatatgatcattattgtccgcaaggggaggactttctggcaggagagaagctgcttacaaaagggctccgtatggatgccatacgcatcggaattgctgcgtctgccggatgtgaccggattcgggtggtaaagaaggtacgtgtagcagtactgacgacaggaagcgagcttgcaaagccagggacaaagctgcgtccgggacagatttatgattccagtctgtacctgatttcggagcgtatccgggaattgggaggagaggttgtcagaatgaactcggttttggacgagcccgagattctgaaggggagattgagagaagcggcaaggtgtgcggatctgattgtaacgaccggaggcgtctcggtgggagaaaaggacctgattcgtcaggttctctcacagatgggagcagataaggtttttgaccgcgtttttgtaaagcccggttctccaacagccctcttccggctggaggaaaccccggtatttgccctgtcgggcaatccctttgcggcaaccgtgcatatggagctccttgtccgggcagcgattgccagatggtatggatgtgacgaactcttcccacacgaaaaacagggctttttgctctccaatttcgggaaatctgccgtaagtgaccgatacatccggggaacggaaagcggaggccggatcctgcttccgaatgggaaagagcgttccgggatcttaagctctatgaatggttgtaactgtctggtgaagatagaacagggaagagcaaatctacgggaaggagaacgggtatgttatatcaaaatctgactgtgcgccccgtcctctttggggtggccggggataagaataccgggaaaacgactttgatggaggaacttatccggcgtcttacaaaccgcggctggaaggtagcttccatcaagcacgatggacatgattttgaagcggatcgggagggaaccgatagctggcgtcattatcatgccggagcctacgggactgtcgtattttcgaaccggaaataccagctcgtcaaggaagaaaaggatatttccctggagaagctcacagccctttttccggaagcggatgtgattctgatcgagggaatgaaacaggcgtcccatgagaaataccgatgccgttacccgaaagaagagtggaacgccgaaaggctggtggggcgaatcgaagaaaagatacgggacgaaaggagtaacagtatgacaatagagacactgatggaaaagatcagtcttcccaaggaaggacaggactgtgtccaggactttccaatgacagaaaccttttatcagagctttaaagagctgttttatgaagatagcaaagccttttttgcggaggcagaccgccgcacagatcgggagaggctgtatctttatttatatatcaggatggctgcggatctctatccagcctttgtggagaaaggaatctcagggaaggtgtatgtggacaccttttatgacattacgatctggtacaaccagtgtgtaaagaaaaagggagttccgggactggtggaagagcggtggttgtccctggcgcttcggatgaagattttccgcctgggacggcttcagtttgagccggatgaagatcgacatgttcttcacgtccacattccggaaggtgagaccctggatgatgcggcctgtggagaatcttttgcgatagcggaggagtttttcggaccagagtatacgatatttgactgcgaatcctggcttctctctccgaaacttcagaagcttctgaaaccggacagtaatattttaaaattccagaaccggtttcagatagagaagatcatctatccgttccgacaggcagaagagcgggtgttcggccgggtacgcgaggacaaggagcagtacccggagagtaccagtctccaaagagcggtgaaagcgatggtgctgaccggggaggacgtaggaatcggacatggggttatctatagaaaataataataaatcaatcaatttataagaaaatccgatttgccactttttgcgcttaccgatatgataatatcgtatgtgatcatgcaaagagacagaggaggattatgatgaaaagaaaagcagcagcagcgctggctcttctgatgacggtttccatgcttgcaggatgcggatcagacggcggcgacaagggaaaaaagagtgatggaaagacgacattgacattctggtgccaccagaatgaaccgtgggtaaaatcctacgaagcgatggcagagaagtttgagaaggaacatccggaatatacggtggaagtccaggactacccgtatgatgtatataatgacaagatccagaccgccattacatctgacacggcaggaccggatatcattgccgtatggggaggtatggcgccgaactttataggaacggacgctctctccgaggtgccggaggatctggcaaaggagctggataaggactacatggctccgaccgtaggaagttacaagaagaacggcaagtattacggcgtaccgatggagtacaacctggagtacggcggaatgatcgtaaataaaaagctctttcatgaaaagggcgtcgcttatccgacaacctgggaagaactccgtgacgtgtccaagagcgtttccgtgaaaaacggggatatcgtggagatgaaaggattcgagatgtttgacaccgactctttgatctgtaactatcttgctatgattttacagacaggtggacagtatttggaggaagatgattctgtcaactttgccacaccagaaggtgttgcggctatggaagagatccttagtatgatcaaggacggcgaatgtgacctgacacatctgacggacggcgactactgtttcaatgatgtgtatcaggacaaggggtacatggcttctgtagggtcctgggcgatcggagaaggaaccgatacatacgagctgaaatacggtacggattttgaatatgtgcgggtaccgcagtacggcgatcagatgtcctttgcttctgagaccggatggggacttatcgtgccggaaaatggaaagaacaaagatgcggcatgggagttcatctccttcttcagcgagccggagaatctggtagagcacaacattgcgtgcagtcagcttccaccgagaaaatctctgctgaccaacgagacatacattgaaaagatgccgcacgtagagttccttttggacatccttccaaacggacaatggatggggccatacaatacttccgatatgcgtgaagttttaaatcagacattcctgaatctatgtcaggaagagaacccggatgtggagggcgcactaaaagaggcttcccagaagattacatccgaatgtaaatacggttactcagcagaatagaagtaagacagaggattccttgggaaaggaattctctgtctttcgctccacttatgtcctgtgtgatcagggagcgaatttctcagcctgaggaaagaaaggattggtaacaggtgaaaaacaatcgatttgtggcgtcggtgctgcttccgggtatggtctttctgggaatttttgtgatggttccgattctgtacggacttggcatctccctgtatgactataatcccgccaattcccgaaatccatttctgggtcttgcaaactaccggcgactgattcgggatgaagttttttggaaagcggtaggcaatacggttttcttctgtgtggcagcggtgagcgccaacattgtagttacgttgtttctggcgaagctgatttctgtcctgccaagcaaggggctaaaaaccgtctttcggacgattttttttattccttgtattgcgccaatggtcgggacagctatgatctggaaatacgggattatcgggacggaaaatggagtcgtcaaccagatcgttcagtttttcggaggaaccccaaagaactggtttatgacaggactcccgttgatgatgttcatcatcctttacacgctctgggcggatatagggtacaacatcgtcctgttttccgccggaatcgagggcgttcccaaggagtttgatgaggcggcggccattgacggggcgggagcaatccggagattcctgtccattaagctgccgctcatgggcagaacatttgcctttgtggcggtaatgacgatggcaaactatttccagatgttcgcccagttcagggtgtttgcgccggacggcggcatgaatgactcggtgatggtactgacaaattatatctataagacaagtttcgtaagttttaatatgggatatgcgtccgcagtggcggcagcgctctttgtcatcgtctttgcggtggcaatgatccagaataaaatgatgcgggcagattggagttatgaataatgaaaaagagaagaacgtataagccatatcattatcttatcatcatttttcttggaagcctgtctgttgtcatactatacccgcttgtctggatgctgatgacgtcctttaagacgaatgtggatatccggacaaacagggcgaaattcttcccgactgagtggacacttgaaggataccggacggcctttgagaaagctccgatcgctaactggtttatcaacagtatcctgattacagttatcattaccctggcggtgattgtcaccagcacgctaatggggtatgtgtttgcgaaatatgagttccgtttcaaacgagcgctctttgtgttgcttttggcgaccatgatggtgccgccgcaggtaacgatgattccaagatatctgatgatccagaagctccatcttttcgatacgaggggggcgctgattgtgccggctttggtaagcgcgttttctgtctacctggcaaagcaatttatcgcggatattccggacagcctgtgtgaggcggccaagatcgacggagcaggtccgtttcagatctactggaaggtgattttaccaaacatccggccggctatcggctccattggtatttttacggcgatggcaagctggaatgattacttaaatccgcttctgatgttaaacagtattgataagatgacgctgcctttgggactgatttactttaacagtgacaggacgtccgatctgtcggctacgatggcggcagcggccatgatgatgatgccgatgattgtgattttcattctcttccaaaaacagtttatcaagggaatgacgatgagtggaatcaaataaaagaaaactatggagggaatatcatgataaagcaagaaactgtgtatgagatgagacttgtgagtgcgcttgagaaggtttttctggatgaaagaccggtgtaccggccggagtgtatgaagctgacggcgctgaaaggagagaccgtgtcatttcaggcagcctgtacctgcacttcttttatgaagaaccgggtgaaggtgaggatcgagtcaccgattagtgatcggattcatgtccggaaggtagaaaacgtgcctgcaggcagagtgtgcggaccgattgtggacgacaattatctgaagaccgaatccgggctgtatccggatctgctgcgtgagctcgtagatggggaagtggatattttccctcagaaatggagaagcatttggattgatattgaggttacggaagatgtgaaagccggcctgtatccggttacagtgatcctggaaaaagatggggaaacactggcccgggcagctacggaagtaacgatctatgatgcggtgcttccaaagcagaagatgatgcatacggagtggttctatctggactgtctggcagactactaccatgttccggtgttctcagaggagcactgggagatcattaccaattatctgaaagaatatgtcaaacggggatgcaatatgatcttgacgccgctctttactccggctcttgacacggcggtaggcatagagcggacgacgacccagcttctggacgtgcgggtagaaaacggaaattacagtttcggttttgaccgggtgaagaagtggatcgatctctgccagtcctgcgggatcgaatattttgagatctgccatctcttctcccaatggggagcaaaatacgcgccgaaggtcatggcggtggtgaatggaaaagaggagcagatctttggatggcacaccccggcagtgggcgagtacacgaaattccttcacagccttctgccacagttgactgaaaagctaagagagtggggaattgacaaggtaacatactttcacctttccgacgagccaagagaagaacatctggagagttatcgggcggccaaggaatcgatcgagggattgttggacgggttccataccttcgacgctctttccagttacgaattctacaagcacggtctggtggacaagccgattcctgggaataatgagattgaagaattcctggaacatggcttgacacacatgtggacctactattgcgtgggacagttttacgaggtgagcaaccgcttcatgtccatgccgtccctcagaaaccgaatttatggattgcagctttataagtatcagattatcggtattctgcactggggatataatttctacaacagtcagttttccctggagaagctcaatccgtacgaggtgacagatgccggcggcgcgtttccgtccggggatgctttccttgtttatcctggcaaggaccggcatccggaagagtccatccgtatgatggttcatgcagaggcgcttcaggatctgcgggcgtgtgagcttctggaaactctggcaggcagagagtttgtgatggaatgtatcgaggaagatctggcggaaccgctcacctttaaacggttcccgaaatcggattactacctgcttgcgcttcgcaaccggatcaatcgggagatcgcaaagagaatttagaattgctaatagaatatacaaagtagaatatacgaagatataggatcccaccggaaacatccaggtgggatcctatgtttcagggagaaagagatggttcataagcagttatcgtaatgagaagagcaattcgtcataggttggatatggaagatagcatcccggaatgatggcctcagcctgatccacggcggcacgaagggcgtccatgtcggagagaatgatgtcgtggtagtagcgggcggcagcaagtggctcttccatcttttccgcttgcagtgtgtcggcggacaggtttgaaagcgctgtggcgatctgctcagatgctttggtcagcgtctttatgatttgttcctcataagatgccggaagagacggcagaagctttttcttgtccagtgcctcctttgacacttcggatacataggagaagagcgccggggtaaagtcctttttcaccatatcctgcatggtcagtgattcgatatggattgtcttagagtagttctccagaatgatttcataccgggagtggatctcttccttggtaaagatctgatgcctggtgaagagatcgatatttttttcggcgataaactgtggcagagcatccggaagagatttcaggttccataagccccgcttttcggcttccgcaacccaagcgtcagtgtagccgtttccgttaaagagaatccgtttatgtttgcggatgagctcttttaagaggtcctcaatggcggtagatctttccgattccgggatgtcttttaaagcatgatatatctgggaaagggactcggccaccgcggtgttgagtaccacatttggtcctgccacagagagagcgcttccaggcatccgaaattcaaacttgtttccggtaaaagcaaacggtgacgtccggttccggtctgtcgtatctttggcgaagtgcggaaggacgtgagcgccgatctccataagtgtctgcttctgtttgagaaaatcgcttccgtcttcgatggatttcaaaacggcggtcagttcatcaccaagaaagatagagacgatggcaggaggcgcctcgttggctccgagacggtgatcgtttccggcgcttgccaccgagacgcgcatcagatctgcataatcgtccacggctgcgatgacagccattaaaaagacaagaaactgcgtgttttcggctggggttttacctggatccaacaggttttcccccgtatccgtgacgagagaccagttgttgtgcttgccgcttccgttgacgccttcaaatggcttttcatggagaaggcaggcgagatgatgggaatccgcgatcttcttcatcatctccatggtgagctggttgtggtccacagccacgttggcagtgtcaaagaccggggccaattcgtgctgtgccggagccacttcattgtgcttggtcttgaccggaacgcccagtttccagagctcttcatcgagatcgtgcatatacgaggctacctttggtttcagtacgccaaaatagtgatcttccatctcctgacctttcggggccggggcgccaagaagggtgcggccacagaagagcaggtcttttctctgcttatagagatttttatccacaagaaaatactcctgctcggatccgatagtcgtatcgatttttttgacgctcttattaccaagaagatgaaggactttcagcgcctcagcattgagcgcttccatcgaacgaagaagcggcgtctttttatccagcgcctctccactataggagcagaatgctgttggtatatacaaagagccatctttgatgaacgccggagatgttgggtcccaggcggtgtagccgcgagcctcaaaggtcgcccgcagtcctccggatgggaaactggaagcgtctggctctcccttgatgagctcctttccggagaattccataatgatctggccgtctcctgacggggaaataaagctgtcatgcttttctgccgtgaatccggtcatcggctgaaaccagtgcgtaaagtgggtggcaccatgctcgacggcccattctttcatggcggccgcgacagtattggctacatccagttccagatgggttccgctttgaatggtcttgcggagcgctttgtatgtatcctttgggagacgttcacgcatcactttgtcattgaataccaggcttccataaagttctggtattgtgtttgtcagttctttcatcatagagagacagctcctttcctatcctgaaatcaaaaaaggcactttggaccaaatccaaagcgccattgctttatgcaggtagtataaacacaaactagtggcgctgtcaatccttttttggaaaatagaaatgtctgatgattcacagataggaatcattgaaaaaacatctcttctaatatgacccttgcaaaatcaaaaaagatggttaaaatatcttagtatgaacgggaatcgaacctgttttctgaaaataagagccagaagatggcgagaaaagggatggaggaaaaaagatgaagacaaagacagagtggaatcagagaagggaaacgggagtcggagaagagtgtggtgtatttggtatctacgatatagacggaaaagatgtagcctcctcgatctattatggactctgtgccctccagcataggggacaggagtcctgcggcattgttgtctcagacaccaggggggagcggggaaatatcgcctaccataaggaccaggggctggtcagtgaagtattcaaggcagatatgcttgcatccctccatggaaatctggggatcgggcatgttcgctactcaactacggggggatctaccagggagaatgcacagccccttgttctcaactatatcaaaggcaccctggctcttgcacacaatggaaatctgatcaatgcacctgaattgaaagaggagctggtctatggaggtgccatcttccacacgaccacggattctgaaatgattgcgtactgcattgccaaggagcgagtgcatacaagaaacgtggaggaggcgatcctttgtacgtccagaaagatccggggcgggtatgcgctggtggtgatgagtcctagaaagcttgtcgctcttcgggatcccttcggattgaaaccgctctgcattggaaagagagggcatgcctacgtcgtagcgtcagaaagctgtgccctggatgcggtaggagcagaatttatccgggatattgagccgggagagatgattgctattacaaaagacggcattatctccaacaaagagctgcagcaggagaaacgagcccattgtatctttgaatacatttattttgcgaggctggacagtaccatggacggcatcgggatctatgacgccagaatacggctggggcgtgctcttgcgaaagcttggccggcggatgccgatttggtaacgggagtgccggagtccgggattactgcggccagaggttttgctatggaaacaggacttccctttgagcttgccttttataaaaacagttatgtcggcagaacgtttatcaagccgactcagaaagagcgaagatccagcgttcggattaagcttaatgtactggagccggtggtgaggggaaaacgcatcgttttggtcgatgattctatcgttcgggggacgactatggcaaacttaatccggatgctcaaggcagcaggagccaaggaagtccatgtgcggatcagcgccccgccgtttctgtatccgtgttattacggcacagatgttccatccaatgatcagctcattgcctcagagcacacgactgaggagatccgcacactcatcggcgcggattcccttggctatatgaagatcgaggatcttcagaccgttgtgggagaccttggaatctgtaaggcatgttttgacaatcaatacccggtttcggaagggaaggaaagtcggatctgataaaaaataaaaaagggatttacaaaaagtaaaaaacagagtatagtattggaataataaaaatgaaggaaacgaaaaggcggcaaaggtgtcggtcaggaaacgcggaaaaagcgatttccagacacttttgccccttttttatgttttgggagttttagagcagcaaaaaggaggaaagacaagcaatggtaaactatgtttttgtaacaggaggagtagtatccggtcttggaaaagggattacggcggcgtctctggggagacttctcaaggcgaggggctatcaggtcacgatgcagaaatttgatccgtatattaacgtggatccagggacgatgaacccgatccagcacggggaggtatttgtgacagatgatggtacggagacagatttggatctgggacactacgaacggttcattgatgaaagcctggacaagaactccaatgtcacctccggaaagatttactggtcggtgttaaataaggagcgacacggagactacggcgggggcacggttcaggtaataccgcatattacgaatgagattaaggagaggttctaccgggcgaaaaatccaggagaggagaggatcgcgattatcgaggtgggcggcaccgtcggagatatcgagagccagccgtttctggaagccattcggcagtttcagcatgatgtagggaaggagcatgccatcctcatccatgtaacgctgattccttatctgaaagcatctggcgagatgaagacgaaaccaacacaggcaagtgtcaaggaattgcaacgcctgggactttggcctgacatcctcgtatgccggtctgaatacccggtacctctggagatgaaagataagatcgcacttttctgtaatgtgccgtcagaacatgtcctgcagaatctggatgtagagtatctttatgaggcgccccttgctatggagcgggagaacctggcacaggcagttttaaactgtctgcatctggaacaaagggaaccggatctcagtgactggattgagatgacggaggcacttaagaatccgaaacaggaagccgagatcgccatcgtcgggaaatatacccagcttcacgatgcatacttaagtgtagtggaagcattgaagcatggaggtatcagttgccatacggatatccgtttccgctggacggattcggagacgattacggaagaaaatgtggaggagacattttgtggcgtggatggaattctcgtgccgggagggtttgggagacggggcacagaaggcatgattctggcggcagagtatgcaagacgggagaaaatcccatatcttggaatctgcttgggaatgcagatggctatcgtggccttcgcccggtttgtcgtgggatatcacgatgcgggcagtatcgagtttcagccggagaccatgcatccggttatcgctttgatgccggatcaaaaagatgtggaaaatatcgggggcactctgaggcttggggcatatccgtgtgtactggatgaagattcccggtgctttgccctttatggaaagagggagatctccgagagacacagacaccgctatgaggtcaataacgattaccggagcgtcctggaagaagcagggatgcacctggcggggctgtccccggatcagaggatcgtggaaatgatagagattacggatcatccgttttatattggtactcaggcacatccggaatttaagtcgaggccgaaccggccgcaccctctttttgccgggtttgtaaaagcggcgtctgagcaccggaattagaatgaaaacgaaaggaagagagcgatgaaaggaaataagggactttactgtccgatgctggagcatgacaactgtggaatcggcgcagtcgtaaatatcaaaggaaaaaagacacatcaggttgtgagtcaggcgcttgagatcgtggagaatctggagcaccgtgcaggaaaggacgctgagggaaagaccggggacggagtcgggattttactacagatttcccatctttttttcaaaaaggtgtgcctaaaagagcagattctcattggagacgaccgggaatacggaatcgggatgtttttctttccggcagacgaacttacgagaaaccagtcacggaagatgtttgagacgatcgtggcaaaagaggggctccgctttcttgggtggaggaaagtaccggtgcacgaggatgtactcggcaagaaagccagagactgtatgccgtatattatgcagggatttattgaaaagccctcggatactgcaaaagggctggaatttgaccggagactctatgccattcgccgggaatttgagcagagcagtacagagacgtacattgtttctctatccggcagaacgattgtctataaaggcatgtttctagtcggacaactacgtacattttttgaggatcttcaggatccggattatcagaccgcgatcgccatggtacactcaagatttagtacaaacacagagccaagctggaaccgggcgcatccgaaccgtttcatcgttcacaacggggagatcaatacgatccagggaaatgcggataagatgctcgcaagagaagagagaatggtttctccgtatttttcagggagtcttgacaagatattcccagtggtggatcagagcggttcagattctgccatgctggataatactttggaatttcttgtgatgaatggaatggatctgcctcttgcagtgacgtgtgtgattccggaaccatgggagaatcatgataccctgagccagaaaaaacgggatttctatcagtactatgcaaccatgatggaaccttgggacggtccggcgtccgtgcttttcagtgacggtgatatcctgggggcagtgctggaccggaacggtctgcgtccgtccaggtactacatcacccgggacggctatctctatctgtcatccgaagtgggagtacttcagggaatccgggaagaacagatcctggaaaaaggaaggattcatccgggaaagatgctggtggcggatactgtgagacaaaaaattctgacagatgatgaaatcaaagagacttatgcgtccagacagccttacggggaatggctggatcaacatatgatggaattaaaagatctcaagatcccgaacaaaaaggtggagcagtatacgaaggaagagtgcgcaaggcttaggaaagcatttggatattcctacgaggagtaccacgattccatccgtacgatggcattaaacggtacggaagggattacgtccatgggtgtggataccccgcttgcggcgctttccaacaagcagccattgctattctcctattttaagcaacggtttgcccaggtgacgaaccctccgattgacgcagtgcgggagaagattgtcactaacaccagtgtgtacatcggaaaagaaggcaacattctaaaagaacagccagaaaattgccaggtactgaaggtcaacaatccgattctgtcagatacggatcttctgaaaatcaagggcgtgagacagccggggctgtacccggcggaggtaatgatcacctgtatgaaacatatgtctctgaagatagcgctggagcgtcttttcatcgaggtggaccgggtttataaggacggggcgtccatcttgattcttacggatcggggtgtagatgagactcatgtagcaatcccatcgttgctggcggtctccgccgtccatcactaccttgtccggacgaaaaagagtacggttatgccgatcatcctagagtcggcagagccaagggaagtccatcattttgcaacgctccttggatatggggcgagcgcggtcaacccgtatctggctcacgagacgatccgggagatggtcgaggatggcttgctggaaaaagactattatgcggcggtccatgattatgataaggccatcttaggcggaatcgtcaagattgcgtccaagatgggcatctccacgatccaatcttaccagggttcccagatcttcgaggcggtgggcatctccaaagaggtcattgatccgtattttacccacaccctcagccgggtgggcgggattaccatgaaagagatagaggaggatgtggaactgcgtcacagtcaggcatttgatccattgggacgaaagacggatcttacattggagagtgtggggcggcatagttttcgcagtcagggagagcatcaccggtacaatccggcgacgattcacctcctccagcagtccgtctggcaggacgattacacaatgtttcaggagtatacaggacagattgataaagaggaaaccggatatttgagaagtctcatggacttccgatatccgaaggaaggcgttcccatcgaagaggtagaaagtgtagattccattgtaaggcgatttaagaccggagccatgtcctacggttctatttctcaggaagcccacgaagcgctggcggtagctatgaataagatacacgggaaatccaacagcggagagggaggtgagtccccggagcgtctactgacaaaagggacgaaggacgatcgctgttctgccatcaagcaggtggcaagcggacgttttggtgtcaccagccgttatctggcaagcgccgaagagattcaaatcaagatggctcagggggcaaagccgggagaaggaggccacctgccgggaaagaaagtgtatccgtggattgcaaaaactcggtattctactccaggcgtgagtctgatttccccgccgccgcaccatgacatctattctattgaggatttggcgcagttgatttacgatctgaaaaacgcaaatccaaatgcacggatttctgtgaagctggtgtcagaggccggggtaggtacgattgcggctggtgtggcaaaggcaggagctcaggtggtcctgatctccgggtacgacggaggcaccggagccgcatcgggaagttccattcacaatgccggactcccgtgggagctgggccttgccgaggcgcatcagacacttctgaaaaacggactgagaaacaaagttcggatagagacggacggaaagctgatgagcggccgggacgtagccgtcgcagctctcctgggagcagaggaatttggatttgcgacggctccgctggtagcccttggctgtgtgatgatgcgggtctgcaatcaggacacctgtccgatgggagtggcaacacaaaatccagaacttcggaaatgtttcaaaggaaaaccagaatatgtgattcatttcatgcggtttatcgcccgggaactccgggaatatatggcgaagcttggtgtaaggacgatagatgagatggtagggcgcaccgatcttctgaaagtgcgggaaaatccacaaagcaaaagaggaaggatgatagaccttggagctatcctgaattcgccgtatatggggaaaggcaatctcaaaggggagtatgagtttggactttccgggacactggatcagacggttctcatcaaagaactgcaagaaaagctggatgccggagaacctggcaagatacaggttcacgtcaaaaatacggaccggacgtttggaacgatgtttggatccgaacttacgagacgatatccggaaggggtgcaggaagatacgtatcagatagcatgtacaggaaacggagggcagagttttggagctttcatcccggcaggactgacgatccgcctggatggagactgtaacgactactttggaaaaggactttccggggggaaacttgtcatccggccgcccaagggaggtacctaccgggcagaggacaatatgattatcggaaatgttgctctttatggggcgactgacggaaaagcctttatctgcggactggcaggagagcgtttcggcgtgcggaattcgggagctacagcggttgtggaaggcgtgggagaccacggatgcgagtatatgacaggcggcagaatcgctgtcatcggtaagaccgggaagaactttgcggccggcatgagcggcggaatcgcctacgtgttggacgagtggaattctctctaccgtaacatcaacaaggagatgatttctatggaggaaatcactcagaagggggatgcggacgaattgcgagccatgatcgaggaacatgtacgggagaccgggtcccggaaaggacaggagattctggagcagtttacgaaatatctgtcgaaatttaaaaagatcattccaaatgattataaaaagatgctgacactaagcagaaagtatgaagcgatggggtttgacagcgaggaggcgcagattgaggcgttctacgagagcgtaggtcagaaaagacaggagggataaaaacaacatgggaaaaccgacaggatttttagaatatgaaagacggacgggaagtgaacgcccctgcaaggagcggatcggagatttccatgaattccatgagccgctcccgccagaagtacaaaaagagcagggggcaagatgcatgggatgcggagtgccgttctgtcagtttggaggaatgattggtacaatggcgtccggatgcccgttaaataacctggtgccagagtggaatgatcttttgtaccaggggcagtatgaagccgcctatcagcgattgcaaaagaccaactgtttcccggaatttacatcccgggtctgtccggcgctctgtgaggcagcatgtacctgcaacgtaaacatggatccggtaacaacgaaagaaaatgagcgtgcgattatcgactgggcctttgcaaaagggatgataaagccccagccaccggaaaaccgcaccgggaagcgtgtagcggtgatcggaagcggacctgccggacttacggcggcgctgcttttgaaccgccaaggacacagtgtgactgtctttgaacggaaggacaggatcggaggactgctgatgtacggcatcccgaatatgaagttagagaaaagctcgattgagcgaaggaaagcacttatggaggaggaaggtgttgttttttgtacaaacaccgatgtgggacgggacaaagaggcagcggagattctggacacttttgaccgggtgctgcttgcctgtggcgcctccagaccaagggatattaaggttccgggaagagacgccggggggatccgctttgcagtggattttctttcggaagtgacaaagacgcttctggattccggatttgccaccgtcccatctgagcttgcaaaaggaaaacatgtcgtcatcattggcggcggagatacaggaaatgactgtgtgggaacttccctgcgtttacaggcgaagtcagtgacccagttagagatgatgccaaagccgccaaaagaacgggataggaacaatccgtggccggagtggccaagagtggaaaagaccgattatgggcagcaagagaggatcgctctgacgggaaaagatccaagatgctaccagacgacagtaaaggaatttctgaaaaataaggaagggaatgtgcgtgctattcggacgatccggttagaacagaagaaaaacgagaaaaccgggcggatggagatgcagccggtgaaaggaagcgaggaaacgattccggcagatctggtgctgattgcggcaggatttaccggagcggaagattacgtcatagatgctttccaggttaaaacgtccggacgaggaacggtagaggatcaggactttgcggccagtgttcctcgtgtatttgtggcaggtgatatgagacgggggcaatcccttgtggtctgggcgatccgggaaggccgggaagtggcaagggagatcgaccgttctctcatgggctacacgaatctttcctgaatagaatcagaaggatgggacagtacaagagaacagaggaaaagatcggacatagttcttgccctttcttccggatgcggaatataataagtacatcagggaatcgacgcaatcgaaagatggaggaaatcaagatggcaaaatatgagacatgggaaattctacagatgatggaagaggaagatgtaaaatttatccgtatgcaatttgtagatatcttcgggacgatccgcaatatcgccgtgactgctggacagatggaaaaggcgctgactggaaagtgtatggtagacggctacagtattgccgggatgaaagacatgggatatgacaaggtctgcttaaaaccggacctcgatacgttcacggtactgccgtggagaccgcagcagggtaaggtggcgcggtttctctgtgatctgatggatcaggagggacgagagattccggaaagttccagatacatcctgaaaaaagtgatggatgaggcagggcaggagggatacagctttgatctggatccggagtgcgaattttttctgtttgagactgacgaagagggcaatccgacaacgaggacaagggagaaagccgggtacctcgatgtggcgccccttgaccagggagaaaacgcgagaagagatatgattctgacattggaggagatgggatttgaaatcgaatcctcccatcacgaggacgctccggcccagcatgaggtagactttaaacaggcccggggcgtcaaggtggcggatcagattataacctttcgttccacagtacgtaccatagcccagagacacggcctgcacgcaactttcatgcccaagccacggacagatcttccgggctcggccctgtcgctaaatatttccggattccggaatgggaggagtctctttgcggatcaggaaatggaaaatggactaagccgggaggcatactcctttattgcggggcttttgactcatatgaacggaatggcggcgttttccaatccgattatcaattcgtataagcggctgaaaccgggatttcacgcgcctacagagctattctggtcgctcaatgactaccgggctccgatccgtgtggtgacgggaagagaggatgagattcatatggaatggactctgccggacggtgcggcgaatccgtatctgctcattgcactggtggtgtccgccggtttaaacgggattcgtgaaaggatggttccgttaaaagcggatgaaaaggccggaaagcttccggggacattaaaggaatctctggatgcactggaacaagatgcgtttttaaaacaggtgtgtggagaacgatatgtggaaacctatttaaaggaaaaaagaaaggaatgggagctctatacgcgggaagtcacagactgggaacttaaggagtatctgcacagattttaacagatggcagggggaggatatatgggaagtattatcatcgcacttccacggaaggataccgcgggaaaaatcaaagaaatacttctgcaccatggcttccgggatgtggtggttgtgcctacggcggctgcggcactccaggaaaccgggcgtttatcccacggaattatcatcagtggaacaaagctttctgatatggattatacggatttgctggactgcctgccgcgttattttgatctgctgcttttggatacaacacagaatgtcagttacagaagacagccgggactgattgcagtgacgatgccggtgagagttctggagtttgtcgatacagtcaatatgatgcttcagaatctggaccgtcaggtggtgaaacgcaagggcaaaaggccaaggcgcacggagaaagaggagaactatatccgaaacgccaagtctgtcctcatggagcgcaaccatatgacggaggaagaagctttccgctatatccagaagagcagcatggacacggggaggaatatgacagagacggcacagatgattctaaccctgatctataatgagatttgaggacaaataaaaacgagagacgaaaaccaaccgtgcatcgcgtatgtacgaatggttttacgtctctcgtttgttcattgacgatgaaggcaaatcaagataaaataaaagaaatcaagaagaacgaggcagaagaatgaaacgaatcaaagacaatgacaatgcgacgattgtcgcatgttacatcggatatattacccaggccattgtcaataattttgtccccctgctgtttgtgacctttcaaaagcagttcgggattgcgctggataagattggattgttaatctccgtcaattttggggtccagcttctggtggatcttctggcggccggactggtggagaaggtcggagagagaaaaacgatgattacagcccatctatgcagtgggacaggacttttactgcttgcctttttgccgtggctgtttccagttccatatatcgggcttctgatcggaattgtctgctatgccatcggaggagggctgatagaagtcatgttaagtccgattgtggaggcgtgcccgacaaagaacaaggaggcggtgatgagctcgctgcactctttttactgctggggacatgtgggagtggtactgatcagtaccctgtattttgcagtattcgggaccggatcctggtggattttggcctgtatctgggcagttattcccttttttaatacctgcctcttttttcatgtgccgatccgttccctcgtggaggagggaaagagcatggggcttcgtgagatctttagggaaagggtattttggattttatttatcgtgatggtctgtgcgggagcagcggagcagggcatgagccagtgggcaagcgcctttgcggaaatgggactttctgtcagcaagacagtaggggatctggcggggccgtgtatgtttgcggcctgtatgggtgcggcaagagcctggtatggggcgttttcagagaagatccggctccataattttatgatgataagcggcctgctctgtgtggcggcctacctgctggcaggcctgtcaaaaagccctgtactgggactggcaggctgtgccctgtgcgggctttcggtcggaattatgtggcctggaagttttagtaccgcggcaaaagtattaagaaggggcggtaccatcatgtttgctttccttgcattggcaggggacctgggatgctctgcgggacctggtcttgtaggaatgatctcagaactttctgggaggggactgaaagcaggacttttttcagcaatcgtatttccggtgattcttgttgccggaatctggatgataaaacaagaaaacaggaggtagaagagagtgaaacaatatattatggcgctggatgcggggacgacgagtaaccgttgtattctgtttgaccgtgcgggaaagattgtcagtcttgcacagaaagaatttacccagtattttccgaagccgggatgggtagaacacgacgcggacgagatctggtcgactcagcttggtgtggcagtagaggccatgagtaagatcggggtgtcggcggatgatattgctgccattggcatcaccaatcagagagagacagccatcgtatgggacaaggagaccggagttccggtgtgtcatgcgatcgtatggcagtgcagaaggacagccaaatactgcgacagtttaaaagagcgggggctggaagagtggttcaggatgaaaaccggactgaccattgacgcctactttgcgggtacgaaagtgcgttggattctggaacatgtagaaggagcaaaagaacgggctaagagaggggaactgctttttggtacggtggagacgtggctcatctggaaactgacaaagggaaaagtccacgcgacggattactccaatgcctccaggacgatgatgttcaatatcaatacacttcagtgggatgacgagattttggaagtcttagacatcccgaaatgtatgcttccggaagtccggccgtcgagctgtatttacggaacgacgtccccggcatattttggcggggaaattccgattggaggagcggcaggggatcagcaggcggcgctttttggacagacctgcttttctccgggagaagcaaagaacacgtacgggacaggctgttttctgttgatgaatacgggggagaccccggtattttcgaaaaacggacttgttacgaccattgcctggggaatggacggtaaggtgcagtacgccttggaaggatcgattttcgtggcgggggctgcgatccagtggcttcgggatgagatgcggctgattgattcggcggcggactctgaatatatggcgcagaaagtgccggatacaaatggctgttatgtggttcctgcctttaccggtcttggcgctccgtactgggatcagtatgcacgaggcgccatcgtcggcatcacacggggcgtcaataagtgtcacatcatccgggcgacactggagtctttggcctatcaggttcacgatgtcatccgtgccatggaggcggactccggtatcacactgacttcgctcaaagtggacggcggggcaagtgccaatgattttctgatgcaggtgcaggctgattttgatgccgctccggtgcggcgtccggcatgtgtggagacgacggccatgggtgcggcttatctggcaggacttgcggcgggcgtctggaaggacaccgaagaaatccgagcaaactggaagattgaccgggaattcaccccggcgcttcctgaggagaagcgtcaggagaagatgaaaggctggaagaaagcagtgcgctatgcatttgactgggcaaaagaagaatagagtgcatagccgaactgttacaataaaattgacgaaaaaagtgaaaaatgatagacaattatgtacaaatatactaaaatagacgtattggattaagacgaatacggaggtagggatatgaaaggaaatgtaattgtaggacagtccggaggaccgacagcggcgatcaattccagtctggccggtgtctatcgtacggcaaaggacagaggagcaaagaaagtgtacggaatgcttcacgggattcagggactgatggaggagaaatatattgatctgtcagagcacattacaaacgatctggatgcggagcttttaaagaggactccggcggcatacttggggtcttgccgttataaactgccggagatccatgagaaccgggaagtgtatgagaagatttttgagattctggataagctggatattgaggcgtttatctatatcggaggcaatgactctatggatacgatcaaaaagctttccgactatgcgattgtgatgggatatccgacccgttttatcggatgcccgaagaccattgataatgatctggcactgacagaccatacaccgggatacggaagtgcggcgaaatatattggaacatctgtaaaagagattatccgcgacagcttttgtcttgagtacagcaaaggactggtgaccatcgtggagattatgggaagaaacgcaggatggcttaccggagcggctgcccttgcaaagggagaagactgtgcgggaccggacctgatttatcttccggagctgacttttgatctggacaatttcatggagcggatccgggagcttctggcgaagaaaccgtctgtagtggtagcagtttccgagggaattcatctggaagacggacggtatgtctgtgagctgggtgcaaacgtggacttcgtagatgcttttggacataaacagttgaccggaacagcagcgtaccttgcacactatgtggccaatgagatcggatgcaagacccgtgccattgagctgagtaccttgcagagatcggcatcccactgtgcgtccagagtcgatattctggaggcgtcccaggtaggaggagcggctgtgaaggcagccgacgagggagataacggaaagatggtcgtactcaagagaatttccgacgatccatatcagtgcagcacggaagtgaaggatgtacataagattgcaaacgacgaaaagcttgttccaagagaatgggtcaatgcagaaggaacctatgtgacagatgagtttattgcctatataaaaccactgatccagggagacgtttctccggttatggtggacggaattccgagacacctgtataagccaagccactagaatcatgaaaaatagaaagagggaatcaaaattgaagatcggcgtgacaggagcagatggatttctgggcagcaggattctccggttctacgcaaggaaatatgagataaagggatatcaccatacggacatggattttactgatcctgaggagacggaaacaatgctgaaacgggactgcccggatatcctgattcatacggctgctatctcagatgtgggagcctgtgagcagaacccggagcactcagagctggtgaatgtggacggagtccggaatctggcggttatctgtcagaagattggtgcaagattccttttttgcagctcagatcaggtctacacgggaaacggagtgaaagagccgcaccgggaggaagaggcgctttccccgctcaatgtttacggaagacagaaagtccgtgcggaagaggaggccattcaggtacatccggatacggtggcacttcggttaagctggatgttcgctgctgacttccgggaaggaaaggaacatgggaatctgattcccgcgattttacatgctgtacggtcaggacagcatgtaaaatacccggtttgggattaccgcagtatcacggatgtgtgggaagtcgtagcaaatctggaacagatgtttgatgctcctgccggcatttacaatttcggtagtgaaaatgacaagagcacctatgaggtggtaagcaacttcctggagagcgcaggaatcccgaactcgatgctggaaaggaacgaagaggcattcagggaatgtccgagaaacttaagaatggagaccgaaaaggcaaagcacctgggtgttcacttcctgacgactgaggaagcactcagaaagcttggagctgaattgggatacgaagggaacgacgctaagaagaaaagagaatagagaacgatagccccctgcgccggcaatgtatgatattgtcggatgacagggggcgttttgttttgataggctcatgtactactaacccgtttccaagcaaaatcagatcgacgttttccgaaagcacaggacagcagcagcgacgttgaaaaccgtgagcagtaccgtaattataatggctggcaggaagtgactgcaatcagtagttccggtcagaagatccatttgtccaagaagaagggttggaacataatcgttcacggccgggaaaaacccggcaaagtaggagatcccgaagcaagcagcacagaccagaagaactgccgaaactgaccggcagaagaccgaagccccgacgaggacagagatcatccacactcccagaagatagaaggcaagcagggagaacgcctggttctgaatgatgctgttgtcccagaagtagacggtgtaggcaaaggtgatgccaaagctgatcagacacccaaatgtccagatcagaagcagggcaaagtatttcggcagcaggatgttgtggcgtttcaatcctttggacagaagaataatcagtgttccatgctggtattctgaagtcaggataccgccgtataaaatcagaaagacaaaaagaatgatctgcatatttttatagtactgtgtccaggaggagagagaagtcacctccagattaccgatctggataccggtctctgccatatcgccggacacgagatccaaaagccacggtgtcatcttagcaaaggccggactgagcacgcccacaagggtgaacaaaagcaacatgacaacgagacgatgggtctttaactgctcaaagagttcttttttcatcatggcacggagctgtctcatgttctaccacctccaaaaataaatcttccaatgtcggctccagcttttccagcttttgcactggcacttgtctggagacaaggtcagccattacagatggcatggtgatgtcagcgcgtttcgggagtatgattgtgagtgcgtctgtctgcaggctttccgggtacttcttcaggcaggcctctgcatcagaacgacgttcaaattcgatttggattttttccccgttgcctttccgtttgagattctccagcgtcccctggacgacgatgctgccgtcgtgcagcaaggcaacgtggtcacagatccgctccacatctgataacacgtgggtggagaaaagcaccgtcgtctcctcagtgacagaagagagaatatccagtatttcctttcgacctaccggatcgagagccgaagtcggctcgtcgcagatcagaagctttggggcgttcaaaagagcctgggcgataccaagccgctgtttcatcccacgggagtaggtgtggatatgtttcttactgtctgtaagacctacaagatccagaagatccaggatgcgccgtctgacatctaaggactgcataccggtgatctcaccgcacagcgtcagatactgagaggcagtcataaagccataatattccggaacatccggaagatagccaatataacggttcgtctggttttcgccaaaagatacccgttcaccgttgacttggatttcgccatggtccggctttagaagccctacaatcatccgcatggttgtcgtcttcccggcaccatttttcccaataaagccaaagacagaatgtgctggaacggacagatgaagatgatcaattactgtgcgggaaccgaaagattttgtgagatctcggattgataaaatatccatgcttattcgtcctccttcccgaatacaaagtacagcacgggtccgatgaactgcatcccgacaatagcaatgatacaccacatcagccgggtaccgcgtttataatgcgtgtgtgtgaagatatgccataaggtataaaagagcaatactagttccacaatggcaagtggaatgaaaaaaggcagcatttcctgtaaactcattcaatcatctcctttaattgattctgaagtctccgaaacgtgttgtcatcttttagtttttcaaaaagcggatgggacagggaggcagcaatgtcttttacgaatgtttttctcgcccggggagagacagagccgtttgcaagctgttcgatccagtgatcaatccggttaaagtagcggtcaccatgaaggcgatactcttcgtctgacaaaagcgtgcggattccgtccaggtatttccgggtatgggtaagagcggcatcgggatcgtcaaactgcagatatccaagcgctgcctggtactcaaaaacggagacagcattggcattgagttttacaagctgatagctgtcgatcaaagactccacccgctccaccgtcatgtcaaaagcattctgatcacttgccgctacggttagatacttagcggaaagctctaccagggagaacagattcagatacatcgtgatctgggcaaagtcacatgccttttccctgtctccgttcatcaaataggcggagacgaggacgctgtcactttctctggaaagtgttctgggatcagagtccgcttccagtatctggagcgcttccttatattgtcctccacccatgagaatgagcgcttttagaatcaaggtatccttgcacagattgagatctgcacagtgtgcgatgatatggtcgcacaaatcgctcatataatgtaaaagctctgtctgtaatttttgtgttttggcaagtaaataatgattcagcaaaaggacacacatctgaaagacaaggggataacaagaataatagtgcttcacagtagtccggatgtcctctaccgttttatcaaaatctgatacggcaaaggaattggaatagtccagatacagcttctggatctgatccttggaaagctgaggcaggtatccaagcagttcatcgatggtaacaccgaaaaacgtggcgagaaccggaatcgtttggagatccggtttgctgatattcttctcccatttagagacagagccttttgtgacgccaatatagtccgccagctcctcctgcgtaattttgcgctcatggcgaagccggattaagttttccgcaatccgcaattcatgcattgttttcacctcctactatgattataagagagagactgggaagattcaatggaattgaacgacactttaagaagaaaagtttaccaataagaaactttttgaatttggtaagcggagtaaatggaaatcggatctgactgaaatgtagagaaaatcccaatggcttttaagagccagggggatcagtttctttcgtatataatgaaagtaattatgaaaatgctcatagacagggaggatgccgggtgaccatcggctgatccccggcatttattatgaaaaagtttattcaaaaagtatttacttgacagcgtatttatcaaatctgtttcgtgttccttttgatgattttagtatacccacaattcgtgaaaaaatagtgttctacaaatgaaactttcaataacaaaaaatgaacaaaatatgaatatcaagttcgcgttgttcaggttgtacatttatttgccgtttcggaacgcgaaatatggcagaccgtctttctgtggcacttccacctgtccctggatgagcggacgggcatagttgaggaaggcttctgtcacatcggaaccgtctggggtgatccagtctgccggtacggtcttttcctcgttgcagatctttgtgacatcggcggttccaggtgtcatctcataagagtctccttctttacgctcaaatgtaatcatcactcctgtcgctccttccattgcacgctctacgccgtaggaacctgcaagaatggcctcctggagatctgtccgggacagacaggcagaagagcagcgttgagaaacattgagttccacggagcgcactttgatgccgagtgtttcttttacgaggttttccaggtatttaccggatccggtcagcattttgtgaccaaaggtatcggtacctacatcatttgcatactcgcaaatgaatgttccggtattgtcgtggattccttcagagatacatacaacaagattcgtggtggtctccagtgcccttcgtacctgtccaaggaaggtttccggatgaaaggcagtctccggcagataaatcagcaccggattgtcacccttaaacattcgtgccagggcggatgccgcagtaagccatccggcatgacggcccatgatttcaacgatggtgacggacggtttgttgtcatagacggatgcgtcgacggcaatctcgcggacggtagaagctacatacttggcggcgcttccaaagccaggggtgtgatctgtcattaccaggtcattatcgatggtcttcgggattccgataaagcggatcgggctttcatgctgcgcggcgtagcgggagagcttgctgactgtgtccatagagtcattacctccgatataaaagacggcctcgatttcgtgctcttcaaatctggtgaaaagttccggatacaccggatccgccagatcctccggaagcttatagcggcaggatccaaggtaagcccccggggttgtctttacaagcggaagggttccgtcttttatcagcgtctgcatgtccatcatctgtccgtgcaggaatccttcgattccatttaccatgccgtagacatgatcgatctgcggcatctcaaagccttttgttataacgccgtagagacttccgttgattacggccgttggcccgccggactgtcctaccaggatatttttactcatgattcagttcctccagttgattcgattttgcttttagtataacgaaaaaagaaacgatgcacaatagaagaaatggaggacttgaaaaatatgcttggaaaatcagagaaaagcgattatactgtaaacagtaactgcaaacgcaggaacgggggaaaacaatgaagtatattacatttgcaataccatgttataattcacaagattatatggagcgggcagtcgagtccgtactcaaaggaggaaaggacgtcgagatcatcattgtcaatgatggatccaaggacgggactgaggagatcgggaaacgctacgagcgggaatacccggatattgtgcgggtgatcagccaggagaacggcggacacggtgaagcggtcaataccggacttctccatgctacagggaaatattttaaggtggtggacagtgacgattggctggatgaggaggctctgattcaggttttaaaccaaatgaaatctttcgaggagaaggatgaagaagtcgatatgttcatctccaactatgtctatgagaaagtaggggcaggacacaagaaggtgattcactacagaaactgtctgccgcaggagcggatttttggctggaatgatctgggacatttccgagtggatcagtatattctgatgcattctgttatctaccggacggagcttttaaagctttgtcagctccggctgccaaaacatacattttatgtggataacatttatgtttactatccgctgcctcatgtcagcacgatctattatctggacgtgaatctgtaccggtattacatcggaagggacgaccaatcggtcaacgagaagaatatgatcaaacggattgatcagcagctttttgtgaataagacgatgattgagatgtatgagatgcggatgattccaaacaagaagctgagaaactatatgataaaatatctggcgattatgatgacggtttcttccatcatctgtattcgttccaagaaagaggaaaatctggaaaagaaaaaggaactctggatctacctcaagaagaaagattaccggacgtacttcaagattcgttatggcatccttggacagacgatgaacttaccgggtaagccgggaagaaagatctcgtccatgggatactccgtgatgaggcggattatcggatttaactaaatatgaataaaagaacggccatggtgcatactactcaataaaagattgagaaagagaggtatgcaccatggccgttgaatttgcacagagccagacaaaagagaacctgatgagagcctttgcaggggaaagtcaggcgagaaaccgttacacaatcgcggcagaggaagcctgtcggaaaggtttttacgcacttagagaggttttcctctttacagcggatcaggagagagctcatgccgcaagattttatgagctcctgaaatcggaagcgggttgtaccatccagatcgacggaggatacccggtggaccagtcagagagtctggtggagcttttaaagatggcagcccacaatgaggaggaagagcataaggatgtgtacccggcttttgcgaagattgctgaggaggaaggattttctgaggcggcttatgccttttcccagattgcaaagatcgagagaatccacggggaacgcttcgcaaaacttgcacagatgcttcagcaggagacgtactatgaacaggaagccggcggagagtggatgtgtctgaactgcggatatatctttaaaggcgcgaaggtgcctccggtctgtccggtgtgccgccacgagaggggctatttcatcccggcctgtatggcaccgtatcttggattttctaattgtaactaagggaaagaaaggggaatgagatggcaagccagaaaatcgaaaatgtgctgaatctggcactggacgcaacacaggaggagaggcttcgctccggcaatctcgaggtggggtacgatgaggcggacaatacatgggatgtcattatcctgtattccgggacactggattcggtggaccggattgcgatggatgtcatcccactgttgaaaaattttgcggtcgtaaggatacgggaggaagatctggaagaattggcttcgttagaggaagtcatctatatcgaaaaaccgaagagactgttttttgaggtagcaaacggaagaagggtgtcttgcatcgacgcggtgcagacaccacgtttgcgtctgacggggaagggcgtgctgatcgggatcattgattctggcattgaatattccaatgcggattttcaaaacgaggacggaacgacgagaattcgtttcctatgggatcagacggtggagggcagcccgcctgccggataccggaacgggacagagttttcggcggaagagatcaacgaagcgctccgacagcccaaccggacgatgcagctacaaagggtgccaagccttgatacctcaggacacggaaccgccgtggcaggggtggcagcgggaaatggcagaaacagcaaagggcagtaccggggtgtggcgccggatggggaactgatcgtcgtcaaactgggaaatccgggcggcattggtttccctaggacggcggagctgatgcaggcggtggactatatcgtaaagaaagcagaggaacttcggatgccggtgtccattaatatcagtttcggaaatacatacggatctcataatggcacctccctgccggagcggtttctggacgcggcggcagagacgggtcgaacactcatcagcgtaggaacgggaaacgagggagctgaggctggtcatgcgtcggggtttctaagagagggagaggagcggaacattcctttggcggtgcaggagcggcagggggcgtttagccttcagatctggacggattatacagatgtcattggagtggcccttcagactccttccggggagagagtcggtcccatccgggaagtgatggggacgcagcggttccgggtcgggaaaacagagcttcttctttactatggggagccaagtccatacagtggactcaatgagatttacatggagtttctgccggcggatgattatgtcaacagtggggagtggaatattatcctgattccggaacagattgtcaccggacagtacgagatgtggcttccggtgagctatgtcctcaatgaaggtacagccttcttctatccgacggaggagcggacgctcaccatcccttctacttcctcccgggtgttgactgtaggggcttacgatgccacagccatgacatatgcggatttctccggacgggggaaagaaaacaaggacaatcagaaacccgatcttgccgcgcccggagtcaatgtcatctccgtccagggacagggcgggtacgctgcttttacaggaacctcctttgccacaccatttgcggcaggcggagcggctcttttgatggaatggggaatgatagaaaaaaacgatccgtttttatatggagagaaggctaaagcatacttaagaaggggggcgagacagcttccgggctttgaagtctggcctaacaatcagctcggatacggggcgctttgtgtgcgggacagcatcccggagacaaggctttcgtgattgtaaacactttttgccaggtgtttttaagcataatgcataaaaagttctctgataagaaaaaaatattatctgttttgatacctcctgtaggattttgaaactcataggttatatttataaccagaaagaaaaagaggacgaaaatctataagacgcagttaaaggaggaaacaatatgatcactatcttgtcaggagttgggatgcttctgcttacgctggcaatcttctcccttttcagtatgaaaatgccaaaaggatctcttgcaatgagcggaatggcaaacgcagcggtggcaacattccttgtggaggctattcataagtatatttcaggagacctgtttggaatttcctttttcagaaccgtaggtgaaaacgcaggaggctttggcggcgtggctgcagcgattgcggtgccgctcagcatgggtacaaatccagttctggccattgcgtcaggcgttgtattaggacagttcggaattttgcctggatttatcgcgggatatgtagtcggattgatttctcaggtaattgagaaatacctcccggagggcgttgatgtgatcgcaggagccctgattgtagctccgctttctctggcagtggcgacagcggctgatccgcttgtgaatatgacacttgcaaagatcggcggcacgattacagcggcggcagagcaatctccgcttgttatgggattcctgcttggaggaattatgaagatgatttgtacctccccgctcagttccatggcgctgacagcgatgatcgggctggacgggctggcgatgggaatcgcggcgatcgcttgtgtgggtggatccttcacaaacggtatcgtattccaccgtctgaaacttggagataagagtaatgtcattgcggttatgatggagcctctgacacaggcaccgatcatcacggcaaatccgattccgatttacggttccaatttctttggaggagggctggccggagtgtcggcggcggtattccacatcatcaataatgcaccaggtacagcgtcaccgattccgggacttttggctccatttgcatttaacaacccgatgaatgttgtattggcagtcgtatttgccgcaatcggcggaacccttgcaggacttgtgggaagccagattttcaagaaacattacgaaaagaaagcagcaggaagagaaaacagccagatggcagaagttgcgatggctgattcatagaatagaagaaagcctctggacgggatatcgatcccgggccagaggctttttcggaagcacagttatacattttcacagtagctcaaaagagcgttaagaaagctgcggatctttacattcccgtgcttgtccgatttcctgcgaatataatccatctcccgtcttacctgttcaaagttgtataaggtatttgaaaattctgtaaacacgtcgttggaatagtcttccagtcccaggtgcgccagattgacaagtccggtggatgccgctctccggattctttgctctacggatttaggattctcgctgaactgggataaaagacggccgagcgtttgctgctccagcgtctccgaccggtcgtgcagccaagtaattaaagtgatgatgtccttgcttccaagctccccgatgatccccagtttttgtagtacgtttgtaagccggctctgaaaattttcggactggggggagggattatctgattgcctgccgttttcggaaaactccgtctcaaaaaggctctgtactttaccaatggtgcggtgcatggacagtgttttaaggacattgcggattacagattccacctcaatcgcatttaacggcttctggatgaagaattcgatccccgactcgtacgctttagcgatcagatccttggaagcaacctgggataacatgatgcaggcggattccggagaaatcttccgtgccttttccacaaagctgattccatccatatccggcatgagaagatccacgatgataatatccggatggagggcagctacatcttccagggcatcatccccgtttccggaggagccgcaacattcgcccagattccgttctgtcaccaggattttcagtatggtccttatatttttatcgtcgtctacaaagtaaaatttcattctgaaccctccaatgtttcttttggcagccggatagtaaaacaggtcctccccggacaggactctgcctggatactcccgccaagcttttcttctacaattccttttacgatattcagtcccagtccccggctgatctccccggtctcgtaattgatctttgtggaatatccggcgtcaaagatctgtgggagagactccggggcaatgccaggtccctgatccacaacagaacagcggatctcatgtgccgtttcctccacattgacggagatagaaacttccgtctcctttgtagcctccaccgcattcataaacagattacggaagacggaaagaagctcgtatacgtgggctgtacgaaacgtacaggaaccattgagtcggaatgtaagcgtcttgttcagagaggccgcaaactgtttaactggtgtctgtaacagggtaaagagctcgtcaaactccagaaagcggctgccgtcctcagtcagaagtgcctctgaaagtccccgcagaatcaagtagtattctttcttgatttcgtgaatatcatttgcgatgatcagtgcatccttcgcggcgtcctttgtaccggaatccaagcggagacgctcgaagagctggtacgcggaatgcatcgtcgactccacgagggacgtatttttctccatccagatgacctcttcctggagtctcgccgtcagaagcgaaagatgccgatagtaatcctgctgctctttttttaggaggacgacatgatacctgcggaataccgttacaaaaatcaggatcagggccgtccggaaaagtgcggcgatgataattcccgattgcgaagatgccgaaaatgcattaatattaagacgaagcatcagttccccaaagttcgccgcatagtcgcagaaaagcagggcgatcgtgtccaacaggatggaggacttccgcatcctgacgaggtagagcgtcaggagcactccgtagaacaggtaaaaaaacagctccggaatggaggaaacaaaggcgtcccccagggaagtcccgttaaaacttccgtaaaaagtacgggagagcaggacaaagatgccggatatggcggacaccgggatcaccggaaagtcctgtgcaagcatggaaaaggacgccagaaaaacaatccccagagaaacactgaactcaggcgaaaagatattaatatgaaactgggctgccgccgcggtaatcagactgtaaaatacggcgtgcagaaaaagatcaaagcggttccgagatttcataggtctgttatcctccgtaaaatcttcggtctcaaacaagtgaaacttagattagggtatttttgtggatgtctgaattattataaaacattttatcataaaaaaggagaaaaaaacatggtgaaacgggaagatttatatggaattgcatattataaaaagtcagcctattatggaagcgcgaaaccggacatccggtttcggattgcactggatatggagaaagggaaactggaggctgctgtctggaaagaaccgtactgctatgatgtgacgccggaagaagagattgagcgaaaagaatttccggcggacgatgagggactctgccagattacagactggattaacgaaaaggcgaaatagagaatccggaagaggaaagcaattcgagcttcccatttggaaaagccgtgttatagtagaaagcgtgtgaaacaaaagaaaaaggaaggttgagagatggctgagaaaacaggggtcattcatggcagattccagtgtctgcatttgaaacatatggagtatctgatggcggcaaaaaatcagtgcaaaagactgattatcgggatttctaatccggatgcaggatttatccgggtgaatcttcacgacaaaaaccgttccaaaccggagaacaatccattcacttattttgaacgctacgagatgattcgacttgccatgctggagtttggcgtgccgagagagcagtttgagattgtcccattcccgatcaatacaccggagctcatttttcagtatgcgccaagggatgcagtgtactacatgagcatttgcgatgattggggggaggataagtaccggacactaaccggacttggcgtgcaggtggaagtgctgtggaaccgtccgactgaggagaagggaacgacagccacggaagtaagacatctgatcatagatggaaagcggtgggatcaccttgttccgaaaagtgtgtaccgttatattacagaacatcatctggatgaaaggatccttcagatcgcaaaggaagccggaaaaacaaaatgaggctacagtcatcagagaaaataaagggggagactcctctccaacctctcagactttagaaacgtctgggatgcttgcagggaagtctccctcctgtcatgtttctaaacagcgataccgatcacacggcttagcggatgatggttccggtccggcctttcagtgcgtcacgaagcgcctcctgacaggtaatgtaagccaagcggccttcgcccttttcgatgaaggagacggacgcacggaacttcggcagcatattgtagacgccaaaatgtccctcctccatatactgctttgcctgggagacggagatctcaccaagctgttcttctttgtctgtaccacggttaatgaagactttctccacacttgtcaggataatcagtgcgtcggcattcagctcctctgcaagtttccctgccgtcaggtctttctcaatgacagcgctggcgcctttgagacggtgatcctgctcaaggaccggaattcctccgcctccacaggcgatgacaacctgatccgcatcggaaagggtccggatcgcgtcaagctctacgattttcaccggattcggtgcggaaacgacacgacgaaacccctttccaggctcctccaccacatagttgcctttttttcgctctgctgcagcgtcttctgcggacatataacgtcccagaacttttgttggggtgtaaaatgcctcgtcgtacggatctaccgttacctgggtcagaatcgtactgacggtacggtaaattccccgtgtaagaagttcctcccggatcgcattttgaagatcaaatccgacgtagccttgtgtcattgccgagcagacagacatcggagctggagtatagtctggatggttcttgccgaattcattcatagcagtgtgaatcataccaagctgtggcgcgttactgtgtgtaatgacaacctgatagccgtcctgtacaagatccgcaatggattttactgtcttgcggaccgcaatctgctgctccgggagcgtcgttccgagggctcggtgtcctaatgctacaaccactttttttttcatacgcattacctctatttctctttgtagtttcgtgtccatgataaaaaaattatataatttttccagggaaaatgcaaccgtcattcggctgcaacacccatgttttctggaaaaataaaatagttagaaaattgtataaaataccatatatagtagaataataaaaaaatcacaagatatggtagaaattatggatcacctctgctataattgggattgtcgccggggacgaagaacagaagtcccgggcaaattcagggaaaacagtgaggtatgatatatgaaagtaataaagagagacggacgggaggctgagtacgacagaaataagatcgtccatgcaatacagaaagcgaataatgaagtcgaaaaggaggacaagatctccgaggagaagatttatgatatcgtagcttccattgagaaccggaagcttgccagtatggctgtggaggatatccaggatatcatcgagcagaagctgatggaggagggcaaatatcatcttgccaagaaatacattatctaccgctatacgagagcgatggtgcggaaatccaacaccacggacgattccattctgcgtctgatccggggcgagaattccgaattaaaaacagagaattctaataagaattccacccttgcttccacacagcgtgactatattgcaggggaagtgtctaaagacctgacaaagagagtgcttctgccagagaagattgtaaaagcgcacgaggaaggtgtcattcattttcacgatatggactatttcctccagccgattttcaactgctgtcttgtaaatatcggagatatgctggataacggcactgtgatgaatggcaagctcattgagtctccgaagagctttcatgtggcatgtactgtaatgacacagatcattgcgtcagtagccagcagccagtacggaggacagtccgtggatatccgccatctgggcaaatatctgcacagaagccacgagaaatatatgaagaaatacagggagaaatatacaggagtcctttctgaagagttgatggagcagcttgcggacgacagacttcaggacgagctgagatccggtgtacagacgatccagtatcagatcaataccctgatgacgacaaacggacagtcgccgtttgtaaccctgttcttaaacccggacaaatctcatccgtacgcaaaggaaaatgcgatgattattcaggaaatcctgcgccagcggatcgaaggaatcaagaatgaggcaggagtttatgtaacaccggcgttcccgaagcttgtctatgtcttaaatgaggacaataatttaagtggtggggtatatgacgacctgaccagactggctgtaaagtgttccgcaaaacggatgtatccggactatatttccgccaagaagatgaaagagaactacgaaggcaatgtcttctcaccgatggggtgccgttccttcctctccccttggaaagatgagaatggaaattataagtgggaaggccgtttcaaccaaggcgtggtcagtcttaatcttccgcagatcgggattttggcagagggagatatggaaagattctggcagattctcgacgagagactgtccatttgctttgaggcactgatgtgccgtcacaaggcgctggagggaacaagctccgatgtaagcccggttcactggcagtacggcgctatcgcccgtcttggaaaaggcgagagaattgacaaatatctgcacggcggttactctaccctgagcctaggctatatcggactttacgaagtgacgaagctgatgacaggagagagtcagacgacggaggaaggacagaagtttgccctcaagctgatgcggagactccgtaccgcaaccgatacatggaaagagacgacaggacttggattcggtctttacggtactccggcagagagcctgtgctaccgctttgcggaaatcgatcagaagaaattcggcagcattacagatgtgacagataaaggatattacaccaattcctaccatgtggatgtgagggagaagattgacgcctttgataaatttacttttgagagtcagtttcagacgatcagcaccggaggatgcatctcctatgtggagatcccgaacctcaacaagaatctggaggcagtagctgaggttgtgaaatttatctacgataatattcagtatgcagagttcaacacgaagtcagattactgtcaggaatgtggctatgacggtgaaattatgattaacgatgagttcgagtgggaatgtccggtctgccacaataaggatcaggcgaagatgaatgttacaagaagaacatgcggatatctcggagagaacttctggaatccgggaaagacaaaagagatcaaaagcagagtgatgcatttgtaggtaaaggggctttggaacgatgtattatgcggatatgaaacggtgggatgtggcaaacggcccgggcgtacgggtatcgctctttgtgagcggatgcacacaccactgtaaaggatgctttaatgaggaggcgtgggacttctgttatgggaaaccatttacagaacagacagaggatgagattctgcgagagctggaaaaaagctattatcacggatttaccctgcttggcggggagccgtttgaatatgaaaatcagaaagcgctggccccgtttttgaagcgggtgcgggagaaattcccggatctttcgatctggtgctattccgggtacgtcttcgataaagagatcctcgcgcagatgtttccaaagtggaatgagaccagggaaatgcttgactccatcgatgttctggtggatggaagatttgtagaggagcaaaagcaggtagatctgctctttcgtggttccgccaatcaacggctgatcgatgtaaagaagtcgatggagacaggagacgtcgtgctgtgggaacagccggaatacgtccacgtggaagtcaaagagaatccaaatgaggtggggattccaccggaaacaagcgggaaataaccggagataaacaatagaggacttatcttccgatggccttgccgttattttgatcatacagtatttgtaacgaaagcacttacagaaatgtgagtgctttttagtaccataaaagtgtagttgttagagagtaattaactctgacatctacacttattttattataataaggggagtaattggtctggcgaggtgctttttggattagccacatccgacatcaaaaatcgttaaccaaccccttattataggtattcgcttaagcaggtagagacatagctctcgtgtaaccaactaaaatgaattgtaataagtgtggctggatatcaattacaagaaaattcaggaggtacatatgataagtgtaggaattgatatttcaaaaggaaagagcacagtttgtattttgaaaccatatggagaaatagttagtagtccatttgaaatacggcatgtagagcgggaactggatactttagcacagatgatattaagattagctgaagaatcaagagtagttcttgaagccacaggaatatatcatcttccggttctgacatatcttcaagaaaagggaatttatgttgcagttgttaatccttatgaaatgaaggtgtggattgtcaacagtaaactaaacaacttttttaaggttattctcccggtactcaactggtgtcaggtaaccgagcgaggaatgaagtctgtgattgttaaaccaattcacataatcagcaagccccagttttaatgcatccagatttgcaaatgtttggttttttacaaattctgtcttgatgattttaaaagttgcttctgctacagcattgtcatatgggcatcctttatggcttaaagatctggtgatgtcaaatgcttccagcgtctcttctattagctgattcttgaattcgttgccacggtctgtgtgaaaaatattgattttttccagactgccgcttacagtcataaatgcctgctttacaagctttgcagttttatggggtccggcactgtaaccgatgatttcacgattaaagaggtccacaagtacacatatgtagttccagttcattccaacccggacatatgtcaatcacttgggagtatcccaaagtttgtgtaaaccttcaaactgatgtaagatagacttacaagtttggaggtttattttatggcacagttccgatagattccaaactgcaatccaccgattttattagccataagtgttacaaaaatgcttgaccacaacagactttgaccttatttcagcgtgttttacaggaatatggaatccggcataaactgatccgtccatttaccccaaggcataatgggaaggtagaaagaagccaccgcaaggataacgaacgtttctatgccagccatacgttctactcttttgaagatttttcaaaacagctcaagacatacaatcataaggattataatcagttccctatgcgtccgttaggctggaaatcaccacagactatcctaaaggaatttattcagtatggtgtaacatatgtttgacaaacccacatccaacttgaaacggtctcataaattttattgcttaattcttgagaccactttcagatccacgaaatctgtcatttcccatttgtcccctgttttttccagagcatattgacattcttgtgtcatcaactgcaacgctttcccctccacctgtacataataggtttccctggtagagacgacacagtgatcgtctccattatagttgacgtctgtcaactcatatgtatctaattgctcagtgatctctctttggacatacgtttcctgctccttatagatgttgcttcctgatctcaaatagtctgagatcagagaaaaatcatgtcccgttactgcgtccgggaaatttttcaaatattgctctactacagcttccggtccattcgtataaatattctcactttttgcggtcagcagaatattcggctgataagtataatcactctgtccaccatactcttcactgtgatatcccacctgaattttggcctggtcatccaccgtcgctccagtattatcctcaaattcaataagatataactctttttccatctgatatatttcctgataaatactatccatggaatatacatcatcaattctgtaatactgcccgcccgtctgagaagcaatataatcaattctggaagaatcgatatcgccgattccaataataaaaaccggtacatgatagcggtttgcgatctctatcacatcctctggagtgcaattactataattgtcatttccatcggtaaaaccaataacacagcgtgcccctgactgagccgccacacgctccactgatgtataaagagcatcataaaggcttgtcatgtctcctgtggtaaactggttgatctttcttgtaagaagagccggatcatcacagaattcctgttccagccgcacaccagtggcaaaggaggtcaattccacctgatcacctgcgtcaaactggacgcttccgataaagctgttcataatagattttgcttcctctagtggattcccgtccatactgccacttagatccgccaccatgtccactttcaaggcttctgtctcgttgagctgattggcttctgtcactttttgacggacaaacttcgcatttgcatcttccttacgaataaaaaacagattcccttgcagattctcaggtacttctcccgtagtaggatcttcaacattcacatatagacgaacttttggaaattctgacgcatctacctgttgtacctgcacctccagactcttttcaggctcgatgtacataaaaactgtctcatctaatttttcaaacatttcctggatcgcaggataatcctgctctttcgcctgtactagtttcctgacctgattcatctccgattcatatgaagaaaactccgcctcttctgcggtggacatatccacattctggtagtactgaatttgttcctgtatgaaattatccaagtctttcttaatcgtttttaagtcactgattacatcctgtttttctttcacatcaaaaagacccagctcttcccacttttgagatgcatcgtttactttttcttcatattctgtaaatccacagtcttgtacttcttcaaatactctatctttttgcatattgaggcctgtcgtcgcatagaccgtcccgccgcccaatgccagcataatcagaactcccgcaatgcccttcgcaatcagtggctttcttttgtctctgcccttatgatgctttcctgacggaaccattttcggacgctctttatccaaataagaagtattcttttctaccttctccccacaattagggcagaacagatcctcctcactcagctcatgtccacatttcgtacaaaacatttctcccgcctcctctctttatctttcttctgtctttgctttactcatcagtctatatccctctgcgattcctattgcgtctgcttcagcccagcattcttccagctttccttcttctgccatctgccgtatctccggcaccgtgtgaaaaccatgctcaataatcatacccggaacacctacattcaccgatcctctgagcactccataataatcttcattcagatccattcttctacaaatggttccccttacgttaagttggtcattataagcatccgtccaattcctgatttgtgtttccgtttttactttgtcaaatccttctactaacgcaatccccaactgataactgctctgagccagatgttttccgaccgcattagcaattccaagagccttgtcatcctgacatgccatcttatttagaattaagatcggcttgttaatggagattggctgttctactgttccatacccgtttaccccttcctgatttgcattggtatgaagggacaaaaacaaatctgtcccttttgcaaattctccacgaagtgagatatgagcactgtccagttcgtaattcgtaaaacctcccaaagatatatctgccgtctctctggtcagtatagtagaaactccatattcctcttgcaatttctgagccagtttcttcgccaattgcaaagtaaagtctccctctgtataggcaatacctgtctgcaccgcatttcttcctccataatgccctggatcaatgcaaataagcaagttgctgactaatatgctctccccatcctgcccatcatatttttcagaatcacttaccttaacattcacacgatattcatattgaaactggcttgtgtctgcccatgtatctgtccaggatatgacatcgctattttgaatctgatctgggatcactgctcctacactctcccaatcagacgtgcccgctggacagcgttcaatctgatactcctgtacatatggattccattgatcagaccaataaagctgaatttcccgatcagaaattctggaaaaagaaagtccttttacaccaataacctgcttgggaaattttgattcttctttctgcgttttcttagactccgtttcttgctttatttgcgaactacttccattctgtcgcccaataaattctttttctgcccatatccccaaagctacaacaactatgactatgctcgttctaaccagaagcaatagcccgtttttctttatttccatactgtttctacgcacatcctactatttcatatccaatctgtctcatttaatctgtcggtcggtaccatgaatctatttctttttgtaatacatcgtacatccaagaatcttcgtccggttccataaaccatgttccatcctgatttaatattccatattttatttttccatcttctttactgactgccaccaatattttctctcccattaaaataggaatatcgtctatgccacttgcaatcacttccccgtcctgaataagatcatattgggtttgatcatcatagttaatccatccaagccatgtgtccacatcgttctttttataccctgttaagctctgatagtcaacgagcatatcatactttttagcttctatccacctacccttactatcaataaaaccggcttgtttttctccttgctcatccattttctttacatatgcgtagttctttttcccaaattttctcgccttgatgtactgaaagtctataacgacttccccttcttcattgatatatccgtatagaatgttttcatcttcattatccagtcccacatatgccagaccattgttcgagaaatctcccgcatcttcatattgacatggaatgacttcctcccctttttcattgatataaccatattttacttccccgctagcattcttttttgccacgtacgccaagccgttgcccataaactctcccgcattggtatattgaaccggaatgacttcttcccctgtttcattaatatatccgtacttgatatttccatcagcatcttctactccaatatatgccagtccattttccgcgaaattccctgcattatcataaatacatggaatcacttcttctccctcttcattcaaaaatccatataaatgctccttggattctgccagagcaaatccattctttccgaatttttctatattctcataccctttggatgtaagaatctttccatctgcactaagatatccatatgtacgatcatactcatctgcatttatcacttcatatttgtagatattttttctattagttgtagtgatcttgttaaattcgtaatttttagttaacacttctccattttgatccattaattccctttgaaatttttcatctacttctatggtacttaatccattcccacccgcaacagtctccgtcctatctttaatatagccttctccatcatatgtagcagtagaaaaaatgacgtctccgttttctttttccaaaattgaaattccggcatactgtattggcagaacctcttcattctttaaattaatcaacccatactgccaaaccccatatccatttccttgtgcaacgtgtgcatattgttcatccccataagtttcaaaattatacgcaaattcatattgaggttcaattacccattccttgtccttattcacaaatccccatttcccttgataaggatatggatataaagtatcctgctcattgctttttgcgggtataccgctttctttttctgttttgttctttttatggagccagttattgatcccccatacactgccaccaaccatggaaacgacgactgccgcacagacgaatatagcgatacgtttctttctcttctcatgctttttcgtctctttttgttcttcctcttgccttaccttggttccacatttaggacaaaattgatctgtatctttcaggcaagcaccacatttacaacaatatttcataatccgctccccctttctaacggttctctcgatagcattgcacttgagaataaacaatcaaacatatcacaacactaagaactaaagatatctcccatattgattcatataccaatacagtccggaaaacaaccatacgtaatccttccaaggacatttcaacgaccatatccgctatttttaatagcagagatacactaagcaactctaccgcatattgcactttatactttccagtcttaatactccaaagaatactgattgtcattctcaccatgagtgcatacagtcccaaataaagtatcataccaatcatcttttcactttcgcccaataaatcaaaaagctgtctggtatatgataagtttgaaaaacaagcatccgaccatacaaccaataatatgacacagaaaaccgcaagtatcacttcttttatcccaatttgctttttacttgattcgttgataaatttttcttctgactctgacacttttttgcccaaccgctcaaccggtttcccgcaacgaagacaaaacttatcattctcttttaactgacttccacaatacgcacaaaacatacccttgcacctcattcctttgactcatatattccttgtccaacgatcaatcctgccaatttgagcaataattctttatgtttttggatattttgtaaaatagttctcaattccatctgcgattccctgaaccatactttcttgaaattttacatctgtcattttttgatcatcctgtggatttgtcataaaccccatttccaaaatagtcaccggaatttcagaccagttgatgcctgtcatagtatcattgggagtaattccacgattttgaagccctgttttctgacagtatgatgccagtatctcatccgcaagctgatagctctgttcatagagatctcccacatatggattttcctgagacatgatcaggcacaatgccccctgcgccgtctgtgtctcacttccatttgcatgaattctgatcgctacgtccgcttgattagaaagaactgctctctccttattgctaatagccgtattattatcttttcttgtcaagacgatctgaaatcctcgtcgttccagctctgtcttcagacgtaaagatatctccagattcagctgatactccgtctttccactataaattcctctcgtcccttgtgttgcttttcttttcatcacagtagaaccgggaccattttcttccagagcgctcatatcgatctgttcactttgatgccccggatcaatcgcaatcattggcttttcgtccactggcttggactccgactgatctggtgctgtattctcaacacgcttttccacattttcttttgcattggttttctcatggtttccatctggctttttttcgtgagagcatccacacattaccgtaagagaaagaatccatataagataccatatttgtcttctacctttaaacatcctattcatccaactgatatccctccggatctttttccaactcctgctctcttaggaaatccgcatttttcttttcatactcattcaacatggaatcactatacatttcatcaaactcttctgggtcgtatattccatgataccaggatttggcatcaaaataattttgcaattcctgagatttaaatcttctcccacgtctggcatagatttcatttctggcataatttaattcttttactgaaaggttttgaatgtctgcaaccgccaaaagttttgatgcactctctggtataatataatctgttttttcttcgattttttcttctgcaacaggtttcgattgttcttgtggttttgtctgctcttcttctggtttgtcttcttgcccttttggggttgaatcaacagtttcttctgcctttacgttttcttcctttttcccttgctgcatatgatcccagagcattaaccccgcaattccaccaataattacagctataaaaatcccacacagcacaatcgttttcccttgaatccgattccccttttccgctgtttccggttcctcatcttctaatggttgtccacatcgttcacaaaacatagcgtcccaatcgttgtatgtaccgcagatctcacatcgtttctttctgtcactttccaatttatatccacattcctggcaaaacacactgtcatctggaattcgctctccacattttggacaaatcattgtattttcccctcatatcttcttataattttgatccgcatccggtacaaaatctctgtccctcttttattgtttttccgcaatttggacacactctttcttgtaccggagtttgatgttgctcttgttcctgattttcatatgccgtgccacactgtgtacaaaacatctgatcgactcccatttccgctccgcaatttagacatacttttttcttttctgcttctggataaagttcttttacttctggatttacaatcaatgaagattgttttgctccgcagttcgtacaaaataaattcccctctggcacctcagcgccacaatttttacatgttctgatattcgtatctgtgttcggtttatagctttcttctggagtgctttcttctattctttcgttttctgtttccactttcgtcccacaatttgtacagaataaatgtccctctgggattacctgtccacagttcttgcaaagtttcccactagatgtcccttgattttcagactgtgtggacctctgaggaagtcttgctccacaattattacaaaataccgagtttgccggaacttcagagttacaattcgggcaaagaactactccttttaagttctgaagctggtctttccataccgcaactttatttttgctctctgatatttgctgacaccacacaagaaaatcaccttctgcgacatctttaaaacaatggtaatatagttctcctattttctggtaaataatcttctgctgattttcttcatcacgaatcgcattggatattttcacgctatcggacatatcctttgtcttcttaattgccccttgactaagttttccaattttattattgatctcatctaaaaaagccatgttcttttcctcctttatgcttcttcttgtaaataccacgaccacgatttcccaaacgtatctgtcgtcgttgcttttcctgtttttgtatctacagttaccgtagtaaccaatacattcgctaccgttccaccctgatatcttacgatcacctcatacccggactcagtttgagtactttcttcatcaaacactacataatcctcgctatgattgatcgtattgtaatgttttgcaaccgcatttcctatttctgtaacagaccaatcctgaattcctgtcgtttcttcccctttcgtgtacacctcactggaccatgatttgctcttttctccggttttccaatcaaaaaattcctcattgcaaaccacctcgatctttatggatttatcatcgataggtgtaaatgtaatatggaacatgtttcggctgcttttaccctgaacctcgtatgtactctgctgatcattccactcaaaataaaagtcttcatcagccatagcagcgcctgaattatgccagaacattaaatcacagtttttctttccattttcttctgcaatatgaaattctgacagcaactccccggatgcaaacttatactctcctgtagctatactcatctgcgctgacttcttttcttccgttttttctgtctcttcttttttatctgaaatctgtatcacgccccatcttccatcttttttcacccaacattttccatcgtacaccggacgaatggtttcaaatacaccagtagggataactgtatttccttttagatttaccagcttccattgatcatctttcacaagggtaacatagcctcctgaagcggcataacaaaacgataccatagcttcctgagttgtattatgtgtctcatctttaaactgctgccacgaagcatcattctctatcggaataatctcctttccatcctcatttacatatccccatttattgtctttctgcacagcaattaatccttctgaaacagatccacattcatcatagataaaatcagtaatcattgttccttctttacacagcccatatttccccttttgattccggaaccattcataaagatttgattcatcaacggttccttccacatctttaaccgggataacttgttctggagcttggaaagtaaatccagcccattcttctaaattatgcagagttccctgataataaaaaaagtattgggcatgctcactaatatccggaaccccctcaactgtactatagtaaatttcttctccatagagagcatcacaacctggcatcccatcaattttatcaatcttttccataacatagtctgcattactcggttcagatgtagcacttgcgtaaatcagtgtgtaatccatacctgttcgcatcattccatccataccgatcaaacctaatctgtcaccttgctgaataatcgcatagtcgctgagatattgttttcttctttcattttcagattcttgtgccttatcattcatcctgacataatagatatcatctgcctctatagttggttctaccacccactcatagttgatgacagaatcatactcttgctctagcttttgaaactcttccacatccttttctggaacttttttctgtgcctgttttgctattttagccgcatcatcatacttttcctgcgctatataggtatcgatcagcttcaaatatggctccgtttttttcggatcaatcgcgatcgcttttaggtatgaatcctccgcactttcataattcaactcttccagatacttttgcccagatgccagatgatcctggtactgtttttttacttgattttcttttgtcacccagataccagcaacgattactgctataattacaagcattccggctaaggctacaaagataaatttcttttcttttttcttcggcttttctgaatttggcacttctttctgctcctctaccgtttccagactcgtgccacaaacggcacagaattttgcgtctttttcattatccgctccgcattttggacacttcatacgttttcctcatcgtcctttcatctcgttagtgtcactgcttgtttagtacgatatcccatttcatcaaaatcatcatcataatcggcgtgcagaacattttcatcctcatcataggtataaaggacggtatatgtataccccgctacaagttctctctctattcccggtgcctcataataattcttatcaaaaatagctttgatcctgttttccccaacgacttcatatgtgccagtatccgtatttctatagcattgacttacaatagtaccatcagaatttaactctaccctacactcatctgggtattccccatcttctataaaatcactggttctttcaagttttccattccatacaccggcaataacatctcctaaatccgaattctcggttgttccaattgctatcacgccccatttcccgtccttcttcacccagcatttcccgttatatactggacagattttctcgaatatccctgttggtatagctgtttttccctctaaatctgccaacttccattttccttcttgaacaagcggaatgtatcctcccgatgccccatagcagaaatctattatttttcgttcctgtgttgccacaactgtctcatcttcaaattgctgccaagaagcatcatattctatcggaataatttcattgccgttctcatccacgtatccccacttatcatctttctttacagcaattaatccctcagaaacagatccgcattcgccatagataaaatcagtgatcattgttccgtttttatacaatccgtattttccccgctgttgattccaccaagcatacgggtctgacacttctattgtaccttcggcatttcttaccggtattgtctgttctggttcctgaaaggtatacgcccatccttcccattctgccaaattatgcaatgccttctggtaataaatatattgccccttttcgtcgaaaaaatctgtaataatatctggatgtaactcatcattataaaatgcgtcataataacttagtcctgttttatcaagtttctccataaggtatcctgattcgatccatgcataatccatacctgttcgcatcgttccgttcatatcaatcagccctagtttttcaccttgttgaatgacagcatagctggattcatactgttttctgcgttcattttcagactttcgttctccgctccccagcctgacataataaatatcatccgcctctatggttggttctactacccattcatagttgatgacagaatcatattcctgctccagcttttggaactcttccacatccttttctggaacttttttctgtgcctgttttgctattttgaccgcatcatcatacttttcctgtgctatataggtatcgatcagcttcaaatatggctctggttctttcggatcaattgccattgcttttaggtatgaatcctccgcgctttcataattcaactcttccagatacttttgtccggatgccagatggttctggtactgttttttcacctgattttctttcattacccagattcctgcaacaattattgctataattacatgtactccggctaatcctgcaaagaggtatttctttcccttgttcttcgactttcccgaatttggcacttctttctgttcctctaccgtttccaggctcgtaccacaaccggcacagaattttgcgtcttttttattttccattctgcactttggacatttcatatgtttatcacccactacttatctaagttcttatcgcaccagctccccacttgatgcattgctgtatcctccctctatgaacgtctgatcatactcggcatataatgtatctttgttttcatcatatgtatacagaaccgtataggtatatccctcaatcaactgcttgttctgcccagcgctttcaaagtaattctgatcaaatgttgcctgaatcgtattctctcctactacttcgtatgttcctgtatcaatgttacgataccctgtagtttcaaccgtcccatcacttttaaattgtgtagaatatcttgatgtatactcctgagaactatccgttgccacatccccggtactttgtaaagcattggtccaaactcctacgatgctgtttttgaattcttccccggtttcttctgcgactcttataacgccccattttccatccttcttcacccagcatttcccatcatatacaggacgaatggtttcaaaaacgccatatggtattgcggtttctccttgcatatttacaagtttccactgtccatccttcaaaagcggcacaaagcctcctgaggctgcataacaaaatgctttttcgtccggcacttccaggtctgctgttccatacctatcatagaaaaacccttttccccatgacggttcatactcaaacggaatcactgtctcgcctttgtcgttgatatatccccattttccgtccttttccgccgccatgaatccgttcacacaagcacctaactcatcataaacaaaatccgtcatcagccgatctcccttatagactgcatatttttcgtctgcactctcccaccatgactctatatctgagaaatcctgccactgatattcactattgaatttcagaacgggtatggtttcatccggtatctgaaccggttctgcgaactctggattttgtttatcatagtattcatttgtattgtgcaacgtatcattgtaccaatagaacatcccctttgttctaccgccaccgccaagaccatccacgaaatctatggttccgtctgcataaagaatatccagatcagactcactgttaaaatccggaataaatcttggttctgttctcttcagcagcaatccgtatggcgaattatagatttcctgataaatcatttcactgcacattttaccttggatgtcaatcaacccacagtttccttcttttttcaagatggcatatttctcctcttgttgattcagttcatttgttgaataggtatactcatcccactgacgtacatagtaaatatcatctgcttctatagtcggttctactgcccactcataatcaaccacagaatcatattcctgctccagcttttcaaattctcccttattcttttccggcacttgtgtttgggcctttttcgctacttttgctgcatcgtcatacttttcctgggcaatataggtatcgatcagcttcaaatatggttccgggtctttcggatctatatcgattgctttcagataataatcttctgcgctttcatagtttagttcttccagatatttttgaccggatgccaaatgatcctgatactgtttttttacccgattttcttttgttacccagattcctgcaatgatcactgccccaatcagaagtactccaacaattcctataaaaatcggcctcttcccttttttctttgccttttctgtctccggtatttttttataactttttgatatttctaaactcctgccacatttagaacagaatttagcaccattttcattttctctcccacaatttggacatttcatacatcctctcccttaccgcactttatagccacattttccacagaatacagcctcttttttcaggatatttccacattgcggacatttttgtggggctttcaccaaatttttcaactttgtgatttcatcaaaaaacggcagcagttcaggaagcggatcttcaaatttcccttcataatatactttccctaactctgcgtaaatcttttccaacttcttgtttgaatcgtctttttcatcatttacaaatactgttttatcattgtcctgcataagtaacccctttctttccaaatccatatatcgctactattcctatcactgcaaggctgatccattggaacgtcgaaaaccatagaaactgtcctctatccaaatcgtaccgtaaaaattccagaataaaccgtactgccgcataaagggtacaataaagtaggatgctgttttgatgtgacttcctttttttgaaaatatataccagcaaaataactactatcagcaaatcggctcccgcttctactacctgtaccggaaacaatgctatattgttaggtgcaatgatcgaatggtggtatgcaatcgctcctatcccatcatacgggataccatagcagcatcctgtcaacatacatccgattctgccaaacgcatgcacaagcggcaaacatggtatataagtctccgcatacttccatacagaaattccgcaaatttttttacataccattaaaccaagaattcctcctgcgagtcctccataaaagacaaagcccccttgcatgagttcactgacataagaaagttccgtcaatcttgaaacatctatttgcttccatgacaccaatagatacaaaaattttgctcctatcattcctcccagaccgccaaatgcagctacaagaataaagtcatcaaaaatgaaatgaaacttttttgtaagtattcctgccaataatatccccgccatcacgcctactataataagcgccccataatatgcaacaaagaaatcaccaatcttgattcccaatatgatccctcttttcaaattcacggaaagatactaatcgtacctttccgcttccgctatgccagacttgcaattcctccaacgcaagctgcacacgccacataaaaaagtaagcttaaaattgttcctataacagaacatacaaatcctgctgatgctatttctttttgttctggaatttttttcgcctgtactcccagaatgattcctatgataccaatgatggctccaagccagcctgaagatatccctccaaatactccaagaacaatggaaagaattcctaacaccagtgatgctactcccattcatttatcctccttgtaatttcctttttcatccgccttttctcctccttccatataaaatatttattcattcataaaagcggatttctttgatttctattctgcttgcttccagctttctaatggtttccaatttaatgagatctctttatatttactttgtatttcttcaaactgctcttcggtaatttccgaatgcaaatgttccggagaagaataataatatgccttttcttctcgccctgtcggatgtggttcataaatatcgctattatcgatggaaagtctgatctcttctatttctccatagctgattccgtcatcagataaagaataatatttccagactttctcaaatgatgattcccagacccagacctggtacaccccaccttcacacggactacagatgttgacaactcccatatcaatatccgggatcattctgtctggttcatcgatactgtacttccatgtatcaataatgtagatgtcatccgtaactgactgctctccaataaaaagttcctcgattccatctccattcatatcgttcagtgcataatataatttcagatccccatctgctttctctgccagatcctcttcgtttttaatatagtaaggatcaaacacctggaaccctgtctgatagctgctcagataagcattcagcacatcctgatacagctgttctccggattctgtttcctgttgctgatcccaatttagtttcagtttaagccgtacctgaccaagatcatttacatctccggattcccagaatgtatgtggatctttcacccagtcgtattcaccagtcactctcatcaacatgtcgtcgacttcatctacaaaatcgaatttaggcattcctgttgtacgcatctgggtcgcttctttgttcaaaccaatttgtgctaacgcatcagctataccatttacttgtgtctccaacgacctgaaatccgatcctcctattgtttgatctgtaccacaatacttctgaaattttccatcttcataaaataccacaaaagaattcatgctgtttccatcagaccagatatacacaagactatatgcgcttccgcaaatgtaggtcttcccattatatttttttataaaaatcccatcattttcctcatccccaaaacctaatacctggactccaagacctttcatctcatctcgcagaattacctctttattttccaattcgtacatttgtaaataaaccgcatttcgctttggagagccaagtccgctttctgactccattatttcattgtttttcaggactagcacaagaagttccgtttctccatctctgtcaaagtcctgtatccttgatgtcagaactcctacctgcgaatgaacgctgtccagcgccattccataatcggtttctacataatcgcaagtataagtaccttcttcacattgcccaagttccggaatgagtacatcctccacatatgtatagaggctgtattgcgcttctattttttcactttttgtttcttttttccctttcgccagaatctctttagccttctgtggttcgttttgtctgttatatacttccgcaagcttcaaataggtttcgggatcttttttatcaattttcagtgcttttaaatactgatcttccgcctgctcgtagttcattgtttccaaaaaacgattcccttttgtcatgcttgacgcaaactgcttttcctttttttctgagaaaagcaggctgactattacaactgcgccacacaacaagcagcagaataaaacaagcccaatcacaggcagttttttcttgctatctctgccttttgccctcgacttaagttctgctccacagaatctacaataccgggcatcttttagattctcccctccacacttttggcatctcatttcttttcctcttataccagctcaaagctgttcttgttgtcgcaaatgaagatttttgtcccccgcggaagataatatgttctgtcttttccaagcggctgaccactttctaggaaacaacatctcatctcttttggagtaatacaatactccctatattcttttacaaaatacacttcgactaatagtttgctttcatttgcatctgaccagaaaatctgattattttcctcacacacaaaaacaagcattctgtctttcagcttatatatcctattcttatatagcccgctttcacctttcaccgctccttcaaagaaattgtttatcggtgacattggtctaggcggaacaattggtaccggttttggtggaataggactagggatatcctcgataggatcacttccgctgttttcttcttcccgaattcctgattgaccaaatataaaaataaagatataaattaaaatccacagtatgaccggaagtttataaatctttatgactcctcccagatcaaaaaagctgattccttcttccatttcctgaaatttgccgtaaatcgcaagaagaacgattactatataagcattaacaagaaacgctcctatcacagctactttacagccattactccaatccaaaacagctaccaggacagcagacatcactatgatcccaaaaaacgcaagcagaccatatgtaaatggtttcatatattcttgcattacatctgccagctgtctcatcaaaagggtatcaccttttccaaatcccaatttcaaaatgtcaataagcgatacttttacaacagcaacttggaaaatattcataaaccctaataatgctgataccacaaataaccctgcgacaatataccgcatatgctttattgatttcgtcattgattactcctcttctacttcatgtaataatgtttttctttggcgtctgaataatttcccagagcagattaacaaaacgaaacagatcagacttcctgctactccggaaaatgtcaatatcaaaccggtcgtgatatccattatgaaagccacccccctgcaattacttgttggtaaagattgtccagcaactgcatttccgcatccgtattattgtcctgcatctgctcataatacagtgcggttgcctttttataatattgcgaaaatgcctgataatctctttctttattcgcttttaaatcctgtttatccagttctaaaaacgcataccttttataaatgttgtaatcttcgccaaatttctgtaacatcgtacccagatattcagatgcttctgtcaggtccttttgcttctcgtgtaatatcaccaaattgttgtatgtatcatacgtatcccacccttgttcaatcacctgctgtaaggaatcaatcgcttcttgcctgtactttgaacttccacttttttctgcaagattaatgtctgcttgtattaatctctccaaaagcaccatctgattctctgccggcaaatcctgttttgctcgtaataaggcttctctttgcttttcttccattccttgatctttataaatgtcaccaattaagatatacgctctctctttcatatgaatatcatccgtgtattggatgcagtgttcaaagtcttgtagtgattctccaatgtgtccaagacttttttctatttcgcccctggcataatatacagaatcttctttcagccctaactctattgcttcatctaagaccttttccgcttcatcaggattctgattataggcaagagcgatggcgtgatcccggtagtactccgcatgatagccccctaccttgaataccttttcaaatgtatcgacagcattttgatattctccaatttcaaaatagctttctgcttttagatagtatagatctgccattttttgctgatttcgatcaatatcttcattttcctccacatcatagtcaacaaaagcgatacactcttcatactgtctctgttcaaatagagatagcgcctgctgataataactttctaaagaagaggaattgatatttcgtgctttttgaaaagctttctcttcctgctcatactcctttttttctcgatactctttttgctcttcaacaagctgattgtattggtctgttctttccatttgaattcgatgaattccatagccggtcaacacaatacacccacacatccccaacacaagcgctacacgtaccatgttttgttttctgataagtgcccgatacctctcatcctttttccccagcccacggaaggcctgaaacatctcaaacgcactttgatatctcttttccggttcaacctccattgcttttgcaataatacttgcaaaaacctcatttgtccgttcacatagcagttctttatcaatcttctccttaaaggttcgtaatttttttccggttactatatgataaaatgttgcacctacactatagatatctgatttttcatcaattcttgcataattggcaatcggacgtaccgtctcactatctaaagctaatatatactgttccggagaagtatagccattggtgtatcctaacaccacatcttcatccaaatagaaggagatgttaaaatcaataagacagatgttcccatccggagtcagcataatattggatggcttgatatccccatggataatcggcggattctggttgtgcaaataacttagcgcattgcataactgcatcccccacctcgccaactgattgacagtaaaagctctatgttcatccatcagatgtttgaatgactttcctgggatataactcatcacagtataaattccttcgtctgttaccagaaaatccaaaacctggggcaagtaagaattccgaaggtttttcagaatatctacttcttttctgcatgcatccaatgccatatttcctttgatcttttttatgacaacacttttcttaagtctttgatgataagccttataaacaattcctcctgctccttcatcaagtttttctatgatctgatatgtgtcctcaaaaatttccagtccattcatctttgtatccctattaagcctttatttccactttaaatttctcatctgacagctggatgatcatctgatctgttaatttatatctcccttcaagctgttctccatcaataaaggtatgattcgatgactgtaaatcctccacgaaaaattcctcacctgttttctcgattatcgcatgacgacgactgatcgtcgggtttcctataatcagataatcactatctcttccttttcctacgacgaacggagtacttgtcatttcgattttctcccctgttcttaacctagtcaaaaatagttttttcattgcatctgatccaaggatagtggtggagtcatcttcttttccactatggttcaagatgtatacagttccttcttcatcgactccactctctgtctttggtctaatcggatcgactggctttctgataatcactttctcacggaacctgcgtttttctattggtggtatcatttcatcggttgtttccttccacccttttaagtaatccctcacttttcattcctcctatctggtgtctttcgcaattctcctgagaactacgatactgcttactatacaaatagccgtcatcgcaatcagaatcatccacgcatagcttacatggcctgctgtagctttaaagaaactttccgccttatgctccagcattggatactctttttgcatctttagttccagactatttaaatgcgcaatacttcccaacgcctcaacggaccatctgctgactgtacagtaagatatctttttccccgctccctccagcgtaaataaaataccggaaaatagcagctgtacaatcaatacaaaaggtgccactgtcattgctttatcccctgatttgactaatgcggaaataatcaatcccatagccgttgaagcaagaatagtcagccatattgtgaatacgatttctacagaataattgtcaaaaaatattccttccttttgcttgtctacaagaattaaaaatgtctccgtcagtactatagcctgtaccactccgatcagcgcctgaagaacgactttagacaacacatatcctgtcaatctcagatttgccatatactcacgctttacaatcactcgttccttgcatatttcctggatcgaattaaataaaccgattcaaattgcggaacagctaagtgcaaacaaaattgatttcgtactttcataaatctggaatatcttatcatcagccacaatatataaaagtaccgcaatcagtccaggctgcaaaaacaaaatcatcaatcgaggcttatcatgtaatagcaattcggcatatcgttctatcaaaacaaaaaattgtgaaaaagcagattccttttttaattttttatctttttcgtaggaatccttgttttccttcactggcggactattcttcgcatatgcgctgtagcgcttttcccaaaactcagtgttctgagataccatattgtaaatatctaccagatcttccgtttggtaaaacttctttgcctcttttacatttccgcaaaagcaaagctttccacccggtcccataaataaaatcttgtcacatagatgtaaatttgcggttgtatgggtgaccatgatgatcgtctttccgtgttgacgcgcaagcgttttcaagctgatcattaaatttttttctgttcccggatctaagcctgacgtcggctcgtccagaaaaaagagtttgggatctgccagcaattctaccgcaatacttgctctttttttctgtccgcctgacaactttcggattaatgtatttttttgtccttccagatcaaccattttcaggacttcttttattctcttttttcgttccactgtatctgtatctttcggcattcttaatctggaagaatattccaacattctttccagagtcagattttcataaataatgtcctgttgtggcacaaatccaattacactttttatacgttggaaattttttatcatatctgcgccattgcagtaaactttcccggaaaatcctggttcaaatccactgattgcgttcatcaatgtagtctttcctgcgccagaacctccaataatcgcgacaaattcattggccttgatttcacaatctacgttttgaagaattttcttcctcttcttcccggctcctacggttttacttacattgcaaactctcaatgatactccacttgccgtcgttttaaaatagatgctttccccagaaaaaaataattgatatccaaggatctgaatcacatctttatctcttaatacaacatcctccgtaacaggaaatccattaatcaaacttccatttttactattacaatctctaaaaatatacctgtcattttcataaaaaacctgacaatgtatttttgatactcccggattagaaaggaaaatctggcacgactgacttcttcctatcagtacatcttttttgtctaactcctcccttttccaggtttctttatcagtttcactggtaaacaaaatgagtaccatatcatctgtcttattcaaattgccaatcctaaggattgttttatcgtatagacgtacaaatccatctttttttgagagtaggcgtttttcctctccaattccaaaaaaagtaccattactactgtcttcatcacgataatagacttcatcaccatctgtccaaatcgttccgtggcacctggatatgatagaatcgcaaatagcaatatcacattcctgcttgtttcttccaaccaacaaatggtcttttctatattgatttagatacacttcctctaaattcccttgtgtatcaataattgtcagtatcttctcttccatttcttctttcccgctgttaaatcagatcaacaaaattcatataccattttcttccaatcttaattactgtaatctcttctgtactttcttccttttctccgtttgctgagaccttcgtttttaccactaatttttttgcgtctttaacttcaacatccgtccggaatgcatcattataatcttcttccatctctgctatttcctccttagagcaggaatttttttctttaatttgatagtccattgacagatcggccccatctccgaattcctcgacaaacttgtcaagaacatactcctccatcatatccactactccgtccatatcaattccccactgttcttctacttcttccggaaaaattgcggacattattttatgtatatcctgctgttcaacaccttctgccatgagtttgattggtctttcataatttccattgcctgcaaatctgatacaaaagaaaatgcatatcacgcacactactgctgccgccagtaaatatggtcttttcaccgacagctttttcgatcttttttcagaaaaatttccatctctttctcttgccgtaccatggtcttttttataaactggttcaccacatttatggcaaaatttttcattatctcctaatttttcaccacatttgctacaaaacataccgttccccttcccgtttttcttttgtttttactactgtttttcccttttgaatacagataaaaaacttcatccctttaacaattccggattatagtcttgcaccagtctgatactttctccaaaacatatcttataaaatttattactttccaaataataaatcaggaactcaatatattggctttgttccctttaacctatgcaagttatattaattttatcgttaatattatacgttttatcgtaccattttgcaatatagatttccagtataatgaattaatgcttaatactattttggtattttctgagatctttgattgactcgatttgaattttgggtaaaatattgactcacattttcggaggtgtttcttgtgaatgtattagacaaaataacctggctccgcctagaacgcaattggtccgaatatcagttagctgaaaaatccggtctgactcagtctacgatttctacctggtatcgtaaaaatatgctgcctacaattccctcacttattaaaatttgtgatgcattcggtcttacgctttctcagtttttccttgaggatgatggaaacactattcatattacagaacgccaaaaactactgttggactatgcagcaaaacttagtccggaacaatacagcgccctgcttaattttttaaagactttataatattctacgctttcctacaaggcagatcgtatttctcatgcctctgccttgtacctgtttatttagcgctcatgttgtatattaaaactgactcgataaaaataaccagaaaaaggattgcttttttaatcgtttctgcttatcctattatatgaaagctacaaactggcaacgattcagtcatacggctcagattcgcagctaaatcttcacgcatggctgaatagttacaaaaacgaaatcagataagcgaggtatgagaaatgaaaccgattaaagaaggaaaagtacgtgaaatctacgataacggcgacagcctgattatggtggccacagaccgtattagctgttttgacgtgatcttaaacaatacgatcacaaagaaaggtaccgtactgactcagatgtccaagttctggtttgatatgacagcagatatcctgccaaaccacatgatttccgcagatgtaaaagatatgccggaatttttccgccagccgcagtttgacggtaacagcatgatgtgcaagaagctcaacatgcttccgattgagtgtatcgtccgtggctacatcacaggcagcggctgggcaagttaccagaaagacggcaccgtatgcggcattcgtcttccggaaggtctcaaagagtccgataagcttccggagccaatctacacaccgtccaccaaagctgaaatcggtgagcacgatgagaacatctcctacgaacaaagcattgctcacctggagaaatatttcccgggcaaaggcgaagaatatgccgcaaaacttcgggactataccatcgctctttataaaaagtgcgctgactacgctttaacccgtggcatcatcattgcggataccaagtttgaatttggtctggatgaagacggcaacatcgtacttggcgacgagatgctcacaccggacagctcccgcttctggccggctgacggctacgaggctggacatggacagccgtcctttgacaagcagtttgcccgcgactggctgaaagcgaacccggataacaactggacacttccgcaggacgttgtacagaaaacaatcgatatctacttacagggatacgagatgctgacaggcaagacactgtaagcggaaaatatgtttattaggccggtaaaagaatatgccaataatacttgatcatcaattgcgggaacaaataacccatgatcccgcaatatttcccatcacatatttctgcgatgagcttgcctcacttccaaattgggcagggcctttacattggcatcctgactttgaaattgctactgcagtaagcagtgttttatcttttcaagtcgggaaacatcacattatactggaagcaggcgacagcatatttgttaatggaaatatactgcatggaataaagcagttatccggcgatatgcccgaaccgatgccgaatattgtcttttcgggtgcagtgattgcacccgaagccagtgcaatctatcgaaaatatattcaacctatcgctcgctgtgatacattgccttttattgtatttaataaaaaaaacgattggcataatgaggtaaatcgattagtcaaaaatgtttaccgtctgatgtttgaaaaaagtcaatgttacgaaatggctgttcaacgcaatctcagcagcatatttgagtatatattctcaaattttgatgatttgcccaaatccgaaaatacacgaatacaaattaatacccacatacgtatccaaaagatgctctcatatatcagggagcattatgccgaagctgtcacgctgggagatattgccggagccgctaatatcagccgcagtgaagcagggcgttgttttaacacatatatggggtgttctcctgtagatgcgcttattcaacaccggcttcaaattgcacacggacttattaaggatacaacgctgacgcttcaggagatcagctattcctgtggttttcattctgtgcactatttcagtcgtcaatttcggcaggcctatggatatacaccggggcaatatcgcattttgggtaaatagtgcttgtatctgggctttttgtgtatttattttgcttgattatgatgatatactgtgccccgactataatattgaatttatctaagaggagcagtcatgactaagcaaaaaaactacaacaaaacacttatagcttgctatctcggttttgttacccaagctatatccgctaactttacaccacttttatttttgacattcaagaacacttatggaattgggcttgaaaagattgcactgattccattggtgttctatttaactcaattattgattgaccttgcagccacaagatttgtcgacaagataggataccgcacatgcgtggtatcatcgcagatattgtctgctgtagggcttgttttaatggctatattgccagaagtactccctgtcccgtttatggggattttgattgcagtagtgctttatgctatgggaagcggccttatcgaagtattagtaagccccattgttgaagcctgtccttttgaaaataaagatggtatgatgagtttgcttcattccttttactgttggggcgcggtaggtgtaattctgggttcgacgatcttttttacagtatttggcttaacaaactggaaaatactcacactgatttgggcacttgtgcccctatataatgcattcaattttatctcctgtcctattgaacggttagttgaagacggagaaagtatgaataccagccaactgcttagattaccgttgttttggcttctgatactgcttatgatatgttccggcgcatccgaagcctctatggcccaatgggcatctgcatttacagagtcagcaatgggtgtttccaaaacagttggtgatttggcaggtccctgcctgtttgcggtattcatgggaatatcccgaatattatatggaaaaatgagcgagaagctggatctgaccaaagcaatgctggcatgcggtatcttatgcgtgatctgctatctgacggcatccttgtcctctataccgattatcggattgacaggctgtgcactttgcggcgcttcggttggaattatgtggccaggaactattagtatttcttcacagaaatgtccaagaggcggtactgctatgtttgcgtttttagctctggccggtgatttgggcgctaccgtaagtcccacaatagtcggcaatgtttctaatatgtttggtggtaatcttaaaataggactatgtattgctactgcttttccactaatgttgattctcgggttgattattcttaatcagaagttcaacagattatcaaaataaaactcgtgtaaaaatacgagatcatctaccgcttatagcttgccggggcaccctcctcgtgaaaggggatgccccggcaagttttcttttctatattgtattctagcaatacacgagttctctcaccgcctgcttttccgcagctttccgaagtttctccatccgttcaatccagtccgtcgaattactgtacttcccaccttcttgaatccccgcttcctccatcagttccggcaatatatgatccatacgctcctgtactttctgttccgtctcaattaaataaggatatatcttctcgtccagcaccagcctgctgtataatacgggctcatgctcccgcagatagatctctctcattcttccatactttccaataaacctgtctgtccttgccgtcagtttcaaatcaggaatctcaccggttcccttcccggtctggttatggttttcctctggattgcccatatcttttctcctctttctgcaaagcgcttcttttggcagcgcaacttttttacaatcattaaaactcagtttatcgtttcaattcctttttctcaatatgcggcgctttttgtggacagattatttgctttcttctgctggcttttcggaacatatttttatataatgttttcacataattgatttacattcagaggagtgcaaaaatatgatacctgattttgcaaaagtactatccgactatatacacgagaaaaatgtgaatgtatattccatggcgcagttctgcgatttggatcgttccaccatgtataagtttatcaatgggaaacggcgcccgtcttccatctcccttgtccggaagatggccgattttatgctgctgactccggcggaataccagcttctctcagaggcgtaccggatttcccttgtaggcccggaaatctatttccggcggaaatacatctggaaattcctccaaaatccaggaaagtatatcagcgctttccctgtcaatttcacaaagacaggggcccattctaccccccccccttgcagaaatgaccgtgctggacggacaatctcaaattacaaactgtatgtttgagattctcgctcaagaggcacaggaggaacagggaaagatccagattttcatggatcccgatttttcgtccattatcgattatctggcgtcccttggctgtcggaaccacagcctgcagattgagcatattttctgcatggataacactcaacagttgatgaataacggacaaaattataatctctactgtctggaacagatcctcccgctttacacgtgcgggtgtctttacaatgcttattatttttacgatacaatcttcacccgaaaaaatactctggaaattttctccgtgatgctgatcacgtcccggtatgcacttttgtttaccagagaccgcagccagggaattctctttggcaaccgtgcatctgtacagctttaccgaaatatatttgggcgcttttatccgagcgtctcctctttcgccgataaagtaacggacgtgatctcccagattcagcgactgatttcttttgattttggggaaaaagacatttatattttccagcctcttccgtgtctgacttactgtctgccagaagaatttctggaccggtacctctacccggatcttccgggccgggagcatgtactgggaatgttatcggacttcatccgccgaacgaaagattctttctcggaacggcgtccctacttccttttcaccgagcaaggtgtccgggattttctggaaaccggacgtgttccggactatcccgactatgtgtacgcaccgttttccatacgggaccggatgtttcttatccaggaaataatgaaaaaatgtttgccacagcagctttgtatgctgaagaaaaactatttttattccaaccggagtatcagcattttttcctcgcctcattccggctacctgtttctaccggtctacaatgaggcggactcctgcgaacagatttacctggacatcaccgaatctcacctcgtgtcgtccttttatgattttttactttatctgaaagagaacttttgttatagtccagatgagaccggcaaagtcctccggcggattcttcaagaatttcataccagagtataaacaatttgcacaaaaaacagttgagattttccccatttatgctatactatttccagaatatgttatagacacgaaaggagtatcttaccaatgaatgacagaatttcacgtgtattaaagaaaatggaggagaaaggcctcacacagttgatcgtctccgatccgctgagcatccggttcctgacaggaatcatggtaaatccgggcgagagactttacgccctcatcctcagaacgagcggaaagcacaccatgcttctgaactatctctactttgtaaaggataccgggtttgaggaagtatggttctccgatatggaagatcagatctccattatcgcggaccagatcgatccggaacagacgcttggtatcgacaagacatggccggcacgtttcctgatcccgcttcaggagaaactcccgcagttgaagaccgtctggggatccgactgtgtagatggtgttcgtgccgtaaaaaatgaagaagaaatcgctattatgaagaaagcttctgaaatcaacgatatggtgatggaaaaggccgcgaattacatcaaagaaggtatgacagaaaagcagatcgcagactttatcgattctgagtatctcaaagcaggtgcaagcggaacaagctttgacaccatcgtatgcttcgggccaaatgccgcggatcagcaccatacgccaagtgatacccgtacactgaaagctggcgaatgtgttctgatcgatatgggatgcgtatggcagggatactgctccgatatgacaagaacattttactgcaaatccgcagatccggaacagacggaaatccacgacattgtacgcgaggctgtgttaagagccgagtctgtgatcaaaccaggagttaagttctgtgatatcgacgcacaggcaagggattacatcgatgaaaaaggctatagcgaatactggaagatccgtcttggtcattttatcggacaggaagaccacgaatacggcgacgtcagtccgatcaacaagaatgaggctgagccgggtatgatcttctccattgagccaggtatctacattgaaggtaaatacggagttcgtatcgaggatctcgttctcgtaaccgaagacggacacgagcttttgaactctgtagaaaagaaatggcggattgtgggctaattaccgacttattcttttctattatatgacatatgaaggggcatgtttccatcttaccggaaacatgcccctttttctatctgttttactgaatctgatctgggcccaggatcaatacatctccaagctccatctcctctgccggacgtaagtcggtccgtgctttcatggtgataacagcaagctgtccgtctccgtggtataatggtttgtcgccacggtttgcaaatgccaggttgacataagccgtaccatcgctgtatatcttattgacggtcagatcttccatggaggcgatcccttctgctttctccgttgatatgaactccaggttttccggatcataatcaataacctttccaaatgcattgatattctctgtctgttctgccaaaacaaagattcggaaagtctctcctgctttgacttcctctttctccggtgctaaacgtacacttcctgccgcagctcctgtctgcttcgtcccgccgtccagcttaaacattgtgaacgcatagtcgtaaacatcgtacacgccattcatattgatatcgccgcctcgtttctggatctgatccacaaagttggctccgtctttcacagaagttccgaggtagttcttcatgttggtgtaatcgccctctgccacttcctcgttcttattcgtacttccgaccgcaaacggcttcgtgccgtctttcttatagactggcagttcgtgtgctgcaaaatagtttttccgcgactgtacaacttccagcttcacatatcttgcgaggacaccgttcagcgatactgcctttccattgtcctctacatccaggtccgtgttgtatgtccacacctcctgttcggctccgttccactccagtttccagtgtctgccgtccatactggagtagacattcatcctctccacggttccgcttccgtagctgtctcttggatagtattcaaacttatccagctcgtaagccgcgccaaaatcataaataaacggagtcttctctttgacaacgtcgtctgccgagaagaagagtccccggaaactatggtctgtcgcatatttgatcgggcctgcctcgtcgctgccgttccaggttactgttcccgcggcgccaatttcatttctccatggatcagacagtgtcatggatgtaatcatctcgctccatgcggaatatccttcttcatttctggaacggatctggaaacaatgctcagaatgatactccaggtcatcgtgcagataggagtctgcatctcccatcgtatagagctgtccgtcgatttgcatctcatagctctctgcaccttctatcttgttccaatgaagccagatggaagaagatgttttcttctcttccggaatcgtcaattccggtacggaaagcttgacattttcctgttcttttctttccttggctctatagatgaatcccagaatctccacacgctgggccattgtctttgcgtccgccgctgccatcttaatataaagttttggcattgtccgcacgttttctgtcatcttcaaaagctctgtctccgcttctgaagcgtatgttcgaagtcttggagcctcatcatagaagaaccaggcttcgccctgcgccgggatctgctcctcaaagtttttctgatctataacttcttttacaaccaggcttttctctccatttgacgcaagaatcgcttccggtctacaggaaagattcacaatccaggtcgtctctctacgggaactgtatccctcgtaattccccttggaaacttccgctgtcagaatcgccttgtcaccttccactttggatgtgtatgtggtggagacatgatccccataggaaatgtgatcgatcgttccatatccttccgcttcctctgtctcattggaaatatactttccatcgtcctcatataccgtataagacgtctctcctgacggccacacttcaatcagccgcttctctctacagatagcgtccggcgtgttattttcctcgtacattggaagaatggcaccctgttttacaaaaacaggaagcttccaaagcggcgcgtcaaagttattgatcacctgtcctccatggtacagctctccggtgagataatctacccagatctgattggaatcaggaagataaatgtgattcctcacatcatttcccatctcatccccgtctatattctgataaaccggcgctacaaggatgctttcaccgagcatgaactggtactgcatggaacggctgtacgcatagtcgtcctccggatactccaaaaacatggcccttaccatcggaagaccagtatcgccatttccggtatccaggttggctgccgctgccgcacatgtataaatatatggcatcaatcttgatttcatcttcatgtacatccggttgatcccggtatacggatctccaaaggtaaatggcgctttcatgtatgtgccccatccatccatattgagcatctgcggagtaaaggatttccactggtaatctctcgccgcaatcagcgcctttccgccgaaaattccgtccatatcacttccgatattcggattcccactcagagaacttccgatataggtcggaatgtggaaccggatatactcccagttacccccggtctgatccccgctccacacactgttgaaccgttgggaacctgcccaaccgtccaaagaaataatattcgggcggaaattctctgaggtcgttacgatatcataggctgtcttgacgccgtttaactggaacgaataccccggaccgacccacgctacgtccgttttcagtgtcgtcgctccgccctttgttacttccttgcgaaaatctcggagcagatgccagtaagtcttctcatcagaatccggacttaaattactttctgtccagagaccggacgccactcctttgctgttggcgtactcagtaaaccgtgccagattttctacattggcgtccaccgccgcaatccgttcttcggaactggatccgtcctcattgacgccgccctgcacatagtacccgttctgtccatatcctccgccatatccgtcatttggcaggaaatagccaagcggcatatcgtaccggagatactcatccagtaccgctcttgcggaatattcatacggggtgtccacgtttgccggataatgttctgccccaactaccggtccctccccattcagcgattcggaatgttgtccctcggacaggcgatatccggtcgccattccgctctcataacgggtctttccctccatgagatgggagtccgttcccttgaccgtccaggctttgtccccggattcatcggaccaggcgtcacggttatagcaatttaagtgtccctcgtaaaatccgtattccggaagcagcattggatttcctgtcacatggtaatacgcacgcaataacgcccttgccgactcacgcccgttttccttttctgtcaggaaatagtatgcgctgaaatggtgctctttgtgagacgcaaggacaagcccttcgtccgactcaccaaagtcatacgttccatcggagaatgtatttctcaaaaccccgtatcctgctgtcgtatagtagaatggatttggggacgctactcctccgtccatccaggcgctctcattgacaatctgaatttttttcccagtatgtacgaaacggccgttctgtgtaccgcctccgtagaactgctctttctcgtgacgcgccagtgtctggatcgtctcatcccccgtaaactccagtggcttggcctcttcaagaatctttcgctttcccacatagatcgtcatcctgcctgtctctttttcaaagacaatacatgtctctttgcaccggatgcataccgataccggatcctctgtaacttctgactccggcttcatatatgcgtccgaactgtccgggcgctgctggatcttcgccgtatgcgcctcatctcttggtgcagcgtactctgagacgctgccttctctgctgacgtcatagcggaaaatcttctcttccaaaaaggtgatcgtcccccggatcccttcctgaaaagacacctgcacgatatggtgcctttcggcgtctctttgtgcggacgtcactttgctgatggctccgcagactgtctgcttttcttcgctcattgaaaacctccttttccataatctctgggattacggatgatgcctagaatagtttgatacaattattttaccagagcatagaaaaaagcgccatccatgagcgctttttctgtacaatatgataaaaagattgtgcttctgtataagtgatctataaaatatatcacatccccaggtaaggttctggattccgtccgtctgctctgcaatccttccaggcttgcacccctgttttcagtctttccagtccatcttccagaaccgtatgggcgcaggcaatattcatccgcaaaaaggatttgccgctctccccgtactgacctccgttggagagataaagccctgtctccttgcagagaacttgttccaattcctccgtatcctccacaagctccctacaatccagccagagaagatacgtggcctcggactccaccagatgaatgtccggaagttcctgttccagaaatgcttttgccgtctgcttattctcatacagatatgcccggagcccatccagccatggtcctccctctcggtaggccgcgatcgccgcagtcatggcaaaaacattcggttctgccacctcatcggtattgagcgcccgccccatctgatgcctcaagtaaggatcaggcaccatgacggccgccgtctggatccccgccaggttgaacgccttggtcggggcaatgcaggtgatactgttctttttgcactcctccgataccgaggcaaagggaatgtattctttccccggatccgtcagttcacagtgaatctcatcggaaatgactaccacatgatgtttccaacagagcgccccgatccgctccatcgtttccttttcccatatttttcccaccggattgtgcggattacagaagatcagcatggtagtctgagggtctgcaatcaccctttccagtttttcaaagtccaccccgtaactctcaccatcataagtaagcggacattccaccacgtttcgtccgttgttgacaatagagttgaaaagaatattatagaccggcgtcaaaaggacaatcttttccgccaccgacgtgagtttccgcaccgctgtagagatggctggaaccactccggtacagaagatcagccattcttttttcagatgaaagtggtggcgcttcttccaccattcccggatagagtcgtaccattcttcaggaatgattgtgtagccgaataccccgtgttctgcccgtttccgaatggcttcgtggatctccggggccgtctcaaaatccatatccgcaacccacatcggtagttccgactctcccacctcccatttcatggacagagtcccccgtctgttgattggtttgtcaaactgataatccatgatgtccccccttgtctctatgcacagaatttctcactcgtcacccggatatcagagcaccagatcttcgtctttccagggtccaccttgtctttttccaggatcagctctccgattgcatccgcccgaatcgttccgcccgacggattgaacacactgtcgatctttccttgaatgtccgcatccaccgacgcatactcaaacgctaatgtcgtatttaagagacggcagtttttcattaccagattatcaatgtagcacatcccctgaagactctcaatcgtgcaattcacaagtgtcagattctttgaattccatccaagatattccccggaaataaaagaatcgtagaccgtcacattttcactgttccaaaacgcgtctttggaaagcattttcgcattatggatctctacgtttttcactccatcaaaggaataatttcccacaagctgaaaatcacggatcaccatattctggctgttcatggcaaaatagtcaccctttgctttgacatgatccatctgcacgtcactacagctccagagtgtttcgaacccatttggaaaattcacatcatccaacactacgcccctacagcggcggaagtttttcggagcttcaatgagcgcccgcttgaccgtaatatcctgggtataccaaacacctgccctcgccatttcgaaccaggtacagtcctccgcataaatcttcctgctgtaccaaagcggatatttccactgaaatatggtggtataaagtgaaatatcctggctttccttaagcggtgactccccttttgcaaaaatagtatcatggatctccagatgttttccttgaaaaagtggacgttctccttctaaatagctctgattgattttctttttctgcatcattttttatctcctcctccaacaatgccaatcacttttgccggcacgcctcctacgatcacattcgcaggaacgtcttttgtcacgactgcgcctgctgccacaatggcatgatctccgatcgtcactcccggcagaatcgtcgcattggctccaatccacacctttttgcctgtacggatcggttttggataagtcgtcccccgatcttccggtgcaaatccgtgattcagcgtagcaaaaacaacattatgtcctaccaacgtctcatctcccagagtaatgcccccctgatcctgaaagcggcaaccggaattgataaacacgtttttaccgacacggatgtttttgccgcagtctgtagtaaacggaggaaacatgcggaaagtctcctcctccggttgtccagtcagttggaaaaacagtttccggatttcctccggtgtatgaaaggacgaatttaattcaaatgtgatcttcatcgcctcaaacgccatctttgtcatatactgttgcatcggggaatctgcccgcaccggcctccccttgtttacatgctccaaaaacgtttccagtactatcgtctcttcttctttcatcttaatcccccctctttttttcatctcatcgatcagtaatccgggcagtagaactttcattcctgcttctatctattccttttattctagtatagaaaaccagaatcaaaatcgcaaatacttatattttattcacttatatagttgaaacctatttagccttggggtatagtaatgatcaaacatatgattcagcattcttatataggaggtaatgatggaacttcgcgtacttcagtattttcttgccgttgccagggaacaaagtattgtcctggcggcaaagtcgctgcatctttcgcagcctaccttatcaacgcagatcaaaaaactggaggaagagctcggcaaacagcttttcatccgaggtggcaagggtccccgtcggatcacactcaccgaggagggtatgattcttcggaaacgtgcggaagagattctggaacttgttcacaagacggagacagagattgccgcatcggacgatatgcttatgggagatatctacatcggtgccggagagacagacagtatccgtctggtcgcacgggcggcaaagcagatgcagctccgctatccaggcatccagtttcacatttccagcggaaatgccgtctatgtcaaagagtccctggaccgtgggctgattgattttggaatcatattcggtacggtggatatgacttcctaccacactttgaaacttccggcgacagatacctggggcgtcctcatgcgaaaagacgatcctctcgcagaaaaaacgtcgatccgccgggaagatctatgggatctgccgctgattgtgtcccagcaggagtctgccggaggacaggtgctgcagtggctgaaaagagatcctgcaaagcttcacattacagcgtcctacaatttgatttacaatgcttcccggctcgtggacgaggggttaggatacgcacttgcttttgacaaactcattcatacttcaggagacagttccctttgtttccggcccctgaatcctccactggaaacggaaatgtttgtcatctggaaaaaataccaggtcttttccaaaccggtagaaaagtttattgccattctgaaggaatccttggctctggacgacactttgtaacgtctgcctgatgagcggagttttccccgaatcttgtccggacctgttcttgacaaactacaggcagattttctatactgggtattacaagtgtaagaaaaaaaggaggaattgattatgaatcatctgccacagatttcggaggcagaattcgaggtaatgaagatcgtatggaagtatgcgccgatcaataccaatgaaatcacagaacggcttaggctagcgaccacatggagtcccaaaacgattcacactttaatcaaacgtcttgtcacaaagggagccctctcctatgagaagcaggggcggatctttgtctacacccctctggtcggagaaaaagaatatattgaacaggaaagttcttcctttttaaagcgtttttaccacggtgatctgacggctatggtttcatcctttcttgaggaagagcgactctccgatcaagaactggaagagcttcgcttgctgttatctcaaaagaaaggagaacactgaatatgacagaatttatcaatggatttatgagtcggtttctgctgtgcagccttttgctgtgcggaatcattggtatattcttcggcatccgcaggcttttgggcagattgttgggcgcacatttgcagtaccgcctttggctcctcctgctcattcttttggcggttccttttcttccgcagtcttcttttcccatcctggcagacccgacccgcatttctccggaaatctcatcttccatttccggattgcagaaaaccaaggctgatactacagtggtctctgcctctgtctggatgaaagattttaccgagtctgttagcaaaagcacaccagcgtttctttggaagttcctttttatcatttggactaccggagccatactcgccctcctttccgggatccggtcagcactaaaactgcgtactctccattattcggctcttcctctccagcatccaaaagccagagaacttttcaagtcctgcctggacaccctgcatattcaaagaccagtggccgtgtacagtactgcctttttacggtcgcctgtgatgacaggcgttctccgacctcggatttatcttccgattcgactgctctccgattatcatgaagaagatttacggtacattctgctccatgagctcacccattaccgtcatctcgatgcgatcaccggttatctgatgaacctggccggaactctatactggtttcatccgcttgtatgggtatctttgcgggccatgagaacagaccgtgaacttgcgtgcgatgcccgtgttctgtctgttctggaagaaacagcttatgaagactatggactgacacttctccggtttgctcaaggctcctccctgccttttgccgccggactgggacagaaaggaccgcagatccgaacccgcatccagcatattgcctcttatcgaaagcccagcttttccatacggcttcgatctgtatgcatctgctttctgattgttcccgtttttatggcatgtgtccctctcctctcctttgcgtccgcttctctgtctccaaacgcgatagacaccggcagaaaaagtacttctgccaccccatcttccggttgggattccagtataagccctggcaaacactctgattctgatggaggactttcggcttattttaccggatatgatggaagtttcgtcctctatgattcggagacggacggctggaccgtatacaatgaaactctggcccgcacaaagatgaggttagataacgatactttttgaaacacagtaaaatcaaggtttttcggacaacggacaagcatggtttgtactacaactaaatattgcaccgcacaagcggcgtttcccacttccacacggaagaacaggaacgccgcttttttcatgccctttgttacgcagtaggggcagaaaaagccttgctacaagcggctttgcgagtgcgaaaaccacttaggcgatacttgatacctaaaccctcaaaatcgccgttctactgcgtaacaaatccacagcaaaaggagtgatgaagctatggcagttttccgtgtggaacgcaacacaggctacaccgtaatgagcaaccaccacttacgcaataaggagctttccttaaaggcaaaggggctgttatctcaaatgctgtccctgccggaggattgggactataccctttcggggctgtcctacatcaaccgggaaagtatcgacgctatccgtaccgccgtttgggagcttgaaaaagccggatatatcacaaggcggcagggacgcgacgagaaaggcaaaatgaccgctatcgagtacaccatttacgaacagccgcagccgccggaattggattgcccggtattggaaaatccaacagcggataacccgatattggaaaatccgacaacggataatccgacgtcggaaaatccaacgcaattaaataaagatatacaaagaactaacttaccaaaaaaagaaaaatcaaatacggatttatcaagtacccattccattcctatccattccctaaatcccttgccttatggcgaggacgaaacggcacagccgccggaacggaaaagaacggaaaggaacgacgcttacagagtgtatgaggaaattatcaaagacaatatcgcctatgacattctcttacaggacagaagccttgaccgcgaccgtctgaatgaaattgttgacctcatgcttgaaaccgtctgtacggcaagaaagaaaatccgtattgccggggacgattaccccgccgagcttgtgaagtcaaagtttatgaagctgaacagcgaacatattcgctttgtgcttgactgtatgcaggagaacaccacgaaaatccgcaacatcaagcagtacctaaaggcggtgcttttcaatgccccgtctaccattgacagctactatacttcccttgtcgctcacgatatggcaagcggcgcgcttgcaccgagaaagccaaagtacggcgacctggactattacacctacaacgagggcgaaagcctgtaaacgaaaaaaggaggatttaccacatggcacagaaaacaggagctttgatttttgatgaaaccgctgaccgctacgacattcgctttgacattgccgactattacggcggcttgcattgcggcgagtgcatggacgtattcacaggcggcaaatggaagccgacccggattgagtacggggacaactggtatcttgtaggtattcgcgccgaggacttgaacgggctgcgggtgcggatttaacggggcggcgtgaacaacggacgcccttttttcacgcccaaaagcggcgtaccaccctaacactatcattactaccgggaaaggaggacggtaaacattgcaggacgaaatcaacgaaaaagtggttgcgctctcggtcaagggagcaaagctgaccgctgaaatgctgcaaaaggcaatcaaagccatgcttgcacaggcaaaaaagcagcaggaaaaacagccccacgggaagcagacgctaaagcagcttgcgaagcagaacgcggggctttccaacattgagataactgagggcaatatcaaagcctttgagcagacggcaaaaaaatacggtatcgactttgccctaaagaaagacagcaccgaaacgccgccccgttatcttgtatttttcaaggggcgggacgcggacgctctgaccgcagcctttaaggagttttccgcaaagaagctgacacaggagcaaaagccctctatccgaaaggcacttgccacattccgggacgcagcaaagcagcttaatgcgaaccgtcaaaagacaaaacacaaggacagggaggtatcgctatgaagccgaatatcaagaagttgcttatcctaaacgccccctatctgctctttgtgtatctctttgataaagtcggacaggcggtgcggctctcgccgggggctggcctctccggcaagctgctttccattggcagcggcttttccgctgccttttcaaatgccctgccgagttttgcccctatggacttgcttatcggcattgtcggggctgtcgttatccggcttgcggtctatgtgaaaggcaagaacgcaaagaaataccgtaagggcatggagtacggctctgcacgttggggcaatgccgaggatataaagccatatatcgaccccatgtttgaaaataacgtgctgctgacgcagaccgaaaggctgatgatgtcaagccgcccgaagcacccgaagtatgcaagaaacaaaaacgtgcttgtcatcggcggctccggcagcggcaaaacaaggttttttgtaaagcccaacttaatgcaaatgcacagcagctatgttgtcacagacccaaaaggaacggttttaatcgagtgtggaaagctcttgcagcggggcgggtacaaaatcaaggtgctaaacaccatcaatttcaagaaatccatgcggtacaatccctttgcgtatctgcgcagcgaaaaggatattttgaaactggtaaataccattatcgccaacaccaaaggcgacggggaaaaatccggcgaggatttttgggtgaaatcggaacggcttttttactgcgcccttatcggctacatctggtacgaagccccggagaatgagaaaaactttacgacgctgcttgaaatgataaatgcgtcggaagcccgcgaggacgacccggaatttcaatcccccgttgacctcatgtttgaacgcttggaggaaaaagacccggaacattttgcggtgcgccagtacaagaagtttttgctgtctgccggaaaaacaagaagctctatcctcatttcctgcggtgcgcgtcttgccccctttgacattcgggaactgcgcgagctgatggaaaccgacgaaatggagcttgacaccttaggcgaccgaaagaccgcgctttttgttattatctccgacaccgacgacacctttaactttgttgtatcaatcctttacacacagcttttcaatctgctttgtgacaaggcagatgatgtgtacggcgggcggctgcctgttcatgtgcgctgtctgcttgacgagtttgcaaatatcgggcagataccgaagtttgaaaaactcattgccacgataaggagccgcgaaatctctgcgtccatcatcttgcagagccagtcgcagctaaaggctatctataaggacaacgccgataccattgtcggcaactgcgatacgaccctgttcttgggcggcaaggagaaaacgacccttaaagaaatgtcggaaatcttggggaaagaaacgattgacagcttcaatacttccgaaacaagaggacgggagctttcccacgggctgaactatcagaaattaggcaagcaacttatgagcgaagatgaaattgcagtcatggacggcgggaaatgtatcttgcagctacgcggtgtgcgtccgttcttctccgaaaaatacgacattaccaaacacccgaagtacaagtacctttccgactttgacaagaaaaacgcctttgacatggaaaagcacttgcgccgccgtcctgcaatcgtaaagccggacgaggtatttgactattacgaagttgacgaagcagatttgcaggaggatacagaatgaataagcgtatcaaaaagaaaaaggcaaaacagcagctaatccgagctatcagcgggcttgtggaagcagccgaggaaatgcagcgggaacaggaacgcaggacaagacaggcgggtatttcctatatcaagtatatcgaagctgtccgggaacggcagtacggcattaagcctgtctacacaccgctttttgaaaaggagggagcttaaagtaaaaataataaacacgggctacatggtacgcgcccctactccttgcgcgtatcgcggcaggaagccgcacccttacaactgaataccgccgcgccgcagaaacatacgcagcgcggggacttatgaccgcggcagttatcgaaaactgaccgccgttttttatgccctttttcgggcagccgcaaagcggcagaaaggagttttattatggcatttttcaacagcgcagtaggcgttttgcagacactcgttatcgctctcggagcaggtcttggcatttggggcgttatcaacctcttggagggctacggaaacgacaatccgggcgcgaaaagccagggcatgaaacagcttatggcgggcggcggcgttgcccttatcggcggcaccctcgtacctctgcttgccggactgttcggttaagcggcggggttagcctatgcagagcatacttgacgcgattaacgaatggataaaggaaatcctcattggagccattaacggtaatctgtcaactatgttcggggacgtaaacgaaaaagtcggaactatcgccgcagaggtaggacaaaccccgcaggggtggaacgcaggcatattttccatgatacagagcttgtcggaaaatgtgattgtacccattgcggggcttgtcattacctacgttctatgcgtggagcttatcagcatggtaacggaaaagaacaatatgcacgatattgacacgttcatgttctttaagtggtttttcaaggcgtgggtagcagtgtatctcgttacccacacctttactatcactatggcggtgttcgatatggcgcagcacgttgtttccggcgcggcgggcgtgatcggcggcaatacgaatatcgacgttgacgccgccctctcgtccatgcaagccggacttgacgctatggaaatccccgaactgttactgctcgttatggaaacaagccttgtgagcctttgcatgaaaatcatgtcggtgcttatcacggttatcctgtacggcagaatgatagaaatttacctttactgttcggtatcgcctatcccgtttgcaactatgaccaacagagagtgggggcagataggcaacaactacttaaaagccctgttcgccctcggttttcaaggcttcctcataatgatatgcgtcggcatttatgcggttttggttggcagcatgattgtagcggacaacctgcacagcgcgattttctcccttgcagcctacaccgtgattttgtgcttctctttattcaaaacaggcgcacttgcgaagtcaatctttaacgcccattaaagaccgaaaggaggttttcacttggcgtatgtacccgtacccaaagacttatcaaaaatcaaaacgaaagtcgcttttaatctgacaaagcggcagattatttgttttgcggcagccctcgctatgggactaccgcttttctttttgctcaaagacagcgcgggaacaagcatggcggcatttgcaatgattgtcgttatgcttccctgcttcctcttggcaatgtatgaaaaacacgggcagccccttgaagtcgtgataaagaacgtcattcagacaaagtttatccgaccaaaggaacgcccctatcagacggaaaatttttatgccgtcatagaaaaacaacgaaaactggaaaaggaggtatcggctattgtcaatggcagaacgaaaaaccatgacccgcgcggtaaaaaatcccgtgaagcgtaagctgacccgcgcagaaaagaaagaaatcgccgccgtgatacaggcggcaaagggcgacgggaagcccaacaccgcgcagcaaaccattccctacttgcagatgtacccggacgggatttgcagggtaacggaaaagaaatactcaaaaagccttgtctttgaagatattaactatcagcttgcacaggcagatgataagaccgccatttttgaaaactggtgcgattttctcaactactttgacgcttccgtttcggtgcagctctctttcatcaatcagggcgcaagaaaggaaaaggcacaggcggctatcgaaatcccggcacaggacgacgcttttaactctatccgcaaagagtacgcggatatgctgaaaaatcagcttgaaaaaggcaacaacggactggaaaagtgcaagtacatcacgttttccattgaagcggataatcttgcagcagctaaagcccgcctttcccgtatcgaaaccgacgtactcaataattttaaggtgcttggcgtaacagcccgccccatgaacggacaggaacgcttgaacgtgctgcatgggattttccacccggagggcgagccgttccgcttctcttgggattggcttgtaccgtcggggctttctacaaaggactttatcgccccgtcctcgttccgttttggcgacggcaggacgtttcgcatggggcgtaagctcggtgcggtatcgttccttgaaatccttgcgccggagctgaatgaccgtatgctttcggacattctcgaccttgaaaacgggataatcgtcaatctgcatatccgcagtatcgaccagagcgaagcaatcaagactatcaagcgcaagataaccgacctcgacaagatgaagattgaggaacagaaaaaagcggtacgcagcgggtacgacatggatataattccgtccgaccttgccacctttggcagcgaagcaaagaacctgttgcaggatttacagagccgcaacgagcgaatgtttctgctgacgttccttgtggtaaacatggcagacacaaaacggaaactggataatgacgtattcgctacggcgggctttgcacagaaaaacaactgcgctttgacccgccttgactatttgcaggaagcgggctttatgtcctctatcccgcttggggagaaccttatcccaattcaaagggggcttaccacatcaagcaccgctatcttcattccctttatcacgcaggagctttttcagcggggcgcagccctttactatgggctgaacgcactttctaacaacatgatactctgcgaccgaaagcagcttaaaaaccccaacgggcttattcttggaacaccgggaagcgggaaatcttttgcggcaaaacgggaaatgacaaacgcttttctcattaccgacgacgatattatcatctgcgaccccgaagccgagtatttctcccttgtgcagcgtttgggcgggcaagtgatacgcctgtcgccaacaggaaaaggcatggacggcaagccccagtatgtgaatcctatggatataaacctcaattacagcgaggacgacaacccgcttgctttgaaatccgactttatcctttccctctgcgagcttgttatcggtggaaaagagggtttgcagcccgtggaaaaaaccgtcattgataggtctgtccgtaatgtttacagaccgtttttagccgaccccgacccggcaaaaatgccgattttgggcgacctttacaacgagcttttgaagcagccggagccggaagctgcccgcattgcggcggcattggagctttatgtttccggctctctgaacgtctttaaccaccgtaccaacgtggagctttcaaaccgtcttgtctgctttgatattaagcagcttggaaagcagctcaaaaagttaggtatgctcattgtgcaagaccaggtgtggaaccgcgttaccgtaaaccgcgccgagaaaaaagcgacccgctactacatggacgaatttcacttgcttttgaaagaggaacagaccgcagcctattccgtggagatttggaagcgttttcgtaaatggggcggcataccgacggcaatcacacagaacgtcaaagaccttttatcaagccgcgaagtcgagaatatctttgaaaactccgattttgtcctcatgctcaatcaggcacagggcgaccgggctatccttgcaaagcagcttaatatctccccacagcagatgaagtatgtgacccacaccgaagcgggcgagggacttatcttttacggaaatgtggtgctgccgttcattgaccgcttcccgacggataccgagctttaccgtctgcttacgacaaagccggaggaagtgagcaaagcatgaaaacggacgtaatcatcaaccgcgacgccctctatgccctgcgggagctgccgagtgaaagcgtgaactgctgcgtcacaagcccgccttactatggactaagggactacgggcttgatatgcagattggacgggaggacacgccggagcagtatatcgggcggcttgtggaagtgttccgggagctgcgccgggtactcaaagacgacgggacattttggctgaatatcgcagatacctactgcggcagcggtatgaaagcgggctgcaagcaaaaggatttaatcggtattccgtggcttttagcctttgccctgcgctctgacgggtggtatctgcggagcgatattatctggctgaaagaaaatcccatgccggagagctgccgcgaccgaccgagccgctgctatgagcatatctttttactgacgaaatcaaagaaatactactatgacgctgccgccattgcggagccaatcgcgccgggaacggcagcgcggtacaggcaagggcgcggcgcaggacacaaatacgccgaggaagtaccgggacagggcaaggtacagggtatcaataaagcccgcagcggcggctattatgacgacgcccttatgccgaccacaaggaacaagcgggacgtttggattatcaataccgtaccgtataagggcgggcattttgccgcttatcccccgaaacttgcggaaacgtgcatactggcgggctgtccggcgggcggcgttgtccttgacccgtttttcggcagcggtacaaccgggcttgcagcgaaaagccttgaccgtcgctatatcgggattgaactgaacgccgagtattgcgcccttgcaggggcgcggattggaggtggtaacacttgaaagacccattaaagccccgtgataaaatcacgcagaaaatgacccgcgacggggctattgcagaaaatcagaccacgggagacacggaacgtatcagcaagcggacgcaggacgcggattttcagaaatccccggagcaacaggcagcacaagacgcagcgcagctacaaggtgcagcttccccgacttctcccttgccccatgtgccgggagctgcccccaaagcagacacaggcaaaacagagcgcgtcatggagcatatcgaagccgcccatacccgcaaagcgtctaaaaaagcggtacgaaaggcacaggcagaagctaccgccgggacgaaatcttcccggctgcaatttaccgacgaggaacgcgctgccccggagcttgaaaagtatatcaagaaatccgacaaagccgctgaccgactggataaggcaaaggcagctatccccaaagaaaagaaacttacgaaagagcgcacctttgacgaagccaccgggaaaggcaagacccgcctgcactttgaggaaaaggacaagccgcccggatttaaggacaaacacagccccttatcccgccccgcacaggaagccgggattttggtacacaacaaaatccattctgtcgaaaaggataattccggcgtggagggcgcacataagagcgaggaagccgccgagcgcggcgcaaagtacggggtaaggaaaatcaagcagggctaccgcagccacaagctgaaaccctaccgggaagcggcaaaggctgaaaaagctgctttcaaggcaaacgtggattttcagtatcataagaccctgcatgagaacccacagctaaccagtaaccctatttcccgtttttggcagaaacagcagattaaaaagcagtatgcaaaggaagcccgcaatactgcaaagggtatcaagggcgcagcggaacgcacccgcaaagcggcagccaaagccgccgagaaaacgaagcagacagcggcgtttgtggcaagacacccggcgggcgtggcaatcgctgtcggggcgctgctgcttttcattatgcttctgtccgggctgtcctcttgtggtgcaatgttttccggcacgttaaacggcgtgcttggaacgtcttatacgtccgaggacagcgaccttgtggaagtggaaaatgcctatgccggactggaaagcgggctgcaaaacgagattgacgctatcgaaagcacccaccccggctatgacgagtaccgctatgaccttgcaaatatcgggcataacccccacgaattagcgtcctatctgaccgcaaaataccaaagctacacccgcgccgaggtacagagcgaattacaacggattttcaatcagcaatacaagctgacgctgaccgaggaagtggaaatacgctaccgggaggaagaacgcaccgacacatggacagacgaggacggcaacgagcatacggacacctacacggtacaagtgccttatgagtattacatcttaaacgtcaagctgacgaacaccccgctatccaccattgcggaaaataatctgaccccggaacaactggaaatgtaccgggtgtacttgcagacaagcgggaacaagccccttatctttggcggcggctctcccgacacttccgcgtccgaggatttaagcggcgtggactttgtaaacggaacgcgccccggtaataccgctatcgttgaccttgcaaagcagcaagtcggaaatgtgggcggctatccgtattggagctggtacggcttcaactcccgcgtggaatggtgcgcctgttttgtgtcctggtgctacgggcaaatggggctttccgaaccgcgctttgccgcctgccagtcgcagggtattccgtggtttacctctcacggacaatggggagcgcggggctatgaaaacattgcccccggcgacgctatcttttttgactgggacttagacggcagcgcagaccatgttgggcttgttatcggcagggacgaaagccgcgtctataccgttgagggcaattccggcgacgcctgcaagattaagagctatccccttgactatgcctgtatcaaagggtacgggctgatgaactggaactgacatacaacaaacacatttgaaaatcgaaaggagaaaaatcattatggctatgagtaaaatcgaaagaattgaaaaggaaatccaaaagacccgtgagaaaatcacggagtatcagaacaagctgcgcggactggaagcacagaaaaccgaagcggaaaatctgcaaatcgttcagctcgtgcgctccatgcgcctgaccccgcaggagcttaccgctatgctttccggcaacggtattccgggcattgcccctatccccgcagactatgaggaacaggaggacaatgcagatgaagaataaaatccttgcaagccttaccgcactttgcgccgcccttgtccttgtgggcggcttttctgttactgcctacgcgcagaccccgacggaggaaaccgacgacagcggcgtaatcgtggaaaccgaaccgcagccccttaccccggagggcaacatgacccttgtggacgacatcgacggggacgctgccgaggataagcagtttatcgtcgtgaaaagcaaaggcggcaactatttttacattatcgttgaccgggcagccgagggcgaaaattccgtccacttcctaaatcaagtagacgaaagcgaccttatggcgattatcggggaggaacagaccgagcagcccccggctgtctgcaactgtaccgagaaatgcaaggcgggcgaagtaaacaccgcctgccccgtctgctccgcagccatgaataactgcacaggcaaggaagccgagccggaagcacccgcagagccggagaaacccaaaaacagcatgggcgggcttctcattttccttgttgtgggacttcttggcggcggcgcagccctctactacgttaagtttatgaaaccgaagcagagcgtaaaaggcggcaccgaccttgacgaatttgattttgacgaatacgacgaggacgagccggaggaagaagctgacagcgcagataccgaacaggaggacgaggaagcatgaaacttgtgatttgtgagaagcccagcgtcggggcggcggttgccgccgcccttggcgttacgggtaaaaaagacggatatatcgaggggaacggttatgttatctcttggtgtatcgggcatttggtacagctttccgaagctgccgcctatggggagcagtacagaaaatggagctacgacagcttacccattctgccgcaggaatggcagtacaccgtagcagccgacaagggaaaacaattcaaaatcctaaaagacctcatgcgccgcgccgacatttcggaagtcgtgaacgcctgcgacgcaggacgcgagggagaattgattttccgatttgtctatgaaatggcgggctgcaagaaaccctttacccgtctttggatttcctctatggaaacggacgccatcaaaagcggctttgacaatctgaaggacgggcgcaggtatgacgctctctatcattccgcattatgcagggcaaaggctgactggcttatcggcattaacgcgacccgccttttctcctgcctgtatggaaaaaccttgaacgtgggacgtgtgcagaccccaaccctaaaaatgcttgtagaccgggacgctgccattatgaacttcaagaaagaaaaatattaccatgtgcgccttatgctccccggcgcagaagcggcaagcgcgaagatctgcgccgctgatgaagcgggcaaactgaaagcggcctgcgaagcgtcggcggctgtctgcacttccttgacccgtgaaaataaaaccgctataccgccgaagctctttgaccttacctctctgcaaagggaagcaaaccgtatctacgggtacacggcaaagcagacccttgaccttgcacagacactttatgaaaagaagctgcttacttatccgagaacggacagcaactatctgaccgacgacatgggcgacacagcggcgagtatcgtatcgctgctttgcggcaagctgccctttatgacgagcgcagcctatgaacagagtatttcccgcgttctgaacagcaaaaaagtatcagaccaccacgccattatccccactatggaacttgcaaaaactgaccttactacgctgccggaaagtgaaagaaatatccttatccttaccggggcgcgtctactcatggcgaccgcagagccgcacgtttacgaagcggtaacggcggttttctcctgcgccgaccatgattttacggcaaggggcaggacggtaatcgctgccgggtggaaagacatggaacgtctttaccgggcaaccctcaaaaagaagccggacagcgacgacgaaaacgagcttgtgttagatgtgccggacttttccgaggggcagacctttgaaaatccggcggcaaaagtgacggagcatgacaccacacccccgaaaccacataatgaagcaagccttttgtctgctatggaacgcgccggaaacgaggacaccgacccggacgcagaacgccgggggcttggtacgcctgccacccgcgccgccgtcattgaaaagttagtcaaaggcggttttgtggagcgcaagggcaagcagctacttcccaccaaagacggcacaaaccttgtctgcgtcctgccggacagcttaacttctccgcagcttaccgcggaatgggaaaataatctgacgcagattgcaaaaggaagtgcagccccggacacattcatgcaaggcattgaagctatgacgcgggagcttgtgaaaacctatcttttcctttccgaacaggacaaggagcgtttcaaagaggaaaagcctgttatcgggaactgcccccgctgtaaatcccctgtctatgagggaagaaaaaactattactgttccaacagggattgcagctttgccatgtggaaaaatgaccgtttctttgaggaacgcaaaaccgtctttacccggtcgattgccgcagcacttttgaaatccggcaaggcaacagtcaaaaagctgtattccgtaaaaacgggcaaaacctacgacggaacagtgctgttagccgacacgggcggcaagtatgtgaattataaagtaaccatttcaaaggacaaacaacttgaatagcaagcataggaagcgggtacccacttccgtaaaatccctgccactctaaccgagcttggcggggattttgcttgttgggaagtttcccaaaccctctaaaaattctcaaaaatctttggcagaaatacgggcgcaccgtagtaggactatgtaaccacaaacgcagcgtccgcgctgccatacgcgaaaggaggttttacacatggcaagtttgcgcgacagcgtaaaggaccatcaagaggaacttaaggacggtattgcatgggtagcattttggaaacagggacgttcatggaacgccgagctgtttcatcttgaagtggacggcactttagaaccgtttgacaggagccggttagaggaaatcaaagcggctgaccccgccgccgttatcttaaatggctactactgcgggcatttaggcgaggatatgagccttgacgagctgaccgccggagtgcgctatcactatgaaaacagcatgaatgaccttgacggttttatcggggcgcatgacgacaggcttcccccggaggttatcgaggaagcaagagctgccgcccatgcagcagggcttcccttttccgaaaagccctaccgggacggggaagattttgacccttatatatttgacggaagcatgagtattgaggactacaaacttatgcaccgcatgattgaaaaagaaaggagcaagcaaatggacgaatggaaaacaggttattcttcatacgaccgcgacagactggacgccgccgacaagatgaagattgagcgcggtatctattttgacacgaaaggcgcggatatttccccgctgaccgccttacctcttgccgagcttgtgaagctgcgggaggaaagcgcggctgcggaacagactgtttttgaaaatctgaaagtacaggcttccgcatgggaggaacaggcaggaaagaccctgctatttgacaaggcgattgagtatgcgagaatacccgaagtgaagcatacggcgaacaagtggcaggacgaggacaacgaccgccacaccatcagcaaccgggtatataaaatgagctaccatgtgtatgaaaatacccgctacgacaaggcagcacagaaatctatcccgtattcctatacgctgtcttggaacatctacaccaacagcccccacgggtacggacaggcgaaaatcgccggacaggacagaaaggtatttgctgaccgggcggctatggaaaaatatctgaatgggcgtatcaaggcgtatgaaaaactttttacggaaatctccccggctatcccgccggaatacgcggaacagtttagggtaaacgggcagctcttaccgggctacaccgtagagggcgaggaaatcaagcagcccgccgccgacattcccgccgctgcaccgagaaccgagccgggacaggaaacggaacagtttgcaatcctgattgacagccgcacccgctttgaaacgggagaaccgggtggctactggctttccatgcccgccacaaaggaagaacttcacaaagctatgcgaagcgtcggcattaccgctgacaatccgcaggaatttttcattcatgggtattctgaccgggaggacaggcacattgccttaccgtatgacatggtatgcgcggcacaggtggacgagctgaatttccttgcggcacgactggaaacccttgacgcttccgggattgccgcgctgaacgccgccacacagcgaaagaacggttttgagaatatcgggcagctcattgactttacctataacgaggactttttcgtgcatatccccgaagtacataatccccgcgaattgggcgattattaccttaacaaatccggcatggtgcaaatgcccgctgaatggaaaaacagcattgaccctatcgcctttggacgaaacgccgccgcacaggaaaaaggcagctttacggaatacggctaccttgtggaaagcggcgacgcatgggagaaacactttgaggggcgcgatgtgccggaggactaccgcattatgagctacccgcagccgaccgtcgaactggacgcagccccggcagtacaggcggctgttcccgaagcaacgccgcaggagccacgcccggttatccccattgtcttaacttccgagaaacccgccgaaaagctcaaagaaataactgaccgcttggagcagggtattacggagctgttcgacagcgagcgttacaaggaatatctgcgcgtcatgtcaaagtttcataattacagctttaacaatacgctgctgatcaccatgcagaagcccgacgcttctcttatcgccggattttccgcatggaaaaataactttggacgaaacgtgatgaaaggacaaaagggtatcaaaatccttgccccgtcgccattcaagattaaaaaggaaatggagaaaatcgacccgcagacacagaaagtcattatcggtaaggacggaaagcccgtaaccgaggaaaaggaaatcacgatacccgcctttaaggtggtatctgtctttgatgtatcgcagaccgagggcaaggaaatccccgacattgccgtaaatatgctgaccggggacgtagagcattacaaggacgttttcgctgcccttgaaaagacttcccctgttcccgttgcttttgagaaaatcgagggcggcgcacacgggtactaccacttggatgacaagcgtattgcccttgatgagggcatgagcgagctgcaaaccttaaaaacccttatccatgaaatcgcccatgcgaagctccatgacattgaccttaacgcccctttggaggacttggagaacagacccgaccgccgcacccgtgaggtacaggcagaaagtatcgcctataccgtgtgccagcattacgggcttgatacttctgactattcctttgggtacgttgccgggtggagtgccggacgggagcttgccgaactgaaaagctctcttgaaacaatccgcagcaccgcagcggaaatcatcaacagcattgatgaacatatcgcagagttgcaaaaggcacaggaacaggcgcagacttccgagatacaggaaatcgggcaagacgcaccaccgcaggagcagccggaaatccccgtacccgacgccactatcagcataaaagaaatgcaggactacggctattcttgggacggtatgtttccgctgaaacaggaagccgccgagcgtttgtttacacaggacggtatcgaggttttccgtatctatgaggacggcaccgagggagccgttaccagtctgaccgatttacaggaacacgcagaaaaaggcggcttgttcggtgtagaaaaggaaacttgggaagccctgcatgaatacaacgccatgaagcagcagctacgggaaagtgagccgacaaaggaagctcttttactctatggcaaagaggacagctacgggatttatcagttagcccgcggcgacgccacaagggacttgcgctttgagccttacgaccgcctgcaggcgacgggacacaccgtagaccgggcgaattatgagcttatctacaccgcgccccttacggcagacattacccttaacagcatttgggaaaaattcaatatcgaccacccgaaagattttaagggacacagcctttccatttccgatattgtggtgcttcatcagaacggcgaaaataccgcccactatatagacagtatcggttttcagaatgtgccggagtttttacaggagaagcagccgcagcttatccccgacgagcatttgaccggggaacagattaaaacgccgcgcggcagtttttatgtatcggatatgagtgttgaacagatgaaagaagccgggtatggacttcatcatcaatccgacgacgggaaatatctgattatgggaaacggtacgcgggcgtttgccgttgccgccgagcagccggaaaaagctaacccgttaaaacatatcgaggacactatcgagcagaacgacaataactttgacggtatcatcaacaacacgccgcagacgccgaccgtggacgctctggagcagaaagcaaaggcgggcgaggttatttctcttactgaccttgccgaagcgattaagaccgaccgtgaaaacggtaggggcaagaaagccgcagcgaaagaaaagccctctatccgagcgcagctcaaagcggataaggaacggacgggaaagaagaaacccacgaagcaaaaatcgcaggatttggaaaggagctgacctatgaataagtttgaagatgtggacgtaatcgcttcccttgaagcgattatgaaacaaaataccgctttttatcagaatgattttgaccttgatagaaacattttacagaaagcggcggcaagccccacagccgaggacaggcggcttttatggttttcccgtccgtccgggacgagctgcttccgggagcgcgacgtttttctaaaaggcacaagacagcataacacatggcggttttacggggaacagacgcgcgataaagtccttgcctatgcggtggagctgaccgggattgtaaacggaaaaatcaaaggcaatctctatgagcttgactatccgcagcatttccggcacgttaaggaacaggcattacccgcagataattacacgctgctctatgagcatggagaacgggtgcagcccgccggacagtatcttgacggcaatcccgacccgcagcttgggaagtttgaacgctttgaagcgcagcctaatgacccggaagcattgcattttctcatgcgggaggaaaagcgcagctatgaccgcttaaagccgggggatttcaagacgcatattaccgcattgcatgacagccggattgaagccgaagcacagcgtattgtagcggaaatgaagcggcaggacagccctaacagccccaacaaaacacatttcatggtggagctttcgccttactttatgcaattagcttctacaaaggacaccgaccgtctgtttgctatgctgccatacaaaacactttctttttctaagattgagggcaggcatggcacttttgcatttttagacaaaagcgaggacagaagccggaatatccgaaaagcgcgcccctctgtccgggcgcagcttaccgcagacaagaaaacagccgccccgaaaaaggcagcggcaaaaagaaaaaatcacgatttggaggtatgagcatgaatagatttactgttgaggaaacaaaccttttgagcatttaccatgagggaagcaaggtgcagcttatagagaacatgaccgctgcgctgccttacatggacgcgggattacgggagcttgcaaagcgcaccctttccaaagtaggcgcgctgaccgaagccgagtacagggagcttgccgtttatcctgctgatgaagtatgaccgggattaagcggctgacgccgcgacaaagccgcaaggtaaacacccttgtgaaaaaggagtgctgcaactgcgagaatggcaactgtattttactggacgacggggacacttgcgtatgcccgcagctcatttcctattccctgctctgtaagtggtttcggattgccgtacttcctcttgataagctgctctatgcggaactctatcagaccgaggactggaagaaatgtaccgtgtgcggcgcgtcctttgcgtcgaagtcaaacagcgtcaaatactgcccggactgtcggaagcggattacccgcagacaggcagccgagcgcatgagaaaaaagcgtactcttgttacgcagtaggggcgaaaaaagcctttgattgcagggcttttcggacacaaaaacaaagaggtaaaggattgatacctttacccctaaaatcgcggttctactgcgtaacatttcaaaagctgcacctatgagaaaacgggcgcggtggccaacatatcggctgccgcgtccgttcttttttttgcgctcatttatccgcgctctgcttctttttcccgttcaggctgacgttccactttcaaaatactgtcgatattcttcttgataacgtcgtattccttgacctgctttttcagcttcccatagtcggcatacagggcttctttctgctcttgaagtgctgcgtactctgcttgcagggcggcaaggcttggtagcttggttatccccgccgccttaattgcctttgccgctgcttcatagagaataatatcgctctcatgggctgtccggtatttctccttatcttttgccttgcggtaggcagcataggcgggcttggtcttttgataggtattgatattcttgataagcagcgtcatatcggtaagccgcttttcaacctctttcaagctgtccgctgcctgttcgcttgctttggcaacttccgtgattttcgcggtcaattctgtgtactgttcaatcttatgttctgtcaagaaattcatggttttcgctgcctgtttcagattatggatttttgcccattgctcatagccccggctttcctgcaccttgatactgttctgaatatcaatgagcagactaacgccgccgcgatctgcgcggggagctttcgcagcgcgggcgcgtttgccgcttatccgttctctgatagcttcctctgtataatctgcgccgagggtttttaagcgggtaaaccgttcctgtccgggagcgcggcaggatatatattttccctgctttatctcatagcccgccgcctgcaatttggatagcaattcttcaaaacttgatacttggggaatgagcgcgtccacggcaattttcagcttgcctttccaactggtacctgttttctctgcctggtactctgcatagctttttcccttgctgccccggttcggaaggacaactgataagccatgttcccggcacagcttatcgctcatgttccgtataccgtaatagctgcgcttgttggaattgtacttgtggtggtctacgaaattgaccgcgcagaaaataatgtggttatggatatgccccttgtcaatgtgagtagtcaaaacatattcgtgctgacctttggttactgcgtcggcaagctgccgcccgatttcatgggcttctctgtaatcgacttctcccggctcaaaggcttgtatcaagtggtgggctaaattgtttcccttatccaacgcctgcgacagagtaaaggcaaactcaatgtctgccgtttcataggagcagccaaaggaggacacaagcattttttcatcagtctttgccggattttggatatagtcaagggctttgtttagcgttcctttaataggcttaatctttgtaaccgccatatttccgcaagcaccccctttatttcttctatgtcctcttggtagacgctgcctgtactgttcacacgctttgcaatctgattgacgttgacgccgattttctgtatctccgctgtcatagcttttatgtcggtatggtctacttgcaggatatacccgtcaatggcaatcttcctaagatacgctgccatatttcgggtgggtatcagtttcatcttttcaagaattaaatcccgttctgcttccgttactctgaatttgatttgcaccgttctttttcgtccgtccatgcgtaaatgctcctttccattccgagggtttgggacacttcccaacaagcaattttcaaccgatacgccgtagtgcgtgagggcgaaaatacggaagtgggtacccgcttcctatgcttgctacgaatgtttttatcctttaggctcttatcacctactacggagaaaaagcgattttgccaaacttacgcaaaagaaaaacgctgcaacctcaaaaaagattacaacgctttctaaatcctgttcagttttaagtcggacattcctattcgccctctttttcgacttcggaaatctcctttgccgttgcggttacaatccgtatgcctgtatcgctcataccgtcaagaagcgcgtcaagctgccgccgctgcgtgttcttctccggcggcgtttctaaaaggaattggtctacggatatatggtaacgctgtatcagctcaaagaatatctgtaaacttgggtgctgccccttgttctcaatgttcgcaaggtagcgcggcgagataaacatttcgtcgcctactttcttgcggctctccttgcatccctcacgcgctgcctttatcgctgccccaaaagccttaaagtcgtatcgtggtactggtctttttgccatagttattcaccctattacattttactgttcccctttcttcttggatatgtctacgtagttctatcagttagccaaaataattcatatatatatatgttgacaacaagctgcttttgtatataatattatataaaagggggggaatgtttatgttacatagcatgcgtattcgataagcattgaaatcaaaaaagatttttcccattttcaatatgggcttttttgtcatgcttattttgcgtatgctatacaacaaaactaacgacgtatagacatagtataaaaactatgccttaattttgttgtagtattatatgtataaatgcaggtcaatgctcatgttgagaattgacctgcatttttttgcgcaaaaggagaaatattatgcttgaaaaatattggataaaatgtccaatttgtaacggaaagacgagggttcaagtattttataatacggtattaagaaattttcctcttttctgccctaaatgtaaattaacgcatatcgttgatgttgaaaaactagaaatcataatcaaaaactctgaaaaacaaactttttaattttgaaaaggaaggatatttaaatgaaacacttacctaaaagtacacctacggaaatattgaatgacccatacggatttacttacaaagaaatgtcggaagtaattggagaggataaagcaagagccttatatacggaattgtataaacagccatttcacaaagaaaatctatcaatatcaacaaaaaaagtctataaaagtagcgatactgaaaagtatgtttatgaattgaaagataacaggtatattgaaacggtttttattaaacggcgagatggtgggactgtttgcgtaagtacgcaagttggttgttctgttggctgtattttttgtgagtccggacgcaatggttttgttcgtaatctaacaccgtctgaaattgtgcagcaggttgtattgatacgtcaaaaagtaaatcgtatcgtttttatgggaatgggagaacctttattcaattacgacaacttgattgcagcaatccatattcttcgagatagaaatggacttaactttccaaccgacggcattaccgtatcaacagttggtccagttaatcaattaaaaaaattgcgcgaagaacatctaaaaattcagttgacaatatctttacatgcagcaacacaggctgcgagaaactgtatcattcctcatatgcacatgtacgctattgaagatgttgttaagcaagcattgtcctattctcaaaggcataatcgaaaagtggtatttgcgtatttgcttttaccaggtataaatgaccgttcctcagatataaggcaacttgcaaaatggtttaagggcaaaaatgttatgattaacgtgctgcaatacaacccgacgagtaattcaaaaattagagcaccacaaaaacaagaaatggttgcgttcaaacatcaattagagcaaacaggacttgaagttaccatgagagtttctcatggtagagagattaaagcagcttgtggacagttagctaatacatataataaagccaaaaaacaacagaaataatttaattaaaagagccagacgcacagacgcagagccgataatatgcagtttgaaatactgctgttatcggctcttttttgattttaatttgtgcccctaataaccatattggagcaaaatcagaactgttgcttgtcgttctttgatttccgcagcagctttgaaaaatcaaagccgccgtttctttttatcttctaatgaaatgacgcggtatcactgttaaaagcggcggctaaaggaggtagccgccatgaagcacataccctatcgacaaaatccgacggtcattgacatatcaaaaaaagcccgaccaccgccgggaacctctctacccttgactatgaactgtctaatcatctaaatactgcttacaatacctatacgcctgtccgggcttttcggacaggcgtattttgctgctcaaaaaattttttgaaaaaatttcaaaaaatcttcggcgtttttcaaaaacgccgtattgccccgcgaaaagggggaagcaccaccaactttccaacgagaaaggaggtgagaatgtggaacctaatagcagggagttttacaaacaatgtgcttttcagaagttttgtaatacggtgctgcacaatgaagcgtgtgacgctcacagggagctgcacaggcataaggcaagggaagtcaccttttccgatttgcccttagacgaagcgcggcaacttcatacctttgatgaatatttcaaacgggaaaccgccgaaaccgtctttgagaaagccgggaagaaaatcacgccgaagctgcttcttgaagcaatccgtactttgccggaagaaaagcgcaaagccgtactcctgtactatttcgagggaatgaacgacaccgagattgcgaagttgttcaatacatcgagaagcacgatacagtacaggcggacaagctcttttgagctgctaagaaaatatctggaggaaaatgctgatgaatgggacgaatggtaacgaacccggctacccggaaaatgcccttgttccctatcctgtcattgtggcagcgacaaagggcgacccggacgccatgaagattgtcttgcagcatttcagcggctacatagcccgtctttccatgcggaagctgtacgacgagcgcgggaacgtctatttcggcgtagaccacgacattcgggaacggctgcaagcaaaactgatgatggctgtcctctcctttaggacagaggaataacctgggcggcggcgggacgctttcactctcacccccttttccgttccgctgctgacgcgggcagcacagccatttttgaaccttgaaaaagaaagcggcgcaagataacggcggcgcagcatagggcaaatcggatacgttccttttgcgtcgagccatacggcgagtgcgccatgacgctatccgggcgggagtattcctacccggacagccgagcgaccaacaccgcgctggaaagcaagtgtagcggcttgcgggcgacgacacgcagaatatacaatgatacttccttacagccacagtccgagcgttaagagcgtcgcaggcaatgggtagggctgcatgagaaccatgccggggtgaaattcccatgaggttatgctaataaccgtccgattaaagcctttgatttattgaatagtggacttgctgctattcatagactgtattatatgtttgcgaaagaaagggggattttctttgacgcaaaaccgaacgcccgttaccacaacggagcataaaatcggaaaagttacttaccttgtatgttcgtccgcaagtgaacacgcgacggacacactggataaaaagataaaaaagctcattcgcaaagacatggagctgaaccccgcaaacgcccgaaaatagggcgtttcttcacattttatacatgacacaggcagcggtatgtggtataatatagacagtacaaataccatgcttgtctgtcgtcggaaaggaggacaaaatgttacagacagacaagattaccgctttatattgcagattgagccaggaagatatgcaggccggggaaagcgagagcatacagaaccaaaagctgattttacagaaatatgctgacgaacaccactttttcaacacgcgctttttcgtagacgacggattttccggcgtgagctttgagcgtgaggggcttcaagccatgctacatgaggttgaagctgggaacgtggcaaccgtcataacaaaagacctttcccgtctgggacgtaattatctgaaaaccggggagctgatagagattgttttccccgaatacgaagtgcgctacattgccattaacgacggtgtagacacagcgagggaagataacgagtttacccctctgcggaactggttcaacgagttttacgcccgcgacacttcaaagaaaatccgggctgtcaaacaggcaaaggcacagaaaggcgagcgcgtcaacgggcaagtgccttatgggtacatagctgaccccaatgaccgcaatcacctcttgccagacccggaaacggcgcacattgtaaaacagatttttgctatgtatgtgcgcggcgaccgtatctgcgaaatccagaactggctacgggaacatgaggtattgactgttgcagaattgcagtacaggcgcacaggaagccacaggcacccccgcccccacccgaattgtatttacaactggccggataaaacactctatgacattctggcgcgtaaagagtatttggggcataccattacaggcaagagctataaggtatcttacaaatcgaaaaagacgaagaaaaacccggaggaaaagcaatattttttccccaacacgcacgaacctttgattgatgaagaaacctttgaccttgcacagaaacggattgctaccaaacaccgccctaccaaaacagaagaaatcgacattttttcggggcttctcttttgtggggactgcggctacaaaatgtatctgcaacagggagccgggacactggaacgcaaacacgcctacacttgcgggaagtaccgaaacaggataaggactggcgagctttgcactacccattatatccgaaagagcgtccttaaagaacttgtccttgccgatttacagagggtactatcctatgtgaaagagcatgaacaggagtttatcgaaaccgccaacgagtgcagcgcaaaggcagtacaaaagacgctgacacagcagcggaaagagcttgacaaggcacagagccgcattagcgagttgaacatcttattccgcaagctctacgaggacaacgctttagggaaactttcagatgaacagtttgcttttctgacttccggctatgatgaagaaaaaaagacgctgacccggaggattgcggaactgacacaggaaatcgacaacgctaccgagcgcagcgcagacgtgaaaaggtttgtcgcactggtacgcagatacaccaccattaccgaactgacctacgaaaacgtccatgaatttattgaccgtattcttatccacgaactggataaggaaacgaacacccgcaaaatcgaaatcttttatagctttgtcggcagagttgatacaggcgacaagcctaccgaaagcatctcctatttcagacagataggagccgacgtaaagagttatgctatctaacatacatcaaaaagaggtaagataacgccctctgcaaaaaaggttacgttatcttacctcaacaaagggtctccccggattctacctacaagatttatgacgccttatttgccctagaagaaggtctgattactccggagcactcggccctttcctggtccggtaccagatatccttttgacgaatggaaccgggatcaaacactatcaagtgctttgacctgctctgtcaactggtacttccaggcgctggaccagcaaatgggcaaatccacccttcgttcctggctgcagcggatcgaatacgggaatgaagccttgcagggtaatcttaactcttactggatggaatcctcccttttgatttccccgttagaacaggtagagctactgaccgggttctatcacaatgaatggaatctgcacccggaatacgtgaaagcagtaaaaaacgccatctgccttgcctcctcatctgacggttccctttacggaaaaaccggaaccggccaggtcaatggagaaaacagaactggctggtttatcgggtttgttgaatcttcgggacatacagtattttttgcgatgaatctgaccggggagggagcctgtggcagcgaggctgcctcccggactcttgctattttatcggatcgtggaatctatacggatccatccctctaatcagtggaaaaagcggaccttacgggttcactgcccgttgtccgcttctttccactgtgttcctaatcggtactgataaggaggaatcctccccagttcctcatccgaaatctcatttcccagatattggaatgttccattctgtcggaatcgtaccttcagcgtatgatgcagagcacagtcatttccactccccagacataccgcctcaatagtcagtgctgtggtgccgtcagcattttctttcacatctacgacctccggcaaagaagtaccgaaggttgtcgggacgtagttgccggttccaagacgtacccataagtaggtccggctttccctgtcgtattctgcaaatgtacgaagctcctctttagttaccggaatgtaatccataatcagagtttcaaactcttcctccggaatcccatccgcatagcggtcataatcgattttcttcccgtatttcatctcatagaacgactcaaacactccattataatccagttttgacaaatctgataaatcccagcgggaacacaaaagattgttcccctgatatccaagtttctcaacacacgcgatagataactctttacacttcttgtccatgggccggatccgaatcatggtccccgcatcgaccacctcacttacttccggtggttcaggcgcacataactcataagaaaaccagcctttttcagtataattccattttttgatgcgggtacggatcgtttccgtaactacaggttttccctcctgactccattctgcgatcgtctccagaatctccatttgtttcccgtcaaatacaaatttcatccggtttaatccaccgcccgcttttatctgatacataacaatctcccctgctttttgatcctggcagtttaaaagaaatcgatccatttttttccaatgttccattgtagaatatgcatctgcgccactcacagtcagcccactctttttcaagatttctttcattttgataagatctgcatcagagagcaccccattggacgcgtctcctttctctgctttacggtaacatgcccccgtaagattcattgcttttttacaagctgcttccgcctcttccctctctcttttaccaaccggaagatcgtatccctgcagcttttgcttttcccatgtctttttcttctccctggacgtatcctcaggacgtgattcctcccggtccagaatccggcttccaagaataatgacaatcaggagcaaaatcagcagccccacgttgcgtctccaatgtctatttctttccatagtatgcttcccactcttcctttgtaaatcttggtttataccatgaatttgtcactcgctcgtcccaggacaggacccggcaggagacataatcaaaacttccctcctgcccaggtcttacaatcagctcgctttttaccgcacagtccagcatcttccatgtccataccgcctccactgtgagacggattgtaccatcatccagcttttcatagccggtaacctccgggtatgggccgtaaggacttcccccatccttaagtcctctcggacgatacagaaatgttccgctttctggttgatacatcatattttcccggatggtggctgtatgaaacgaaaaataattttgcagtacttcttctacttcctgttccggtacctgatactccgccccccaggaagcctcatatggaaccggctcaccgaatttcacataaaaaagccgttcatacagatcgtaaaaatccaacttttccggttccttttcattccaatccgtaatcaatagattgttacggtcatatcctatctgtgtcacatagacgcggcaggctttcctgcacacagaatccagtggtttcactcgaaaagctttttgtccgggcggcccgtcgtaccctgcaggtcgggcctcttccagaaagagatagcctttctgagtatattcccaggagtttgtttcaaactcgttgtaataattgattttcggcttttccccccattgaagagagctcaccgctgcctttaagcctccttgctctgcttccagatcataacggatccatcccccctcctttgtcacacagaacagagttgcctttgcctttttcccctcttctgcttgttgacagaaagtttccatctggctataattcaccatattgatctgattatccgtatccacggccgcatatccctgctctccaatcgcccggatgatagtttcctgaatcgtttccgtatccttttcctgttcataaagatcctttagtctctcagccagccgcagggagtcctctttccgattctcttcagattccggttctttgatctcctcggttttctgatctgttcttctctctgctccatacccacagccacttcccacaactataatgagaagtcctgctatcatccatcttttccagttcactttgttctccccttttgtctttttaaacgttttgatgatttaatattacacttgtaagatttataagtcaagcaccattctaatcattggaagcgccaaaaggcacattcctggattatatgcggtcgccagtacaaaaaatgaggaagagtaaaccgatcggttctcttcctcattctttcttttcattttcatcgattaaacctgcacaagccctaccatactgccaatcaacacaacaatcccgagtgcaatacggtaccatccaaatgcctgaaagtcatgcttcttaatataatccatcaggaaacggatcactacgatggagacgaaaaaagccgtcaccataccaactccaagtactaaaagctctgatccactaaacgcaaatccatatttcagaactttcagaagacttgccccaagcattaccgggacagccaggaaaaaggtaaactctgacgccgcttttctggaaaccccaatcaggagggctcctacgatcgttgccccggaacgggacgtccccgggaagaccgccgccagaagctggaacacaccaatgatcagcactgctgaaaccgtcaaatcatcgaccgtacgaatcttcggctttctgcctttattccacctttcgatgataataaaagcaataccaaacacaatcagcgcaaccgcaaccggaacggcatggtagaacagttcttcgaatacactgtcaaaaaggattccaatgatcgccgccggaatacaggcaagcagaatctttccccagagaatcatcttatccatctcaacaaacggttttcttttatctttccactgaaacgggaataactgattccaaaactgaagaacaaccgcaaaaatcgctccaagctggatcaccaccaaaaatacattgataaactcctcgttcccctttaattgtataaactcatccagaaggatcatatgccccgtactgctgaccggaagccattctgtgattccctccacaattccaaataagactgcttttataatttccatctgtcttttcctttttctcccctttcaaatttacacacatgccacttttattttaccatcgtctttcgcacctgttccagaatcaaaatcgccacaagacaagctgccgcaccaatcagaaccgcggttgccatcggaatcgtaatcgccgtgatctcaaacagcgatggcaaaatcgccagcgcaaagaaagtgcctcccaccatagtcacacacacaaatgcgcgaagccaagtgagcggaatacaactcttaatgacagctcccatagaaataagaatcaaaagcatatacatcgttgtctgcctctgctccacgccaaacggtgctagcaacgaaaacaccgagatcataacggcaaccgtaataccaaacggagccgcatgggaaagtgctgtcggcagaaatcttccccgaatacgccggatatccgattccacaatcgatacgaaagacggatatgcttcaatgcaggcatcaatcaatgtcacctgaatcggaataaacgggaatggctgattagagaacaggcagaagaacgatacaagcaccgaataaattgtcttgataaagaagacctgagccgttcttgtcacgttgttgattacctttctgccctccatcacaacatgcggcaaattggtgaaatcggaatccagaagcaccacctgggcaatttgacggcttgcgtcacttccgtccgcaaccgcaatcgaacagtccgcctctctgagagccagcaggtcgttgaccccgtctcctgtcatggctacctggtgtccctgcctttgcaaagcctttacaagctcttgtttctgtttcggagtcactctggcaaacaccgcataatcctgacaaagggcatcgtagtcaggagattccccaagcgtagacatatccagagcatcctgccatcgtttcaggccagcacgctttgcaatcatcgccacagtctttacatggtctccggaaatcactttcacgtctaccccctcgcgccggaaaaagccaagcgtctcttccgcatttttccgaatcgtatcttccagcacgacactgtaaaccggacgaataccctccggaagtttctcatcatcttcccatgtctgtccgtaataaccaataataatcactctgcggcccttttccagttcctgttccagatgatccggaagcttatccatcaatctttccggcgcccccacgaaaatacttccggcgccctcaaagctgatacatccccattttctcttagaggagaaagaaattttatgctccggacgatacttcggctccggctcaaacttcaccttcaacgcctggaacgtcgcattattgtcgtcactggctgccatgtaggatttcaccagcgcctccccgtccgtgagatcagaaagcggtaaaacggtatgtactctcagctttccatctgtaatcgttcctgtcttatcaagacaaatcgtatccacgtgagccagcgtctcaagagaataaatattctgcacaagaattttcatccttgcaagccggatcactcctgccgcaagagaaacggaaatcagaagtaccagccctttcggcagcataccaaggagagctgctgaagaggagatcacggattcatcgagcggggattgccgcaggaaatatgcttccagaaacaaaataatcccaagaggaatgataaggaaacttgtaaacttcgtcaccttacgcatggatccaagcagttcagaatgaatctgtttctcctgcttcacttcatttgccagtttggtcgcataattctcgtttccgacatggattactttggcatatgcctttccggatatgactgaacttcctgaaaaaagctctgctccctgctctttaataatcgcgtcgctctccccggtcaacaaagactcattgacctccagcatcccattcacaacaacagcatcattacagatctgattcccgcttgccaatactacaagatcatcctttacaatctcttccatctccacggtcatttcgcggccgtctcttcgtacacgtaccgttgggcggttcagaatcgacagctcgtccaccagtttcttcgccttaaactcctgcgctatcccgatcacaatatttaaaatgataatggcgataaagagcatattggagtatgccccaaccagaaacagcagtactgcaatcaaaaagttcagaaagttaaacagcgtacaaagattctcccgcacaatctgcggcttcgtcttcgtaatctttgcggcgcccgtaccgccttcgccacgggccctgcgctcctctacttcccgggccgacagccccgacagattttcattcattacacgaaacctcctgcactatgtttctccgaagttctccctcttcggaaaccatgttgatccattcgtttatattttcactgattttatgcgattgcaccggagggcccaaccgctcatacggagtttatcatatcagaaagcacataaaaatgcaatttttctatgaaatatccgtgaaaaaccagtggatttaacaatttttttagaaaaatgggcagaccggagtttttgctctgcctgcccggatcattcctttttagccttatttcagaatctgatactgttcgtctgtcaccgtttcgagccattcattagaggtcttttctcctggaacttctattgccagatgggtaaaccaactgtcctttgccgctccatgccagtgcttaacaccagccggaatcgttaccacgtcgcccggatgcagttcccgggcctcccctccccattcctggtaccatccccgtccggacgtgcaaagaagaatctgacctcctcctctgtccgctctgtgaatatgccaattatttcggcatcccggctcaaatgtcacgttagctaccggaacgccttctgtagtcagcatcttcaaatagcttttgcctacaaaatactgtgcaaaggccacattcggctcaccaagtccgaacagacccccacccttttcatcctcttcttctttccatacttctttcgcaattcgaaacgccgcccatgctttcggccatcccgcataaaatgccgcatgagtaagaatctcggcaatctctgaccgggtgacgccgttctgctttgctgttatcagatgatattgaaaagaagaatccgtaagcccctgagccattaatgccaccactgtcacaagagaacgatcccgtagcgacagcttttcttccctgctccatacttcgccaaacagaatatcatcattcaattctgcaaatttcggtgcgaattctccaagatctctgcgtcccgctgtttgctttactgccatattgattacctcctaccatactttaaacccattatttttttacatccttattataaaacaccatttttccactgtctaatacctttgttttcttaattttattatccttaatatattttccaccaaaaagaacaaatgttctaatttctcgaatcctccaattttttccggggcgatgctaaagcatccccccggttataaaattgcctgtccagacattactttttttctccacaacctactttctttaacgtagggtactggcatcaggcgcacagctttgtccggggcaactggaggaattccaacactaccagtcccatgatataatacttcctcttttctctgtaagatgattatatcttattagccacttctgttacaactttattatagcacttcacccgtatcatctacacactggtcggcctttgcggcctctatctgatcagtctgttcggacggatacgtggcttttccgaaaactaacagcctgaaaggcttttcatccggtacgccgctattttccgtattggacctatgcgccgtctaagagcgcattcatatcctcataaagaagagctctcgatccggcacccatcacaatggagatgtacggatgccccgccacattctcatttaacagaatgaggcagtatccggcttctcctgttgtgccggtctttccaccaagcacagtgaccccctccggcgcgcttacaatcccctttgcataataattcgtcggcgcccaatcctctgtgcggacatttccgtccgcctgggtgatagatgccgtataactctttgtttcaataatctttaaaaacgcttcattttgaatacagttctggaaaatcagatacagatcataggctgttgtataatgattctcatcgtgaagtccgtgtggattcataaaatgcgtattgaccgccatcaattctttggcacggtcattcatctcttccacaaatgcttcctccgatccggagatatactccgcaatcgccgttgccgcatcgtttcccgaagacaataacaaaccataaagcaatgtttccagtgtcaactggtctccttcgtgaagcccgcaaagtgaagcgtccaccggaaagcttgacacatccgcattctttccgactgtcacgacatcagaaaggtttccccgctccagcgcaatcagcgccgtgaggatctttgtcgtgcttgccgggtagagacgatcgtgaatccgattagaatatcgaacactcgccccatccacatcaaaaagtcccgcggcatggacgtctgtcgaaccgtcatagctgatctcatttttatcatccgcggaaacacagagattggtagccgcaagtccctcggaaagtaagacattttccccataatgctccttttcgtaggaccatacttccgctttcttctgggcgtttcccatgaccaccgtatagccggccccgcctgccgccgtgatcagggcaatcgagacaccggctgcgatcagcttccgtctgctttttttctctcccgtcttcctgctctggtttcttcttcgtctttccttacttttcttaattcgctctctgcgccttagaatttcttcttccctttgattactcatacccaacctctttacaagttttcctgtctcttatctgtacatttctctccagtcgagatcgcccctatcaatcgccaagatgattagttccgctgtcgcaagatttgtagccactggaatattatacgtatcacataggcggatgacgtcgttcacatccggctcatgaggcttcggattggacggatccctcagaaaaatcagagcatcaatcccgttctgtgcgatctgtgagccaagctgctgctttcccccaagcggccctgccaggtatttgtgtacgtttaagtttgtcacttcctcgatcagacgcccggttgtcccggttgcgtacagctcattcctacttagaattcccctgtatgcaatgcagaagttctgcatcagtgtcttttttgaatcatgtgcaatgagacctatattcatcttcctcactccttatttatattttttctgttgtagtccaacatttaacacgagtccgataccgataaacatactgacaagggatgacattccatagctgacaaacggcagcggaattccggtatttggaaagagtcctgttgcaacactgatgttgataaaactctgaatcccgatctgcgaagcaactccgcagcagataatcctgcctcccatgtccggtgctctcatccctatcctcagacattgtattacaattaataataacagaccaatcacaatacagcaacccacaaaccccaattcttctccaacaatcgcaaaaataaagtctgtctgtggttcgagaataaagtttccattcttcacggaagttgtcgtgttattgttgagtccctttccagtcagacgaccagaaccgatagccatgatggagttattctgctgataagcctcgtcgctgctgtatttttccggctgaagccatgccagaatccgagtttcctgatacccctgcagcacgtccacatccgagtgaacgataatactcagaaggatgacaaccgtcgggactgtaatcagaagtacaactccaatgaatttatagctcaaacctcctacatacatcataatgcagaacaccatggctatggaaatggtcgtcgaaaggtctggctgcttgtatattaaaagacacggaatagcgaggaagatcactgcctgaatgatggtaagcggtttcttcatctcatcctgatgattcataataaatttcgcaaaaaacagtactaaaagaatcttggcaagctctgagggctgaaacgtcgtgaatccaaagtcaatccacctggtcgccccgttaacatcttttccgaaaaagcgtactgccagaagcattgctatcgtcagtccgtacaaaacccattgcagattcagaatccacatatagtcgatcaaagagacgataaccaacgccacaagcccgatcagcaggccgatcatctgctttccctggacagaatgtttggcacttccgatgaccataatcccaagggacgtcaaggcaagcacaaagatcaacaacgaaaatttaaaatcttttaaacgatatgattttgtaatattcagtatcttcaaagtctttctcctgtcagtgtaatggtgatccgggaacgggtgactgaaacatcaaaggtttccggagtggtgtcaatgtattttgacaccgtcaaaaaaaggtctttctgaaacagttcacatacgtttggattacagtctatcctgtcggatacaagaaccgttctaagccggtcttttgctattccgaccgatgcctttttatccattccttcaaataatcccatctctgcctcctgattagttctttttgaaaagatggctgagccgtgagaacagccctacttttgtattcatatccatgagaggaacctcctcaccgcaaagcctccgacagatgttcatataagctctcccggacggcgaatcgtctcccacaaccggttctccctggttggtagcgatgaccacctgctcgtcatccggaatcgcgcccagcagatgaattgggagaatctccgttacatcttccactgacatcatatcccccctctttaccatgtcgatccggattcggttaatcacaagctccagatttcggatctgcttggattcgagaagaccgataatccgatccgcatcccggattgcggagacctcaggcgtcgtcacgacaactgcccggtcggctcctgctaccgcattctcaaatccctgttcaatccctgcgggacagtccagaagaacaaaatcataatcctccttcaattctgccgtcagcttcttcatctgctccggtgagattgctgatttatcctttgtctgtgcggacgggagcagatacagcccctcgtaccgcttgtcatggattgccgcctgtttaagccggcattttccttcaatcacatccacgagattgtaaacgatacggttttccaatcccatcaccacgtccagatttcgaagtcccaaatccgtatcaatgacaagcacctttttcccgagctttgcaagacccgtcccgatattcgcggtggtggtcgtcttcccgaccccgccttttcctgatgtaataacaataatttcacccatgttccttcctcctaagaccaaacttgatgaacagatggcagtgcgaaacgactactgccttgccgtcttctctctttcgtaatgttttgtacagcatcagtctccggaaacaacagttccaagagaagctgcgtgtcctgttacgatttcatctttttcatccagtccgtaatagtagcggacaatatcccgtccgatttcggaaggatacgtagaattataaccgtttgcgatccggatcgcgaatgcaatgtctttttcgccctgtccgcccgtgaatccgacaaacaggccatggttcggatgcgtcttactctgctgtgcagtacccgtctttccatacagttcaaagtttccaagaccgttaaatgtggaagtactcgttaccatgcgtctcattccattgtggactgccgtccacgtagagtctgcgacaccttccacctgattcctgatctccggctcgtaatccttgaccaactttccgttgacatccgttgttttttcaaatagcgacagattgtagacgactcccccatttgccaccgcactaatgtaacgggaaagtcctgccgtcgtgtagttgttggtcccctgaccaatagaggaccgcacgacatcgctgtcagaaatcttcggttcggattctgtgatttcaagccctgtcgtgtcccccagtccgaattcttccgcatatttctggagacgctcaatcccgtatgcatcattgtattcgtttccggacgttcccagcctgtagcccacttcatagaagaaatcgttacaggaatgttggattgcgcttactacattcaggcttccatgggatcccggataaatccagcatctcgcgattggtgatatcttatcaaagattccggtacaggaaatcgctgttcccgtaccaatcacaccttctgtcagtccggctacagagacaagcggcttatatgtggatccaggcgctgtcttctcctgcgttgccttattataaagaggactcgacgtcatggaattcaactgcgcgaaataatcagaatccatcgtattggccagccgattattatcgtaacccggataagataccatagcacgcacctgccccgtgttaggatccgtgatgacaatagaacctgtacacggctccagaccaagctctcccggtgtgatctccagactttcaatcttgctccggataaaattatatggatttaaagaaccggagctaagctgattgtactgcttttcattgtatttcagaatattctgctcaaatagaatccggcatacctggcttccggtaatctttccctctttgatcatgtattcataaataatcttttcaaaggcaccgtcgtccgaaaggatatctcctacatactgaatgattgcctgataaatctcggaagcactggaatagcttgcgtctccctccagataatctgtaagcctggatgtatcgatccagttcttggatatcgcataggaaagatagcggttcacgctgatcgtctcttcgttcttccatgccaggtacatctcatcgttcgtatcaatccgatcctttaccaggatcttggaattctccgtcagaagtgtatccaccacgtagtccagataagcctgcattctgtcagacagatctttgtaggccgttccgttttcattctgcagttctgaaagaacagaactgatagcagcttcctcattctgggaatagatctccagcactctcttctccgtcgccccggcattactctttgcgaaacgtcctgtatcaataatctggtttttgaaaaaggcattgtagacgtctccaaccggaataacgatggcgtccgcatctgtcaccttgcttctgtcataatccagacggttgaccattttggacagcagaatggccgccagcttctcttccaaaatattgtacgccgcaacctgaagatcagcatcgatggaaaggtaaacgtcattacctgctttcgcttccgttaccttctcggaatcgatcacttttccgacgttattgacatagatcctggtctcgcccttttctccttggagcgtactgtccatgcttttttcaattcctgctttcccgacaatatccgtcagggaataggacttcttttccttttcagaaagcgcattgtactcttcctgagaaatctgtcctgtatagccgatgatagacgcaaaatatttactgttattgtactgacggatcgagctctcttcaatactgacaccagtgagctccccttggttttccatgatctccgctactgtcgtatcactgacattcgtagcgattgtcgttgcaatatattttcggtacttattcaggctgatggcatagcggatattgacaagctttaagacatctgccttctcatacttttcctcatcaattccatagccgtaagtcttgtccgtacagagataatgtatgatatcatccgccgtatagtttttctgtttctcagaaagcttgtcaattgtagcatacccaaaaatatcggcgataaaccggagtcttgcggtaccctctgtcgaaaactcgtactctccgctgtcatttaatacgataccgaagctgttgataatggaatctccgtttttttcaatgatgtcgatcacgctgcgaaccgttgcgttgagctccttatttttctgagccgtcgtgtcgtaatctccgttatcctcaatcgtcaccgagtaggcaaggacattgtctgccagaacaatcccgttccggtccagaatccgtcctctggtaccctgaacctcttttgtcttctgaatctggagcttataatcgtttaaatagctttcgccctttacgatctgaaggtagaaaaccctctgcaccagaatcgcaaacaacacgcaaaacacaacacttgcgataaacattctggacttaacaagcctgatgactgtctcttttatgtgttccaaaatattaaacaaacctgcttgcactccttttttcttcctctacaagtttccggtttattctcaaaatgatctgatatacaatcaacgtgaggattaccgtatagagcatttccggaataatcaaatgtcccaggtaatacaggaaatgaaaatcactctgcaacataaactggaacacatagatcagaatcccataagccagctcgctgctcccgatcaacagcagagggagcttaatattctcatcatagtacagcttctgaaaaaatccattggcataaccaaccagtgtgtagaataaaatatagaacccgatatactgtccaaaacagatatcaagcaaaaaaccgcttagcactccaacatacattccttccctctttccttccatgaatccgaaggatgcagtcagaatgagcagaagattcggcttgaccgacgcgatctcaaaataatgaaacactgttgtttcaagcagaaacagcacaatcaccatcaccgcttcgatccctttgcgctttacagccagcatatggcctctcctttctatttttctgatgaatcactctgtgtctgattgccattatcaatcagatcttgcttcgtcgttgtaataacgagcacctcctgcagcttcttaaaatccactgccggtatgatatagccggatcgtgtaagattgttagaatccacattgacttcgctgacataaccgatcagcagcccttgtaagtacttactgctgatattggatgtgacgatctgctccccgaccgctacttcattttcattattcgcaagctgctcaaacttcaccactccattgttaatgagcttgaggtccccgctgacaatgcactggtcaaaagtcgtcattatcatggatgaaatattaacctcgtcgatgatagagcgtacggtggaggaatgtgcgttgacctttgtgacaattccaaccagaccatttccactcaaaacattcatatcctcccggataccatccgcacttcctttgtcgatcgtaaaggacgtaaaccaattactcccgtcatttgcaatgacacgcgcacccactttcgggtaatccgaggtattctgatccatcttatataaatcataaaaacgctccagctcgactgccttttgctgaagctggttattttccatcttcagattggcgttctgttcttttaacgttttattttccttctgaacacttttcaatgtgacaaaattgtccgccacaccattgacccacgtcccgatcacattaatccctttctgcatcgggacaaccgtataatccgcaatcacacgcaccggaccgctcttaacacccgcaaaaaaggtcgccgccatgcacaaaatgcaggcagccacaataatcagcagccagtatttactttccaaacctttttgatttcttgtcttcatcctatctcatccacctataattttcgtctttcatggaatacgccaaatcttcaaaatccctgtccacaataatgctacgcacgcccctagccgcacagagctgcggctgctctgccgtataaaacggtacccctgtctgtgcctccatatatcccgtcaatcctttcgtacaggcaatcccgcctgtcaagcagattccctgccgtctgatcgccccaagcactacaggcggcgtctgctcaagcatcaataagagagttcggatacagggctttaagaactcctccagagcctcacgtacgatcgtactaggaatttctcttactccaggccttagccggatcagatctctccctgccgccaaaacaggaggacgtactgcctctccaaacacatcggttttcctgcgtacctcctcggctgtgggcctgccaatcacaaagtcaagatttctccgcactatcgtgacaaccatctgatccaggaatgcgcctcctgtctttaacagtctgttcagaacaattccgcctctggaaagaatcgcgatgtctgtcgtctcaccgccgagattgacgatagccgatcccggcgtctgtcggatatcaattccggcgccaatggcgtccgcaatacagcgctctacaatccgtacttcacgcgccctgactgaagaatggataaacagatcaaaaaatgcttttttttccatctctgtcacatcagtgggaaccgcaattacatactcggtccctcttgtaaagaagccttcttccgtcctcagcacgcactccagaaggtactgcatttctccaatcctggatatcacaccctctttcatcggaaacgcaatggtaatatctccgggcgttttttccaacatttcatatgcccggtcgcctaccgcaaaaatatctgtatggttccggattgcgactgcgttctttaccgtacggatccggtcttctcttttatcataaatctttagctgatacgtaccaggatccaggccataaatggttccagtcattttcttccagtcccttctcttctttatacccaccctttttcggcaagacttacatacgactgatcgccgatgataatgtgatccatcaacgtaattccgatcagctcccctgccttcgcaattttctttgtcacaagaatatcttctctgctcggctctggatctccgctcggatgattgtggagcagaatgatcgacaccgcgtctttctgcaatgcttctataaacagctctctcggagaaatgacggacatattgaccgtccccttggaaatccgcgtctcgccaagaagctttgattttgtatttaacatcagaagttttagttcttcctgtttgagatgacgcatatcctccatatagtaagatgcgatcgtctcaggtctgtcaaaagaaagaggttcttttgccttttccttcgcgatccgtcttgccatctcacagagacatagaatctgaatggccttgaccttaccaatcccgggaatcttcatcagcgcgtcttgcgagtaagatggcagtcttgtaagcccgccctctcttccggacggatagaggatctttttagccgtctcaaggacattgccgccctttgtgccgcttcttaaaagcacagccagaagctcaatatctgtcaggcttttggcaccaaaacgtccacacttttcatatggacgttcctcttctagtaactctttcattgtttgattcatatcttttgtaaactctaatgatcggttcagtagattataagaagcgataaataatgatagaaagaatcatgccaacaatgctggcgatagaaatattcacactcagtcccaaagtaagaaccagaatcccaagatccagtataaccggctgttgcaggccaaacgtctgaccgtaagaaagccatccaagtccaggaatatcctgtgcgagcatccctataaatccgcccaacacaatgcctgccagaagcatcaggagtaatccccatccgtttttgcttcttgctcctttcatctgtataccctccaaacttttgtgttttacaaaccgcttttattctaacacacttcaaaaaatgtgtatagcctttttccgtattaaattttccttaagaatcgacaacgtatttacagagcttgcaggcactcttgtcgtcaatgtgtcgtcaataaaacccttagtaaaacgcagccagttgtcgaacatcagcctcttaaataaaaaaggcaccgccagtttgcgatgtcttctttgtatgcaggaaaatccactcttctttttctgaaaattactcataagaaagactgtaaatcttatcatataaagaaatattctcttctttcaaatgatgggtaatcaaaatcaatgtaagtgtcgggcaggccaataaggcttcctctacaagtgcagcgttttctttatctaacgcagaggtcccttcatctacgaataaaatggttctattatgaatcagcgcccttgctatggcaacccgctgtttctgtcccccggataagttctttccgttctctccaactttcgtatccaacccatccggtagtgccttcaaatcattctgcaatgcactcatatccaatacttcctgcattttttcttccgggaagtcacttccaagagtaatattatcccttatagagcaatcaaaaagatacacatcctgttcgatatatgccatctgttcataataagtgtccccatcaaaagaagaaatttcttctccgtcatagtagattttcccttgataatttcctaactgtccgagcataatctttatcagcgttgtttttccgcttccactctttcctacaagagcatatttcccattcttttcaaatgtataattgatattttcaaatactttcttcttcccataagaaaaagataaattttcaagaacaatttctttcttaagtgccggaagttttttgcttattctattttcttcggtatttttatcacaatctacttttgcaaaatatggccttgaacccgcaatttgcaattttgctgaaatcaactggctgaatgcatttcctacttgatttgtaagattcaaacttccgaaaattatttcaggtgcgatgattcgcagtacacaaagcacaaatgtcagaatatttattgcattgattccaaaaatactaattactgttgatttataattttctttgcccttgttctttgcaaaatcacatttttcttcttcaaatgctttgcccgcttccatgatttctttataaaatttctgcggatttccaaaggattttaagatgcagattcctgcaatctgttcttttactttgtccgtataccgttccattgccagtgatactttttctgcatatttttccactttatcactgaatcttttgcttacatacatagaaataccggacacgaccaatgtcaatgccaacaattcccatttaataaaaagcaaagaaatagctcccatcaaaagtctgaatcctgtatccatataactgtaaaaaacttggaagccctggttttcagcttctctgacatcattagtataccaggatacatactctccgctatctgttcccacattcttttcaaatgattcatgaagtatctttttactaatgtcatttcgaagctccgtattcatggtggaaataagatatgtttgataatttttccttatatataaaagcacatagaaaaaatatgcaagagctgaattaaaagccacaacaagcagtacttttttaatttctccctctataacctgcttacctatatacatttgcagaaatgcaaaactcgtctcgattccatttataaaaatcatcaaaaagagtaatacggcattttcttttttatagtgcaacagatactttttcattgtgccaccttctctcccagacagtatacatttgtatatttctgcatgtctttttcttccaaatgatgactaacaaatagcaaagtcacatctttggactttaagagagccgtttctatcttctttgcgtttattttatcgagcgccgaagttccctcatccacaacaagaatgtttcgcttatgaatcaatgcccgtgccactgccactctctgtttttgtcctcctgaaagacaatctccattttcgcccacatccgtatcaagcccttgaggaaatgattttaaatcctcataaagtgcgctgttgcgtaatgcctcttccagttcttccttctgaaactctgcaccgagagtgatattttcccgaattgtcgtatgaaatagaaatacattttgttctatatatgccatctgtcgataaaacgattctgtatcatacacagcagcatccacgccgtcaaaaagtaattctccgctgtatgaagttaattgtcccaaaagaatttttaataatgttgtttttccactcccgctttttcctatgataccatatttcccaccgactttaaatttcagattcaagttctcaaaaaccggcttctccgaataggcaaagctcaaattccggaattcaatttcattgttaatcatcggaagttcttttttcttttccgttttctccgccattctattgattttttcaaaatatggtctggctccatccatggcaacccgcagttcagaaagtgtgaggatagaattttttacctgattgattaagtttcctcctccaaaaaatatttctgctggaatcacacgaagagcgcacattccgaacaacaccatattattgacaaaactcgcaacggaattaatccctctaattttcagcgttgcttttccctgggttttcacatatatatatctttgtttttccagctcttttgattctccttcaatctgacgttgaaatcgatcttggtatccgaaatatttaagaactctgactccccctatctgttcttttactgctttcgtaaatttttcccatattgcagacactttttcagactcttgtttcacatcgtttccaaaacgatgggacaatacataaaccatacctgttgtaatcagtgtgcaaagcaaaagctgccaattaattgctcctagtacaataatgcctaacactaacttaatgatttcatctatggcatcataaaaattacggatgcctttttcttccgcttcttttaaatcattaatgtaccaggataaatactctccggaatcacctttttttaattgttcaacagatttacttaacatctgatgattcagattctcccgcatggcttgattgatttttgcgattactttcgtgagatgaacatcgtaactccaaaataagaggtgaagtatcagatagagaatcatgatcccagcagaacaaatcaaaattcctcgcaaatccccttccattacaagctttgccatgtacatcgtaatgagcgtactacctaagagaagtaaattttgaaacagtaattcgaaaataataatagaactttcaaatttgtaatgtttcataaaagatttcattctttatccctcatcttcaaaactttggtaattatcacagatataattttcagtcattattcttttaaatggacacatgttatttaaacatgaaaatatcttattgcaagaaaaacatttgtcatataaaatgttttcgctccacacttcattttttttcaaatccaaatgtaaattaccatatccgtctatatatcctacttcattttgtgatttatttaatgcaaccgtacatttttcgactttcccacttgcccgaatagtaaatccatttttatacgaagcataacacatttcatttcccaatcctatatttccagtgttatcacacctgatttttaaattatcaatataattaatatgatctttaattaatttctttcctgtgattgcatgaagtaaatcaagacttttaactccctcacctcccaaatcacatacctgacgtacaagtataccaaaccgaacatcttcaccatatttttcattaaggaaatcataccaagagaaatctctatcacctgctaaaatattgtttcggatcattatattaaacttatatgtatctggtaatttatgaattgcatctaaattttctataattttttttaaagttggctgcccattttttaacaaacgttttttatcatgattccagccatctaatgttatttgatacgatacaattccactgtcataatattcaagaaagctttgttcatctaacaaataaccatttgttgtcatggtaaacgtatatttacttttatcgttatcaaccaaacttttaattagtctatttatacgtaaaactatatctttacataatgttggttcgccgccaaaccaacttatacttatatgattatacttagcataattcttttctaaaaaacgctctattcccacgactatatctgttttcatagttatattttcatgatcttcatagcaatatacacatctaaaattgcaagcttctgtaggcataatcgttaataccaaaacacgatcaaaatatgcttttatttccgaaactttttctttgacttcattttcatctaacaaaatgccttgtctatttaactcttgctctaaaattgtttttaaatctttacagccatttttctttaataaataatactcttttttaaaattttcatctgacaactttatttcactatcatacaaattagattttactattacactattatcttctgtctttttttcagtacacccaacaataaaatacatactcatccttccttcatattttatataaaatatatgagtttgcatacttaacattgtagcaaactcatatattatcatcttcagttaaccgttacatgcatttccacatgctccaggtccgcaattaccattcgtcatcatgctaaccctttttaacttttcgtgcaaatcgctattcttcacctgaataatttccatattgctcctccttcctacctgaaaattaattttatattaacacatttttctatattagtctatattacatatataaaatatgtataagcactgttttttcgttatattgtacaaatcaaagattgttttttatacaatacaattttcgtctaaatacatacttgaaattctgttctttcgtgatataattttcgtatggggtattagcgcagttgggagcgcgccacattcgcattgtggaggccacgggttcgaatcccgtatactccatggaaacggcaaaagtagtcggtttattttgatttttgccaccgaataaaaaagagacagaacatatcggccttgttggaagtccaatatgttctgtctctttcttttgttcccattgatttcatagcacaataatttcttatctgaatttttagaaatgctctctgcccttgtaccttctctgctgtgtccatatcctctacaggtgtttttatcgtgatttccgaacccatcacgctggttcgccatcgaaaaaactgacaaaatccgccccatgtgccatactctgcattgcccagagcatcatctgtcccggctttggtgccggcgcctccatacgggtattccattcattccccccgactgctgctccatgatcccgaaatgatgcaaaatggaatccagcttattctgctgtaaccgcaattttgattacgccgtccagccggttttcaaagatccgataggcttcattgatttccgacaaaggaaaccggtgtgtaatcaatggcgttgtatcgatctttccttgttcaatcaaagataaaatttcaccacagtcacagccatctacgcctccggtcttaaaggtcagattctttccatacatctgtggaagtgggaggatctgcgcttcctcatagagagcaacgacggtcacaatagcattgggacgggcacacttccaggcaagctcaaaggtgtcctttgtgccggctgcttctatgacaacatccgccccgccatgttccgaatgagcaagaacatatgcttcacattcttccggtgtacaggccagcaccttcgggtaatgcttccgaagaaacagacgtctttcctcctctttttcgcagacaatgatagctttcggattctgaagcatcgcgcacagcaacgtacagatccctgtaggccccgcgccgatgatcagaacggtatcctccggctggatctcggagatgcgggcagcccaaaagccggtagccagaatatcccctacaaagagtgcctgttcgtccgtcacactgtccggaatccggttcagcccttggtcggcaaacggcacccggacatattctgcctgtccgccgtcgatccggcatccaagcgcccagcctccatttgggtccgtacaattattgacataaccatgcttgcagaaaaaacaccctccacaaaatgtctccacatttacagtcactctgtcccccggacaaaccgacatcacctcgtctccaatctgctcgacaattcccaccatctcgtgcccaaccgtaattcccggaacagcccgcggtacactgccatgcttgatatgcagatcgcttgtacagatcgagctcattgtcactcgaacgatcgcatcctgcggattttgcaaggttggcttttgtttgtcaatcagagcaaatttatcatgctctatataggtcaatgccttcatacggatccccctttcttgttcccgcactctcttttcttttacaaaatcaccgtgtttctttcatcatgatccaccgggcgatattgcttcgcgatcgcctccgcagtcttgatgccgtccatggccgccgaagtaatacctcctgcgtatccggctccttctccacaagggtaaagtccacgaatcccgagactttgcatggattcgtccctcgtgattctcaccggagaagacgttctcgcctccaccccggaaagtaccgtatcatttctggaaaaaccgtgaattttatgttcaaaatcttggattccctcctgaatggcctttgcaatgtcctccggaaaaattccacgtacatcgccaaacgtgcaggctcctttcatctggggaagaacctccccaaatccggtcgaaaccttatcttcacagaaatcaccgaagcactggaccggaatctttccctttccggcccggtatgcccgctcttccaattctctttgaaaggcgatcccggaaagaggatccttattctcccccataaagtcttccggggttactgtaacaatcaccgcactgttggcatttttccctgctcttccatgataactcattccattgacgcacagacgtctctcttctgaggatgcgtttacgacataaccgccgggacacatacaaaaagtataaacaccccgcccatttcctgcttttgccgtcagcttataggctgccgccggaagatccggatgctgtttcgttccgtactgggacagattgatctgctcttgcagatgctctacccgaacgcctacagcaaaggacttggcctccaaaaaaacaccggacttctttaacatcgcgaacgtatccctggcactgtggcccagagcaagaactactgtctgtgacggaagtaatgagtgggttccatcctgctcgatttcaattccgacgatgttgtgatcctgaatctgtatgcctgtcatcttcgtgtaaaaccgacattccccaccataagactcaatggacttacggatcttttgtaccacatcaattagtatgtctgtacctatatgtggtttgctctcgtagagaatctcctccggcgctccatgttctacgaaaatccgcagtacctcccggtttcgtccttctggatcctttaccagtgtattcagctttccatcagaaaaagtccctgcaccgccctctccaaactggacatttgtacggatatcaagaactcctgtctcccagaatgtctctaccgctttacggcgctctttcgccggcgctccctgctcgatcaaaatcggacggtatccgtacttggcaagcagataggcacaaaatagtccggccggtccgcttccaactaccacaggacgctgttccatcatgtttccgtccgtacagactgaaaacgtgtacgatatttcttctgcccttgatatgtttttgttctttccacgatttaagatcgaccactctcttttcgtctttgacagagtcacatccactgtatagacataataaatttccggttttttacgagcatcgatagagcgcttgataatctccattcctgtgatttcctctccggaaacgccaagaatgtgccctaccttttttttcagctctgcttttgtatggctggttttcatttttatctgttcgattcgaatcatgcctgctcctttcccgcagcactccttcctgccacatagccgctcgaccatgcccattgaagattatagccgccgcacattccatcgatatccagcacctcacctgccaaaaacagtcccggaacgatacgggattccattgtcttagaatctacttcgtccgtcgcaattcccccggcactgacctgagcctgatcaaaccctttcgtccctgtgatccgggtggaaaagatcttgatcacatgaaccagacagtcaacatctgcctttgtcagatcctttgccagaaatttttctgaaatgccagctcgttccaacaaaatacatgccagtttctcatgaaatactccggtcagaaatgttcccaccggtttctcaggcctcatctgaatccgtgacaaaaggaaacttttcaactgctctttcgtaaaatccggcataaaatcaagctctgcccttacttctatggtaccttctgacagcgcttttgccgcaaaacgactgatctgaaaaaccggaatcccggaaattccgtaatcggtgaactggatttctccctgatccagcgctcttacttctccgccgcacacaagctctatcttcgctccggcacgcacgcccgaaagcttcgggtaaaacgcttcttcgcacatcagttgcaccagcgccggaacgcagggaacaatcgtatgtcctaacttcccggccatccgcatcccggtgccatctgccctttgtactctgccggcaagtcccccggccgtcagaatgacatggtctgcctcataagtctgttcctcttctcctacagtcacaagaaccgttcgttttttacttttcttttccggtctttggagataccgtttcgccgttatatggaaacgtgctccttttgtgatcttctctgcaaacacattggtttccacttttacctgtagacgctttaattccatgaccagcacgtcccgtaccgcctgcgcctgttccgaatgaggatagagatacccatcccggttcttggagtaaagtcccatctccagaaagaaccggatcgtctccggcaccgggaatcggctgatgacctccatggcaaaatccgggtgctctcctcggtaagctcctggcatctgccggatattggtaaaattgcattttccatttccggtcgataaaattttctttccaagctccccgttttgctccagaatcgtaacccgggctcccgctcccgccgccgcaatcgctgccatcatgccggaagctccgcctccgattaccacaaccttcatcatgctttctcctttattcaatggttacaacacctgcttctgtcaatttttgaagagtcattagaattccgaatttggcgtgctcccaggtaagccccccctgaaaataaactgcatatggcggtttgatcggagcatccgccgatagctcgatagatgaaccctgaacaaaagcacccgccgccataataacatcactgtcataccccggcatcgcccacggttccggcgtcacataactgtccaccggggccgcagcctgaattccctggcagaaacggatcacaccctcagccgttccgaactcgaccgcctggatgatatcatgccgctcttccttcatggacggaatcacggaaaatcccagcttttcatagatacccgccgcaaaaatcgcacccttaaccgcacctttgacgaccgttggagccagaaaaagtccttggtaaaagtctttcattaccccaagagacgctcccacttccttgcccagtcccggtgaagtcagacggtaagcacagttttcaatcagatcctttcttcccgcaatatatccgccgatcggcgcaagcccgcctcccggatttttaatcagggaaccgacaaccagatccgcgcctacgtcgcttggctcctgaagctctacgaactcgccgtagcagttatccaccatgcaaatcacatccgggaaccgctctttcataaaacggatcacttctccgatctgctccacggaaaagctcggtcttgtctggtagcccttggaacgctggatggtcacaagctttgtgtcaggacgcaccgtcttttcgattgtctcaaagtcaaagctgccgtccgcaagaagatccacctgtcggtaactgattccgtattcttttaaagaacctttggacttacggattccgatcacttcttctaatgtgtcatacggcttaccggccacagaaatcatctcatcacctggccgcagattagcggcaagggcaagagcaagggcatgggttccacaagtgatctgcggacgcaccaaagcatcctccgtatgaaaaatataggcgtacaccttctccagcgtatccctcccgaaatcattgtatccgtaaccggacgcatactgaaagcactccgtattaacacgggctttctgcatagcgtgaacgacctttagctggttatactccgcaatctggtcgatggtttcaaatcgctcctttaaatccgtctcgatcttcattccgaactcgtagaccttccgtgaaatgcctgcctcctcgtaatgctgttttaatcgttcctctatgttatgattcatcttctatgattcctcttttcctcagattttcaagtaaaaacgccaggattctgtcttcctgataattaaaatcctgtttcggcacccagatcacatcccgctcccgcttaaaccacgtgatctggcgttttgcaaaatgtctcgtatcccgctttaagatccgcacggcttcttcaagcgtcgtctccccatcgagataagcgaggatttccttatatccgagccctttcatggaggtcatatttcggttgcatcccctggactttaacgcacgtacttcctccacaagcccgtcttccaacatctgatcgaccctggcgtcgatccgctcatacagcctgctccgttcatcgttcagaacaaaataggcggactgatacggcgactctttttttcgctcttcctcgttgtgcagcgaaatctttttcccggtaagatggtaaaattccagcgcccggatcacccgttttcgattattcggatggatctcgtttgccgcttcttcgtctacctcacggagtttctcatggagcgcctcctcaccgtaacggtccgcaaacaaggaaagctcccgtcggtagtccggatcttccctgctttccgtaaaatcaatatcatacaaaagtgcctgaatataaaatccggtccctccggccacaatcgggatcagtccattctcatagatctcctccatggcctgctttgcgagcttctggaaacgaacgacatggaactcttctgtcggttccagcacatcaatcaggtaatgcttcaccccgtccatctcctccggacggatcttggctgagccgatatccatatgccggtaaacctgcatggaatccgccgatatgatggctccgccgattttctttgcaagcccgatggaggcgtttgtctttcccaccgccgtcggacctgtcagtatgaccagtggtcgtttcatgtatcttcacccttctatacgattctcttaaatttcttttccagttcccgttttgtcatggcaatgatcgtcggtctcccatgcggacagtgatatggattatccagttttaaaagctccaaaagcagctcttctacttcctttctggacagtcttgaattccctttgaccgccgccttacaagacatggaagcgatcttctcatccagaatctccggtgtcatattcgtgctgatctcatcggacagactgtcaatcatttccagtaacagctcttttttcgccacactgaacaaattgtccggcaccgcacgtaccgcgaaggaatctcctccaaacggctcaatctcaaacccgatcttcgtgaaacggtccagataacggcgaaacaattccgcctcctgcatagacagatccaaaatgatcggtgggctgatatactgggacgtataatctcttgtcttcatcccctttaaggtccgctcatagagtactctttcgtgagccgcatgctgatcaatgatatacatgctgtcatggaactgcacgatccagtaggtatcaaacacctgaccgatgatcttgtagtccggcacggacgcctcatccagaagtttctcatcaaacaaggtaatctgttttgatttctgctgttctgccgtcaatttttcctgctgttccgttcgggtacggtaggagacagcttcccggatccggtcctgattgaatgacggtttatggatctctccccgctctttcacctccgcagaagcaaactgattatggtaagacgttacccgatcccgcatccgttccataaaataattcagatcccttttttctggtgttgtaaccgcgttttccactcctgctgaaacctctggtgcccccggtgtgacagctccggattgtacagagagatttgctgttttcggtgtcccggttgtatcggatgcttttgggatttccggtggctttggcgcttccggggcttccactcttggaatcagatcacgtccatgaagcgctcccgataccgtctcatagaggaactgatatacctcctgctgatgcccaaagcgcagttccatcttggtaggatggacattgacgtcaatttcttctcccagaatctccagatgcagtacgatgaacggatatttgtgctgcatggtgaaatccttataggcatcttcaacagcttttgacaaaatcccgctcttaatatacctgccattgacaaaaaaagtctcaaaattgcggtttccccttgtgaccgtcggattgccgataaacccggttatccggatctccccgttttcccgggaaacttcgatcagattggcggtgatctcccgcccataaacatggtaaatcacatcttttaatttcccgttcccggacgtatgcatccgttcttgtccgttgttaataaactggaaggaaatgtccgggcgagacaaggcaagccgtgtcatcaggtcacttacatggcttgcttccgtcatcggcgtctttaaaaatttccgccttgcaggaacattgtaaaataactggcgcacgagaaaggtggtcccgtctcttgcaccggtctcctccagagagacctctttcccaccggaaatctggtacgccgtcccgcaaacgctctcctcagtcttcgtgatcatctccacttgggatacagccgcaatactggacagcgcttccccgcggaaccctaaagaagaaatatgtgccaggtcgtccactttgcggattttacttgtggagtgacgtaggaaagcatttcttacgtcttcttgttccattccccctccgttgtctgcaatccgaatcagagaaatcccgccgtcctgaatctctacttcgaccgccgtggctttcgcgtcaatcgcgttttctaccagctctttcaccacggaagccggacgctccactacttcacccgcggcaatcttgtcgatcgtaacctgatctaaaacctgaatctttcccatggctcctccttaccagcgattgttcagcttattctgaagctgatacaatgtgttcattgcatccattggcgtcatgtggctgatatccatcgacttaagctcctcgatgacatcatgatccgacgctgtatcaaacagagagatctgcgccatatccaccacatcaagcttttgagatttctcttttcctttcatctcctggccctgtacgctcatctgacgcacccttgtagtaatatccgcgtcagaaagctcctcggaaatttccctggcacgagtaatgaccgtctcaggaactccggcaagtttcgccacctgaattccatagcttctgtccgctccgccctttacgatcttgcggagaaagacaatatcatctcccttttccttgacagcaatgcaatagttattgacactgtcaatctttccttccaactccgtgagctcatggtaatgggtcgcaaacaatgtttttgctcccagaagtcttgcgttgctgatatgctccactactgcccatgcaatagaaagcccgtcaaaggtactcgtcccccggccgatctcatccagaaccagaagacttttgctcgtagcgtttctgagaatgttcgccacctcggtcatctctaccataaatgtactctgacctgaggccaggtcatcggaggcgcctaccctcgtaaagatccggtccaccagaccgatatttgcctgggatgcaggcacaaaggaaccgatctgtgccatcagcacgatcaacgccgtctgccgcatataggtagactttcccgccatgttcggtccggtgatgatggatacccggtttttcctgtcatcaagatatgtatcattggcaataaacatgtggttgggaatcatcatctccacgaccgggtgacgtccgtccttgatatcgatcgtacccttttcgttaatcttcggacggacataatgatttcgctccgccaccaatgcaagagaagcaaaggcatccaccgcggcgactgcttttgccgtcgtctggatccgcacgatctcatccgcaatccggttcctcacatcacagtagagctcatattccagggcatagagtttgtcctccgcacccagtatcagatcttccagatcctttaactccggaataatataccgctctgcgtttgtcagcgtctgctttctggtatagtaatccggaaccatatttttaaaggaattggtgacctccagataatacccgaataccttattgtacttgatccgaagattcttgattccggtcttttcccgttctttctgctccagttcggcaagccaggtctttccatccgtctttgcctttctcagccggtctacctcctcatggtaaccgtcccggatgatccctccttctttcatggcaaacggaggttcctcaacaatcgcacgttccaccagatcgcagagatcttccagcggatcaatctcattgtacagatttttcagaaggggactcttcatatcccccatgatacagcggatatggggcagcatggcaagagatgccttaaaagctgtcaaatcccttgggttggccgactgataggagatctttcctaccagacgctccagatcgtagacggaggagagatactcccggatttcctctctggaaatcgactcctttaaaagctcttcaaccgcatccaaacgtttcgtaatttcttccttgtcaatcagtggctgctctacatacttacgcaacagtctggcccccatagctgttctggtcttatcaagcacccaaagaagcgaacctctcttctgcttttcccgaagagtctcacaaagctccagattccgcctcgtggaactgtccagcaccatatatttccctgtcgagtaagtcgtaagcttcgtcagatgggcaagggacgtcttctgtgtctcaatcagatactgaagcagggcgccggaagcgataactccacattcatagtctgccacgccaagactctcaagcgatgatacctgaaaatgttctctcagagccttcttacaaagatcctcatcaaaataccatgcgtccagagcagagatggcaaccggcatccggtttttcagatcctccaactggataccgctcacatagagcgcctcattacagataatctcagaaggcgcaaatttataaatctcatcgaacagctttgtggcactgtccgtctcagttacaaaataatctccggttgaaacgtccgcaatcgagacgccataccgtcccgcatcaaagacgattgacatgatgtactggtttttcgtctcatccatcgtcatagaatcgatattcgtccctggcgtcacaatccggatcacttcccgcttgacaatcccctttgcctgtttcgggtcttccacctgctcacaaatcgcaaccttgtatcctttctccaccaatctggacagatagctgtccaccgcatggtacggcacgccacacatcggcgcacgttcctcaaggccacaattttttccggtcagagtaatctccagttctttggaagcggtcagtgcatcatcaaaaaacatttcataaaaatccccaaggcgataaaataaaatgcagtccttatactctttctttgtttccatatattgctgcatcatcggtgttaattctgccactttgattctccttttctttagctgctttttctattttatcttttttacttcctgttttggtatttagggcgcttcaccctgatattacattatatcactattttccgggcaaaaaaaggaaaatttagatttcttttccttgctcattaccaaatcgggatccgcggtttctcttctccataaagaagatgcagcagatatccacccaaataaataccgatcgtacagagaaatccgaacaaagccatgaaaggcagacaaatctgtccaaagagctgaaacggaacattgctgtaatcccagacattcagattcagccatttgtttacaataattccggtaatgaattcacaggaagtaacaaatatcatacatcggataatctgaatacccaggggatcccgccatttacctgccctgccctgggcagtgcaaaacaccagacacaatcccccaaggacaaacatcgtccagtgggaaaacccccggaatacgatctcaaatgtatagtaaaggcagccgccgactgcccaaagaaataagtattcactcatttttttcatagaaaaacgtcctcacttttgtacatttccatacatagtgtggacgttatttctgtcattatgcatccggtgtgcccggtttatttttccactgcttctccgatataataaaatcctttacaagtcagaagcctcaccggaaccaacgctccaatcatttccttcgtacctggaaaatgtaccagcagattattgtccagccttccggtcacaagagacggatcctgatcgtttacttcctccacaagagcggtacggactgtactctcaaatctggcacattcttttgccgcaatggcctgtacttcctttaacagacggtcaaaacggtctttgaccacttcctgcggcacctgaccttccatcacggaagccggcgtacctgtccgtttagaatagataaacgtaaacgcactgtcgaagcgtactttccgcaccacatccagcgtctcctggaaatcctcctccgtctcctgaggaaatccaacaataatatctgtcgtaagggaaatatccggcacagcttttcggattttttccaccagttcgagatactgctctttcgtatatctgcggttcatctttttcaagatccgggtacttccggactgtaccggaagatgcaggtggtggcagatcttggacgaatctttcatcacagcgatgagatcatccgaaagatccttggggtgagacgtcataaaacgaagtctctccaggccatcgaccttttctatttcacgcaaaagctctgcgaaggtcatcggatcttccagagttttcccgtaagaattaacattttgtccaagaagcatcacttctttgacaccgtctgacacgagacgctcgacctcccggatgatatctttcgggttccggcttcgctcccgtccccggacatacggaacaatgcaataactacagaagttattgcagccaaacatgatattaacaccggatttgaacgaatatttccgatcactcggaagatcctccacaatccgatccgtatccttccagatatcaatcaccatccgtccggactcaaaacgggtggcaagcacctcggcaaacttataaatattatgggttccgaaaatcagatccacaaatcgataactttttttcaacttttctacaacatgcggctcctgcatcatacagccgcaaagtccaataagcatatgtggattcttccgcttcacacgattgagctgtcccaaacggccatacactcgctgattcgcgttttcccgcacagtacaggtattgtaaatgacaaaatccgctttttcttcctggtcgatcatctcgtatccgatctcctccagaattccggtcagtttctctgaatctcttgcgttcatctgacagccaaatgtcacaattttacaatacaatggccggcccagttcttcgctctcttgtttcacatactgttggcatttttttataaaatagtactgccgctgtggctctgtgaccggcgccacatccagatgctcgtactcttccagaattgtactccacttctcctgatcgatcattcttagctgctcactttccctaaatatagtataagatgtatttattttttatatttaacttccagtatttcattataccacatactgtcttggacaggcaatatgagtttttcttcatcaattccgtgttctttaaaagttgaattttacgaatatctaaccggatataccgtaagattttacggaaaagtagtataataacacaaatacggaggtgtgttcatggcggaagtagtattaatagtatttccaatatttataattgtagttatttctttattaatgtcaaaaaaatgggatatgtctgaaaaagttgataaaggaatcatggtatgttattggaaattaagttatagaagaaaatttattagaacattatggatgattcccatagcgattgttattattttttattttcatactacattccaatccatccttcagacatgcttagttgcaactctattggcaattatgctgcttattcaagcaatatataattatagaaaatggaaaaatgaaacctgcaagtagtgaaaatacatgaatagctaaaattcctatttgactattaaattggtatcacgatagaaggcctgtcgtattcctccaatagaggagcaagacgacaggcctttcgtttctataatcctgattcaaaatctggtcattcttttccggtcctacccagcgttgctggcagcgatcttcacacgactccaaagatcactgataatcttttttgtttctgcattgtatacaaaaacttcatcattttcattatctgtccgcgggatataggcattaattccttcatagtcgcctcccttcccggaaaggtcatccataacttcctgatttgacgaggtatatcctacataactggaattatcgtaagcgccgtcatagtcgcttgcataattgataaacgcatgggccagctccggattctttgcgttttttggaatcaccatcgcgtccgaccagaggttcgttccggtatccggcatatagtaccccatgtcctcgttttccgccatgacataacttgcgtcaccggaatagatcaggccaagcgcctttctcccctgcgccatattgtcgataatctcatccgtaacaatctcggtatccatagtttctacacatgttacaagccaatcatatgcctcattgagttccgcctggttttccgtattcatggaatacccaagcgcctttaaagccatcataaaggaatccctctcagagtcatacagatagacgtcccctttatatttctgatccaaaaatatattgtatccttctctttccagatctttcagatccactttcgtcttgtcgtagacgattcccaccgttccccagaaatacggaatggaataatcgttgtccggatcgtatggcagtcccagaacgtcctcagaaagcttatcgaaacaatccaacttggacttatccagtttctgtaaatagccctcttcaatcagacgctggatcatataatcactcggcacgagaatatcgtatgcttctccattcgccaccttgatatacatctgctcattcgagtcaaagttttccatgacaaccgttgctcccgtctcctcttcaaagtcttcgataatattttctccggtatattcgccccagttatagatatgaagcgtctgtccctcaaatgggcgatccgctccgccactactgtgttttaatgtcgccacaacaaccgctacaacacagcataccgcaagagccggaatgagtttatgtctgtggctcattgcattggtcttccggcttttctttgccgccagcacaggtaccagattaatcatcagaagtacgagcgtaatgatcaccacaacgagcgtagagactgcattgatacttgggttgacacgtttactcatagtatagactacaatacttaaatttttcacgcctcttcctgtgacgaaataagaaataataaaatcgtccactgacatagtaaaggcaatcagtgccccggaaagaatccccggtgtgatctggggtacgattactttcgtgagcgccttaaacggtgtagctcccaaatccatggcggcatccgccagattgggatccaaagaacggatcttcggcattacggaaagcatgacataaggaatacaaaaagcaatatgcgccaaaagcatcgtcacatatcctttttctattttaaaagtgataaacagcagcataaacccgattgcggttacaatctccggattcatcatcggaagattgttcacctgttccatgagattgcggatcactttcctggagctggacagtccgatggccgccacagttcccactacggtcgcaatcatggtggcaagtatcgcaatactaaatgtcgtatataaagctgtcatcatatcctgcgactccagcatgtgccgataccaacgcagggaaaaaccgctgaaactggtcagagattttccatcattaaaggaaaagacgatcatatagaggatcggcacatagaaaaacgcgatcatcagaaccatcagaacttttccaaagatacgatttttctttttcatgctttctccccctttccaccctgattccgagtttcaattctgcggacaagcatcatcaggagcatcataatcaccgccataatcatagaaatcgcgcttccgaaattccattctcccacagtgatgaactgattctcaatcatgtttccgatcaggaagtactgtccgcctcccagaagttttggaatgaaaaaggaactgaccgcgggcaggaataccaatgtaatcccattaatgactcccggcagagaaagcggaagcgttactctccgaaatgtctgtgccggactcgctcccaaatccgcacttgcctccagcaaggaaggatccatcttgctaagagacgtctggatttgcaaaatcataaatggcaggaaattgtacaccataccaagaagtaccgagccctctgtgtagagaagttctacatttccaaggccgaaaaatccgagaatacgctggatcattccgccttcactgagaagtccgatccaagcatatgtccgtaccagcatattgatccacattggaatcgtaatacaaagaatcaggatattctgtagcttttcccggcttctggcgataaagtaagccgccggataacctaaaatcaggcagatcaccgtcgtcttaaccgcaatgacaagagatcgccataaaatcaaaaggaaatccggatccgtaaaaaacttgacataatgatccagggtcagggagaaagaaactatactgtttcccggctccatgacagaatacatggcaatcaatgccatcggaagtatcagcatcagcgccgcccacacgatatagggaatcgccaattttgaaaatcgtttcatttaaaatacctccctggacataacatggatatcctccgggaaaaaggtaagccctacctcctgtccttcctcggtataatccgtggtgtgaattttaaactctcgtcctgtggtagagaaggtaatctggtagacaccctctttcacgttctccggctcaaaatcatagtcaacgctgagatcgacagcttcatcttcattactcagtttccatgcctgagcgcccgcccaagtcttcagatccgtatcgagtgcctgagattccgtgatctcatccacagtcttgaaaaaattaaacgccatgacaccttcgttcgctttctcatttttgacaaaaggctgatccactacatagatgctcttctcaatacttgtcccgttagatgtggagaaagtaaccggataccgtccctcttccttggaaagctcatactctaccttggcgatggagatgaattcatctgcgtccggatcccacgcctgggcgttggaaagggcgataatctccttatcgtccagctcttctacatcatcgatatccacataaaaatcgttggcactgatcatctccttgccatcctcacttttgatgtcgtgattacggatcactctcatattgacggttacacttgtccccggcactgtctccaccatgatttcatagtgaactcccttaaacaggacactgagtacttctcctgtcatctttcctgcgctgacatccacgatatcgatatcctccggacggattaccacatccacaggctctttttccttgaatccaaagtctacacagtcaaaggtaatatcatcaaaccggactttataatccgtaagcatcacacccggaataatattactctccccaatgaaattcgctacaaaccggtttgccggctcattataaatatcctggggtgttcccacctgctggatttctccgtttttcataaccacgatcttatccgacatggtaagagcctcttcctggtcatgggtgacaaagatgaaagtgatgccgacttcctgctggatccgcttgagctcgtactgcatttcttttctcagctttaaatccagggccgcaaggggttcgtcaaggagcaggacttttggctcattgacaagagctcttgcgatggcgacacgctgctgctgtcctccggaaagtaaagtggtatttttatcttcatatccttccaaaccgatcagcttgagcattttcatcactttctggtcaataatgtctttactcatcttcttgattttcagcccaaacgcaatattttcatacacacttaaatggggaaacaaggcatacttctggaataccgtattgagttccctttcataaggtggttttttactgatttcttctccgtcaaaaatcacggatccttcatccgcatccagaaatccgcccagaatcctcagaagcgtcgtcttcccgcagccacttggacccagaagcgtgacaaattcattttcaaaaatatccagattgattcctttcagaacgatctgcccgtcaaaacttttcacaatattgcgaaactcgatcagttttttctcttccatctcatttctccttcctagaataccggcggcgttgtgatccaaaggatctttgcatcgcctgcaccgtgattatacagataatggctttttgacccgtccatatagaatgtctcctgcgcctttaccttgtacttcctgcccccttcttgtacaatcgttacacttcccttgagtacatatccaaactcctgtccctgatatgaggaaatcacctgacttttccgatgggaatgaagcgtcagaataatcggctccatctggtttttctgagcattcgggacaatccactcaatcgtataatgttcctgctcgtctacgaaaaagtcctgtgtcggaaatacaatctgtgtctcttcctcttcccggaaaaaatcggacagattacttccgagagcctccagaatatcctctaaagtagcaatgctgggcgttgtctgcccacgctctacctgagagagaaatcctttcgtcagctcacttctggatgccagatcccgaagtgtcagatcattctgaagccgtagctccttgagtttctttccaatctccacctatcgcacctccggttttctattactatactttttgttaaaaatatgcgaactgagtttaattatacatgcctgccgacaaaatgcaacaggttttgattattttttgtcccatttgggtaacagttcagccatgtacaaagtcacaaaaatctgagttccaacttgtttgaaaacgaagatttttgtgtactttgtatatggcgctctaccatcagcgaggatgtagccacgtaagtggcgataaaagccgcatagcagctaatccgagctgttatggctgaactgttacccatttgactatgatgcctcctccaggattctaaggacaagatctgctgttcctacctgatagccgcttgacgcatagattacgttctgttctccccttgtcacagcaagaagaggaagcttttcgtgatccacatacagtcttcgtccgacagaaggtacatgctcctcaaaatcatcataaaacaccctgatatctgggaagagacgtaggattttctcaaagaggggatgctcccatgcttccttggatgaaagaaaaaacaggatacgggaagtccaatcctcaaatcgttcttgttcttggatcatctcattcaaaatatgttctgtcggttcttcccctgctttaagccacaaaagcacatgggctccgtcaccggtgagtacccgtgaagaacacttgtctccatcttctgtatggacctcaaactccggaagggataaggattccagcatttccatcaaattacttttcctggactgtaactgtacttccctatgttctcctggagtaagaaggaactgacaagccgctgcatgaacagttccgtttgggagtcgggtggccgtcatcagccggtaggtaccggattccagaaaaatctctttcttttgctttttccatccctcatccctcagacgaagaactttctgctctgttgctgatatcctggtgagactccagttctgagaataccgccatgttcctggttcctcggctctcaaaacaagcacacagtcttttcttctgttaggatctgccgccataaaccggccttgcttccaatactccggcgtcccgtccgcttcattaagccttgccgcaattccaaagcttcttgccatcgctacaaatagcactgcttttgatcttctgcttccacatcgtatcctaaaacaggcagccggtgttgtcaaaacagtactccgttcatgctccggacattcccggatctcctggcaaatccatgtccataaggattccggattgttccggaatcgctcctgcgcttcttttggcacctcatgttgaaaccaccttcggtaaggtgtcagaatctcgtcctcagcccttgggtttaacatatgttttataaatatctcttccggtaccgtacccgcataaagcatcgcaccactcaggtggtcttttaacacatccagccgaacgtctgtctggtcttttgctgtcaggatcttcagaagtgcccttcccatcctctgttctttctcactttttctcttttgttcgttcacaaatacatttctgtccggattttcccacgcttttcgctttctctcctgccgggtccgcaaggccgcaagtcttcttgctccttcctctttctgggcagcatccggtcgtctggccaccggagtccggtcagacggcggaatcatatcaaactcctgccaagagtattcttctatgtttctttgcagtgtcagcgttatacggctgtccctccttgtatccagaatctcttctgccgctttgtcctgccgtccacaatacagatgaaggcttcctgctccgcaggaaagccgcactttcccctccatgtctgtatggcagtttgcaatcggacggaacgcggcatagttgacaacttcaaaagaaaccgggagatccggaaccggccgtcccttttcgtctaaaacaaggacttccaacgcctgaactccatctgcgtacctgcgaatctcgttttccatggtcaccatgccctctgatccgatctcttcttcccgaagactctctggctcttctgtatcgtagttccacgctttcctctccccgtcaaaacgacgagcatgaatcagcatggctctggaagccgcatattcaaaccaccccagatccagaagcggttccggttcacacgctccaagataatgccagtttccgtccacccagacttccacccatgcatgattatcatcacagtgggaccaatacggcgcataaacctgacgggcggggatacccgcgcttcttaggacattgaccgcaaagacggactcctctccgcaccggccgtaccctcttttccagacggacagcgcagataatgtgcggtcatcccccgcttcataagccacctccccggcacaccagtaattgatttccagtaccgtttcaagaggtgatttcccccggatctgttcctgaatctgatgataaaagagtgatctgcacgggcggatctcttcctcgttgacccgatgaaataacacatattgcaggtaaacggattctgggagctcccgtacctcctctttttcctcatacagacgcacaccatgccgtacaaagtccaggtacgtctccaccggattgtttgcgatatcgctgtatggcataaacgcgtacagataccgcatggcaagagcttcttcctcaggaagtgtccggatcaccagctcaaccggatccaggatcgctcccaaatcttgtcttaccttctcatatgattctttaattctcattcggctgtgttctaaaaacatttgtttcttctcctttgcctcttcctataatcctgttctgtctgccgcctcatctcacagccgcttcaaaacttcccttgcccttctcaccgtctcaccggaggtgcggtaaatctcatattcactcagcttcgcaagccccatatggacattcctgtttcggtatgtcatggcgctttcgagcttctctttcgccgacatatggtaggcgcagattcccgtctggcggtaaagtgattcgattccttccggcgtgacgcccccgccggcctgaatacagatttccccctgactttcctgctgcagcgcggccagtaattttgttccctccatacaagtatttttctgtccggaggtcaaaattgtctgaatccccattgttttcgccaccgcaagaatctccatcggttccttgcacacgtcaaaggctcggtgaagggtcactgacatgccgccccgctcttccagaagcgcttccatccggtcccggtccagtattccgtccggcttcaacatcccaataacgatcccatcagctccccggtcacgaaacatcctgatctcctctttcataatcctccactcatagtctgtataacagaaatctccaaatcttgggcgaatcagtatatgaatgggaatatgtatctcctctcttactgcctcaaacagcttgattcccggtgttgtcccgccgatcataagattctggcaaagctccagcctcgtagccccgccccgctctgctctgccgccactgcggattccactgagtccacacagatttccaagataaacgactgcatttcaaccatttcctcctcacctgcgttcctgtacaggaacgaatctgggaacagtataccgcagttttgtcaaaaacgacagacttaacgggaaaagcggcgaaaaaaatacacgacgatccggacaagcccagaaagaagcagcactctccccatccttttggaactcatcatttcatagagccaggatccttttggaaaccgaacggccagaatccctatgagatcctccgcagatactggttggaaatcttcccggtcattggcatctcctttggtaataaatccttcttcttctcttcgtatgactctgtgtaacaccatctgtccgtttccattctcaaacgcaatcacatctcctgtctgaacgtcctcctcccgacagctttgaatgtagaccatatctccttcaacgatttccggcttcatagagccagacaacacacgaactggacggattccgaaaaaagtaggcatcacaaaaaacagcacaaaggaaagcgcgctcaaaaggagcagcgtatcaattcttcgaaaccatttatccatgccgtcgtctccgcctttttatcagaaggatacctgtcagtaaggcgcctcctgccatacatccataaagaattacatgactgttctccccggttttgaccgactcctgtcctgccggaaccgtagtatcctctgacactgcccgaaacgtccaggtaagtgtggactcccgcagacggtatgtattatccatgtcttccggaaaacggagaaagaatatgagattttctttctcattttgttcatacgtttcaaggaaagcaaattgccccaaggattgttccgaaggacttccttggcagagaaccgtaccatcttccttttccacccaaagttccgcctgttccagaagaagttcttcctctgtctccagcttccagtatacatcttccggccggccgctccggttatcgatctgaagttctccttggatgacatctcctggaaccagtgttccaaactctgcgaaaaacgtgtccggtactgttatgatgtcgtctccttccagcacgacccggcacgttcctttccggggtgtcaaaatccgaagctggtcgcccgttttcccggatactttctgaatgacctgatctccccatggatgctcagacgtaaaatccggcgtaaaatttcggctctgaatggcgtctgctgccacatgaatccggatctcatcctcccctccctgttcccaggtctctggtaaagtaaatgctgtaaaaagtctcaccgtttctctatgctttacgacatcggtatggtagaaatactcccctttgcgaacacagttaccgggaatcccggaaaaggacgagatcggaatctcccgattactttttgcttccgccgtcatctgataacggatcaggcaattctcacccagattttcaatctccgtgatcatcgtaattttctgtcccggcagaatatgttccagatcttcccaccccttttcttttttctcgtctccatagcgatgcatccggatccggacttctccggaacgaatcgtagtcgtcacttccccttcttgtactgccccggaggcagtcgtaccacacagcatccagcacaacaggacagctatgatacgtctttttcttttcttcaccttcccacctactttccaaagaaattgatctcgacatcattgtgactgaactcactatagttcgtcagcgtattgcagaaagtggcctttgccgtatcgtggtcttttgtatccaggataactttctctccctccacctctccattttccacttcccggataccggtcagcgcataacgggaaaccgggatttcccgcaccgtccacataccagcgggaatcttcattgtaaaagacttccgatagatctgtcccgtctgaaactgttccggcatctccagagattcgtagtaggtacgtctgaccccgttataatcagttcctgtaatctcaaacagaaaaaccggagtcccaaagtcctcccattttccggtcacttcttttgtgattgtcactaccggattcttttcgtatacaactttgatatggtgatctgcattgacttttgtaaaggaataatctaagagatgctgattcttatcaatcacttttcgatccactgtgatggatttcagatagtatcccgtcaatggggcataagaaatccgcatacttcctcctgcgggaactttcagattggaggcggtaatggagccattttcagcctccgttgtgatttgataatagaatgaagtccgtactgtttttgacttctttggtgaattttgatctaccgcaagagatgcctgattagaaacgatattagaggaaccgaatgtatagtcttctcgtttatgtacctgaatccgtatctcaaaggcgcgtccatacatccagtctgtcgatggatctctcaccgatacccgtacctgattgccggttccttctgacgtctgaatagaaaaataggaactgacatctgtctgattatccgcgtcatacactttgacctgatccacatgaagtggttctggaaccggatccgttagaatcagactttgataataatccgcctgctgacattccggtactttaaagttgataaaataggtgaatggttcttctccatgtacttcttcccgatccacaagcttcgtcggaaccggaggtgtaaaaggaccatatccttttgcggaaccggcgatccacccaatcagcgcccccatctgatctgatacatccgcacttggttctccgatcagataatgttcaaatcgctcataatcattcttgattttctcaggtacatattgactataggtaaaactgcccgggaaagcgactcctcctcctacccgcagggaaaaagaggatgtatttttatattggacttgtacactgtccttatcatattcctcggaattcacattctgggcataaaagtaataaaatccatcccgttcgatgtaatatgctctactgtcctgtggaacggaaattccaaccggatggtctccttttttcactccaaagatttgcccataatccaaatcttctgcccggtatgtcatatctacagcgaggggtctgccctgatcatccaagatctccagttttgcttcataccagatgtcgctaaacaaaagcccatagaagtctactgtctttgaaaacgcgactcccagaagaggatagtaccgtttcccctcttcagtgcgatacacatcccagtctgtaaaggtaatccgaagattggtattcttccctttatagctgcccatattagtcaaataacaggagattttccctttttgtgtatcgcttgtcacgatctgcccccaccgttccactccttgtcccgtctgctgaaaacgcttcggattagaaactccgcttgtatctgtccaagtacaggtacttctgtctgtccgcttcagccggaaggaataatctgagtcttcctcttccccgtatttctttaccgtgataggggacccctcttccctggaagcctcaagggcgctgacatgttccgctccctgtacgggaagcatttcaaaacagaccgccgccatgacggcggcaattcctgtgatccaccgttttactttcacgcttctgcctcctgttctcccttgatggaagcaaacgcttcccgggccgtgtcatatccctgtgcctgcactgtctcctcatagatcaagacgcgaaacgcgctctgtgtcccccctgtcgtcacatgggtaaacaaaggcttcgtctcttcccttccgccaaggatgctgcgatagtaatagtatccgtccgcctgcttttctgtccagttttttgtatcaaaatctatggaaaccggaagattgggctgatccacctccacaaacgccctcacatagcatggagtatgggaatcgtttttcaccgtcactttcttcggataaacaatatccgtcgtcacctgatccggcggttcgaattcctcctcaatatgcgatgtattatccccggttttcaggacattgttcttctcattctgatgggagaaataagccgatacatccagtacagccgcactccatgctgctgccatgagaatggacaaaagcagcacacagagattcctttttctctttttcatttgttatcctgcctcccacctatgaattttgtttcagatagatttgaaagacgtctgatggcgctttggattccccgatatgctccgcctggattgcataacttttcaccggaatattgagcgtctcatcgtcaatctgcccttccatcacattggccaaggtaacactgttaaaaagtgctcccgtcgtctcgcccttcttcaaaactttgcactcctgttcggttccataggcatagatatatcgatgggctgtcaccttaccggatgaactgacgtccgactcctgaatctgtacccagccgtcattgaccttgtaagtaaaaagctccgtgtctgctttaggaagtttcttcccatccgctcctacagtaatgatatttcgcaccgggatctgaacttccaggaaggcgtaggcatcatttgttccggtattggtgatcctcggatcctttttcactgtctgattcggagtcaggtcggtcttttcatcagaaggtactttgtcccagtccggctcctctagtccggttttgacgtttccgacagtcagtgtatttgtcttttcctgggcatctgtgaaataggcagaaatccctctgactgtggctgtcgcggcaacgacaagcaacacaatgatcatcacctgtttccctattctttttttcctcatacgttttcctccatgtcttgttttctggctgcatcatatgtgttcagtcaatcaaaggcctcaccccctccaaacatgaaattttttttaaatctggatctccgaaacggatcatgtttcggtctcgaatatagaaaatatagataaatagaacaatcagaacgggacaacgatctgcccctcttagaaatgtttaaagtatatcacgctctttctaaaaaagcaagaaaaaagactgcgctctttcacgcaatcttcttaaaatttcagacaaactgattttgtctttcgtcgtattcatatccgataccggacagcggcacgcaaatcgcatctttttcgatttccagatcgtcgcacagaacgtccagcgacgggtagaaatccctcagcttcatattgacgatgctaagaagcatcgccggatctttcggcaagtctgccatcttctctcacatccttttcctactcgtaacacttttggtccgtcacaatgattgcaggacggatatcatgcaatgcaaacggcacttcttccattacctgttcttcaaaacagacagcaagagtttgcatttggggatgctgttccagataccggtcgtagaatcctcctccgtaaccgatccggtgccttttcttatcaaacacagcccccggaagcaccatcaggaccttgtcatccgactggctttcgaagacagggcattcggcctttggctccctgatcccataagcaccactttcaaaatcttcccagatcttcacccggtaaaactccatctcctttccctcaaccctgggacagaagacttccttacccatctcccatcctgcctcgatcaacatcccggtctccacctcggaacgaaaattccggtaaattaaaattgaagacgcacgaagaaaacagctcatcttgcagacccgatctgtaatctccatgctcttctgtctccgtatttctgccggtatcctgtttctgatatcaagaaccttttttctgatttcctttttttccatacttttcaccaagattgataattgttccatctttttctttgatggaaatctgattaagctgtccccgtagattctcccggaacgcctcgatgtattcctggcgcagaatcttctgttctttcttctccgcttccgtcagcccttctgctttggacttatgataaagctcgttgattcttttgatcttttcttctttcatcctcttgtacctttcctaattaactggaataattctccagaaatccgtaaagtttttccaccgtccgtatctctttcccatcaaggatctcctgacggacgtcctccggcaaatcctccaccacaatattggtatactcataaatcgtctttttatctgacttatagacggcaataaagccattcagatctttcagataaaaaacttcctccttactgacgtccccttcagcggctatggcagcctcctcttccctggccgcctgcacaatttcctgttttaatctggcctcctctttcgcctgatttttggagtactcaaaactgaactggtaagccgccccgatcagggctacacatccgagaaaaagagcaaaaagcccgatactgtattttttcatagaagcacactcctttttcatacagtatctgctcttttttttaaattatacaagttttcccaaaagctgctcgaacggcaggccgtctctttcgtttcctgcttgccccgccttttcctgcagacaggccgccacaaagttatgtgcctgaaacgccgcttctttcaaggtcgccccttttagtattgctccggcaagcacagcgtcgaataaatcacctgtaccgtgggattggtacagaacttcggtctctgtgtattgctctacaaaaccgccctcaacaatcgccattccgatcctgtgctctcctacattcgttccggtgatgataccatttttcatccccatctcgcaaagccgggagacaatagcatgaagcccctcccccgtcatcccttcttcataaggaacaccgcttaataaagcagcctccgtcagattcggaagcaacagatccgcttcccccaaaagagcgcacaatgcttctctatagctgtcatcaaaattggaatagtacttcccatgatctcccataatcggatcacagattacaagaggcgccggccctgtctttaaaagctccaaaaccgtttctaccatcggaatatttcccagatatcctacaaacacgcagtcaaacgtgatgttctctctttgaaaatgccgcagactctctttcaaatagtttcccggcaccgggaggatctccggtttcccgaaacctccggtatgggtagataacagcatggtcggaagcggacagacttcaatccccattacgctgaggacgggaatcatattcatcatggccgcttttcctactgaacacaaatcgtggatcaataacattcgtttcatcaatcaccctctatttcagcaaatggactttctgtaacattctggcaatctttgctccttttggaagtgccaggatttctgcttctgtcaggccgccgatcgcgagcaggctgatcccatagacgcaaattccaactacaatggcactcaatgtcgcaatcgcgctgctgataaccagcgccaaaacaaattgtagcacaaagacaacaatgcccatgatcacagcagctactgccgggtagacaaaggttctcttcttctcctgcacatatccgaccgcctcccggagattgtgtgagttcaggatacacatggccagaccaaagattaccttacttgctactaccgcatagatactccagtggaagaataccagcatcacaaaaagcgcggcaatatgtatcacaagagatgtcgccgcgttttttactggagccatcatccggttgacaccctgcaacactgcattggtcagtgtggatgccgcatagaagatgatggaaatcgatccaatacggaagagatttgccgccaccgtgttatcgatggaaccccagatcagatccagcatcggctttggaatgacgaaaaacgcaaccgcgcttggtacggcaatgagcatcgtcacgcgcattgccatctcgatcttctgatgtacctgttccttgttctgcttctcataggcacgcacaagcggcggcacgatagacgaaccaagcgcgtttgccataaagagcggcacattaaacaatgtatagtactgtcccagacttccaagcaaagcggcacagtgcttttctgaaaatccctgtgcagacataatgctgctgaacatagcgctgtcaatgacattctgaatattgtaaacagtagaactcaaaataacaggtgcgatcgtcagaatcagtaccttgaaaataaaaccaaagctctcctgacgcgttgtcctgtccctgcggattctcttgttcagctttcctttgtacgcatagaaaatcagcacaagaaagaggagggcaatcaggcctccgataatgactcctaaagtcgctccggctgcggaaaaggccggtgcgtagagatcatttctctgatcggaactgacggtttttccgtactgaagcaggacatatgctccaatgatgctgacaatggcgtggatcacctgctccagaatctgggataccgcagttggaaccatcgatccctgcccttggaaaaatcctcgaagcacacccatcacagacacaatgacaagtcccggcgccagcacccgaagggcataggcactcatactcatcttcatcacgcctcccgcaagcaaatctgccccgaagaaaatgatcaggctgataccgcctccaacaacgatggcaaaaaggagcgccgccttaaagattcggtatgcgttcttttcctgatgcctggacagtctggccgaaaccagcttggagaccgcaagcggcatactgtaggatgtcagaatcaacgcgatactgtagatctgatacgccacctcataaaacccctgtccggtcgtccccataatgtttaaaagaggaatccggtagatcattcctatgattctggagatcattccggccgccgccagaattcctccctgcacaagaaactcatttccgtttttctttttacccataaaacacccctctattatcttttctcatttgcagtttggaacctggaaatccccaggcgctccagaatttcattttgcttcttttccatcacaagcctctcctgctcctccatatggtcataaccgagcagatgtagcatactgtgggcaatcaaaaaggcatactcccgaaggggggaatgtccgtattcctcagcctgggagattaccttttccttggagatcacgatatccccaagaagcgcttcgccgctttccggatgaaaacactctggctgattctccagaaaatcaaattctcccgccgtctcatattcaatcataggaaatgacagtacgtcagttggtctgtctatcccccgttgctcccggttcatctctcgaatcgcttcattgtccgtgagcaggatctcgacctgcgcttcataagggaattcctcataatcaagcgtctcctccacaacctgctctgccactttccggcagtcaaccggaagccggatttcagattcttcttctaaatatatcgtcatattaacctctgtatttcttactttttctcctggttccccgtctctggctttcctcttttttctcataattctcgtaagccttgacgatcttctgtacaagtgggtggcgcactacatccttgcttgtcaggtggcagatgctgatgccgtccagaccgtttactacccggaccgccacatccaggcccgacgtctgtcccgacggcaggtccttttgtgtctcatctcccgtgatgacgaccttcgatccaaagccaattcgtgtcaggaacatcttcatctgagccggggttgtattctgtgcctcatccagaatgatgaaagcattatccagggttcgccctctcatataagcaaggggcgccacctcaatgagccctttctccgaatttttcagaaagctttccgctcccataatctggtaaagggcatcatacagcggccgcaggtacggatcaatcttgctttgaagatcccccggaagaaatccgagcttttcccctgcctctatggccggacgcgtcagaataatccttgcgacctcattgtttttaaatgccgcgattgccatggccatagccagatatgtctttcctgtaccggcagggccgagtccaaagacaatcatgtcttttttcattgcgtccacatagcttttctgtcccagcgtctttgccttgacaggcttcccctgaaccgtataggcgatcacttctttatccatctccagaacatcgcccgcctcatcctccattgcaagcgagatgagatagtttacgttctgttcggtaatcacattccctctgcgggacagttccagaagcttttccagaatctcctgtgccctcttcgtcctgccctcttcccccatgatcttgatctcgccgttgcgctcgatcagtgtcacatggaacgtgcgctctatcttctttgcataggtgtccaactgaccgaatacattcgcttcatgctcagttggtatctgcattgttctctccaagattcccatgttctgtctttctttcctttccgcatgattccagaagaatcattgttccttttgctcttgcactttgcgtgtccttgtatattttaacatcattctcaagaatttgaacccctttttttcttaaatcctcacagaagcggtcaaattccaagctcaagatctcctgatattctttttttgagtacgtttttttcacttctcgatacgatacttcctcccggatcccaaaggaaaatggaaatggaaaacttaaggaaaaccctggacggatctccgaggaggatacttcccgtccttttccctcctcaactttctgccccagcgtgtattctttttgtgctgtccggaggaaaatctggcgttttttctgcttttcatattttttgaccgtataagataggtccaaaacatcctcatagttttcctttgtttttatcttgatgtcggcatccgcattcacatactgatagcctacaacctcctggctgtcgtttttgatctccacgcgtccggacacaagcaggtcccccgccttcacttcatcccccgcatgaaccataggaacgccggaccgggtcacaatctcctggatgacaccatccttttccgcaatgagatcgtttccctcctccactggattttcttcactgatttctctggaatcgctgttttccttgacgtcaatgtggatctggcttccttttagcgaagctgatacccagataatatcgtcgtattcttttcgaatcatccgggcaatcccggcacagtccaccgaagaggccatcattccgcaatgaacattctgttttcgcaaaaatgacagaatcgtctcatctgttcggacatagttgccgctgatttcgatattccagatgaaaagggaaaggatatatacgagagcgatgcatccaaaagcccccgcaaaaaaaatcttccttttacggtgccggaacaggaaaaaaggaagaccgtttttttcaagaattcgcagattcgtgccggtcttttttaaaatcggtttgagctttttcatgccggcaatcgtgatattcatatcataaaaattacggcccggtaacagtccccagaccggaatcttcctgtatttgcacagattcagaaatcgttcgggagaatatccggtaatccgtatccggacatatccctttatataccgcaggatccgtgtcagcaatatgcctcctcctttttttcaaactccaccttccagatcttcccggtaattttcatctcatcgttcatatagtattctatacacattcgttttccggtaatccggatcgttccggcttttgttttcacccggattaattcctgggtatattcctgaatcccccggtaattttctatggagacttcacactgtccggtcagatggatcaacggaagccccataatcacatcttttggtgcatttgccgtctctgcgatcctctgccggatcccgtctgcgcgcgtctcttcctgcctgttctggtttcttcgtctgctccccatctgtttaccgcacatcttgttttactggcaatatatgcaaagcttccgtttcctatacgttctcactttgtcctgtttcttttggctttctctcttttcctgtgaaggacagcacgtcaatgcagtatacatccgccgccttcaaaagtccttcatcaaacgtatgcttggcctccggcgccagatgttccataatcttttcaaatccatgcagcttttcaacggcttctgtcagtttccgaatcttcccggttcccatgacgctctgataagcaaaagaataagaacaggtatatgttcctctgatgacgcctccttcccggtccagttccaaggcgacaaccggttcgcgggaaaaagcgtccgctttccgaccctgtgacgcagaatgaaaatacaactttaaggatggtgcactgtcttttatatcctcccattcgtatccgtaattgaccggaacaataaacattccttccttatccatagctccaatccgcacaaccacacagtcgtcaatcagctcccgcagtgtctcctgatctttgatttcccgattttttaatctcatgcttctcatggcaatccccctctttttgtcattataaagatgctaaaaatgcaatcgctttgcgtattcctgcaatgtctccgttcgatagatctgccggatcttttcccgctcctcagggtgacaaagcgcacgataagtccaaaattctttcagtctcgagagtacgtgctgttcgtttccgatctctttctggtatgcgacatacagctcatactgaagatcttcccatgtcgccgtttttcccttcgttctccggattctggaaagtaataacggatctcccaggacgccccgcccaaacatgaccgccctgctttttggaaatgcataatcccacgcctcatattcttccagagtaaacagatccccattataacaaagtggcagactactcttctccctggcaaatcgatatatttcccaatgtaccgttccggtatagaattctttcgctgtacgtggatgaatgataagttcggaaatcggatatcggtcaaatacttccaaaagcgggccgaactcctccggatcctctaccccaatccgtgtttttatagaaatcctcatcctcgtcccggaaaagatcgtatccagaaacctttttagcttctccacatctcccagaaatccggcccccctgccctttgagacgacgcatcgagacgggcatcctagattaagattgacctcccggtatccgagttcttccagttgtcgggcaccatttaaaaactcctcctccttattcgtcagaatctgtggaatgacatgcagcccttcattgttctctggaagcacgtctcttcgctgccgcttagacaattttccgtttttatctggcgtcaaaaacggaataaaataagcatccatcggctcaaacaaacggtggtaggtattccggtagatataatccgtgatcccctccaggggagcaaaataaaacgttctgttttccatgttcttcgtaacagttcaactagaaatcatagcagtgaattctgagatgccatggatgaactgttaccatttccaccacctttcgttcttacttccatccgtacttctaaatcctttgtccatgacatagactgaaatcaacagtgacttcgggaatcaaacattatgaaacatcgtctcaacctaaaaaaagctgctcttttgctcttgctttttgtcgccgcttactgcgtaggaaccggaatcggtatcctgtttccttcaaattcttcgaaagaaacacaggaaacttctgcccaggcgtcggaaaactggggactgagttttccaaaagagggcgaacgccctatcggaaacgctgaaatttccgagctctccaccttgaatgccgcctactgccaggacacaaaagaaaaggtcatctatttaacctttgactgtggctacgaaaacggaaacagcggtcagattctggatgcactcaaaaagcataaggctccggctaccttttttattgtaggcacatttctgcgtgacaatccagagatcgtaaaacggatgataacagaagggcacactgtcggcaatcatacgtggcaccaccctgacatgtccgccatatccacggaagactctttccatgaggaactggaaagtgtagaaacactctttgagaagacaaccggaaagaaaatgagtccttactatcgtcctcctcaggggaaatttagcacgcgcaacctggaaatggcaaaaaatctaggatattacacctttttctggagtctcgcctatgtagactggtatgaaaacgaccagccgtccaaagaggaagcctttgaaaagctccttggccgaattcatcccggtgcgatagtactgctccacaacacctcatccaccaacgcacagattctggatgaactcctgacgaagtgggagcagatgggatatcatattgctccactatccaatctggtggaaacacagttttaagaagaaaggagggatatggtctgttcaaccgtatccctttcattttgacttttcattataacgcacctttgctccaattacaaatctttccccctctgaattctccctttttccagatttggttcaatccagtgtttctttgcataattccacaggacttcagatccttccgcagttctgtcatttcttttcaaaatctgatccagagaaaccccatgctccatccacgcttttccttcggtacatgcattgagaaataacggctggagattgtccatcgttcttgcgaatttagcctcaggcgtttcccctgcctcaaactccttccatagttccatcagaaaagtgccccggttctttgggagaagcccgaaaatccgatctgccgccttttgctcccgctccttttgtgtcttcttggcttcctcatcgtaagcgtatgtatcccccgcgtcaatctccacgatatcatggatcaaaagcatggaaatcgtccgaagcacatcgattttttcgttggcaaattcactgaaaagaaggaccatcaccgccatgtgccaagcatgttccgcatcattttcttttctcatcccgtctgtgagataggtctggcgacctatcaatttttccttatcaatctccttgataaacgcaaataactgagttaatgtttcctccattttcgcctctcctcatccagttctctttgatttgttatgtgtaccactttcgttttatattcgtccagaatccgttggtactctgcctttttctttctggttctcccgtcccgtaaaatccagagtacaaatcccagatccagcttttccggacatccttctgtcatagactcccttgttcttccccggtaccttcggctccgtgtccatgcccggtacaagcagaccagacgcggaaaatcgaggaaaagaatctgatccgcctcccgcatcctgcgttcatattccagactgtggtaattcccgtcaatgacccaggagtcatggctgtccaaaaaatctttcatcatctgttctttctcgtcttgaggccgctccttccatcccggcagccaatgtaccgtatcaagatacaaaagcggaagctgatttttcttggcaatccaagccgcaatcgttgactttccacagccactgtatccaatcactgctactttcatttctgttttttcccccccccctgttccactgtcattgtaatttcttccggcgcaaatctgctacttattttcccgcatcacacggcagggagccccgtatgcaatactgtcacttggtatatcttttgtaactacacttcctgcaccaatcacaacattgtcaccaattgtaactcccggcatcagaatcgctcctcctccgatccacacgttatcgccaataactactggagctgtctgtgttttacaaaattcaaatgaaccgtcctcttttgattctccaaaccggtcagacgcattggttggatgaaatgccgtatagatctgtacatttggcgctatcaacgcattgtttccaattcgtatctcattgtcatccaaaaatgtgcaattcatatttacttcacaattattaccaaaataaatattattgccatagtctacataaaatggagctgtaatccagagattagttcctcttcctcccaataactcgttaagaatccgttccttttcctgtaaatcagcagaatccgtatgattgtaatcccgcatcaaatcttttgctttatgccattgttccaacaattccgggtctccacaatcataaagatctcctgccaacattttttctctttctgtcataaaaacctcctgccaactttttattcttcttaataagactgcagtctcccataatacacagccgtatgattccccattgtcagtattccgtctctattatatttccggtacagattctttaatgcttccaaatattcctcaaacccgtcatctccctctttcagcgagtaggatccagataaacttctccgaataaaggtttcttccgtgtaagacaaagggtgatcaaatgaccggtattgatagtgtccttcaaaaaaggtctgtattctctcatcatcctttttcatcccaccgctaaatccttgaaaccgcggacaaaacgtacggtaaatcgcaaaggtctcttggttcagtttttcccccatatcccgcacattccagatcaggtacacccggccgtccggcttcaggatcctccgacattctttctgaaatgcagtgacatcgaaccaatggaaagcctgagccgatgtaacaacatccaccgcatgctctttcagtgtagtcttatttgctgttcctttgacagaacaaaaattttctccttttaggaaattctcttctgcttttttacgcatatcatcatttggctcaattccatacacaaaacagcccatctttaaaagctgcttcgcgaattttcctgtccctgatccaatatccgcaacaatcgtttcttctgaaaatccctgttccaaagccagccaccgcacaaactcctccgcataggccggccttcccgccacataatcatccgctcttccactgaacttctttaacgtatctttcatattagtttccctttccacccgactctgcgttttctttctccagtgtctttttaaaccggaagaaaaacaggcaggctgtaaacataacggcgatgacatccgcaatcggctccgccatataaactgcttttgcctgatcccctttcaaaagcattggcatcagatagatcagagggatcagcagtacaaactttctgacgactgctactgtgatagattccactgcatttccaagggcattaaaggtcatctgacaggcaatctgaataccgaagatgacacaggctgccatataaatccgaagcgctgtccttgtaaagatcatcaattccggatcggatgtaaacatggccgcaaacccctgcgggaacagcaaaatgagaagccataaaacggttgaatacgccagactggattgcaacagcaaccgaaaagtcctacgaacccgcttcatatttccggctccataattataactgataataggctgcgctccctgtccaagtccctgaaggggtagcatggcgaactgcatcacactggtaagaatcgtcattgccccgaccgcaatatccccaccatatttttgcaacgaagaattaaagcacacggaaatcacactctcgctggcctgcatgacaaaaaccgaaacgccaagcgccagacagggcaaaacaaccttgggagtgatcccgatattttttcttcggatttttaatgtcgttttcttcccgcagaggaaccatacgacccatatgcaggacatcgcctgagaaagaatcgtagccaaagccgcaccttgtacatccatgtcaaaaccaaaaataaagatcggatccagaataatgttggctactgcgccaatcaatacggagagcattcccgtcttagcaaatccctgtgcagtgataaatgaattcattcccagcgttacttccacaaataaggtgccgagcgcatagatactcatataccgtacgccatattctatcgtattttcacttgctccaaatgccatcagaaaatctcgattccagatcagcagggccacggtcagaatgacggaaatcaaaatctgaacggtaaaacagttgccaagaatcttttcagccgcttcattatctttacgccccatggcaatcgacgcccttggcgctcccccgtagccgacaagcgccgcaaaagctgagactatcaaaatcaacggcatacacacgcccactccggtcagtgcctttgctccaatctccggaatatgtccgatataaatcctgtctacaatattatataacatattaatcaactgtgctgcaactgttggaagtgccaatcttaatagtaatttcccgattggctcctttccaagaaattccttatcctcattcatgtttcttccttctttctccttttttattgctgacattttccaacattcgcgccctcatccgaagatacatttcatactcttcctccgaaaatcccccatacagaagacccagaaaggcttcctgggttttttgaatttcccgcgtcacaggaaatgcctcctttgtaagttttaagtgaatctttcgccggtccgtcggatctgctccccgttccagcatccctttctggatcagggcatctgctccctttgaaactgccgctttggacaacattctcagttcaacaatgtctgccgctgtatccttctgcggattgttttttaaaaacgcaatgatatcaacctctaccatagaaagccgatacccatcgcagacttctctcatcatcttttcataaagacgtaccatcctttgaattcccatccagaattcagtaaaattatacatgtcttcactcccttctgtttttatgcaagcaaatagttcactaagaaactgtttcttagtgaactattatacccttcttatttcttttgtcaagtgtacaattcggatacgatgtaaaccatttacaaatcacatccgctagattttctcaaaatctgccgcgccatgtttgcaaatcggacacacgaaatcagccggaagctcctctccttcatagatatatccacagatcctgcatctccagccggtctttttggtctgttgcggcttcggcttgatgttactctgatagtacgcgtaagtcgtggatggcgtctcagaaagcactgctccatcctctacatctgccaaaaacaaggtatgagtgccaagatccacagattgtatgactttagcagaaagccacgcattggttccctctgtcactacatacagtccattctccacacggaccgcctgtttaaaatcagcaaatttatccgtgtcttttccgctctggaatccgaaatgacggaaaagatcaaaagacgcctgttccgaaagaacagatacattaaactttccggttctttcaatcattccatgtgtgtagttttccttgttgactgcaagggaaatccggtttggcgtggatgtcacctgcatcaccgtattcgtaatacaaccattatccttttctgcctccttaaccgttactacaaacagcccataacttaatttgtacattgcttttttatccattctttttctcctttccaatcaactccgggtatttctgcataaataccgctgccgccccgatgaggttggcgtctttttggtaactgcatgtccttaccgcaggaataaccaccttcgtaccggcggtctcttcgaccgcttttgcaatcactataagacggcttttcacctgatctgcaaaatcttcccggctgctgattcctccgccaagcagaatgagctccggatcataaacatgctgaatattaaaaatcccctcagcaagtttcatgtagaagtcatcgaccgccttctgacagttgacgtcacctttttccgcctcctcaaagactttttttccgtcccattcctgagtcggataagcagccttcactctacggacaagagacatagtagacgcctggagtgaaaaagtactcagatttccttctcgatcccgcatgaccatgcaaccaaactcgccgccatatagattggcaccacagcagattttcccatctatcacgactgcgccgccgattccggtgccacaaacaacaaaagcaagattcttgtatcctcgagcatttccgaatgtcacttccgccatcgcggcacagtttgcatcattttcaatactggaaggcacttggaatctgcgtgtcagctcctctgtccaggaaagaccatgaatacacaaaaccgcgctcctgcctccaattacacctgaagatacattcactgcccccggtgcgctcatggcgatcccaatcatctcgcccgattcttttgccttgtttacatactttccgatctcctccagcaactgttcaatatcctgatgaatcggaaggatttcctgtgcaccaagtcctccttccatatcacagattcctgcttttattgatgtgcctccaatatcaatacacacaagtattcgtttcaacttctgctctccttctatcctttaaagaaaggtctggtaatcttcgtagtttcgtttcaaaagctccggtgtattcaaaccatacggacatttcttcatacagtttccgcaatgcaagcagtcttcaatcttcttcatcttctcctgccattcctcagatagccatgcttcttgtggagctcttctgagcatcagactcattctggcacagttgttaatctcaattcctgccggacaaggcatacagtatccacagccccggcagaattctcctgcaagctggtctttgtctttttgcatttctgtctttaattcctctgtaagctttggggacttatcctgataagataggaattcatccagttcccactctctttgtactccccagatcggttccacatgggaatattcaggctgacacataaacgcatatgctagggctgaattatgaataagccctcccgccagccctttcatcgcaataaatccggtattagtctctttacaaagtttcacaagctccttttcctcctctgatgccagataagaaaacgggaactgtaatgtctcataaagaccggataaaaccgattcctttgccactgcaattctgtgatttgtaataccgatatgacggattttcccctgctcttttgcttccagagccgcctcatataaccccgtgccatctcccggcttcggacaaaaggccggattgtggaactggtacagatcgatgtagtctgtctgaagctttgaaagactctcctccaagtctttccagaattccttcgcatcctgcgctgctgtctttgtactgatgatgacctgatctcgtacggccgcaagagccgcccccatcttctcttcactgtccgaataggctcttgcggtatcaaaataattgattccgttttcaaatgcttttttcagaagctttcctgccttctctttggagattctctgaatcggcagtgctccaaaaccatttttgttgacctgtaatccggttcttcccaatactacgtattccatcttcttcctccttcgttatcacgatgaaaactcgtgttcatgctttttaaaaaatttataatatgctttgatattttccagctccgtccaatgcttcacatccacaggatcttcatccaggtcgtaaatcttcgcccctttcatggataacacaaaaggcgagtgggtagaaatcacaaactggcatccgtaaaatctgacggaatcctcaataaaacgcaccaactcctgctgtctgacaggagacagactgttttccggctcatccagcaaaaataatgcctgctctgtaatcttttccgaaaaatacaaaaacgcactttctccgtttgagtactcccggatcgtatccatcagctcagaccgcacaaaccgggactgggttttgcttctggctttatttactttctttaatttctcatagtcatccaatgacctcatctgaaaatgtgaatactttgcatccagatattcctcaaaaagactctccttcttccggtcgattccctcattcatactgcgaatattcagcatataatcaaacacatcgtcgcttgtgataatccggctctcacctgggagcgggacgcgcgcttcaaagtcacaccgttccagataatcccagaagaaattggatctattaaacgcactgtcccgatcaagcccgagtttttccgcaatcacattgatggcagtcgtctttcccgtcccattgcctccgtacaaaatggtgaccggggcaaaatctatgcgtcggaaatggtgtctggaaagaatctgaaacggataaaaagaatcatagcaggtacgcttctgcctcataaaaaaatcaaattccacctcttcgtccggaaaggtaaaccagtccagatatatcatagcttttcctccttttccgacttctgctcgcttcaatacttatattgtagcactggtatcggatttttgctatctttttccgtgtttctgccacctgctcaccgaattaccggaagtgtcaaaaagcacatcccaggattgcgggcagtcgccaaggtttctggaaagcctggtctagctcgtcgccaatcgagtaggggagattttctctcccctctcacaccaccgtacatgccgttcggcatacggcggttcaacataacttataatacttcctcttttctctgtaagatgattatatcttattagccacttctgttacaactttattatagcacttcaccccgaccagttcgccctcattgtattttcctaagttggcaatgtaaatccgcatttcctccaagttcttccacctccttttagcggtaataaaagataccattgtccgtaaacaggtagttttcgctggtttccagttcccgaccaatggcagcgtagtcgatatggttcaacaggtctggatgtacttctccaaatagctgtacctcctgcaccagataacgggcgagggattccccgtcctgcaccggatagcagcgtatctggtctttgtggtcgataaattccgtaaagctgggaaaccaccgcttttgtaccacatccatttcataatagaggggcgttccctgcatttcctgtaccatccggcaaagggcgttgatttcccagagccttgtgttgccttccaatggaaagggcagctcatagtcttcaatttcgatttcttcctcactctgaaccccaagacgttccctgatttcttcaaaatccacagggcaggaaaaccatgctccaggatattcctcaaaatcttcatggtaaaaccgtgtggtgttcaggatgtagattctcattttctcaatcagtatcacgtcctttcttagaacaaaaaatggcaactaactttgtttgtcagttgccatttttctaataaaatattcgctttaattcttcatcactattgatttttttaattacccaaggttgtaaaaaataattgatttgtgggtctaacatacttactaaatgagtttgtccggcaggggttaatatttgtaaatgttgaagttctattactaatccattgttcatgggtaatggcagggtgtgagttggttcacgtaaaaactcccgaatgattgtcacctgttctggtgtcatatttttcaaatatttaatctgagcagttcctaatctcttagaagcatacttgtcataaaagaaatgaaaaattttagatagtaataaaacgattagtaaagctgtggaaatcacaaaaacaatgcctattgtaaaaccatatttttctcgaaaatttataatataaaacttttgggctaacttttgaggcaataataataatgtaccactggcaatagataaagctcctaaaatgttcggcggtaatttcaaaaaatcaataaaatctttcatacatttcctccactttcaattactattaaagaaattataccaccattcttagtttatctcaattatcatacactatcatattacatcttctttcttttggggagttacgctccccaagcccctagtggacttccgccatgaagcaatcagagcttgcgccataacggaagtgtaaaatggattccctatgctccgataatcttattgaacagttccagtaagatgtcctttacaccgtccgcattgaagaccagaccgaccgctacaagggacaccaccagaaaaccgataagtttggaaaattccctcttaaatccgaggtacagtccaatcaccacgattgccagcagcacaagggactgggcgttggataaaaaccagttgtaaagattctgtccgaaattcataaaagctcctttctttcctgtaagagttcttaggttctaaaattgccgccgttaaagcaccacctcctttgcagcggcggcttgctgcttcaggattttttcatgcttctccgtcagccttgcatgggtgatgatgtcatggacaatctgggtgtggttcatcttatccagacggagagccagctttaacgtgggggctacctgatgggagagccagtgcagggtgcgttcaaaggaatagggttccggtttggttgtcagtttcaggcttcccctgtgttccccgataaaccactcccattcttcactgatacgccagtcagaacggggcttcgtatcgtccctgtccacgaaccggacatagcggttgatgatttgaaaggctgtccgttctggattgtcatgttctaacaggtcacggatggcgtaaaaggcacgctcatttttcagccggatttcaaagcggttctttacctctgcgtccgcaataggaatatcgtgctttttgtactgctcatagtctttttcataaatgcagaagtacacctcactttggagggagccgatatacagggtgttccccatacattctttttcctcacgccgtaccagttcgccgctgcggtagcttttgaagctgcggaagaccgagatacattcctcattccggcacttctctgtcagatggggaatgttcaggattcccgttttgtcattgatggcaaggtcaagccgcttcatcacgccgtcctccatgagaacatccataaaaaactcataccagctccgttcctgtgccagcagatagctttcaaactggcggcagccacgccctttcagttccagcagcacccctttttccagttccggcgataccagaacgaaaatatcacctagatagtaatgctctgtgtaagaatagaagccgtagtcttcatggataaagtaaggcagctttagccgcagcacgtcttccacgatatgcttcacatccgtagtgggaaagcgaatccgcacataatcaaagagcatttcaaggggattgtctggattgaagcgttccagagctttcgtgatggtttcctgtaatgcttcggatgggtgagccttgcccgtttcaatatcgctcaggtacggacgggtgattccggcagctaacgcaagtttctgttgtgagataccgtaaacttcccgtttttctttgatgtccagtacccatgtttcttcattcagtgaaaatccctcctgtctaaaaaagcgtatgtcaactttcagagccttgttgacacacgccggatatgggaaaatcccttgtgtaccgtgggattctgccctgttgtttggttgttgcctgtcgatttgtacccctctgttagatacgaggggttcatgctggcgtgccttgcggcacaccagccacagcaggtcagtccgtttctgcggcttttgcttcgcacgccgcctgcactccctgcctgctgtctatgagcttttttatttccttgaggaaatcgtgtccttttggcacaaggggcgtataaaattccgagataacgctggttcccacatccacatagccacgcccttttatctgctttaggaagaactcctttgtggtttccccgaacatcatcccatagcccatttccgacatccgccccagagctacacggaaattgaactggtcacggattccatcccccagatactttgcgtctggacgctggcaggcgagaatcaggaagaagccagcctgccgcccaagcataacgatttgttttaacttgttgaggacagcggcgttttcctttgtgccgagcatttccataaatgccacatattcatcaaagataaggaaatttgccggaagtcccaagtaagcgtagttttctcctgtccggtaattctccatgagcttcatgtcttcgctgcgtttcatcatttcttcatagaaacggtcaatacaggcgagcatatcttcctttttgtagtacacatccggcataaccgcctgtaaatccgcaaggtcggcgttcttcgggtctaacacgaacaggacggcgttggtgcggagcagggcttcaatgagggtcaggatgaaataagtctttccgccgccggttcctccggcaatgagcatatgggggagcttatcatactcccaccagacattttccataagccggagcctgccgtcctttgcctgtacgtcctcaatagagatacggttcgcaatagtatcataaagcagggtgtactccacataggaatcttttaattccttatccgtcagctcacagtacaagccgctttccagctttttctccaagtttaagagctgttcctgatatttccccaaggtgatttccacacggatatggagcaagccctgtttcatctggtagtagattttgggaaagtaagtgatggtttctttggaacggctggaagataagtccttgaaaaaagcgtcctcctttcgctgttccgattcataccacttgttttccaataccatccttgccagcttttgacggtgaatgagctgctttacttcatccctgcggtatcgccagaacagaagaactgctgcaagacacaccagccctgccacgcccatactgaataacaggtaagggatgtttacatcctgtgttatctgggagagggacacttcctgccagttggttccggcaatctgccctgtatgaaacagcaggacaaccagcaggaagacagggaacagggcggcaagggcagtatggaatacaaggtctttatccgtgggacggatacgttttccacgagggaaaagctgcttcatgggaacaatcctcctttcgctttcttcttatattcctgttattttacagggggagcgtctttcttcggcggctgtggattcatggcagctccttttttcaggacaatatcctccgccttgatgtaccagtccacctctgctccctgaaaggtagccgttgccacggtatctgccacaggatggataatttccacctctgcgttgtaatcgaactcctttaatggcacgctggcagggatggaaacctgaatcatacgcccctgtcctctggattttaagtcataggtacgctccttgatttcttctgataccgagccgtcttcattctggaggtgaacctcacggcggagggcagaaaacttcaatgccccgaatgttgcttccttgtcaatcacgattccgtttgctaatctcatagtctgatgtcctccttttccttacgcttttaccatatcgtcagcgtgcaaaatgtagttggtgaagccccttgtgccgattttatagccctctgcggtgatacggggattgacgagcttcacacgttcctcaaagtcaaaatgtttctctccggcttcggcagggaggataaccacaatatcatctgccctctgtacgtctgaataaagattgaagctgcgggagagtaccgccatgcgtccgttgattcttctctgttctgttttgtcttctccggcaaactccaagttaccgaatgtcttttccatgttgggaataacgaattttaattccatatagatgtacctgtcctttctgaatgttgtgtttaatggttggcttcgggttatggtttggaagcgaaggggaacgctccggcggtggtgatttcttcgtggtatcacgtcctttctggttctgggataaaaaaatagacgcccagttttgaacgtctttgtataatggtagaaatatctacggtgattgcaaatagtatttttccatgttatcatatttgtagattaagcggtaaaatgataggagtgatgtgctttgaataatattaaagattacagggaaaatgaattaaaacaatatgtagttgcaacatcattactatttttacttcttcatggatttatagatttctccaatccacaaaatattgattatataaaaggaattgtttcttttataggaacttcaatattaacatctgtaatatatatttttacacttgttattgatggagttatggatgataaattgaaaaatgtaatagtcaatttatggtttatgaagctgccaggggaatatatatttaccgagataaaagctaagaataaggatattcgctttacaacagaggaagcattacaaagattttcagctatatatagtaatatacctacaaatgatagaaaaaaaagaatttatgaaaatagccaatggtataaaatatatagtaagcatagagaaaatccggtaatcttcatatcaaatagaaattacttacttatgagagatatgtatatatccacgtttgttatactaatgttgtatataatggcaagttttttgctgaaatggttttctatagaaacttcgtatatagtgtatttactaattgttttaatattgaccaatatagcaacacatattaaagcaaaacgctttgcctataatgtaatagctcttgagatagctgataaaaaggaggaaaaataaatgagtattattaagtctatatcagttggcaatggtgatatgttctatattaaacatggaagcagtaattttactattattgattgcaatatggatgatacaaataaacaaaaaataactgatgaaatcatatccgaatcaagtgataaggatataacccgttttatatctactcatcctgatgaagaccatattcacggtttaaagtatctagatgataaaattggaatccttaacttttactgtgtaaaaaatgaagcgactaaatctgatgaaacagatgattttaaaaaatattgtgaattaagagattctgataaaaaagctttctatatttatgaaggatgttcacgatgttggatgaaccaaaatgatgaagaaaagaaatatggttcatcaggaataaatatcttatggcctattactgataatgaggattataaggctgaattgcttaatgctaaggaggggaaaagtcctaataatatttctcctatcatcaagtattcgttaagtaatggtgtgacagttttatggtttggagatttggaaaattcttttatggagaaaataaaggatactgtcgagttaccaaaggccgatataatatttgcaccacatcatggaagaagtagtggtaaaatacctaaagaatggatggagagtattagccctaaaattgtaattataggagaagccccatcggaaaaaatcaactatttatctaactataatactattacccaaaatacagctggcgatataatactagattgcgaatccggtattgtagatatatatgtgtctaatgaaaattattctgtaaaattccttgaaaataataaaaaagcaaatgcttatggagctacatatatcgggacactaaatgtataaatagtattgtttattttatgaaagaaaaatagacgctcatttctgaacgtctatagaggaaagatattgaggtttgctggtttatactataaatctggatgtacttcgattgcatttttattgcattttttattttttttcatatagattttagtggttgatagttcctgaaaatgctttaaaatcaacgattttcacttatatggcatactgtctgtctggagttcgaataagttggagtatcgtaaaaagtcagtgtttatgcgggtttgcggcactttcaaaagtcttttgataacaaattgataacagttgcataagagccattattcttgtaatccggtggttttatggtagagaataattgacaggcggttgtgcaacaaataaatccatattataaactaagcccttagctgtgggtatgaaactcatggctaagggctttttgttgtgcttatttttagtcgatatcttcggaaagaatttttttaaaactctgaaagttatcgccaaattctttgtaaaactctcgttttgatataggtttctttgtggagagtttttcatataaggtgtatgcagcagttactaaagtcagtgtgttgaaatcggtgatttcattaattatttcttcagcgtgattagaaatcaatgttgtatcctccttacgctaatcaatgagtttatccttgaatgcttcaattaaagcgtcactaagttcctgtgatggtactttcgcccatcgctgtgtggtatcgaactttggatagtggtaacgccagttatcgtattcttccttactgatttcttcggaagataacttgtccgcctgttctttccaagcatagagcattttcagtagttcgtgagcgtctttccctttgtccttgttgactttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttgtccgcctgttctttccaagcatagagcattttcagtagttcgtgagcgtctttccctttgtccttgttgactttcagacagatttctccatctgcttcgctgacagtcagaccgtacagatcttcaagggtaaacaaggtgtgcattagtccgatatagctgtcaatgtcgggtacatcgagggcatgaggggaaacatcaagtgcctgtgccaatgcggcagtaagttccgctttcggctttcttgttcctgtttcatattgtgccaaacgtacatctgcacttcgctcaggaaagccgataatcgtaccaagatatttttgtgtcattccacgcagaaggcggaaaaaatgtattctctctccaatcgccataatcatcgctccttgtatatgtagtgtaatcagtatagcagatatgtttaggcgaagtcaagataatacaaaacaaaaaagtttaatattcttcccgaaaccacttgacacaaacaaatatgcttagtataatgggttcgaaattaaacaaataagtttagagaaagaggaggcaatctatggagaacaaatttattcgtgctgaagaagtagcacaggaactaagcgtatcaaagccttatgcctataagttaatccgacagctgaatgaagaactgaaagaaaaaggctttattacgattacagggcgtgtgaaccgccagtatttctatgaaaggctctacggagcaaggaaggaggaaaaataatgccggtatttaagaatgaggacaatggaacatggtatgtgatggcaaggtatgtgaactggaaaggcgagcgtaagcagaaatgcaaacgtggttttgctaccaagaaagaagcacaggaatgggagcggatgtttcagttacagaatgcgtctgaccttgatatgagctttgaagcgtttaccgaactgtatatccgagatgtgaaaacacgtctgaaggaaaacacatggctgacaaaggagcatatcatccgcacgaagatacttccgtatttcgggaggttaaggattagtgagatttccacaaaagagattatcacatggcagaatgaactgcttgcctatcgggatgagaagaaaaagccatactcacagacctatctaaaaacgctgcacaatcaactgtcagccatatttaatcatgcggtacgctactatgaactgcgttccaatcctgctgcaaaagtaggaaatatgggaagtgaggaacacaaggaaatgctgttctggacaaaagaagaatataagaaattctcttttgagatgatggataagccagtttccttctacgcttttgaaatgctctactggtgcggtatccaagaaggagaactgcttgctttgaccgtagccgatttcgattttgagaaagaaaccgtcagaatcaataaatcttatcagcggctacacggagaagatgtgattaccacaccgaaaacaaagaaaagcaaccgcattatcaaaatgccgaagtttctttgtgaggaaatgcaggaatatctgagtatgctttatggattgaagaagaaagaccgtatctttacagtcacaaaaagttatctccatcacgagatggacagaggggcaaatgccgcaggagtaaagcgtatccgcattcacgatctccgtcacagtcatatcagtttactgattgatatgggcttttcagcggtggcgattgcagaccgtgtggggcatgaaagcattgacatcacttaccagtacgctcatctgttcccatcaaaacaggtggaaatggcagatagattagatgatttagagaaaggagagattgcaaatgtcagctaagaacagggataacaaaaaccgttggagaaacattacggtaggatttcgggtatctcccgaagaaaacgaactcatcaacaaggcggttgccttatcgggattgccaaaacaggaatactgttaccgccgctgtctgaatcaggatgtagtggtacagggcaatccgagagtgtataaggcgctcaaactggaacttgctgctgttcttacagagttaaggcggattgaagtaggaaacagcgtggatgaggaactgatgaacgtaattgaattgattgccattattcttggcggtttgaaaggagaggatgagaatggagaataaaaaagaaaagactgcctttaatccatctgttggcgcagatgaaaggcagccaattcaaaaaatcgctgaaaatagtatatccgagtatgaggaaaatatcaagagttttgaagaaatgcagagagaaatgcagttgagtttagacccctcctatctcaaagcagtttccatgaatgagctgtttgacacccagtatcagagcaagccgccgttgatcgacagtctgctctaccccggcacatatatttttgcaggttctcccaaactgggaaagggtttcctgatggcacagcttgcctatcacatcagcacaggcacaccgctttggaattataccacccgaaaaggaacggtactgtatcttgcccttgaggatgattaccgccgcttacaggaacgtctgtatcggatgtttggaacagagagtgcggacaatcttttcttctctgtttctgccagtcagctagggaaagggctggatgaacagtttgcaaggtttgtggcagagcatacggacacgaaactgattatcattgatacacttcaaaaggtgcgtgaggtcggcggagataattacagctacgcaaacgattatcagattatggcaaggctgaaaagttttgcagacgtccacggtctttgtatcctgctcgtacaccacacaaggaaacagacggcggatgataaatttgatatgatttcgggaacaagcggactgctcggtgcagcggatggggcgtttctccttcagaaagaaaaacggacaggcaatgcagcaactttggaagtatcaggcagagatcagcaagatcaaaagctatatcttatccgcaacacagaaacgttattgtgggaactgcaaagggcagaaactgaactgtggaaggaaccgccagagcctttactggatgagattgacgaacttgttatgaaggataaatccttttgggaaggctcagcaacggaactggtttcgctgataaaggtagaaattcagccccatgtcatcacacgaaaactgaatattctttcagggcgattgtatgcagagcatggcatttattataagagtaaccgcactcacgatggaagaaaaatacggttttggaaagacgatacggaaacagcgtgacagttggtgacggttgtgacggtatttttgacagcggaggtggtagcgaaataaccgtcacaactgtcacataccgtcacggaaaggatgggatacgatgagaaatgtgcaaatatcacaggaattatttatgcagctgctccgctttcacttgatggaagatgagagttgcgagaaagaaatcaagcaggagttggagaaaaagttggacaggatggtcatgcgtgacctgtttggaaaatcaaaaactgcaccgacaaaggaagaacgggaacaggcaagaaaagaatatctggacaggcggggagtgccggagggtttccgttggtaattctttcttgatgataaggacaggggtgtgccacacccctgtgaataacagacaagacaggaagggagtgttgcagatgctaaagcagccggaaagaggaagcagaaatgtgaatgatttcttttatgagatggagggcagacagctacaaaaaatgaacaaggtactggcaggtgtggaactgacgaaagcagaggaaagaaccctgatatggcttgccggatgggaagaaagtaccgtagatcatctgctgtcagtcatagaaaaagcagcccggatacgggcagataaaaggggcggatacgcccataaatctaatcgtgagtccgagaagtaatcggattttgttaaacaaaaacaagccctcggcgtttgagagcgaaatacacccatcgcacaaacctgcggtttatactctgtgtatttcgctctgcgaggcttatgccggatacggcaatcggttcgtgaacaggtgcctatgcacctactcacaataaagttggcgagagccgaggaaggaggatgcctataggtagacattcatttatcagacaaagcaagctatctgatgtggcaggaaggattgactatatctccaatccgaaacgacaggaacatctctatgccacctatcagacagaaggggcaacacctgagttttggaaaaccttgcaagagaaaatcagttggattttaaggcgagcgggtcaactgggaaatgtatcgaagggcgtgagttcatcatagcacttcccgaaagttttgttcagtacagggcagatgatgtggtaagattttttacggagacttttcataaaggatatggtgtggagtgcagcgcagcccttcatcacaacaaggcaaagacgaattatcatattcatctggtattcagtgaacggaaaatgctggaacaactcgaagtgaaaatcgctacccgaaatatgttttatgatgagcaggggaagcatagacgcacaaagaaagaggttttagacgagcagagcaatcttcgggcggggtgcagtattatcccccaaggggaaatctatgaaagtcatatcttcacgaaaaaggatgaatggtttaaggacaaagcctttaccaaagaagttaaggaactgtttaccgatacgatcaaccgatatgtaaaagaagaatcagaaaaactatccgtattccaacaggccgcgtatatctggcaaccaagaaaatcggaaagaacaatccgaaagcagaggagataaaggcagataatgcggcaaggcaggaatggaatcggacagttgatgtggcattagtcgagggcgttcctgaagaagatattttgaagataaagcaggaaaaaattacagataaaacgctgcaatctatcaggacacacggttggctgccggatatgttccgtcagattatccgaggtgcgaaagactttttgcaggaagtaattttcaaatttaaactaccgccgaaacctgtaccaaagattgatttgcaggaatggaaagatatgcagaagctcatgtatgaattgcagagacagtccatggagataaaacgcacacagcaggatatttcttctttgaaaaagcaactgtcacagttacgaggactatttaaaggcaaagagcgaaaatctctggaagggcgaattgaactgttagaggatttggaaaagcgtctgcataagagtttggaacagatcgtaaagcgggaaggctatcccaatgtgcaagcctttcagaaggtttataacaaggcagaagaattgattatagaatacaacgaagaactaagggtatggaaaaatcagacggaacagaagaaagaaaaaccgttggagcagccgaaaaaagcgagtgtactggaaaagttgcaccgctatcagcaggaaggcagacagcagccgaaacggtcattcaagaaaaaatcaatggatagagaacgataagaaaggtggaaacgattatgaagaaaacaatatttgaagaaataggcggcacttatatcagacatggggattatcttattccctgtcttaccttgccggaggaagaacagaggtttatcggcgtatgggggaacacatagattattttcaaatggtaaagaaatattgtgatgagcagtaagaagatggaatttaagaaaattgttttaaatggatttatataaaaaatgtaaattttaatcttgaaaggaaaaatgaaacgtggtagtattaaattagaacatatgtttggtagaagtgtagaaagatgaataaaaaatataaagttataaactttttgttgcttggttatgagaagtaaggtaaacttaatgagagagtttgaaggaggtatagggaagtgttctgttatgataaattgtggaaaatgttaattgataaacatatgaataaagttgaacttagagatgcggcaggaattacttcagcaacactagctaaaatgggaaaaaatcaaaatgtaagtatgcaggtgttaggaaaaatctgtgaagtgttacaatgtaatattggtgatatattagattatgttggaaaaaaacaggaggaaaaataatggcagaaaataagttttatgattatgcaactggaaaagaagtaaaaagtaatccggaagaagcgtatagacaattatttgagcatattctaatagatgatttaggatatcccaaatcgcatattgatattgaagttgtgcttcagagaggagcgaagcgtaatgcggaagaagtagatatagttgtatacaatagcgatgtacataaacaagagaatgcatatattattattgaaatagaaacacctaagaaaaaatacgatttacaagcgttttcgtatgtgacagcaacaacagctccatattgtgtgtggtttgcaggttttgataagaatagtgaaggaccgttttataattatagagatttagcaacagatccaacgaagtttatgtctattcccacattgccacgttatggagaaactcaagatacaattggacaatataggaaacaagatttaaagcctgcaaaagctttaaaattattgttcagtcgtatgtattataagttatatggaaatggaccaattaaaagagaagaaaatatagcaatagaggttataaagctactattttgtaaaattatggacgaaattagccctgatgatttgtgcgaatttagagctacacccatagagctttcttcagaggaaggaaagaaagaggttaagaaaagaatagagctactttatgaaaaattattgaaagatccagattttggtactatgtttaagggggaaaaaattgaatatgatgctgagtgggtttcgtatatagttagtgaattacagggaattgcacttatgcatgaggaaactaatacagatgcattgggggatgcatatgaaattttattaccgtccacattaaagggggaaagtggacagttctttactccacgagagattgttagatttgcaatggacattataaatccatcatacaagaagaatgagcttgttctagatacagcatgtggatccggtggatttttatcaatagctattgaaaagcttagaaaacaaatagaagaattgtatcaaaacaggggattctcaaaagataaattgaattctatgttaaaggactatgcagataaatatatttttgggtgtgatattgatccattattatatcggatttcaaaatcatatatggcaattgttggagatggaaaaagtaatatttataattttgattctcttgagccctataataatttgaatgaaaattttaggaagcgtattaagcccggtactgtggatgtgataactaccaatccaccttttggtaccaaaattgatgatacgagggactatgtattagaacaatatgaacttggacataaattagtaaatggaattccaactaaaatgttagtagatggccaggatccagataaattatttgttgaaagggatattttgtatcttaaggatgctacagaaacagaagatggagggagaatggtaattgttctcccaaagcaaaatttgtcgggggctcaggaggagagcgttgaatttagaaaatggcttttaagtaaagtacagattacggcgattatcgatttgccacgagaaggatttcaaccgcatacaggtacgaaaacatcacttgtttttttgaaaaaagtgaagaatattccagaaaattatcctatatttatggcggtatctgaagcagtaggacatgatagaagaggaaatcctttatacaagaaagatgcatccggtatgaatttattagatgatgaagggaaagaagtgatttggaatgatttgccacaaatctatgaacaatgggtaaattatacattatcaggaactgtacaaaatgtacaaggggatcatatgccgagttgttttgtagtaaattcaaaacagatattagaagatgcatcaagaagaatagatgcttggtattgggatcctaataaaaataatttagcaaaagaattagaagaatctattggagaagaagtgctggaaattgtccggttaggtgatttagttgttgaacatggtattttttatcctggccgtcataaaagaaattatgtaacagccggcgaagaaagtgttccattttattctggaactcaaatattacaggtgcgcccatttgatttaaaatatacgcctaaggattataaaccagctgctaaacattatgttgagaaagattggattttgataactcgttcgggttctactggtagagtagttatggttactgatagtatggctggaacaatggtttcagagcatgttattagggttatttgcgatgaaacagtcatagatccatattatgtttatgcatatctttctactgataatattggaaaaatattgttggaaaaaggtatatatgcatcagttgtagatcatattactccggattttgtggcgactattcctattcctaggttgagaccagaaaaagaaaaagaaattgctgataaagttagaacagcagaaattaagagagatgaagcaaatagggtgttctggaatgaacgaaatgaaattgagaatatgatgtttggtagcattaagaaaaataacattagtgagtaacagttgctgaaataggcagtattgtgattgaatactgcctattaaacacatgttagagggagagtattaaatgatagaatactttatttcgtcaagtattaaatattcatatgaagatgaaaaatatttaaaaaacggagcagaacttttagatgaggacggcaaagatatagatgcggatttgtttaaacgccatatacaaaaggaaacagctaattttattcatcaaagctatagcaatataattgttttggttggtgcgggagcctctgttttatgtacgaataatgcgatagataaccgttttggaaagactgttgcaatgttggcagatttgattaatgctgagcttaagacagattctaaatattattctttacaagagttagctgatttttgcaaatatcctgtttcggttgaggttgaagagaatggtgtaggaaccaaattaaacccattatttaacttagaagattttttatcggatatactttcgtttgaaaagtatgtgccagatagtgattacgataaatatatcttgtcaaaaaacaaaatttttgaattgattgtgtctaatacaagttatgagtatgacaatacctatttaaaacattctgcttttataaatacagtatcgcatcttgttaaaacgcctagcaaactaacactggttactacaaattatgatacgttaattgaagatgcggctgatagtatagagtacacggtgatggatggttttacctttactcacagaccgcattttgacagtgatatgtttgaatggaatcttgtaaaggatatagaaaatataaagactagggaattggagtataagaaaaatatcatcaatttgcttaaattgcatgggtcgttaacgtgggaacgtaatgaaaaagggattttcagaaaggaaaagggtgaggttgctgaaccaattatgatttttccaagttctaataaatatatgcagagttaccaggaaccatatttcgaattatttacaaagttccaagaattattgaaaagaccaaataccttattaattactacaggatttagttttgccgataatcatatttcacaaatgataatacaggcaatattgcataataagagtttggcaacattaattacagatttcaatattacacagaacaatgaaaattggaaaaagatagaagatttgatgcaacataattataaaattgcttttctaaaagcaacgatgaatacggatttaacagactacttaggagaatattatgacgattgattctttgtatgacaaaatggataaaaataattattatataggaagaatttcacaggtgtatagagacaacagcattgcacaagtggaaaacctatcattattgtcacatagaaaaatttacaaagagtcattgattcctaatactattaattatttagtaattattgattctgttcgtgggatttttcttggagaagtgtttcaaacaaaggttgcatcttctgatagattgcacgattctataaactatggaaaaatagagacagtatttccagaaataaatatagacattatcggagttatgacacatcacgataagaaattcaggctaccagaatttatgacggtaggtgtttctgaaaaagtttatttggctaatcgggtggttcttcaaaagtatctagaatcaatcgaaacaacaaattcaacagaggcaaagatgcaatcgtttgcaacatatcttgatatgaatgaggaagaggtatcgttgaagccaagtacattatttgaccatcatttatttgtggtcggtgcaaccaatagcggaaagtccacatcagctttatcgatattggataaagttattattgccaataaaaagactttgattattgatccaacaggcgaatataaggattcatttcctgaacaaaaggtaaaaaagttaaatttaggaattgatacaactatttcaccgggaaaactttcaatgcaacaatggtctatgctttttgaaacaaatagcaatacccagagtgcagtattggcagaggcaatccactctctgcgttatcagcagaaaaaaggacaaagttcttgtttgacgaaagcgggacaaaatattgcgcaattacaacaacaattagccacagtgagtaaaacagatacagatttcgatatatcgcttttaccagagcagatagctgcagaatcaatatcagaatctagaagaggagatatttatgaatatgattcttttagagcaaatacaaatagttaccttgtccaaaaagtaacatatcagttgggaaataccaactttttgaattttattaatcataatttacaattaatgaatctcttggatgagattgattcgtttatacacacaccagacgtttgcttgtatataaacgcttcgactcttggagcttctgaaggaattggaggtatgattattgatctcatatgtaattatgtactttcacaaagtaatattattccatttgttttctttatagacgaggttcatagatatacgaaatcacaatattcagaagaagaatttcataagggcttaacgcttgtggctagagagggaagaaaaaaagggatttttctttttttaacatctcaaaatcctcaagatgtgtcccctgtactgttagggcaaattggaactatgctgatacaccgattgacgcataatgatgaaatcaaagcaattaaaaatcatttggatgagtattctgttaagcaggtgaaaaaactaaaccaaggtgagtctattttgacaagtattaatcttatgcaaaatatttttttacatataacaaaatgtaatcgaaaacaagataatgatacaccgatgctgtaaagagagggagagaaattttttagagtatgtcaaaaaagaattgttttcataagcaaaattgcttataatttactaaaagacatataggtattatccacagttacagagccagtgttatcaatgccgataacaaaatgataacattagcccgtataggcaggataatatggataaatcaaataatcaaaagaaatgcaaacatgacaacaaataatctctaaacaaaattgattagtgattgtcgaattcgagtagtaaatagggggccgggaagccgcataaacagcgggcttcccggctcttagtgtgtggcgtgatacctttttgatacctatataaggaatatttaccagttaagtaagtaagaaattattgtcagtaacataattaatataacaaaaatataaagtgcaatcatgagtttatcttttaaaaccatctgtattagtattttatttgactttttttgatacatttcaaactcatgagttattaatttgctttgactttcgagatcatgtatagttgaaaaagatggcttttttatagataaaacactattaatataatctctgtactttgaaagaagtatcgtaaggtttgtttctgttatgtttgagaataaaaactcatcttttgtggattttgcaattttcttaatttcatttaataaatcgtttaataaattatcttttgaaatccagtcgtcatcaggatgtgctgcataatattcattttttgttttatagcctttttggatcatttcgttttttattttttcatctgtatcataagacacttctaatacggcacgaataccccaaaatattccatctatataacctagcttacgaatcaataaattgaaggaatttatttgttcgtgataattaccctgtatcataaaaattctggaaacaattatacttgaaattattcctccaatgataccaagagataaattaaataaaatgttaaacattagttactgtcctttcctcatttagtttaaaattatttcacttttttcgccattgataatgattattttttttatcatttcctttttcatcaacattgctactggttgcaggccagttgattttccattcaaaatattcgtcttctgaaatctctccgttctttaactgctcttttcgcagacaccattcacgcaggaattcatttaccagaccataatcaatccacatacccacaggagcatgagtaggccattcgtcgctgtcattatatcggacagatttatcatcagaagcgttgcacttgccgggattacgcacaagctggaataaatgaaaggtgttgcgattatcttcgtcaagccagaagaatgtttgcataatgtcctcggcgcagccaggagcttcggtgataaaattaatatagtttacatttaatatcttagcaatttccatgagcgtgtcttttttaggaacacgataaccagactcatattgcgctacacgaacatcagcatttcgttcctcgtatcccagctttaagcctaattcgcgctgtgttaatccacgaaatgtacgtattcttttaatgcgttctcctaatatcataagtcatatcctctctgaaatctataaatcatatgtcataatccactcgtctccgatttcctttatgattctaaaacctattttttgttacagtttagctgcataattagctttttgaacggaaagtgaaacatgtttataactgtgtgcttgtagcagagacaacatttcttttattaaactgcgtccaattccttgtcctcgatattttttatacagagagattgcaagggaaggagtcttatcatcaatatgtccgtaatcattcataattcttacccagacagcaccaatgattttattctcgacttcagcaactaatgcaaaatcatcttttgacgatccgaaacccttaacataaacctgcagttcaggagcagtaataatactttttgaaggtggctctactccttctggaacaaaaatggcttcgtataaaaaatcgtccaataacggatactcctgtgctgtcattttccgtattgtatatttcataaagccctcctgtgaaaatggctatcctattttttatattttagcataactcaaatcatacgacaacagaaacttatcagaaatgctaaatttaataaaaaagataagcttaacaaatatgctattgacaataacaaaaacggtaagtataatacagatacgaaacttaacaaaaaagctaaacaagaaggatatctatttgaaaaatgatttatttgtaacagccggcgaagttgcacaggacttgggtgtttcaaaaccatttgcatacaaattggtgcggcaaatgaatgaagaactggcagcaaaaggatttattacaatcgctggaagagtaagcagaaaatactatgaagaaaaattttatggtatggcgcaggcaaattaagagggggaggttatggcggcgtacaaagatgaaaagcgtggaacatggtatgtatcgttccactattatgactggacaggaaaaaactgtcggaaagtgaaaagaggttttaagaccaaacgggaagcgatagaatgggaacatcattttcgtatgaaagaagcttctgatttggatatgacttttggcgagtttgtagaagcctacaccagagatatgaggccgaaactaaaacacaatacttggctgacaaaggagcatattctgcggacgaagttattgccatattttaaggacaagaaaatgcgtgacattcgtgcgacagatattatccaatggcagaatgaacagatttcttatcgagatgctaaaggaaaaccttatgcgcctacgtatctgaaaactctgcaatcagaattaagtgctctttttaatcatgcggtgcgtttctatgagctgaaaagcaatcccgttgtaaaggcggggccgctgggaaagggaaaagcggaggaaatgctgttctggacaaaagaggaatatctgaaattcattgaagcggtaaaggacaaaccatattcctatcatgcgtttcagatattgtactggtgcggtttacgggtgggcgaactgttagctctcacgccgcaggatattgattttgataacaaggtcattcggataacaaaatcttatcagcgattggagggcgaagatgtaattacagacccaaagacaccgaaaagcaaacggaatgtgagtatgccggatttcttatgtgaagaactgaaagattatatcggcagattgtacgggattcttcccacggaccgtatctttcatctgacaaaaagctttctgcaccatgaaatgacgagaggggcggagaaagcgggagtgaaacgcattagaatccatgatttgagacattctcatgtatcactgcttatcagcatgggattttcggcggtatcaatcggaaacagggtggggcatgaaagcgtggatattacttatcgctatgctcatatgttcccgacggagcagacacaaatggcaaaattgctgaatgaagaatttaaggagggcgcagaggaatgagcggcacacacaaatatccgacaatcagtttccgtatctctcccagagaacgggaagaaatcgaagcaaagattttcgcaagcggcatgaagaaaaaagattattttgtccgttcctgcatttataaccgggtgtgcgttgtaggcaagaaagaaacagtttatcagattgtggaacggttgcaggaaatggagaatcggctggtagaattggctgaacaaattgacagtaaagagccggggattacttccgaagaaatcagagatttgcaggaagcctatgaagatatgctgaaagcaattctctggatgttggacggcgcaaagtatctgtggcagggtaaagaaaaaagccctgacagcggcaactgttagggctgtgataactggaaaacctctgttatcaacaatcacaattcaagtatagcagaggtttcttccggtaacaacgaatttttcaaaaacggaggacattatggcaggaacgagaacagaattacagatgattaaaatgtcggagatacagtcgcaggaggtggcgtggctgtggtttccgtttatcccttatggaaagctgacgattgtacaaggcgatccgggggacggtaagacaacgcttgtgctgaacatagcggcgaagctgtcaaaaggcgagggtctggacagcaaaatgaaactgaaggagccgctgaatgtgatttaccagagtgcggaggacgggcttgcagatacggttaagccccgtttggaagcggcagaagcaaattgtgaaaatatttccgtcattgacgagagcataaaatcactttccatgatagatgaacgtctggaagaagcagtcataaggacaaaggcgaagctgctgattttagacccgatacaggcgtatctcggcggcggtatggatatgaacagggcaaatgaagcaagggatatgacaaagaagctggcggctctggcggagaaatatcaatgtgccattgtacttgtagggcacatgaacaaagcggctggaaataaggcggcataccggggcatgggttccattgatttctttgcggtggcaaggagcgtcctgctggtcggcagagtggagggcgaagcgaatataagggcggtagtccagataaaaaacaatctggcggcgtttggacacccgaaagcctttgagttgtcggaggacggttttcactggctcggagattatgagattaccgccgatgaagtgttgggcggtatcgctccgaaagcgaataagctggaacaggcgaagcgtctgctccgggaagtggcggaaacaaacaatgctatgcagagcaatgagattttcaatcttgcagaggaacagggtatatccagacggacgcttgaaaatgcgaaaaaggaattgggtatcagagcaaagcggataaacaattcgtggtattgggaactggataaaatcaagccggaataaggcaacagcgcaacaatgcagagtatatagaatttgtgggcttggtgtctgcaaggttgcaaaagatatagaccttgcgttgttgcggtcttgaaaaggagggcgaatatgatacgacagccggaatggggaacaagaaacgtgaacaaatatttttacgagagtgaagcccggaggattgccgcattcaatgaaatattcggagatgtggaattgactgcggcagaaatgcggacgctggtatggctgtgcggatgggaggaatgtacggtggaaaacgtactttcggctatccgaaaagctatggcggcggaagcaaagcggcgggaacagccgccccgtccgtaggacggaaaagccctcggcagagcgcaaaggcagctttggatggacggaacggctgtcgaaagtgcttttgcgttactttcggcgaaagtaacaaagcctatgcgctgtatccggcgctgattacccggaaagggagaaaggatattgattgaagcgaacaatcagctttatgacaggaaaaggttctgtcaaccataacagcagaaaattccatgcaaagaatacagacccggagagaagttatcttaacgtggaatattgtaacgagaatgttaagaacgtatatcacgaattatttgatgaagcactcgcccggtacaatgagaaacagaccagaagcgaccgccggattgaagattattatgagaaaatccgttccggcaagcaggagaagccattccatgaaattattttgcaaatcggggataaggacaacatgggggcaaagacagagaacgggcagcttgcggcaaaggtgctggataaatatatgcaggacttccagcagagaaaccctacgttaagggtattcagtgcctacctccatatggacgaagcttctccgcatcttcatatagattttgtaccgtatacgacaggaagcaaacgggggcttgatacaagagtatctttgaaacaggcgttagcggctcttggatttaaaggcggcacaagacgggaaacggaattaaatcagtgggtggcttatgagaaagaacaactcgccgctgtcatgctggaacatgggattgaatgggagaagaaaggcacgcatgagaagcatttatccgttctggattttgagaaaaaggaacgggcaaaggaagttgcagaactggagcaatctatttctgacggaaaagaacgattataagatattcagattcagcagaggaaagcagagcaggaaacagagcagatacgacaggagggggaagcagtccggcaggaagtatcagaactttcggaaataagtaatttgctgaaggagcaggcggcaacgctggcagaggacaaggaaaagctgctgtctgataatgagaaattggagaagcaacagaagaaattgcaacaggagattgagaaaatggttcagtctaaggcggtcatggaacggaatatacacgcctatggcgaggacgagaagtggcagttgcctgaaccgggagcgttgatgtctgcaaaggcttataaggataaaaaagcctctccacttgtggagaaattgaaagagacgataaaagcattgatgattaaatgcgtccagcttgcggaacaggggaagaaactgaaagataaagttacccggcaggaacagcagatcagccgcctgacagataaggtcatggagcagagtgacattattgaccgattgcaggagaaaacggcggatttggggcatttagagcgttattttggtagagaataggtgcagtcgatagttgagcggtctaaggctctggaacgggcggaacaagcaaaaaagcgcccaaaacgtgcatttgatatgagcagatagggggaatgatagagtgaccgatatggagaaaaaagtcatggttcggctgtgtgcgaaaattctttcagaaacagatttgtatgatacggatatggaagtgcgcaatctgattgactggatatgtgtgtcggagcagataaaatcaaacaataatgagatacgcagtctgacaggggaatataaacggatagaaccagattgccgggagggagtgaaggcgcagttggaacggatgaaatcactctgtaaagaacgtgacagcttgtatgagaagcagaatgatttgagaggacagaaatagaaaatagagagagcgttggaacagtaggaatttggggcatggcggtggctgtgccccttatttcttgtggcaaaattgctgataatatgctaaaatcaaagagcagagataaaaacacaacgtaagggataacatctcttatagagccggtaggtagtccgaccgcaccgctttggtgtaagtaaccctccctccttgggtcgtccattctttgttcagtacaatttttaaggaggaattgtcatggacaaagtatcgggcagattgacagtattttttgaggaaccattctggataggcgtgtttgaacgcatatcggagggaaagctatctgtatgcaaggttacgtttggggcggagccgaaagattacgagatatatgagtttgttctgaaaaattactatcgactgaaatttagtccagctgtggcaactgatgtaaaggaagcagttcgcaatccgaaacgggtacagagggaagtgcggaaacaggtacagaacactgggataggaacgaagtcgcaacaggctttgaaattacagcaggagcagttgaaaactgaacgtaaagtagtgagccgaaaacaacgggaagcagagaaacagcggcagtttgaactgaaacagcagaaaaggaaagagaagcataggggcaggtaacacctgcccttggcattttgatgaaaaaaggagaagaaatttagaatgcctaaaaatattttattgtatgatttgcttatatcatgtcctggtgatattaaaagtgaaattgaagttatagaagaagttgttgaggaatttaaccaacaatttgctactacattaggaattagtattcgtacccgccattggagcaaaagtgcatatgcacagtcaggtgggaaaccgcaagaactactgaataaacagtttattgataattgtgatgcggcggttgctttgttttggacaagatttggaacaccgacagataaatatggctcaggatcggaagaagaaatagaaaatatgataagcaatggaaaacaagtttttgtttatttttccgaaaaacaagtaaatttatctgaatgcgatttcgatcaatatcaaaaagtaaaagattttaaggataaatataaatcaaagggattgttttattgctataactcggatgaggaattgagaaagttattttatgcacatttgtctcagtattttttaacgttaaaacaaataacaaccttagtggaacaaagaagttctaagttgcttttgaaggctatttgtaatggggagattaaagattctgctgaagttgttaattttgattttaatggtattgaaaatcgtgaggaaaggcttaatagaataaggaaattatttggagaaattttgaagagcccagtgaaaaaatgcaggagtgaatataatacatctttaggttataaagatgtagaaatttcggaagaaaaagtggaattaatctcaaaagtcgctgagtcccttgaaatagaattaaacgagagcttttttgcattaggaatgttgcgagaaaacatgtttaacaatttggcagtgttaggaggaggacgtagcttagaaggcaaggaggaagaaaaagaaaagtataataatattttgcggttatatgatacgatttgtagttttagtaattggtgttctgtcgaagaatgttttggaggaatgaaagctattaaattgtgtttaactaatgagggaactatgtatgatgaagatatagacattgaattatatctgcctaacaatatgtttttgtcacatagagaatttagaattcctaaagaaggaaccctttctaacttagaagaggataattcactaaatgatttatttgaaataaaaggaacagagtcatatatagattatgaatcttcttgtaaaccatttaatcaagtatatgttcctgatacaccctctgtttttccttttggagggcgtgattatgaagaagaatataggaacgacctagatgatattttttgctataaaatatatgaaaagggaaacgagattattgtaaaattacatatagactatattaaacaacacagtgctgttgcttttccaacgccattatttttaaaagatatcaatgtgtataatgatattcgatacaaaataatttcaaaaaataatgccaatgttatttcggggaatttgcaagttaagactcataaaatgccaaatgttgaactttaattacatggtgctagcaccatgtagatagggcgcttaaaaaagaaatatttgtgatacccgtatgatacctgtttggatggaaactgtgaataaggtgtgtaaattggatattatgaataccaaaataaacaaaaaaggcattaatatttaacgattatgttatagttgcagggagttcgaataagttggagtgttgaagaaacccagtatttatgcgagtttgcggcactccaagaagtcttttgataacaaattgataacagttgcacaagagccattattcttgtaatccagtggttttatggttagagaatgattgacaggcggttgtgcaacaaggcgttcagagccatactcggaaatattgcatatttcctcgttgtggcgtatccgccaaatgaatgtatgcaaatatatgtttatgagtgcaagcactcaacgcatatattcgcaacattcgcttggctctgaacgaatccatattataaacgaagcccttagctgtgggtataaaactcatggctaagggctttttgtcgtctttatttatcaggtttgagttggtctttgaacatttcaaccaaagcgtcactaagttcctgtgagggtactttcgcccatctctgtgtggtatcgaacttcggatagtggtaacgccagttatcgtattcttccctgctgatttcttcagaagatagtttgtccgcctgttctttccaagcatagagcattttcagtagttcgtgagcgtctttccctttgtccttgttgactttcagacagatttctccatctgcttcgctgacagtcagaccgtacagatcttcaagggtaaacaaggtgtgcattagtccgatatagctgtcaatgtcgggtacatcgagggcatgaggggaaacatcaagtgcctgtgccaatgcggcagtaagttccgctttcggctttcttgttcctgtttcatattgtgccaaacgtacatctgcacttcgctcaggaaagccgataatcgtaccaagatatttttgtgtcattccacgcagaaggcggaaaaaatgtattctctctccaatcgccataatcatcgctccttgtatatgtagtgtaatcagtatagcagatatgtttaggcgaagtcaagataatacaaaacaaaaaagtttaatattcttcccgaaaccacttgacacaaacaaatatgcttagtataatgggttcgaaattaaacaaataagtttagagaaagaggaggcaatctatggagaacaaatttattcgtgctgaagaagtagcacaggaactaagcgtatcaaagccttatgcctataagttaatccgacagctgaatgaagaactgaaagaaaaaggctttattacgattacagggcgtgtgaaccgccagtatttctatgaaaggctctacggagcaaggaaggaggaaaaataatgccggtatttaagaatgaggacaatggaacatggtatgtgatggcaaggtatgtgaactggaaaggcgagcgtaagcagaaatgcaaacgtggttttgctaccaagaaagaagcacaggaatgggagcggatgtttcagttacagaatgcgtctgaccttgatatgagctttgaagcgtttaccgaactgtatatccgagatgtgaaaacacgtctgaaggaaaacacatggctgacaaaggagcatatcatccgcacgaagatacttccgtatttcgggaggttaaggattagtgagatttccacaaaagagattatcacatggcagaatgaactgcttgcctatcgggatgagaagaaaaagccatactcacagacctatctaaaaacgctgcacaatcaactgtcagccatatttaatcatgcggtacgctactatgaactgcgttccaatcctgctgcaaaagtaggaaatatgggaagtgaggaacacaaggaaatgctgttctggacaaaagaagaatataagaaattctcttttgagatgatggataagccagtttccttctacgcttttgaaatgctctactggtgcggtatccaagaaggagaactgcttgctttgaccgtagccgatttcgattttgagaaagaaaccgtcagaatcaataaatcttatcagcggctacacggagaagatgtgattaccacaccgaaaacaaagaaaagcaaccgcattatcaaaatgccgaagtttctttgtgaggaaatgcaggaatatctgagtatgctttatggattgaagaagaaagaccgtatctttacagtcacaaaaagttatctccatcacgagatggacagaggggcaaatgccgcaggagtaaagcgtatccgcattcacgatctccgtcacagtcatatcagtttactgattgatatgggcttttcagcggtggcgattgcagaccgtgtggggcatgaaagcattgacatcacttaccagtacgctcatctgttcccatcaaaacaggtggaaatggcagatagattagatgatttagagaaaggagagattgcaaatgtcagctaagaacagggataacaaaaaccgttggagaaacattacggtaggatttcgggtatctcccgaagaaaacgaactcatcaacaaggcggttgccttatcgggattgccaaaacaggaatactgttaccgccgctgtctgaatcaggatgtagtggtacagggcaatccgagagtgtataaggcgctcaaactggaacttgctgctgttcttacagagttaaggcggattgaagtaggaaacagcgtggatgaggaactgatgaacgtaattgaattgattgccattattcttggcggtttgaaaggagaggatgagaatggagaataaaaaagaaaagactgcctttaatccatctgttggcgcagatgaaaggcagccaattcaaaaaatcgctgaaaatagtatatccgagtatgaggaaaatatcaagagttttgaagaaatgcagagagaaatgcagttgagtttagacccctcctatctcaaagcagtttccatgaatgagctgtttgacacccagtatcagagcaagccgccgttgatcgacagtctgctctaccccggcacatatatttttgcaggttctcccaaactgggaaagggtttcctgatggcacagcttgcctatcacatcagcacaggcacaccgctttggaattataccacccgaaaaggaacggtactgtatcttgcccttgaggatgattaccgccgcttacaggaacgtctgtatcggatgtttggaacagagagtgcggacaatcttttcttctctgtttctgccagtcagctagggaaagggctggatgaacagtttgcaaggtttgtggcagagcatacggacacgaaactgattatcattgatacacttcaaaaggtgcgtgaggtcggcggagataattacagctacgcaaacgattatcagattatggcaaggctgaaaagttttgcagacgtccacggtctttgtatcctgctcgtacaccacacaaggaaacagacggcggatgataaatttgatatgatttcgggaacaagcggactgctcggtgcagcggatggggcgtttctccttcagaaagaaaaacggacaggcaatgcagcaactttggaagtatcaggcagagatcagcaagatcaaaagctatatcttatccgcaacacagaaacgttattgtgggaactgcaaagggcagaaactgaactgtggaaggaaccgccagagcctttactggatgagattgacgaacttgttatgaaggataaatccttttgggaaggctcagcaacggaactggtttcgctgataaaggtagaaattcagccccatgtcatcacacgaaaactgaatattctttcagggcgattgtatgcagagcatggcatttattataagagtaaccgcactcacgatggaagaaaaatacggttttggaaagacgatacggaaacagcgtgacagttggtgacggttgtgacggtatttttgacagcggaggtggtagcgaaataaccgtcacaactgtcacataccgtcacggaaaggatgggatacgatgagaaatgtgcaaatatcacaggaattatttatgcagctgctccgctttcacttgatggaagatgagagttgcgagaaagaaatcaagcaggagttggagaaaaagttggacaggatggtcatgcgtgacctgtttggaaaatcaaaaactgcaccgacaaaggaagaacgggaacaggcaagaaaagaatatctggacaggcggggagtgccggagggtttccgttggtaattctttcttgatgataaggacaggggtgtgccacacccctgtgaataacagacaagacaggaagggagtgttgcagatgctaaagcagccggaaagaggaagcagaaatgtgaatgatttcttttatgagatggagggcagacagctacaaaaaatgaacaaggtactggcaggtgtggaactgacgaaagcagaggaaagaaccctgatatggcttgccggatgggaagaaagtaccgtagatcatctgctgtcagtcatagaaaaagcagcccggatacgggcagataaaaggggcggatacgcccataaatctaatcgtgagtccgagaagtaatcggattttgttaaacaaaaacaagccctcggcgtttgagagcgaaatacacccatcgcacaaacctgcggtttatactctgtgtatttcgctctgcgaggcttatgccggatacggcaatcggttcgtgaacaggtgcctatgcacctactcacaataaagttggcgagagccgaggaaggaggatgcctataggtagacattcatttatcagacaaagcaagctatctgatgtggcaggaaggattgactatatctccaatccgaaacgacaggaacatctctatgccacctatcagacagaaggggcaacacctgagttttggaaaaccttgcaagagaaaatcagttggattttaaggcgagcgggtcaactgggaaatgtatcgaagggcgtgagttcatcatagcacttcccgaaagttttgttcagtacagggcagatgatgtggtaagattttttacggagacttttcataaaggatatggtgtggagtgcagcgcagcccttcatcacaacaaggcaaagacgaattatcatattcatctggtattcagtgaacggaaaatgctggaacaactcgaagtgaaaatcgctacccgaaatatgttttatgatgagcaggggaagcatagacgcacaaagaaagaggttttagacgagcagagcaatcttcgggcggggtgcagtattatcccccaaggggaaatctatgaaagtcatatcttcacgaaaaaggatgaatggtttaaggacaaagcctttaccaaagaagttaaggaactgtttaccgatacgatcaaccgatatgtaaaagaagaatcagaaaaactatccgtattccaacaggccgcgtatatctggcaaccaagaaaatcggaaagaacaatccgaaagcagaggagataaaggcagacaatgcggcaaggcaggaatggaatcggacagttgatgtggcattagtcgagggcgttcccgaagaagatattttgaagatcaagcaggaaaaaatcacagacaaaacgctgcaatctatcaggacacacggttggttaccggagatgtttcgtcagattatccgaggtgcgaaagactttttacaggaagtaattttcaaatttaagctgccaccaagacctgtgccaaagattgacttgcaggagtggaaagatatgcagaagctcatgtatgaattgcagagacagtccatggaaataaaacgcacacagcaggatatttcttctttgaaaaagcaactgtcagagttacgaggactatttaaaggcaaagagtgaaaatctctgggagggcgaattgaactgttagaggatttggaaaagcgtttgcacaagagtttggaacagattgtaaaacgtgaaggctatccaaatgtgcaagcctttcagaaggtttataacaaggcagaagaactgattatagaatacaatgaagaactaagggcatggaaaaatcagacggaacagaagaaagagaaatcgttggaacagccgaaaaaagcgagtgtactggaaaagctgcgccgctatcagcaggaaggcaggcagcaaccaaaacggtcagttaagaaaaaatctatggatagagaacgataagaaaggtggaaaagacaatgaagaaaacaatatttgaagaaatgggtggtacttatatcagacacggggattatcttatcccctgtcttaccttgccggaggaagaaggacagaggtttataggcgtatggggacaaagacatttacgttatctgaaagaatatcgtagggtgtatatttgaatctgcttacaagtggaaggctgaatgattatttggctgatatagaagaacaggcacagggacgctttgaaaggattgtagagcagatgaagcaagcacagggaatcacggaacagttaaaggcagaaaatcagatggaatgggtagcgagaatgaacaatatacaatcgtgtgcaagggagattgtggataaagaaatgatttatcaataagtgggatggtggaaagcaagtttgaaaagggcttgctttttgctttacaatgtgggtggctgatgtataattatgataaagagataaattagaattgaccgagctgaaagcgaaggatgcttgttgcccgaaggacaagaagatggaagtagaagaaaacaaaaaaataattttttatatgaaaggctgattgcagaatgtcaaaacaaaatatttatgataatgatttattttacgaaaacttcgagaaaatacgtagcgaagaaatcaattttaatgatattattgagacaccaataatattaggaatgatacctgaactatatgaaaagaaagtattagatatcggatgcggtatggggcaacatgcacttcaatattcaaagaaaggggcgttatccgttcttggaattgatatatcggaaaaaatgttagcatatgcaagaaagaataatgttgcctctaatattgaatacagaagactggctttcgaagaattggatgatttagaggaaaagtttgatgttattacaagctcattggcttttgattatgtagaaaattttgaaaggcttatgaaacagatttatagtcacttgaatgaaaatggcaaatgtgtattttcgatgtcacacccgataagtacagcatatgatgggacttttgacagatataccagaacagaaactggagaaagattatatgctaatctacgaaattacggaatagagggtaagcgtgttattcactgggtagtagatgaatatgaactttatcatagaacggtttcaacattaataaatgatattgtttctgctggatttattattgaggaatgtcaggaatcaaaagtaccagaatcaattagagaaaagcgcgcagatatgtttggaggggttattcatcagccagactttattttctttaggtgtggaaagcaaaattgatattttatctatgtaaagaacccgacagcttccagtttgtagaggagaagagggataatgaaagataaaagtattttaattagtggagggatttactgttgattttctaagcaaaaccgcttataatttgagtcggaacatattgctattatccgcagttacgaagggtgtgttatcaatgccgataacaaaatgataacattagctcgtataggcaggataatatggataaatcagataatcaaaagaactataaacacgacaacgaataatctctaaacaaaattgattaggtattgtcgagttcgaatagtagtaaaaatgccgcaaacccgcataaacactgggttttacgagtgagaaaacgctccgtggcaacgatttggcaataaaattgtattattcataaataaagagctaactgatttttggtgaagtcagttagctctttttgcgtttatttgtccatgaattgttcaccgagtgcttttagaagttcatcgctgagtttttgagaagggatagtgtcaatagttttttcaaaattaaaaccctgccgtttggcagccggtagtcagccggctatgatatcagacagcagatcctcttctggtttgagaagatgatccatattcatgtagcgtctggctccccagctggttgttgctatatgacgcagtctggcacatacgagcatcaaggcactctgtccatcgggaaaagtaccgattgattttgtacggcgtttaatttctcggttaagacgctcatcagcgttattggtccgaatccgggtccaatgctgcgtaggaaaatccatttaggtcaaggttttctcgattccgtccgctactttcttggcggcttaggcaagcttcatggcccggggcttctccgctacctggattgctttttcacgggcagcttccttgctctcctgtgcatgaatagccttgagcataagtgctaccgttttcatcttattgcggggtgtaacagaaaatatatttttgtaaaaatgaaccgtacatcgctgatatctggcatccggaaagacttccggaatggtttccagcatgccaaaatttttatcgcctatgatcaaacgtacaccagtaagcccgcgctctttcagccatacaaagagagaacgccagctttcacgatcctctttcatgccttccgcatcgccagggatcagggatctcccggcagccatcctggctgacgccaatggtaacaagaacagaaacattctggatctcgcctccccagctgcgtttcaggtaaacaccatctacggaaacatagggatagtccccggaaagcggtctggtacgccaggtttcgatatgctcataagcctttttattcaggttgctgatggttccaggggatactttcgttccccataaagcttcggtgatatcctctacgcgccggacagaaacaccggccagatacatctcaatcagagcttcttccacgaaagattccctgcggcggtatctttcaataattgcagtctcgaaaggaatgcctttgagttttggaaccttcagttcgacttctcctgcggtagtgtggagattgcgtttataatggccggagcggtatccctggcggtcagaggaacgctcatacttttcagcgttgattaattcgtgggcttccttatccagcagggcatttaaagtctcttcgacactgttacggacaagatcgctgacttaaaattttaaattccacatggctttaaaaattcattgttattataagttttttgatgctggaatcttcaataactgttataatgggaccgacttctcaaagaaacttctgtttttggacatggcaaatggtccactgggattctgtgtgcaggactgaattacactgaccatctttaaaaatgtgaaaagtttacttccagtccgacagcagatttttgagatggtttttaatggttaaagcggatcagcttaggcgtcagattgacccagtcaggttcaatcggcctaagctgaaatgcgtttaaggtttcttttctaagtgtttccaatgctatattatacggtgtccttccgcccagacactctctggggggcgaattgatatggtttacgatcaggtttatgtcccattgtgttaggaattcaaaacttgttccttttgggaggatcatccgcagcatcgtatgtgcctgttccagcccgcccttctgtccgctctacataggatcacaataataaatgctggaacgctgtattccggtcacgccggtttccagagtatccggatcaacgaatttggagccacggtcagtcagaatgtattcaaacacagagacgaactcgtaggtgcccatacgtttttccagacgatcaaaaataagacggacagcacctttggtgcagcggttcatcaggaatgcaagaaacagcttttctcttgtaaaaaacatggtcaacagagttttctttgactctctcgaagaatggacggtatccatttcaacatgcgctgaaagattggaggcacaaaaatcgctgtaaagtctgccggtaaaaacagctctgtccgtcatctgtgttttgtgacatttccttggcttaaaacgaactttccgcttcagatcgatattccttgcggtgaaaagtccctgatcaagataagaatacatggtgcggacagacatatctaattctggatgattcgtcaggatatgataagccgactgtccttgttcaattaacggagaaatgatcttaactttttgatgcagctcccgtttggttatgttgatcccgtctctggaatctcgaagcttttcgcgatattttctgtctgcaaatcgggcattatagttgtacttattggcgattgtacagtgagtgatttttttatcacagccattgcagacataaggtgcccaatcaagccttaagcagcgctcttttacaaagcctttgcatgtttgattacaggtagggcaggaagtgtatgtaatgccgcacagaaggattttcccacaggtattggtttttctgcaatgatagcggtgaacacagaagtttttggcgttataaaatgtgcctttgtgataccagtcggaaagtcggtgagcccttacctcttttgagatggtagttgggtccttgcacaggaatctggcaatgtgcttaaaggatgttcccttattcaactcattttcgatgtaaatacggtcttcaaggataaggtgtctctgattacctgggatatatttactcatttgtgttattcctccttttactgctatcagaaggagagataaacatagcacagctatatgaaaaagtaaatatcaactgtgcaggagtaaactctacatctcattaaaggagtggaatttaaaaattcattttaggtacggacaagatcttttaaatcgtgctttattaagtccttatttagctgtataatcttatcagacatggttctatagcctcctttgatgggttttgttgtggtgatttaattctaccaaacggctatagaccatgtctatttttatgaaattaattatacgttatcgaaaacatttttgcaaaatcaaaagaaattgaggaaaaaaatgggatctgctaatacaaagatcggaagcatactcggaagagcagatcctggtattttatgggctgaataatatcatcgaggctacctttcgagattttacagactccggaaaaggtttagaacaggctatcggagaatgggagttacatgaattaggatagatattttagtagaaagaacggaaaaatactttagaaaatagtaaaaatatttatggagataattaaatctgttctataaggcaataaaaaggaatttcttaatttgtgtaaaattagaactataggtaatttaaaatttatagttattaatgataaaatatttatgagagaattatcggaaaataatatgggctcaataaagtttaactaatcctttgcttctatcataacagggagagatttaaatagattgaaataactattattaagaagaaaatttatagtatttataaaaaaataaaagaaaattaaatgaggaatacctaataacaggttcttctttctgctcagtacaaatgtggcaaacagagtgattggtgtgctggatacataaataaaaattctttggagaaaagtttagaacatcaaaagaatttaggggaatgctaagtccccgaccgtatagttttatatatgcttcttttctggtccaaatagaataaaatctatgctgttgttctaaattagattgacctgtgttgatatactcattttcgttatttgtaaaaaaacgagatgcaagtgttaaatcaattggcttaattatttctatatctataccgatggaatgattacttacagcacaagtaacatattcacctgaatgagaaacattaaaataaaaattaggataatttcgtaaaaaaggttttccaaaattatttttttctaaaataatgttttgcttaggtaaggagagatgttcggaaattaatgtttgaactataatatccccaatcaatgaacgttgagcatcttcttgaaaatgaaatttttgaagttgttgttgcctctcaaccggtaaattagacaataaggaatagtattgatgagtagtaagtaagtcagtaaacttgacaatccatacttctatcatttcagactcctttcaaaaacgaaaaattaatacattgacgattagaatattatcactaaaacgaaaaataagcaactaattataaaaataacttaagtaaatgaaaaatgaaattttaaactccactgtccaagcggacagtggagtttacttttgcatagttgaaatttactctttcatacagaagtggtattgttatctctccttctgacagcagtagaaggaggaataatacgaatgagtaaatatattcctggtaatcataagcatcttactcttgaagatcgtatttacattagaaaacgaattgaacaaaggcacttcctttaaggatattgccagattcctgtgtaaggatcctactaccatctcaaaagagataaaagctcaccgattgtctgactggtaccacaaaggtactttttacaatgctaataacttctgtattcatcgttatcattgcagaaagacgaatgtatgcgggatgattatcctttgtggtgtgaaatgtgcttcctgtccaacctgtaaccaaacctgcaaagactttgaaaaaaaacgttgcagcagactggacaaagctcctgatgtctgcaatggctgcgcaaagaagatcaatcattgtacgattgcccataaatacaattacaatgcccggtttgcggacagaaagtatcgggaaaagcttcgggattccagaatcggaatcaacatgaccaaacgggagctgcgtcaaaaggatcaggtcatttctcctttgatcgaacaagggcagtccccttatcatatcttggttaaccatccggaattagatatgtctctccgtaccctgtattcccacctggatcaaggattctttaccgcacgcagtgttgacctgaaacgcaaacttcgcttcaaaccaaggaaatgtcacaaaacacagatcacagattgagcagtttttacgaacagattatacagtgacttctgtaatctggcgcttccctcacatgttgaaatgggtaccgtccattcctcgaggagatcaaagaaaaccctgttgactctgttttttacaaaggagaagcttttccttgcattccttatgatccgttgtacagaaggcgcggtacgccttggttttgaccgtctgaaaaaacgcatgggaacctatgaattcgcttctgtattcgaatatatcctgacagaccgggctcggaattcggagatccggtcgcattggaaactagtatgtgtggaatacaacgttccagcatttattattgtggccctatgcagagcggacagaaaggtgggctggaacaggcacacaccatgcttcggatggttctcccaaaaggaaccagcgttgagtttcttacccaatgggatgtaaacacgattgtgaaccatatcaattcaactccaagggaaatccttggtggaagaacaccatacagcatggcggtggaaactcttggcgaagaagctctaaaagcatttcagcttaggccgattgaacctgatcaagtcaatctgacgcctaagctgattcgctgtaatcactaatcaactatctcaaaaatctgctgtcggatcggagcaaacttttcacaatttttaatatggccggtggaattcagtctcgcactcggattctcagtggcccgtttgccgtacctagaaacaatgcattttttgagaagttggcataattatagcagatatcaaaagtttttaccctaaaataatgtgtaaacagcgaaaaatttaaacgactgtggaatttaactctgcactggaatttaaaatttcaagtcagctaatttaagtaaagaatagcaatttataataaaaaactaaaaatttattataaattttatatctaattttcaattatccgcataaacactatacattcaagcattttgaagtatagaaaaacactcatcttaccacgaatttaccacgattgaatgagccttgatatgaccgtaaaactactaagggagatagcacgaaactgtgtatctcccgatttttttatacagttgattacttcactccgatttcaaatttcaatattgctttcatcatgtctgtatgaatttctccttttagttcttcatcaacctgcataatgattttaccactttcagagtggtaaaaaggacgcaagcataatttagaaatataaccgtcataaaacttcaaaatctctttaactgccatttcatctccgcttgacgctttgcaaatcaattcaaaagagggatagccataatctttactcatttctttacttcccttcgctcaaaagcatttttaacttccttagtcctctagttcttctactgcaaatagcagaacgtgatacatggtacagttctgaaatttttctgtcgttcattccttgaaaataacgtaataaaatcgcactacgctgtttttctgacagtctatgtaaaactgtaccaagtgtttcatcagatacataaattgtaaagtgcaagactttaaatgatacacaatcataaaaacaggtatcaatcgttccacgttcaacttgtttcgtttcggctatttcacaaaacaatacttcacgtttagaatgtcttgcaagctgtctgtttcgacttttcactttgttcttaatgacaatcagcattaaagaattgaactgtaatctgacgatatgctcgaaagaagatgtcctcataatctcaccccctttctgctaatgctgaaatatataaacggaataccgtttataccctttagaaatacagaaaaatggtaagaaaaaagcccacacaaaacatatatttgtgcgagccttaaatactgcaatattactctttcttttataacactatccttttagcagatttcaaattttcttttatatattgtttttagcctaacatactatttaaccccttgtattatatctctaacttttgaaaaattctttttgaatatattgaaatcatgattgaagcaatagaagctacaaacataacaacccatgtttcttgtataaatacatcgaataaaataccgtaaaccatttgtccaataggttgaccgcacatagcaactgctaccagcgtagccattatctttcctactaattgcggtggtgtttgtgtctgaacaagagtgtaaatttgaacaacaaacatagtagatacacccatagccacaaagcacatcactgtaactacccagtaggaaactattgcaggcaattctaaaaatagcgaaattcccataagtaaaacagcagtagaatttcacgtttcttgtctggcaactcacgtaatgcttcactcaacaaatcattttcaacgcctactgataacccattgagtgtaaaaatctgaaagtcagttgaatagttatctgttgtcgcaaactggctaacaagataatcgccaacatccgaaaaggacacctcacgctttgcaatccttgaaagataaagcatataattctttcgctcgtcttccatagcacgtttacagatatagtcaaactgattttctattgtggtctgaaaagaagatggtttcatgtttctcaccccctttctgtctaggaaaggaagtgagccttgctcgtttatctcctttcactcttagtcccaatgtgaaagggggatttgttgcattactgataaataaactttgtaaaaaagttctgaatagccaaaaaagcatataaacagatttatttctctgtttacatgcttctgttattctatctatatgatttataaaaccacattggtggacgtacttatctattgcagatagacgactttttttgacaagaacccaatgtaaggaaatttattgtatatgatgtacttcatggcgacgttgacctccaacaaaccgccatttggaagtaatatacaatattttaacagcgtaaatagcactaccatataacggttttttttattggcgtttagtagtgctttttattaaatataaacctataaaccatataacacgtttttctatacctgtttttaattcagtaggaacaataaaatgtatagaggtggtctactatgcgtaaaaaagaagataaatatgattttagagcctttggtttagccattaaagaagctcgattgaaacgaggtttaactcgtgaacaagtgggagcattgattgaaattgacccacggtacttaactaatattgaaaataaagggcaacaccccagcatacaagttctttatgaccttgtatcgttacttcatgtttccgttgatgaatttttcttacctgctaataacttggtaaaaagcacccgacgattacagatagagaaatacatggatagctttacagacaaagaactatccttaatggaatctttagccagcggtatcaacgaagcaagaaacatcgaagactaattaaaagaatccatacataacggaaagagccgataaaatgagattgtattaatctcattttatcggctctgcatctttgcgtctggctctgtaatcacagttactttgaactgctttatttcaattaaattttcttgtctgcatttcggacaatagagggggaatttttttaattcagtatcttcccttatctttaatcgtgttttatttccacatacaggacacaatatccacttgtagtttataataactatctcctcctttacactttaattcaaatctttattaaaaaatatttcatcttatttaacaagaaaccatatttatataacaacataaaatacactaagttattttattgaacatatatcgtactttatctatccgactatttggacgacggggctggcaaacaggttcaccggtagtaacatggtacccttttaactctgttaaacaaacactacgtccatttgtaaagaaagttaaatcactacgatattcttgaatacaccgagcagggatttctccactaagaatgacctcattatttttcaattgagtgtctacgatgttcgcacaatatttaggagcatcgttgtatgctcgtgaaagatattcctgtggcgcataaattttaaaactaagatatggctctaacaattctgttccagctttttttaagacttgttccaatacaataggagcaagcatccgaaaatctgctggggtactaacagggctatagtataagccatacttaaaacagattttacagtccgtcacattccaaccatacaatccttgttcacagccatagcgtatcccctccataactgcattttgaaacgattgatttaagtatccaagagaaaccgagctctcatactgtactccgctccctaatggaagctgtgctacagatagaccaatggaagcccagaaaggattcggtggaacttcgatgtgaatggtatactctgctttttttaacggtctttccatataaatgactgtaggctcttttatttctatctccacatgatacttttcttgcaacagtgcactaatcacttccatttgtactttccctaagaaagaaagtataatttcatgtgtcgtagaatccacgtaatatcgtagaagcggatcactatctgagatttccaaaagggcatcaagcaacatttctctctgttcaggtttactcggttcaacagttgtttgtagtagagggtgcggattttcaatcttttttctctgtggcaatagttttgtatctccaagaacactatctaacttcaaaaactcattttgcaaaataacaatttccccggaataagccttatcgattttacataattcaccatttattgaagtatacatttctgtaatttttattttttccttttccgatattctaaccgaatctcgcaaatgcagtacgccactataaagacgtatatatgcaagacgctgtcttttttccgaatactcaattttgaaaacttttccgcaaagttcagactgacctcgatgtgttgatgaataaaatttattcgtaatcacttctataaggttatcaatccctatattgttttttgcacttccgtgataaacagggaacagggaacaattatgaaatcttatgctttcctcttgttcgagttctaatgcttccaataatttcccagacgtatatttctctaaaaggtcatcgtttccctctattaccgtatcccattgttcagattcggtaaagttcgtcacacacatattaggatacagttctaccttctgtttgattacaatttcggcagaaagtttctctttaatatcctgataaaccgttgataaatcaattccattttggtcaatcttattgataaaaaagattgtgggaatccccattttcctaagtgcatgaaataatatacgagtttgtgcttgtacgccatcttttgcagaaatcagtagaattgccccatctaaaactgataatgaacgatatacttctgctaagaaatccatatgtcctggcgtgtctatgatgttcaccttcgtattttcccactgaaaagaggttattcctgtctgaattgtaattcctctctgacgttctaaaagcgtattatccgtcctcgttgtacctttgtccacgcttcctaattctgtaatcgctccactgttatataataagctttctgttaaggtagtttttcccgcatcaacatgagctaaaactccaatattaataattttcatgtgattttcctccattcaaaagcccaaaagggcataaaaatcccagtgataaatactcttatcactgggatttttatgcataaccataggcatacaaagcatacagatattctccggatactttagaatcacatgataaaggtattcttaaactgggtacaaaaaactaagccctcctaaaaaaggacatccaattatttgttcccactatcaaattgacagtttatttaagaataccttgccgcatatttattaactccttttaaatagatacttaaataatagcacgtaagagcatatttgtaaaggaatctccaattttttatcaaagagagtacgtgattacaaaatagctgtaataatgtaccaatatttgttattctataatcttccaattactcccgttcttttcaagtaccaaatcaaattgagatacctgcgttgcctttgcctgatttaccacaaatcagattttatccctttcttcctcttgattgcccacaacagaaaagaaaaagccctgtcaagagctttgccaccattggtggtgctttgcactcttgatcgggctttttgtttgctgtatcttctcgcaagaggaaaaaagttactcgtcctcatcatcaaaattgttattccttaatacttctcgtaacagttccatatcttcttttgagttcgggtttatcattttcacgacttgataaggtgtcttatacttatgtccctctatgctttccccaaacatatccatactgtataaatcatcatagcggtctaataatttttgaaacttcaaatgctggataaattctttgattgggtaaaggtcggacgcttcaatgcttttcccgttgatatagtctgtaatatattcccgtaacttttctaactcatattccagccattcttcctcgctgtcaaagaagttatcatagtgtccatgtttcagttctgcatttagacgttcttcggctcttaaaaactgacagacttccttttcagattgattgacatacttccattctcccgacaacaattcattgggcgtaacgtccagcacttccattatcttttccagcgtttcataggcaggatagttcaaccctctttcaatcttggaaaggctctgcatattgataccgattttgtccgcaagttcctgttgtttcattcccctaaattttcttatggtctgtatattatttcctaaatggcttattttcattgcataaccctccatatctcgttatatcttcgctattataagtctatcatgcttaatatgatttgtaaaggcaaaaaaagatattgacaaataagcatataagaattactatgttcttgtaatcgaataagcacaatagaatgaaatataaaaacattcaaaaagaaatacctatctgattaaatccgtagatatgaatatcggttgaaatggaacttgttagaaaaggcaaaacagaacttgctgacaaagtatttctgacacggtggcggaagcctctcaggcttaccgccatgacaccttgtgtcaaggggaagaaatgctttgtcggctggcgagcctgcgagccttgtctgtgcccccgttatctaacaggggggcactatttcacaaaagacaagtcaaaaaccatacaaccccaaagctgtaaggagtaatgaggagttttaagaagatagtaatttcacattcttttgaatagtggtttacaggtatttcaaggctattgtgggattggaggaatacaatgaacaatttagaatttgcacttgaaatgaagaataaacgtcttgcaagcggtctttcacaaggagaacttgcaagtcttacccatgtatcaagatatagtatcaaccgctttgagaacggaaaagccaacgccagcaaggaaacacaaaatattatcctgcgttgtctgaattactatatctgcgataagcctttttatctgctcgttgattatctgtctgtccgttttccaacgactgacgcattggaaattatccgaaaggtgcttggcatgaaagcagattattttatccattatgactatggatattatggctataaagagcattacgcctacggagaaatcaaggtcatggcttctgatgatgaacacatgggtgtatttttagaattaaaaggggcaggctcacgcaacatggaatatgtcttacaggcacagaacagggattggtattcatttttaaaccgctgtcttgactgtggcggtgttatccgacgttttgacttggcaatcaatgatatgtgcggtctgctggatattcccgttttgtctgaaaaatacaaaaatggcggtgcggattgtcgctgtaaaaactatgaaaatgtacaaggtggaaaactaagcggaaaaaaccgtaatttagcaagtaccctttatatcggctcaaaggcaagcacaaaatatttctgcctgtatgaaaaacaaaaggaacaggcaaccaaaaagaaacatacggatattatcaaccgttttgaaattcgtctgcgtgataaaaaggcagtacaggcagttgaggaattgttattgacatataaccctcatgggttggtgttttaccttattactgattttgtgcaatttcccgattatccgctgtgggagatattcatttcccatgacagtttaccttttgaaatgaaccccgtacctgtcaatatggaacgcactctgcaatggctggaaagacaggtcatgccgtcaatcgtgatgatagaggaaatcgacaggctgacaggctcaaactacatgaaaatgattgatgaatgtacccacctttccgaaaaacaggaaatgcttgtagaacagatgtgtacggatatagcagatgtaatcgaaagtgagggggtgttttatgagtaatgcacaggatattcccgtatgggaaaaatatacccttaccattgaagaagcgtcaaagtatttccgtatcggagaaaacaagttaagacgattggcagaggaaaacaaggacgctggctggctcattatgaatggcaaccgcatacagattaaacgccgacagtttgaacaggttatcgacaaattggacgcaatctaatgcaaatgagccttgtatgtgttatgatgaacacaagtcatatcaaggctctttccaacaaggaaaggagcagacaccatgaaagaaaaaagacgggatagtaaaggacgtatcctgcatactggagagagccaacgaacagacgggaaatacttatataaatatgtagacgcatttggaaacacaaaatatgtgtatgcttggagattgacacccacagacccgacaccaaaggaaaaacgggaaaaaccctcacttcgtgaactggaacagcagataagacgggatattgaggacggtatcgacagcacaggcaagaaaatgacactttgccaactttatgccaaacagaacgcacagagagcaaatgtgaagaaaagcacaatgaaacaacgggaacaactcatgcggttattgaaagaggacaagttgggtgctaggagcattgatacgataaaaccctctgacgctaaggaatgggcgttacgcatgaaagataaaggcttttcctataacaccattaacaaccataaacgctcgttaaaagcgtcattctatatcgccatacaagacgattgtgtaaggaagaacccttttgattttaagttaagtgaagtcctagaaaatgataccaaagagaaagtcgcattgacagaggaacaggaacaagccttactctcatttatcaagacagacaatgtgtatcacaagcattatgatgatgtgctgatactgttaaagactggacttcgtatctcggaactgtgcggactgacagtagctgatattgatttcaagaatgaagttgtaattatcgaccaccagttactaaagagcaaggaacagggctattatattgaaacgcctaagacgaaaagcggaataagacaagtgccattaagtagagaaacaatacaggcatttcaacgggttatgaagaaacgcccaaaggcagaaccatttgtgatagacggacagagcaatttcttatttgtcaatcataaaggcaagcccaaagttgcgattgattacaacgccttatttgtccgtatggtaaagaaatataacaagcaccacaaggacaatcccttgccacatatcacaccgcatacgctacgccatacattctgcacaagactggcaagcaagaacatgaacccaaaagatttacagtatatcatgggacattcaaacattaatatcacaatgaactggtacgctcatgcgtccatagataccgcaaaatcagaggttcagcgtctaatcgcatagaagtatttaccacgattttaaccacgcttgatagcgaaaatataagaagatagacctagatatgtgaggtttaccacaaaagcaaaatgcccgtagagcctataaaataaggctttgcggacatttaaggagatataaaaagatagtcaaaaagacatatataatttagaataaactctattactacacggatatagcattatctgctcctatgtttttttagagcaaaattatgaagtgctacgaaatggataaggtattacaattacttttcgtaaaataatatacggcggacaactgatgctaattatatttaatgtatttattaaagaggatcatgaggagatggttaaaatgatacaaatagtgtgaaagtacatgagccagaagaattaactatatttaagatggagcgatgataatacttttagtaagataacgattaaactatataagtagaatataggaaatgtgttggactatacaagaaagattggtcggttatattttgaaaattagagtgggtattaattttctaatatttgtttcacaaataaatagtaaaaaataatggttaaatacattgacaaaaacacaagaatataaaagtatgtagaacacaatttgctgaaatgcaatgaagaatagaagaaaggaaatgtgatgtttgagtttctataaacatcatacaagattttatgaaatttacaattagtgaagaacaaaaacaattagtagaagaagtaaaaaggtttgcgagtttatcattaaatgattcgaattatattaatgaattttcgcatagagaatggaaagaagtggccgactttggaattttgggtttaattacggatgaaaagtacggaggcctatgagaaagttattttacggtaactttggtagaggaagcattagggtatacttgtaaaaataatggatttcaacagtgtataaagggaatataataaaaaacttaataatggactgccaatcttacacaaagtaccgctcaaatgtgactacgggtaatatttttgtatcttggcggagaaagggggaacttctgacggcattgtgtaaagttgatagtgaccggaacggtatccttggcggtcggcagatcgtttatatttttctgcattgaccaacttatcagcttctttgtcgagtagagcatttaaggtcacttcgaaactgttgaggacaagatcactgatttgaaattttaaattccagtgcagagttaaattctacagtcgtttagatttttcgctgtttccctaaatgaagttggaaagtctatttcttacaaaaagtagaaataacttattcataagtttatgctggtaagaggtggcctgcctacccaaaggaggcattccatatgaaagatgatactagcagatattggaaacgccttacccttcaggacaggtatgacatcggagaaggattaaacaacttccatactttggccagttgagctattggggaaggcttcacccaccatttcaaaagagatcaggaagcatgggataggagattctatccatacatcaaaaggaaatgactgcgcccttagatatcggtgtcttgtaaagcatttatgcctaaactgtctccgggatattgaatggcgtagctgtcggaaaacggagtgtaggaaccattgtgacagatagcagtctgatgcctgtaaaagtatttcccgtgcttcatacgtctgcaatggatgtattcgtatttacaaatgcgaaaagccatatttttattatccagcaactgaagggaaccaaggaaggaattgccctgccatgtcaacagctttatgaattggattgccttctgaaaccgcttcttaagcagggacagtctatttcccacatttatgatgctcatgaaaaagaaatcccctgttccattaagataatctataactatattgatcagggaatattcactgcacagaatatcgatcttccaaaaaagtaaaataaaagccgcggaaaaagagtggagcaggactatgcataccgggaaggaaggcttataaagacttccagacatggcttgcagagtatggagacagtgatgttgtgaagatggatgctgtacttggtttgcggataagcagaaaaaccatgctgacgatgcttttttgaagcagcagtctgatgctgatttttcttttggaggaatgcagtcagagatgtgtatgtgaggtgttcgattggttagcgggccttttgagtacagagagattcaaaaaaagttatccggtaatccttacagacaatggtgcagaattctaaaatccaacagctttagaaagagacatatcaggggcagaaaggacaaagatttcttattgtgatcctcttgtctcttggcaaaaggatcgtttggagaaaaatcatgaataaatatgaaaggtaattccaaaaggtcgaacattggaaccatttatccagaaagagatgacaaatagtacggcaagagccaatctgaacgggaggtctccatttgaactggctcagttattgaatgcgccggaattgttattggcgcttggattaaaagaaattgagctagaccggattatcctaaaaccgaaaccactggagtaaaaagcagattttaaacctgcaggcaggcgctatttcatgaaaagataaaatctggcatgtggaatttcctttttcggggaattttccaggtgccttgttactatgtttgaaaatcatggagatttaactgattttgaggtgaatacaactgtttcccaagaatatgaaaaaataaaatcctcaaaaatagaagtaagtgaaggaatgggagcattggatataaagcgaaatcttgattttcattgaaggccctcatctatatgacacgacaaacgcatgagtaaataaattgtaaacaaaccttctttttctgataatgataaaagaaaaaggggattaggtatcatggaagaattacttgagtggttggaatatatagaggatgtacatcagaaatattatccggaaatggagtcttagtatattaaaaatggtagaattactaaagccgggattatctatgaagaagaggtttgcaattagcctgcgtccaattaaatatctggaagaagtattattttttaaaaaagggatggatatggaaacggaatgattcatgcgtttgacgtgatctatcttagctctgctatataataaataacaaaaatatgttataataaatctacttacgggaatgaggagaaattagatgaaatacgaacgaaattatggcatagatcttttacgtctggttttgatgtacatggtgtgtatgttacatactttaggacaagggggaatcttaggggtatgccaagccggaacagtggagtataaggctttttggtttttagagattttatcatattgtgcggtggatggattcgcgattatcagcggctacatggccgtggacaggccacgcaaatacgaaaaactggtggatatgtggtttcaagcttttttctattcttttgtgattacgatgctgttcactctggcaggatgtaatccagtctgggaaaaagcagatatgatcagatgcgcgtttcctgttacatttgggaaattctggtattttacagctttcttcgcgctcttttttgcaattcctattttaaataaatttatgtttacggtagaggaacaaagtgcgaaaattgcgtttctcatactgattattttattttcatgtatggggctgtttgcggatgcttttaaaacacaaggtggctactcaactttatggctcatcatcttatattgcataggagcattggcaaagagaggcaaggtctttgaacagaagaagtcgttcactctcattattatgtgggcaatttgtattttttggacatgggcccacacgtttttcagggaaatgagcagctaacgaattttgtgtctcccacaatcctgctgagtggattactaatggtcattcttttttcaaggattcgtttgaagggcacggtgatagcaaagctttctccgttagcctttggtatctacttatttcagctcaatcaggtaatatggaataattatctgagaggtgcttttacatttgtagcagaaacaaatattattttaggggttgtgtatgcgtttgcttgtgccgcgttgatttttatttccgggttagtcgttgaatttctgagaactaagattgcaaaagttataaagattcctgaattaagtaaaaaaatagtaagtgtgtttcattggatgttgaaaaaagtatgcgtcattctaaaataagtaaaggtaaactactgtattattctatgtccttccctgcaaggtggaggacaattttttttacagaaaattatgaattataattcataattgacattatgagacaaaagtgatatatttcaattatgaaatataggtagaaaggaggcggcgtatgcgggagacgcaaatgtttgaagaaatctggaaggagtttcaacgggagatatcggaagagcaggctttttcgttgtctttactaatggctttttcctggcattacggagaatggcaggatgattttggactggatattggcagtggtgccatggtttcgcaaggttccctcattgagagcattaaaggaattcagggatatgatgtgcgtgaggcattcagcaggttatctgaaagaataaactggcagatggtagagcaagaagcagttcagaggctactgaaaaaaatgatagactgttttgtatggtatggcaaaaagggggaagatcccagagaggtgtttgctttgatactggacttgatgggtcgggacggaaaatgtgtgttgacgccaccaggggtaaggagggtgattgtggagcttctcggtccacggaaggcaaagcatctcgcgtccagttgttgtggaggtgccggactgggcttggaattatgggattacctgaggctgcggaatccagagatctcattctgcggggaagaacagagtcgtgagctttgtgatgtggcgaatttgtacagctacgcctatggagtttctgcaggggagattgtagagagggatgtgttgacgataccggaggaacgggaacggcagcggtacgatatgatcgtgatggatgttccaagaggaagaaatgttacggagctctgccagagtacagatccaagactttacggctttacgaaacgtaatatttatgccgactggatttttattcaggatgctttgtaccgtttgagcgaacatggctctgcggcggtgattgtgactccaggttccctgattcggagaaacgaggtgagtctaagagagcagattgtagtaaatgactggttagaagctgtgattacgtttccaaacaatttgtatccgaaagatcataccgggagagagctgctcatttttaacaaagcgaaaaagagaaagggaaaaacaatattccttgatatcagcggatattgtcagcggacaggacggaatgttcattctctgacagaggagggaatcaaactggtgaaaaaagtgtttgattctgcggagcagattcccggagtgagtgcagtctgcggtagggaagagattggggagaatgcattttctctgaaacctcttcaatatatccgccggaccggggaaaaagagatacagtcaggtatcactttggaggagattgcgcagatcgtcaggggatcacagcttctgaagaaatcggacattaaggaaaatggagcagcgttttttattaatatcaaagatattcagaacgctcggctggagtttggacaggccgaccggattcagagaacaagctctgtgtgcaaggcaaaatttcggatcagtaaggacgacattttacttacgtcaaagggtgcggttttgaaagcagccattgtggaggcaaatccaccggaagcgtatattagtggaaatatcacgatgatccgggtggatcagaggaaatacgacccgtatgtattgtttgaatttttaatttcagaacagggacagattgcattggagcgtatccaatcggggactacaatccggataataagcaatgcgagtctgcaaacgctgaaagttccgaattatgacctggctagaatgaaacagatcggcggacagctcaggagaaatcaggagagatactatcgggaaattacagaagcaacaactcgttttcaaaaggaaaggggacggcttctggatgaattggaggaattaacatgaaaaaggtgtttatcagttttagttctaaaaatcaacaactggcagaaaaattccttgagtttttgcagttgggaatgggattgcgaagaagagatgtgttctgtacggcgtttccggaaaagctgcaaacaggtgaaaattttattgaaacaatcagacagcagatgcaggaatgtgatacagtcatttctctcattacagccgaatatttacagagcccgttctgtctggtggaaatgggagctgcgtgggctttgtgcaagcagtatttcccattattgactgtaaaatatgaagaattggacaggactcctttgaagggaattcagatgagaaagctggacgagcaggaagatctgagtgtggtatacgatgaattacatcgatgcaaagttctggaagatcatagtacggcggagttttacaaaagaacggtggagtttgtttcttatgtaaaaaagtggatagcgggtgattatgtactgcacccagatgaagaggggtactatgagacggtgattgaatcggtccgggagctgtcgcagaagcagtaccgttgttacgggatcaaggggcaccttgataatccgccggacggcgaacaggcgaacagtgactggctgttttattggggcaatacgtttccggatctggtaccgggagaccgggtcagatttaaaacgtcaaaatcaaaagtaaatgtattccaggatcttggacgtgccagaaatatatatccagatgatctcagaaaggtataaaggtgggggattccattaaggatataccaaagctgtataccagttgggaaagtaaccggatgtacggcaaagagaaaaagacagtcctgtgaaaagttaggtttggaaaatctaaggttcacgggactgtcttgacttatgggaacaaaaattttagtttattttcttaccgtcctgataaacggcttctactcgcttcagagcagagaggtcttccaatggattcccatccagtgctaccaggtcagcagccattccttcagtgatagagccggttacattgtccacatggcacagtttggcggcatttaccgtaattccggcaaggacatcttgattggaggcgcccagtgatgagatataaatggcctcttgtgcaagtccctggtggattccgtctgtaccgataccaaatttcagtccacctgagatggcgccttccaggcatttgcagatgatttctttttctttcagactcccatctttgtccttcggagaaaacttgaagagaagatcatcgtttagtgcataacttggcgtgtatacgacccatcggtctgcgttcttcactttttcaacctggcgttctgagatgtaatatacgtgttccagacagtcgattcccgcatcaatgcagtcatcaagaccctgtcctcctgagcagtgacatgcagtggtaattcctacacttcttgcctcctggacgactgcccgaagctcttcagggctcataaaatgatagataaaagatgttgcgttgatgacctttgtcataaatactttcagaaaatcaacaccatggaggatattttcgcgggcctgccggcgaaattcttccggtccgtcaaatggcattcctacatacccatgaccgtgagaggcacgcatgccaatgccgctgacaacaagttttggaccggatatccgtccttctttctgtgcttttttacaagtgacatcaatataaaaacgatcccccagacatcttgcagtggttactccggcatgaagatcatcgttcatcgtctttaaggcccggatagtctgttcacattcacaatcattcattttcacaagatgatgttcaatgcgcgtatccaatgcaaggtgattatgacaatcgatcattccgggaatcagagttttgtcgcccagatctgtcacggtaatatgttcgccggaaggtatctgagaagcatgattataaatgcgggtaatctttccgtcctcaatctgaattgctccgcgtgtcattaaggtaaggtcttttccggtaatgatcttgtctgctttaataatatgaatactcattgatgaatcagtcctttccaaatcagttttctttgtcttctaaggaagatgcagccgctttgagagcgagtttttttgaggctctccggcttacccatcccgttaagataggagtgagaattgcagtgataacgactgcggcagccgtctgggcagtggcagattctacatatggctccaacgatgggtccgccattgcaacggatgcaggagtagcaactgcatttccgcctacagtgccgatagccattcccattggatctggttttcggcggattgcactgtaaataatgtatgtgagcacacctgttgagaatacggtgataagtccaagaagtatcccaggaacgccggcctttgctatgtcaacaagactcatattagcgccgaatacaaaaccattcactggaagaatcatattcaggcctttggaaagaagatcacggaagtcggaatccagatttccgaggatcataccaataatcagtggtatgattgcagctacaatggagagtacaggaatggaagcgagacctgtcgtcccaagagcaatcatagtaaggaaaggcccgtcatttaatgacagaactgcaatggcgccgacatctgtatcatctccaaattcttttgcaagtgcggtataaattgctccatttgagtttgtaactgcagaaataaccgcaaatggggtgagaccaagaatacctgcaggaccaaatataagattgagcaaataaccaataatgacaccaattactaattttaaaatggtaagaactgcgcctttatatagtggttttcctacttgtttcacgttaattgtagctccgctgcagaaaatgaagagccctaccagagtcgactggccgcttttaaataaagctgttgtaaatccaccgatttccaggcactggggaacaaacgtattgactgcacaaccgatcaataatggaattaccatcattccgccgggaaattttttcattgtcgcacatattttcataatgatactaaccgtcctttccagtcaatgtgattagacattgatcatgtgttctctgctgcggccgcacagcatgtgattttacataaagtaatcagcaatttgtgtgccatctttgtaaaaatagccaaagagccggtttctggtcttcatttatgctttcctgaacttgttttcaatagattttaaaataaaatgttgcacgcgttgcatatggtgcaaagctgtgcaacattatgattcttttcggttaaaactacttttaatccccataagttctctgtatttggcaacagcccttcttgacaggaagatgccgtccccttcgagcagttctttcagtttttgatcactgtatggacttctcttgttttcttcactgatccgtcttcgtatcatttcctgaatctcttttgcatttcgggtagttgatccggatattcctgatacactctgtgaaaacaggtttttcataggtacagtctccttgggatattggatatactttccctttacggcacgagagacagttgaagggtgaatccccagtgcttgggcggcttctgccattgtcattgggtgaagggggcccgtcccttcaaaataggggagctgttggtctaataaaaattgtgtaacattcatcagtgtttttcgtctctgttccacattttgaaggataaatgttgcgcgggaggctttttcacggaaatatgctcgcagttcattatccttggttttgagtatcatattctggtaataatcgttgatctgatagtttcccatccaaccgtcattcagttgaatttcccagtcttcctccttttttatgatgatatctggaacaatgtattctgtttttttaataccaaagcctgtggaaggacggggatttaatgtgccaatcattagcatgtacttgcgaacctgagatgttgggatcttcagagatctggagatatgtccaatgttcccatgagctacatcttccagatgctctttgatcatctgtttcaacagagggtcttcagatccaagggcctctaactgacgaaggagacattctttcagatccgaggaaaaaacacctaccggctccaggagtttcagttcatccaggcaatttgtcactgtctcttctgaagtgtgaaaatatccggcgacttccttggtagatagtgtgaagtaaccagaatcatccagacattcgattagatatttttgtaaactttcatatggctcatcgttgttgccaatgttgagctgacttcttagatattctttcagatccttactttcttccatctgatgattccattttttatcatcctcagatggtagaacaggaagggattcataaaccgtttccggagactgaccattgatttccaacataggattatcgaggtattcttgtcttaaaaagcagtcaagttctacattatccattgcaagaatcgtcaacgactgtatctgcttttgtgttaaaatctgtttttgcttttgtagaagttccaatgtctgttccatgggcaggcctccttcctggtactttctttgatgttaatattattatgtgtgctggaatgtccacgcaatcttgcagctttcttccagttcctccagaccgaaaaaggtctccatcaatgatgttccgccaacaacaggcccatgatgagcaaggataaaagcatcactgaatggcgcggctttttcaaaataaccaaacagttcgttactgccgggtttcgcatagggaacaaggcctatagttcctactttcattttcaaataaggtgtataatccggaacaatgtcagttttgtccgggtggtccagaaaggaaaaaatggtagcataaaaactgtggacatgaatgactgcctggatttcttccgatttttcgtagtatagtttatgaagaggaagttctttacttggattgatccctgcaaggtgctgcccctggaaagatacttctgagaagctttcagtggtcagatttccgaagcaggtgccacttcctgtaatatagatatgaccgtcatggagaaaacttaagtttgctgaggaaccggtagctttcccacggtcaaataattcttttgcgatccaaatggcatcattcattttttgttcaagtgtgttcatcgttcattacctcgtcatttcaagagcccgtgtgaaaaaatcaacttgtccaaaattaccggattttaacacgaggcggatgtgcttgttttgtactggtatcatgatcgggacgccaggtgccacagagtcacctatttcgaatacatcatagccaagaacttttgttacagcaccggaagtttcaccaccggcaactacaatgcgcccataccctttgtgtaacagagcgttggcaacactgccaagtgtcctttcaatcattgctgccactatttcagttccgagtttctgcacttctttaattttttcagaagtgtcggatgaataaatcagaacttcatcatccggatggctcagaacaaaatcgatgattttctgttttgtctgtgttccattatataatgcaaaaggatcaatccgaaaggaaggatgccctttttcttgaaaatcctgaatctgtgctaaagtagcaatagagcagcttccggcaatcacgacgcctttgctatcggctgcttctgagttctcaggtatggttctggtacggttgccggcgtcttgtaagatccggatacccaggtgcgtcaggattccagaacctccggtaagaaagcggagatgaccaaaaagatccgcaatcttctgaccatcttgttcacatgtataatctgggacaatataaaaatgatcttcagtaatttccagacattttttacgaagcagctcagcacttgtgttaagatctgtagtgtcccattcgtaagcgtgatatttactttgcgtttcgatcagggctttaatccggctgtcccacataggagtaagcggatgatttttcataggactctgatcgagaggcactccgttcacaaacagttttccacttcttacgattctaccgtttaccggaagggcaggacacaagatggtgcatgtttccccaagatattccataattgcatctgcaacaggaccgatattccccttttttgtagagtcgaaagtggagcagtatttaaaatagaatttctcggtcccctggttttccagccacttaattgcttccagagtgctgtgtacagcaacatcggtcgcttccgtgcgtgattttagggcaattacgactgcgtcagtctgttcagggaccggaaaatccttttgaatttcgttcataagtaatgttcgcagtccggcatttctcagaaaacttgcggcgtcggacgcacctgtaaaatcatccgccacacatcccagtaatatccggttttttggtttttccatattcttcttatcattcctttctggtcgctttcattcattgcagatttttttcagaaagcgaaattgcttctataaaaaaataaaagcaatttttgtgccaacttattctatatgataagatttcatttttcgccagagtgtggagcgatccattccgagaagttcagcagctcgtgttttctttccgcccgttttccttaacgcttctcgaatctgttcttcttcgatagaaacgtttggagatattgtattctcttcatggagcactgaatcattatcagttctcttgcgttcggatgaagaaaagacatcctccgggtacagcgcagtctccatcagatgcttgtctatggtatcatgttcacacataacagaaacccgttctgcaatattgcgtaattctcggatattcccttcgaaatgatagttgcgaagcattttttgtgcttctggtgtaagccctgcaatatcttttccaaatttgttgttatacttgttaagaaaataagagaacagggggagaatatctgctgtcctttctctcaaaggcggaatatatactttcaaaacatccagacggtataaaagatcctgccggaattcatggtctatcaccatctggcgtagatttctgtttgtagcggcaataattcgggtgtctacatcaacgactttgtcatcaccgattcggcgtatctgacgttcctgaagtgcccgaagaagtttcccctgaaaattgatggggatttctgatatttcatccagaaacagagttcccctatgagcctgctcaaaaaatcccattttcccaccgcgccggcttccggtaaatgcaccgtctgcatagccaaacagttcactttccagaagattttccggaagtgccgcgcagttgacggcgacaaagggtccgttgctccgttcactggcattgtggatactctgagccattaattcttttccggttcctgtttcgccaacgatcagaacattcgaagatacggcagcaaacttacgtgcgatagtaactgtgctttccataagatcactttttcgtatcatatcagagaatgtataggcggcgacaagacctttttcggaaagtttttttcgtatttgtgattcaatctgctgaatttttttgaccgtctggcaggtaatgaccacacctgcagctttatctcctacgatcacaggtacataatctatagtaaaagttgtgttgtctacattttggacagcgttataaacaggttgtttcgtctgaatggcttctgcacatttttcttcaaagaaaggatatacctcatgtaattgtttcccacgtatcaatcctttatccgtgtaaatcatctgtagcatttttttgtttacgagtgcaatttcttttttaccatttacatagataattccctctttcgatgtctgcgtgatggtttcatagatttttcttctttcatgttcctggtagattgttcccatcatacgagccgcttcgtgtaaaatttggatcattgcttcttctcccgtttcaacggtaattgcattcatatgttttctgagcgcttgtgaagtgacagaatatccacccaccacggcatcatagttgttttgctttacatcttctatgatttcggatacacgttcaaaatcctggcatgtttttactgatacctgtgctcccagaatagagcttaaaatagtttcatcatgggtttgagcagaggaaacaatgacggcaatccgggtagcatgatactgttcttttgcttttaagagagcacgaaggatgtcatatccggtaattggaatttcaagaaccggaacttgattgtctttttgctttaatatggcagcgctatgaccacggccaattacaaggtcataagcttcatcccatggcatatgctttatttcttccgcttgtatcacgcgaatatcaacttcaaattctgtgtcacgaaagtattctttgtaaattttttttacggtttgttctagtttgggataagggacaaccagcaaaactcgaaacataatcttctttctcccttcatttttttcaaaaattattttcttctattttataatgttctggcttttttgtaaaacgggttctttcatctgtatcttctgtattgacacagaaatacagaccgacataatgcacaagggaatatgacggtctgtggtatgaggatgatatctgatgaaattataattcggtaccttttttgtataagtcaaaagttggaaggtcggaaagatctacatgttcgagtgtaacaggctctcccttttttacatctttcaggagcactgctccattaagcagatagaacggagcagcatttttagcggtgttttgctccagaagttctggaacaagaccatcgatggagtgatgatgaccggccacttttaactgtgttccttttggaatatcctgctttgcgacaccggcaaggacggatacctgacggcattccgtatgtgttcctatattcataaaatcaccaagaaggatggaaactggtgtttccagtcccatataatggtacggatagtaaatacatgcatagttatcgttgcggcttatgatatgtcctttacttttcaggatgtcccacatttttttgttttcacagcgcacgatgatgaattccccgccacagaaactggcctcatcttcttcccgcagattgtaaaatacatcaacgacaccggtttttttcaaaataccaccatcttcttccggaataaaaatgtttgcaagctcactcgcctttgctacaggataattcaggaaaggtgaggatggtacaaggccggttacattggagacgagattcatctcacagagatcagcagaaatcacttcggtgtagttctttaaaagatgttttcttgcatcgagcgtttcttttccgtgatatctccaacaatcaatgatctccggcatggattcaggtttgctgtttccatcggtataagtaagcatacccgtttcacggttccagacgaaatcatattcgctggcttttcctgccgcaataatttccagaccaagaaggtttgcccaagagcatatatcaagaagattccttggctgatctccgtttacaagagaataaacggctccattttcagcagcagtctgatttagcattggcccacatacactgtcagtttctttagagaccatatacacattaattcctctttttaatgcagtgagagccgcatctgcgctgactgtggtgtttccggtacattctaccagcgctgtaattccacattccggcaacagacggtagtcgcttacgattaaaacagcatcctcatctgcgctgtgaattgcttcttttgtttcacaatatactatttggttttccttataaccgatttcttttagtaccgcctgacattcatccggatgtctggaacagatgacccggagatccatcagtttgacttttggaatctgtgcaagaagagtataaccataccctctagttgctccaatgattccgacttttgatttttttccggagctgtcgttaagcaaattcgtataatccatatctacattctcctttttgaaaatttgcagaatctttcgacattaaatctgtccggtaggacgctgcatcaatcttttaaccatatatatagcaagtgatgtgccaaatccaataaactgattgtaacagtttagtcacgcagcggctaatccgagctgtgatggctgaactgttacaactgatttcagattctaatctatgtatgcggcatgtatatgtaaatagggatattttggaacttatggatgatggtgatgttatgaaatgttgcaaaacgttgcaacgacgttgatgcagtcaaggggctcttgggcttcagaatgtgaggatatcatttttaatgatacatttgttcgggagaagaagtttcagtctcttgacagagaatgagagcctgttataattcgaattaaaagtataaaaaactataaggtgatacgaaaaggagaaagaaaatgttagatgcgaaagttgcagaattattaaacacacagatcaataaggagttttattccgcctatttatatttggattttgcgaattattatacggaagaggggcttgacggttttgccaactggtacaatatccaggcgcaggaggagcgggatcatgctatgctcattctgaaatacttacaaaataacggctgtaaggtgacatgggaggcgattgataaaccggataagaggtatcattcttttgcggatccgctgcatgcgggctatgagcacgaaaagtatgtgacaagtttaattcacaatatctatgatgcggcaaatcaggtgaaggattttcgtaccatgcagtttctggactggtttgtaaaagagcagggggaagaagagacgaatgcggaaaatatgattaagaaatacgagctgttcggttcagatccgagagcgctttatatgctggatggagaacttggtgcacgtgtttatacagcaccgtctcttgtattataagattaagaaaaaagaagaaagtcggaggcggcagaacggggggagaaacatcctatgtgcagcgtgttttatgttggcgagaatatgatacagaagatgaaacatctgacccaggagattgataaggaagcagagaaggtgaagctggagcgggatattcatcccacagatcgggcgttgattttgcggtggggcgatcacaagattagactgtcaggaatgaaatggggatatccggtgatacatggatcaggggtactgatcaatgcgagagctgagtccgtgatggaaaaaaggacgtttgcggagggaatccgataccatagggcggtcattcctgcgagtcatttttacgaatggaattcgaaaaaggagaaatatacatttcaaaggaaagacaggagtgtcctctatttagcaggtttttttgatcttattgataacgaagaatgtttcatcatattgacgacagaggccaatgcatcgatgagggctgtccatggccggatgccgctgattctgcaagaagatcagattgaggactggctccgggatggaaaggtgacggaggagattctgcgtcaggttccgatggagctggttcgaacagcgaaatacgaacaaatgacgctctttccgatgtaaatagaatggaaccgatggagggggaaacaaaatgaaaatcgaaatgcacgttcacacaagtgagggaagttcctgtgcgaaggcagaggcccaagagattgtcaaagcatacggcgaagccggatatgatgcgattgtcattacaaatcactttgatcctcttttgcttcaggagtttggggagacggatgagcagaagatcgaacggtatctgcttggttaccgtaaggcgagggaagccggaaaacgatatggagttaaagtgatgtttggcgttgagattcggctggaaccaggggtagaagattttctgatttatggaattgatgaggagtttttattccaaaatcccaatctttgctttttgagccagagtgaagtgtttaaccgatgtcatgcctacggagcagtcttttatcaggcgcatccgtttcgggagccgtgtgttccacagcgtccggaatatctcgacggtgtggagtataaccagcgcccgaacagtgggaatcacaatgaaaaattggatgtgtggcggaaggactatccggagttaaggcttatatctggaagcgactgtcatgacctagatcaagtaggatatggaggcattgagatagaagagaatgtagacaatatcaaagagattgtcgcaatcatgaaaaagggaaactatcgtttgattacaacaccagtttaataacagaaaaaagagacttttcatctctttttctaccattataataccacaaaatggccgaaaaatcaagtctggcaatgccatgcgcccggtgctatacttggctctcaaacgataaaggaggcatgtgcatggaacagaactggatgcagttactggatcagcaaaatcagctatccagagtgatggagaccaaccgtacggcgcagacctatggtcttatactaagtgagcaagatgctaagttgcttttgaaggagaggggcagagcgcttaagaaggagaagagagtggaattcggcgagggaattctgcctaagatgatctatgaattctgcgattgcccgtatctgaatcaggagcattatgtggagaccctagtacgattgcaggatatcttttatctctataagaatgagatgctggatgagattacggatgatgagcttctgcattttatgagagagcaatatgaaactgtctgttttggggatctggactatctggaggggacttgtctggatattttcgcacaggcgatccgggccggatacaggggataccgggtgacggatggaagaagtgagtatggacagtttgatgaagtgaagcgttgggattatgagctgtatctggaggcgcttcaggatctttgctggaggtgatggctgtgtggtatgagatggaagagcttgtgccaatcgttggcagactggcacggaagtatacgtcaggagacagtacctctatttcctatgaaaaggcagagcagttgatgggagcagttctgtactgtatccgggaagccggagcacagagaaaatgggctgttacggacagggagaatctgacggcagagacggcgtatcttacgggggcagcgtgcgtggagaaaaagacgaaaagagcattaagactatatcaccagatattaaagaattttgattcctatgagcagcactgtctgaatgaaacaatcacaaaaggaatgccagaatatttccggtggtacgatcccattttcgcaccacaggagacgcttctgacactggactatccagtgctggaagatttgaaggattatacaggaattgactgtgtagagcgatggctttcccgtgtgaaacaggagcagcagtttcttcattgctttccaagggccgatttgatctggatgctggaggaatatgatgaggactaccgggatggaatggataatctgtgcgagatggttttaagcgtctgtgtgaaacaagttcttgccgggaaatccttggcaaaccgggtatttggccgggaagaggaaaatcggattcgggaaacgcttgagcagggaggagctcggcttctggatgaaaagatttatccggttttgcgaaagcttgtgtcgaaagcagggagggatgcagatgctttgtggttttatctgtttccggccatcgattctgcttttgtacggatacaatataccgctcgtcatagaggacaggaggcggatgatcgggtgatagaaatagagttacagagggaggttacatatgagacagagacaacaactgccggattacagagacagtctgccgaacctggcgcagtcgattttgcgtgaatttggtattacagaagttggaagggagagtctgaaaagtctggatccatatttgggaaaaggttatcaaaatatcgttgtccttttactggatgggatggggtcaaaagttatggagagaagtctggagggggatggattctttctcagacgtaaaaaagcagactatcattcggtatttccaccgactacggttgcggccaccacatcgatccggagtgggcttcagccgtgtgagcacagttggcttggatgggactgctactttccgcagatcaataagaatgtgaccgtctttacaaatacagagaccggaacaagcactccggcggcagactaccatgtagcacaaaaatactgcggatatgagaccgtggtagagaaaatcaaccgacacggagggcaggcttatgaagtcatgccgtttgaggagccatttcctcagacaatggaggcgatctgtgagagaatcgaggagctttgccggaaaccgggaaagaaatacatttatgcatattggaatgagccagacaagacaatgcatgagaccggatgctacagtgaagagacgaaacgagttgtccgtggactggaagaacaggtggagacattatgcaggaagctcaatgatgcgcttgtgatcgtgacggcggatcatgggctggtggatacaaaaaatgtttcccttacggactatccaaagatctgtgagtgtctgaagtggcttccgtccatcgaaccacgggctttgaatctgtttgtaaaagaagaaaagaaagatcagtttgagcaggaatttgaaaaagcttttggaggacagtttctgctgatgacaaaagatcaggttctggagagtcaaatcttcggggatggaacagaacatccgaatttccggggaatgattggagactacctggcaatcggaataggtgatgtgacgattttttctgacagagaagaggcggaaagcatgaaaggagtccatgcgggacttctggaaacggagatgcagattccgcttattgtggaagaacgggcgtagcatgaagatggtggatgtacttatgccacatctgccgcgagggggcgcctagatgaaaataaaagggatgtaccacggaaaggatctgtggacatcccttttcgtatctgataaatctcagatcatacatgttagacgacttttggcaggggggatcactccgctttcattggcagcaggaaggtaaatatgctcccttctcctggcgaactttttaccgagatagttccgccgtgagcttcgacaatccacttgaccatggagagccccagaccggagtggcccgatgcacttcgtgaggaatccacccgatagaagcgctcccagatgtgaggcagatcctccgccgcaatgccaatgccgtcgtcctctacctggcctacgaagaaaccgctctgttcatagcaggagacgaggatatggccgccggcctttccataagaaattgcgttagatatgaggttgacaagcatccggatataaaaggtctcatctacctttacgaaaagatccggttcgatctgtgtggtgatggcaatcttcttttcctcagacagcatagcctgttcttcacagaccatctcggtgagttcactgagattcaaaagctccggctgtaattgctgtcttccttggtctgcccgcgaaagcaggagaagctgagagatcatctgcgccatgttctgcgcttttttctggatgagtccgatcgaaacacgctgttcggccggtagggacgcatcagataatattgcgtcacactgggcaagaatgaccgtcaccggggtgcggagttcgtgggaaacgtcggaggtaaactgttgttctcgctgaaaggcgctctcgatcttggtaagaagctgatcaaaagtatccgcaagctggtaaatctcatcctttccttttccaagttctacccggcgggacaaatcctggtcaccttgaatctgacgcacggtttcagtgatccggcggacaggccgaagggtccttctcgtaaacagatagccgatcacggccgtcagtacaaccagaaggggaagaacaatgacagcgaacctcagagtaatccgaaaactggattccgcatccgtgacagaggaaatgccccggacaaatacaagaccgtagccgttcagccgataggaaagatcatagatataccactgtttttcggcgtcggacagggtttggatttgcccatcggaaaaatcaggatgcagggaaaatccataaggtatccggccaaatagaaagtcgccattttctgtgtagagtgagaggtatacccctccatccagattgtagaaatcagaatccagatcaaaagagccgtcttcccactcgatatctttcaggctttcgtgaagctgcttctttaacgtattctgagtggaggcaagaatctctttattgctcagagagaaaagaatcgcaagagccgcacacgtcaaaagcgtcataaaaaaggaatataataacgtaagttttaattttaaggaaagtcgtttcatattgccaccttcagaacatagccggcgccccgcaccgtatgaattagctttggctcaaatccatcatcgatctttcgccggagatagcggatgtagacatcgatgacattggagcctccagtaaaatcataattccagatgtgctgttccagcttatccctggaaagcacgattccttcattttgcatcaggtagcgaagcaaggagaattcctttcctgagagatggatttccgtgtcgccacggaacacctgatgggtatcaagaaggagtttcagatttgcggtctgtagacaattagaaggagcttcggcaggtttccttaaaaggactcggattcttgccagaagttcctcaaaggcaaagggcttcacgagataatcgttggccccggcgtccagtccggccacacgatcctcaatactatcctttgcggttaagaggagtacgggaaccgcacaaccccggcggcgaatggactttaggacgctcagaccgtccagcacaggcatcataatatccagaacaagtgcgtcatattccgcgccggccatatactccaacacctcctgaccgtttttacaggaatccacactgtagtgttcggcctttaaacgcgcagtcaaaatccggttaagatctttttcatcttctgcaattaagatacgcaaatagatcaccatccttatcgttactatttatcagtatgtgactgttcacggaagcgccattcctaaaacatactacatgtttatcgtggctgttgccactgatttattcagggaatggtactttctttgtctgcatgaaggccagatgtcccttgtactggcataacatccggcattaggcatacgggtgaactgtaacatcagtataaaacataataaaaaagaaagaaagaaaaacttgacactaccagggaagcgaagtatgataaggaagaaatcggtaggtgaggttaccacagggatttgggccacctaagattgctaccgctaaattgtggagacacaatgcgctggttaacaggtcatgtcgccgataaggcataacctaatgcaattattatgccctgtgatactaaagcttggacgtaggaaagtttgaggtagatatgatctccggttttgtgccggagatttttttcttctataggataggcgtctgaagaacgatcctatagaaaaaaaggccctccgggtagaaccgaggaaaggaaaggcaggtgaggcgcaatggatgctggaggcagttatgactcgttttgttacatgaaaacatggataagagaaagtagggattgctatgaacagacagattttaacagaccttttaaggaagagagacttcaaggcagtcagaagtattctggaggtcatgtacaccgtagatattgcggctctccttgccgagttggacgataaagagatgattctggcgtttcgcctgattgaaaaggccaaggcggcagaagtttttgcagagatgagtagctccatgcaggcctatctggtggaaatgtttacggaaaaagaattaaaagagcttttggatgagctctatatggacgacacagtggatttgctggaggaactaccggcaaacctggtgacacggattctggagcaggttgacagggagaaaagggcgcagatcaacacgattctcaactatccggaggacagcgccggaagcataatgacgacagagtatgtggatctgcgtcgtaccacaacagttcgggaagcaatggaacacatcaaacagaccgggattcataaggaaacgatctacacctgttatgtcctggaaaacaggaaactgatcgggattgtctcagccaaggatctgatgacgatggatgatgacctgatgatggatgagctgatggagaaggagattatttccgtgacgactcatacagatcaggaggaggcggtgcgcctgttgtcacgatacaatcttttgtccctgccggtgctggatcagcagggatatatggttggaatcgtgacgatcgatgatgcgatggacgtcctggtagatgaaaccacagaagatatggagattatgaacgcattaagtccgagcgagcagccatattttgagacaggtgtgtttcggcatgcaaaaaatcgaattgtatggttattatttttgatgttatccgccacactcacccagacgattattgcacactatgaggctgcgtttaccgcggttccgctccttgtttccttcattccgatgctgacggatacaggcggaaactgcggttcccagagttctacgctgattatccggggactggcgctggatgaaatccattttggggatatcttcagggttgttttcaaggaattccgggtggcgattctggtgggcgccgcactggctgttgtcaatggcgtatacatggtgattcgttatcgggacccaatgttggcgcttcttgtatccatctccctggtagccactattttgatcgccaaaatgatcggatgcgtgcttccgttgtttgccaagaagcttcacatggatccggctattatggcggcgccgctgatcacaacgattgtggacgtctgctccatcatggtgtactttcaggtggcgacccatctgctgggactgatttaagaaaagagaaaatgaatatatgacaaataagaaggactgattatgggtattcagattcagcaaagatttgatatccatgattagtcctgtttttatgaaagtatgacagaaaagaggtaaaggtatatagggtaaaactcatggactcaaaataaaaactgatggacaaagtgttgaaaagaaactgggaaaatagtagtttgtttgtataaagtgatgaaaaataagtgtgagtgcaaagaaaggaaagaatatgaaagaagttaataaagaaccatttatacatttattttcttgttctaccggatattatttgtatgatgtcaatacagattctattttgaaggtcactccggatacttatcaaaggttagagaagcgagagaatattgaggaaaatgagcaaattcgcaaattaaagaaatatgggtacttaaaaacttcacatgtccaaatatcagagcacccggtcacgaaacttttgccatcgctgtacgaaaatagaatcgggaatctcactttacaggtaacacaacagtgcaatttacgatgtgattactgtgtgtattctggcaaatattataccagaacccattcaaataagagaatgagttttgaaatggcaaaaaagggattggattttctgctgtcgcattcttctgcctgcgaagaacttcgtgtgggattttatggcggagaaccattactggaatttgagttaatcaagagatgtgtagaatacatggaaacacagaccaaagataaagcagtccattatcagattacaacaaatggaaccttattgaaaggcgaaatacttacttatctgatagagaaaaagtttgaaatcacgattagttttgacggacctaaagagatccacgacagatacagaaaatttgctggaagtgacaaaggcagctatgacaccgtgatgcaaaatgcacgttatatcaaagagcattatcataacttctttatttctaatgttacctttaatacagtcatcagtccggaagaaagctatagctgcattggaaattattttaaaggggaagaactgtttcaggatgcggtttttacatccggtctagtaaaagatgaggggaaaaaagagaaaaacacagtatcagaccgtttttcagaagaatatcaatacgaatattttaaacttttgatgagtaagcttggaaaaataagaaaagagaatacttcagttctcggaagggagcaggtagaattcttgaaaatgctaagaggagggaaacagcaggacgaggatatcgagcttccaaaaaaatggcatcatggtggcccatgtataccagggatcagaagtctatttgtgactgtcgagggagacctatatccttgtgaaaaggtatgtgaaaatgtggaacttgccagaatgggtaatatcaactctgggattgatattcaaaaagcgtcccagattctgaacatcgaggacataacatccggtcagtgtaaggactgctgggcatatcggtattgtgatttttgcatccgatatgcggaaaaagaaaaagaagaattaaaaacatgtctattaagaaattgtgcagatatgagaaaaaagatagaacatgtttttaaagattactgcgtgttgagagaactgggatatgattttgaaacagactctctaaggaagggaacagaaaatggaagaaaataaaaaggaactatttgacatagatacttcggtgatgtatattcttggaatttcggaggcacttttcgattttcagttattagtacaaataaaagcgtgctttgaaagaaaacaatatagcgtggcgattgttacggatatggaaatggaagaggagaaggaagatatctatagtgtgtatgactattttagcccggaattgtccagtgaaaatctgataaaggcaaatcattatattaaggaaatagagatgaataaggagtatgatttgttcttggtcggcatgaaaaagggttccgtttcattcggaagagaaattccggaagatttaggactttctgtttacggaatttcaagaatccttcatccggactgtgttttattacaggttttctggggagattatcaggagacagatttacataatatggggaaagaaacagagcaaatcataggggaagaaattgactttttctgtattcaaaacaatacagttgatatgtattcctctcttaatcaacacaaaatcatttcatctgagatagaaaacacagtggtggaatcgacaatcgacggtttggaaaatagctatattttttctttaaacagtgagaaggaaatagaacgattaacagaagcagcgaccgagaagttacatagttatgcagaaatagagagaatgtgaataggaatgaaagaagaaatcagtaaaaagttgaaccagattcttttaaagagaacaggaatcgattttcagaagcaggaagagttacagacagaagatttctttggaggaaaaataaaaattccagccagagagcttgttttgatctgctttgacatcgaaaacgaattctcaatccagattccggaacgtgaattgcttgcgggaagcgtgaaaaattatgtgagaatgaaacatatggtggaaaacttgttaagatttttatagattaacagttgaaatcacaggaagaaggaggtgaaatatatgcagaaaagattaggcaaaaaagtataccgaaaaatgcctacgatgcaggttttagcagggtgtgcttgtatatcactttgcaatgcttctggaagcagtatgtcaaagatgctttctattatgatcgcaccgtaaggaaaatggagaggagattacagcaacgtaatctcctcttcgtcataagataataaagggatatcggagaatggatgctttaaagtatgatttgaaacaagtaatattcatatgcaaaaggcaagtacttttactttttgtatgtattataatagaaggatgtatgacctatgcccaaccgttgctgctgacaaagattactgaccaagggattcttgggaaaaacttaacagcacttctttcatcggtactattttttgtcgccgcgaaagtgagtgtggcgggaatgggagttttgcgatcctatgaattcgtgaaaatacataatcagatgtttggcagattaaatgaaaaggcatttgctaaattatacagaattccaatcagcatgtataaagagaaaaatggaatgcagattcttcaggccttgcagacagacatccagtctctttcttccatttttgatgaaatagcagcattgtcagtaggagcggtttttcaggtgattgcaggtgcagtcgggctgtctgtaattagtcctcaaatgacaattttgttatttgcgatgattgtggcaaaatttattatcgttgtttttttctcacaaagaaagaaagaagttgttaaagaaaatttattgatgaataatcaatttatggcttggttggaagaacagattagtgggattcgggagatgaaactttggaatctttatacgtttcagaataacgaattgaaaaaattacagaagaagctgctgcagtcttatcaaaaaagcgccatgtgggatcagaagtattctttttgtgaagtgagtgtagatacactgattatgggatttttgtatcttctgggagggtatctggtaatcatgggaaaaacgaccgcaggcagtctattagcgtttattacttactgtagtaatataacaggatcgatcacgttgctgatcgatgtaagatactattttgccagaatcaaaccttcagcagagcggttttatgaatttttaaatgggaaagaggaaaaggcaatattttcaaaaaaggtgtgctataatgaaaatgataaggagcttatccccgtgattgagttttgtgatgtgacgttttcgtatcatgggcagaagcctgttttagatgggatatctttccagatctatcaaggggagaaggttgccattatcggcaataatggagttggaaaatcaacactttttgatttgattacgggactatatcaaccggaccaaggaatcattaaaataaaaggaagagatattcgtgaacttggtttggaaacgatacgaggaaagattgctgtagtcagccaaaatccgtttttttataatacgtctgttattgataatatcgatcttggaaggcgaaataacatggaggacgtggtacaagtttgtcgtttgagcggagcggattcctttatttctcagatggaggaaggatatgaaacgatgcttggtaatcgcggattgaaactttcgggcggcgagagacaaaagatagcggtgtcgagggcgctgttaaagaaagctgaaatagttcttctggatgaagcgacgacaggatatgatgtggattccagaaaacataccatggaaagtttgttttcaaaacagacacttgttaaagtcacgcaccaggaggaagagctaagagggatggattccatctaccgcttacatcgagggaaactggaacgaatacgaggaggagaggggaaatgaaaagaaaaagagcacttgacaggtttactgcgatccgactgattgccggaatagcagcacttttgacgttctgtctggtaaaattctatattgatggagaatttcggacatggatggaagtactggaaagactgaccaagggagcagggattacaccagaatatattctgttttttatccctttcggattcgtgctgctctatcttattcgggaacttttgcttctggcagggaagtggtggcgatggttttcctggcttccggcgctgggatctattacgtttgcaggagttttggcatttataacgtattcggccgatatactcctttatgcgaagattccgttatattatcttgccatgtttaccgtggagtttataagtattaaatacctggaacagagagaagacctgaacgagcggtatgaggagatcaaggcgcgagagaaaaaagataaggaacatcggaaaaaggccaaccattttccaggcaaatatccgccggaattttatgaagtgattcgccagaatttccgttatcactggaaggagcagatcgtttttcttatttccggaattctgctcgccgcaatctgctatattgtttttgccatatattttatgacagatcggatttacggaggtaaagggaagacgagtttcatgttcggtcagggaatccatgggatttttcagagtcttgccctcattctgggcgtgttaagtgttctgatgatggtgctgatgatttcctggtacattaaggagcaaaaaaaagaataccggctgatggtgattctcggaatccgaaagaatactgcataccgcatctttctggtagaattttcgatcaatgtgctggcggctgcggtaatcggtcttccgattggaatgattggggcagctgtcctgcgaagaggatttgcaaggagctttcagggacacatagagttaccatccgtcgtcagtgtttcccaggttctgatcggttttgcagcttatgtgatgttgatgattctggcgcttggctttaaccaggaaaactttatttcccttggaaactccacagaattaaatgaagaacggaaaaaagagagaaagcctgagagacgactggctctttggattgtatcgggaattggtttatatgtcctcgcaatcaaatggattacgattcgtggctggacggagatgaagtttatctattgtctgccggcgcttggaattttctttttgctttccggtgggatggcgctatggctgaaaaagcggaagaacggggcgggctattacaaacacctgttccggtggaatccgttttactatcggttttggaagaacgttatggtactgttttatctgtccgttgtccagtttttgctcctggcgctgttttctacaccctttatcacgtctaatatgaggcaggatatcccagctatgtatccgtacgatatcgtgtgtacggcatatgagacggatctttcggaactggagcagattgcggcagacgcggacgccacagtttaccagtatccaatggtgcggatgacgtcgctgtatggaagtgatacagttccaaactggaatggttctacacgtccggttcaatggccacagggacagcatatcgcaatctctgagtcgacctacaatcagatgcggaaaaacgcggggcagaagcctcggaaactgggattgaaggggaaagagatgcatgccgtctaccagcaggatctgtcggtcaaagcaaatgttctggattgggatacgaccaggttcagcgtacatctccgatttgggcagccgcttgagtattatgatacagcgggatattggaatgtatttcctgaacgggaaattgtaagtgaagagagaaacagtctgatcggagcgtttcagcaggggaaacaggaaaatctgattgtgctgtcggatgcatattttgaagaagtctggaatcagatcagtacacaaaaccgggagaactgggccaaaagggaaacgatttcaaaggcggagtggaagttttattcggctgtccacgaagggaatctgacagagggacctacgatgctgtactgcatgaatgtaccggacgggaaatcagcagaggtggcagagaatctggaatatttaaaggagaaacacagcctggatcgtgtctgggaccgttctatccagccgttttatgagaggacgcagatgatccggaatacggaatccgaaatccttctcgcacggacagccaatggatttattcttctggtactggtgattatggcagcattccagtattttctttatgtaaagcaggaagaagatacatggaaatgggaagatacattcctggaaaagattggtatgaggagaaaagaaagggcaaagaaaataggatttcagcttcgtttctttatgctgctcccgatgatccaggcagtaatcggcggaattttctttattggaattactttaaaggccaggttgtttacggtgtcagaagtcctgagatatggaaggtttatgggtatcatgtatgcaatctatatattgttttggctttttatctactcgatgatgcaaagatatgtcctaaaacgtctgcaaaaggagaatagttaaaagtagaagaaatgattgtgacacacagagcaatcataatttccaacagcaaatcgggcgaaacccttccgtaagagacggcctatgccgtttctatcattaggggctccgcccggttcgctgttactgtttgttttttgagttcttttttcggtatttcacacactcagttaaaagatattcgatctgcccgttcatggaacggaaatcatcttctgcccactgggcaatttcattgtaaaggctttgcgagagcctcaaagggacttgttttttggcctttcccttttccgctgtatttttttccaaaatgtgtcccaccttttttctggatttagtagatggtaccgctatttacaatcggctgtgcatccttgtttccacacaacacgacaagtagattgctcaccatggcggctttccgttcctcatccagttcgacaatctcgttttcgtttaatttatccaacgccatctgcaccatgccgacagcgccttccacgatcttctgacgtgcatcgatgatagctgccgcctgctgtctctgcaacatggcggatgcgatctccggtgcatatgccagatgcgtgatacggatgtcaataatctggataccggcgtcagcaactttctcctgaagttccaactgcataatatccgcgatttcctggctactgccacgaagtgacttttcgtctccctgctcgcttgtatcatacgggtagatgcgggctgtgtttcggatgatagcgtcgcattgaatggagagataatttttatagttctctacattgatgaccgcctgcgtcggattgacgactttccagatgacgatagctccgatttctaccggatttccaagctcatcattgactttctgcttaccattgtcaagcgtcatagtcttgagggaaatctttttcgtgcccgttgtgaccgatgtatgaccgtttgctcccatggtgaaagaattcttcgagccgatcgggttgatcggggagcagaatggattgatccagaagtaaccaggctttttcagtgtgccatagtatttaccaaaaagggcaaatacaagggcttcgttcggatttaagattttcagtccgcagtacagaatgatggacacaatgaaaagcacaagaccaagagcgatgaggaatccgcagagcccgcccgaaatccggtccataccggaaagaaccggacccaagatgcacatggcgatgctggcagccagcagcagtgtgctgacaaataacataagaaatccatttttcgcattgataatgcgttcttcgtgaaccaaagattgttttgtctccataactcttcctccttcagtcttacatgagttaaagtgatattattttgatatcataatagatctaaagcagaaaattgtcaagagaaaatctatatattttttcggaagggaaataggggtaacccttggaaaaagtacataaaaggattataataatagtagaaatctttgacatacattccgctgatgtaaaggaaaagaggtgtttgtatgagagcagtaagacaggaaagtgtggaggctatgcgtccggtcagtatttacaccgcaggggatcggattgaggccgagatgcttttagaggcacttcagagaaacgatattcagggcttccgggaggcaaggggttccggaggggtcatggatgtctatacggggaattctatttatggagagaagatttttgtagatgaaagggatgcacaggaggcaaaggagattatcgattcgattctggctcagacggagcttgaggtggagccggaagatgagattaccgatcagactgtgaagagtccgaggtggcttaggagcagtatgggagttctgcttgctcttttacttgcgtttttgatcggaggaactgtgctgagtatatttttctaagataaagaggcggtatcgtctccggagagattctgtcgtaatgaatcagacaagagagctgaatcgttacacgttcggaggggataccgctttttaaatgcgttgctttgtgatacactgtaagggtaagagctgatgacaaatacgcctgagtacaggaggaagaacatgagatttaatacgcaaaaatacagacaactggaattgtttattaagacagaacctggggagacaggcagactttatatggtttccggaagtgcgcgcaaaatgtttcagatcagtcaatacagaaagtggctgaaaattacggtgaatccggggacgacctatgaggtgtcggctgagaactgcgagatttcctatgcctatttaagcggctgtgagcagatgctggagagaggcatctgcatgatccaggacggaagattttatgacaggagtcagtggggtgaatggtatgacacgcccatccgtaaccagtaccacctttccccaccaaagggatggatgaatgatccgaatggattttgtgtttatcatgggtattatcatctgttttaccagtttcacccattttctgaggagtgggataatatgtactggggacatgcggtaagccaggatttaatccactgggtacatcttccggtgtgtatggagccgcagcaggagattttgaactatccggagctggtgggcggcgctttttcagggacggcattggttgacgaggagcagaagctcagactgttttttacgcgccacatcggaaagagaagagataggacagctttcagggagtatcaggtgatgacggagagccgggacggcctgaactgggagcgggagagccggattattgaaggcccggagggccgggatttccgggacccgaaagtattttatgagaatggagaatataagatgcttatcggtatcaggggtgaagagcatccggccatatccctttataaatcctacaatctggcgcagtggacgtactgtggcgagatttttgaggaacaaaaggaggaggagaattttcctctggaatgtccggatctcttccgtcttgacaaccagtgggtattgactgccggatactgcgggcatgtggacgggcacggaagaaaaaacagcatctattaccacatcggagaatggtatcaggatcagttccatgaggaggccagagggctttatgattttggcgcagatttctatgcggtgcagactatcgatacggagaccggacgggtggctgtcggctggatcagcgacgtggcaaaggagcacgtcaaatcgccaaacggtgcgtgcggaagtatgagcattccgagggtacttcacatcaaggacgggaaactttaccagaatccggttcagggaatctaccggcttatccgctacccggtctacgaaggatgcggggaggacgtggaggttaccggaattgagggcaacacctactatgtcaaattagagatggagaaaccatcagattttcgaatgacactttataagtggaaagacaggaagctgtatctggagcaaaaagatggccagtgccgtttccggaccgtgggagaaggagcaaaaaatattctctatccggcggaaatcagtgatgttaccacggtagaagtatttgtggaccggaacgtgtgcgaagtattcttaaatgacggacaggcagcgggggcgaagaaattttaccagcagtcagagaccggaaactttgagttccacgtacaggagaaaggcacagtgaagtctctggtagtagagaaaatggagggaatttggaaacagtgagaaagatcagggcagtattatttgatatggacggcgtgctgattgacacagaaaaatatctgacccgcttctggagacaggctgcggcagaggcggggcttcttttaagtcttgaagagtgttatgcgttccggagctttgccgggaaatatgcggcgccctggtttgccgaaaaatatggagagcagtatgactactggacaattagggagcggagaaaggaactgatgcaagagcatatccgggtacacggaatagagaaaaaggatggcgtggaagaggtgcttcaagtccttagccaggaaggataccagacggcggtggtgacggcgacagatgaaacgagagcgagacagtatctaagagatattggaattttagagttatttgatgctgtcatctgtgcgaatatggtagagcgtggaaagccgttcccggatgtgtacttgtacgcctgtgaaaagattcagaacagaaagaaccgcaggactgtgtggcggtggaggattctccaaacggaatccgggcggcgtatggcgccggatgtcatgtggtgatggtgccggatttgacgcagccggacgaggagagccagaaccggatcgagagaaaggcagcatctatccgggatattcccggagttgtccgggaaatcagcagaggaaaattgcaatacgggaggtaaagatggggatatttcggattatcaggggcgatattacacagtgcaaggtggatgcgattgtcaatgcggcaaatccgtccctcttagggggaggcggtgtggacggcgctatccattcggcggcagggccgggacttctggcggcgtgcaggaaacttggcggatgcacacctggagaggcgaagattacggagggttttcaccttcctgccagatatgtgattcatacgcctggaccggtctatcagggcggaacaaagggtgaggagaagattctcgcgtcctgctatcagaacagcctgaagattgcggcttcttatggactgaaaacggtggcgtttccgtccatcagtacgggaatctacgggtatccggtggagaaagcttccagaacggcggttcgtgagatcctcatctttcttcgtacccaaagtatgataaaagaggtgacgatgatctgtttcgatgccggtacgcagaaagcttatgaggaggcatggagagagatcaacgaggtagattttacgattcagaaagcagaggaatccgatctggcggatattcgtaagctgatgaaaaagaccgtggttcatatggagaattctgactggttttatgacggaggaaaggatttccttgtgacctgcttaaaggaggatgagacgaccggatttgcggttatagcacgggtaaagggtggcacgaaaaagggctctctggccggatgtttccttgcggagattccaggagatgtagagtacaatcttggaaaggatctcggattttctaaggaacagttacttgtcagtgcccatatggacacagcggtagtggatcctctataccgggggcatcaccttcaggatcggatgatggaagcatgcgagaaggaaatgaagaagcgtggcatccactatcttcttgtaaccgtccacccggacaatccgtacagcctttccaatgtacggaaaagagggtaccagatccggaaaaccaaggagaagtacggtggatcgctccgtcatattctgtgtaaggaagtctgaagatatggcagtgttataagatggcggcgccgaggagagagaagaaaaaacgttgacggaggatcggttttccgtaataatgaaaggtgcctgaaaaaagtatggaaaataatacaaaggagagaacatgatgagtcaacatcaggaacaaggtacgagaaaaagaggcggctttggacttttgaaattttatctttcacagaaaatcatcaaaatccttttgattcttgttgtcgtggcggtagtgattttcggcgtccgcaaaacgttcttcacggagagtaagataacaaagcttggatttgaagatatcggagagctggcgactcagtgtgcctacacgacggaagttggggtgcaggagggatccagagaattgtttggtatccagattccgtttacacaaagcaaatatatttacagcatggatttcgagatcaaggcgggaattgattttggggacattgactgggatctcaaggataagataatcgaagtacggctgcccgaggccaggatcttaagtagcgagatgaaacaggattccttccaggtttaccacgaggaggagagtatttttcggcagatcagactggaggagatcaatgatggatttgaggatatgcagaagcaggcagaaaaagacgctgtcagtaacggacttttggaaaacgcaaaaagcaatgcagagacgatcctcaaggagttcttcgcaaaagaatatgacctgaaagaatataagattacgtttcgtgagaaataacaggagtgaaaaaatgaaaaagaagattcttacagtacttgccgttgttgcagcggctattttcattttctattttattttgtttctgactgcatagggttccgatgcgacggaacccggccaaaaggttgtaattattcagaaacaatgaaaaaattctcaatgacatgtagtaccccgtcttcgtcgttggacaatgtaatgtaatctgccgcttctttcacggcagtctgtgcatttgccatagcgacaccaaggccggcggtttcaagcattgtgatgtcattacagccgtctccgcagcagaccatctgctctgtggtgagtccgatactggaaaggagtttacacaaggagtgtgccttatcgatattctgcggcatgatctccagaaagaacggatcggagcagtaaatatttagaagtccgtgaaagtaaggaatcagccgtttttttaccatggcgatatcgtccgggtttccggtaataagaaatttattattctcctgttcaacagaagccggaaagttatctacatggataacagggagcccgttgattgtggactccaatttggtgtactcatttgtctgaagtccggagaggataccacgactggagtaaccgacaatgtcgaccggagcgtctttgataagttcgaagaggggctttgccacatcttttggcagaagacgattgtaaacagtctgaccgcttcgacagtcagtaattcttcctccgttgaaggagagaatgtagcttccgaatcgttgcaactgcagttctctggcaaggggaagcaccccggttgtcggacgtccgcttgccaggaccactttaattccggcttcctgaatccggattaacgcctcccgtgtgggaggcgtgatttgtttttgggagttggtgagtgttccgtccagatccagggcaagaatctgatagtctatcattgtttggctcctttttctatctcatctttcgtgttagcttcgaattcggtgagcgcctccacgatttccgaaaacttcatactattggacgcttttacaagaacagtatccccggcctcaaacaaggacggaagatcgtgtaaaaattccttcttgccggtatagtgaagaactgtattgccggaagcaagattcttggctccaaggtacatctgacaggccagcggtccaatacagacgatagtgtcaatgccctttctggcggcatactctccggtctcaaaatgaagctgctcctcattctctcccagctccttcatatcccccatgaccgcgactctacgacctgtggcaagtgcaaggacgtcgagggacgcccgcatggatgccgggttggcattgtaacagtcgtccaaaatcatcagggtgtccgtttcaatgagatggttacgcccggtcaccggctgaagggaatggattcctgtctcgatctcctctggggaaagtccaaagaggtgcccgatgtaggcgcctgcgagcgcattgtacaccatatgtttgcccggaatcgggatgtcagcctggatggtggtctcagaaaagtctccacatgcaggaagctggatggtgcagagcgtcccttttaaccctctgttttcgatgtgggaggcaaagaccggggcggcggaatcgatgccaaagaagaccggtttttgtccgtgcacatcggtcaccgtgcggagcatatcgtcgtccccgtttaaaacaaccgcaaactccggctgtaaatggtcgaacatttccgtttttgcctgtaaaattcctttccgtgatccgagattttccagatgcgcgtatccgatattggtaatgacacagacgtttgggcgggcaatatcagccagacggtgcatttccccgaaatggtcgattcccatttccagaacagcaatctcatcttcctcggtcagacggaaaatcgtcagtgggagtccgatttcattattataattcccctctgttttcagcacccgatatttctgttctaggacagaagcgatcagctccttggtactcgtttttcccacgcttccagtaattccgatgactttcagatcaagctgacttcgataaaagtgtgccagatcttttaaagcctgctcggtggagtttacaaggatataaggataccgcgccccggtaagcggatgctcggataaggtgcaaagagcctccttttccatgacctgttcaataaagtcgtgtccgtccacccttgcgcccttgattgggacgaagaggaagtccttttcgattttgcggctgtcgatggccactcctgtgatttcccggtttcgagcgtcctcagaacccctatatgtaccgccgcaggcggaggcaatatttgccagtgataaccctttcatatgttttctcctgtctttggtgattacccgcagtaacgggcgtccatcgatttttcaatcagcagttcacagagctctccaaactcaataccggcggcctttgcctctttcggaagaagacttgcggccgtcatgcccggaaggctgttatactccagacaatagatgttgccgtcctctgtcagaaggaaatccgcacgggcatagacatcgagcttgagtgcttgaaacgcatgctcggaaattgcctggattttctttgctgtctcttccgggatacgggcagggcagatctcctctgtcatgccgtcttggtatttattggcatagtcaaaccatccggttttcggacagatttcgatgaccggaagggcctttccgtcgatcacaccgcaggcgagctctcgacctttgatgtattcttcaataatgatctcatcctcatagcggaaggactctttgactgctttatcaaactcctcctccgtctgtgtaatgtagactccgatactggaaccaccagagcaaggctttacaacaagcggaagtggaagtccggtggaggcaagggagtgatccgcggtggaccgtttcatccaggttccctttggggtcggaatatgatttgcctcgaaaatcaccttggtgatctctttgtccatggacagggcacagccaagggagccagaccctgtgtaacggatgccaaggacgtcaaaggcagcctgaagctttccgttttcacctacatcaccgtgcagtcccatgaatacgatatccgcgagacggcaaagttcgatgacattggctccgaaaaagcagtcggatttgtcttctctggaagctttcaccgcttccagatccggctctgtagaacggatgcctgatgcaagggaaagccccgcatcaggtcttgtaaaaactgcttccagattgtctcccgcgtccggaagtcccagaaacggatccagaagaaaagcgtcgtgtcctttttctcttaatgtacggcatataccggcgccggaactaagggaaacgtcccgctccgtgctgagtcctcctgccaaaacaatgattctcatagtcttcgattcctccttataaattatccatactcatctggtccaaaagctctttcttaacctgatataagcgatctgaaagatccacatacacattgtgcgggtagaagagacgcttcgtctcatcccacagagtatctttttcctgacggcagtattcggcgatttccatgacggacggcgagtgatagacacattctccgtttatgaaaaccgggacgagcatctcacgcattgtataggtgccgcccttcatccgcgtttttttccatgtctcgatggggtcaaagagcagaagatcgtcattttcatcaaaagtctcatccgcaaagcagatcaggtcagccttgatctttccggtctccttttcgtaaatcctgtagattgttttgttgcccggattggtaatcttttccgtgttctcggagagcttgatctttggtacaaacacaccgttttcatcctggatggcggccagcttatagacgcccccaaaggacgggcagtccttagacgtaatcaggtgggttcctacaccccagacatcgatggcggcaccctgctgtttcaggtcgtgaatcaggtattcatccaaatcgttggaagcagaaatttttgcgtctgggaatcccgcatcgtctaacatcttgcgagccttcttagaaagatatgcaagatccccgctgtccagacggattccaaagcttttggaccggattccctcttcccgcatctcacgaaagacgcggatggcattcggcacaccggatttcaatgtgtcgtaggtatccacgagaagggtgcaggagtccggatacattctggcataagctttaaatgcctggtactcatccggaaaactcataatccagctatgggcgtgcgtgcccatgaccggaacatgaaacatctgtccggccagtacattagacgtgccgacacatccgccaatcatggcagctctcgccccgtaaagtccggcgtccggcccctgtgccctgcgaagaccgaattccatgatacctccatcgtttgccgcataaacgatgcgggcggtcttggtggctatgagggactgatggttgacaatatttaagattgcggtttccacaagctgtgcctccatgattggggccaccaccttgatgagaggttcccttgggaagatcacacttccctccggaatggcatagatatcaccgctgaaatgatatccacttagataatgaagaaagtcttcgtcgaagatgtgaagacttctgagatagtccaccgcttcataggaaaaatgaagtcccttgatatactcaatcacctggtcgagtccggccgcgatggcgtagccgttgttacatggattggcacgataaaaaacgtcaaagacaacaactttgtcgtgatccttctccttaaaatatccctgcatcattgtcaactcatacaaatctgtcaataatgttaaattacgttccagcattggatacacttcctttcgctgtgcggcctgacacacagcctatattataaaatagcgatgggccaaagtctgggcatgatgtgaccttggcgaccgcgtatcaacccggaatgtgccttttggcacttctggtgattcagcataatgctggaaacattatagcactcatccgggcaaaggggaagaaaaatccgtgttgaaattgaaaggctgggagaagtagtatataatagatgtaaaaaaaggacatttccagatggaaggaggagtcaatatgaccacacgaaacgtgacagcagcagattttggaagcagatatgaggctccgggggccgaactggttcgtattgcatgccagttccagagccggatcttactgaagagcggggagatgcaggtcaacgcaaagagtattatgggaatgatggcatttcaaccgtcaaagggaatggaaattgagatcacagctgagggatgcgacgaagagcaggctgttctcgaaatagaagcttttttgaaaaatgaatagagtacataaaaacgggtggagacatacaaatttccacccgtttatttctatacgatttctacatttttctgaatggtctctttgatgatctgctcaaaatacggggcgagatgctttcttgtctccttgtcaagatccttcgggtagaccggagcgccgtactcgatgacgacgtgggtctttttgatcttaggaaagtgagcctcaaacatctctgcggtattgttgagactgatcgggacgatggcgcacccggttttctcggcgatcttaaaagagccctccttaaaaggaagaaggcttaactcctctcccgaatttctcgtgccctccgggaagatgcagatcgagataccgcgtttgatataatcaatcgctgtcaggattgtcttcatcccctgcttcgggtcgtgacgatccagaaacaggcagtaaagatacttcatccacgtggagagcaacggaatcttctccatttccttcttggcaacatagccggtcagacgcttgcagcgggagtaagtcagaagaatgtcaaaatagcttctgtgattcccgataaagagtaccggttcatccggtacattctcaaggccgatcactgtagtctctacgccagcgatccgcaggatacaacgaaatccccactggacaatccgcagggaagaaaaatccctcgtttcccggtttttctttccgatcagccattccacgaagaagaccggaatggaaagaatcaggaagaccaccagaaaaatggcgacacagataaagcgaatcataggattagttcctttccaaaaaagtttaatagacaacatgtcgagaaacgacatatcaacaaagtactatcattatactataaaaatgctgaaaaagaaatccggttttgtcatttttttcaggaactttgtgtaagatgataaagagaaaaagcaggatcgcatcgtatgggcaaaaaagcaggaaatttccgaaaaatcatcttctcctgtactgcgatacttttcctttttttggtggccgggtgctcggttacggatcttggaggggagaagaagcaggaactggattttacggtcctggaaaaggaagacataccagaggaactacaggaaacgattgaggagaaaaaggacgaaccgatgaaactgacatacacagatcagggacagatggttctcgtcagaggatacgggaagaaggaaagcagcgggtacagcattgaggtgaaagaactttacgcaacggaaaatgccgtacatattcgtaccgagcttaaaggaccgggagaaaaagagcaggtgatcgagaaatcgacgtggccttatattgctgtcaaactggattatcataacagacatgttgtctttgaagaatgaggaggttccctatggagttggtgaaaaaacagattgtaaaacagtggagtggaaaaccggttacggaccagtttctgattgatgaggactacaatgtgccggataataaaaaggatatcaaaaaggtgatgatcagtgagggcgagctgcggatcgaagaaatccgcaaggtggataactatgtgaaagtccacgggaaactattgtttcacattctttacgtcacggacgaggcggaagaaaagatggccgaattgtccggtcagtttccgtttgaggagatggtttataccgaggaggagaggggtgactggctgatccgaagcacccggacggatgtgacggcggtgatgatccactcccggaaactcaatatccgcacgatggcggaaatggttcttgtaccggagacaggcgaagagggggaagtgaccgtggatgtggagggcgttgaccgatgttgtaagaaaaaggctgacaggcgggttctgaaaatgcagaatacgcttcgggatacctaccgcatcaaggaagagatccggctcccaaaaggaagggaaaatatcgccgccctgctgtggacggatatgaaaccacagcggctggatacgaagctggtggcagacagcctcatcgtggagggcgagctgttggtattctgtttctatgaaacgccggatgagacactgaactggatcgaggaaccggtgcgctttgaaggcaggatcccgtgtccgggggcggatgagacgatgtaccaccagattgacactgcctttacggatgagaatgcggaagcaagactcgatgaggacggggaaatgcggatcatcggaatcgaagcgtccctggaggtgaaagcgtcggtttttgaagaggaagaggtggagcttctggaggatctttattctttaagttgcaatctcaccgtccagaaagaaatgcaggagtgtgagcagcttgtcatgcagaatcatctcaaatgcagcgtcagtgagacactctctcttccggagctgaaagacaatatttttcagatctgccatacatcgggcagccttgagattgtcagaaccgaagcaaaagaagaaggaatccaggtagagggcatcctccatatcggatttttgtatgtcaaaccggatgatgatattccgtttgatacttggcagggtatggtaccgtttacctgtgtgctggaatgtaatgagatgtacccggatgtacgcagctcgttaaacggctacatcgagcagctctccgtaaatcttctgggtcagggaaaagctgaggtcaaggcgacggtctcttttagggcgttggtgcggcgtccggtgtcgattgagaatatcgctggactgactgtggaggagaggtccatggaagagcttgcaaagcggccgggaattgtggggtatgcagtcaaggatggagacgatctttttggacttgcaaaacgctttggaacaacggaggagagtatctgcgaggtgaatggaatcgagaaggaaaaagggctccagccaggtgagaggatattgatttttaaggagaatttgagtatactataaagaaatgtatacaaaatacatagtgtcccattggggcagaagagaaaagagtgagaacaaggagagattggatggaacggattcagctaaaagcacttgggaagattaatctggggcttgatgtacttggaaaaagagagaacggttatcacgatgtcaggatgattatgcagaccgtttacctgtatgatgaggtgacgctagagaaacggcaggaaccgggcatcaccgtgtccaccaatctcatatatttgccgacagataagacaaatatcgcataccgcgcggcgaagattcttctggatgaattcggtgagaggcgcggtgtggcgatccacttgaaaaagcatatcccggttgcggctgggatggcgggcgggagcgcagacgctgccgcagtgctctttggcatgaaccggatgttcgggtggaagttaagtgaaaaagaactgatggaacggggcgtgacccttggcgcggacgtcccgtactgcatcatgcgtgggactgcgcttgcggaagggatcggggagaagctgaccagactccctgccatgccaaagtgccatctgctcatcgcaaagccgccgatttccgtgtccacaaagctcgtctatgagaaactggacgcattggcgatcgtagaccatccggatatagacgggattatcgaaggtttaaaggaccgggatctcatccgggtggccggatccatgggaaatgtcctacagaatgtgacagagacagagtatccggtgattacacagatcaaggagaaaatgatcaaaggcggagccatcaatgcgatgatgagcggaagcggtccgaccgtatttggtcttttcaaagagcgaagtatggcaaagaagacggcggaacagattcgacagttgggacttgcaagacagatttacacgacaaccattcacaatgtacgaaagaacaggaggagcgatgaatggaagcagatttcggagcagaaatgaatgagtatcttccgctgcgagacgtggtgtttcagacactgcgtcaggcgattttacgtggcgaactaaagccgggagagcgactgatggaagtgcgccttgcaaaaaagctcggcgtcagccggactccgatccgggaggcgatccggaagctggagcttgaggggctggtgctgatgatcccaagacggggagcggaggtcgcggagatcacagagaagagtatgagggacgtgcttgaagtcagaagagccctggaggtgctggcggtaagcttaagctgcgaccggatttccggggagcagatcgaagcgctcaaagaggcggcagaggaatttgaccggtccctgacctcggatgatgtgacaaggaccgcagaagcagatgtccatttccatgatattatttaccgctcgacagacaatcagaggctgatccagcttctgagcaatttgggtgagcagatgtatcgttaccgggtggaatacttaaagcacagggagtttcacccgcagatttccagggagcacaaggagctcatcagctatctggaagctggacagaaggggcaggcggaagaaaagatcgccgtccacattgacaagcaggcccaggccgtcctggagacgatccgccggaacagaaatccggaaaaaacagaataaatcccggagatccggcaatactcctgttaaatttcagatgaaagtaacgggaggaaagtttggatgatgacggagagaaaacgaaaatgggtgatggcagtttcggctgtcatcctttctgcgatgctgactgcctgtgtctggcgtacggagacggtcagtgctaagatggaaacggcacagaagcacatggcggaggaagtgctgcgcttccatgtgcttgcaaacagcgacagcaaagaggatcaggagctgaagatgacagtcaaggatgaggttgtatcctggctcgaagcaaagatggactgtaatagcctggaagagaccaagaactttatccgaagccatttaaccgggattgaggaggtggccgaggagacggttcgaagggaaggatattcctatccggtgcaggcagctttggagtggacagacttccctgagaagagctatggggacgtcacttttccggcaggttcctacgaggcactccgaatccagattggggaagccaaaggccacaactggtggtgtgtgctctacccgaatctttgttttatcgacagtgtccgggcagtcgtacccgaaaaagggaaaaagcagctcaagcatgttctgacagacgatgagtacgatatggtaacggcgacctcaaaattcaaagtgaaatggtttttctttgggtcgtaggaggggctctaaagcttcagaacaaaagacgaaagggaaaaggaatgacagaatttttagtaagacggtttgtcaaaaactatgaacatacagagacagtagcagtacgtacagcatacggcgtactggcgagtatggtggggatcttttgcaatgtctttttattccttgtgaaaggagctatcggcattgtgcttcacagtatctctgtcacggcggacgccttcaacaatctctcggacgcaggctcgtcgattatcgggcttgtaggcgtcaagatggcggaaaagccagccgacgaggagcacccgtttggacacggacggatcgagtatattgcggcgcttattgtggctttcattgttctggaggtaggatttacctttctaaaagacgccattggaaaaatccggcagccggagatcctgaaatttaacacagtgtctgtggtgatcctgatgttttccatcggagttaagatctggcttgctttctttaacaggaagctgggcaaaaagatcaattccaaagtgatgatggcgacggcagccgacgcaatgggtgatgtagcgacgacgacggctacgatcctgtccgttttatttttccgggttacgggaatcaatattgacggctttgtagggattggcgtcgctctcgtcgtgatgtgggcgggcgttggtatcgcaaaagatactctggaacccctcattggtgaggcagtgccgcaggagacatgtgacgaaattacgaaatttgtggaatcctacgatggaattgtagggacccacgatttgctggtacataattacggaccgggcagaagcatggcgtctattcatgcggaagtaccaaacgacgtcaatattgaagtgtctcacgaggtcatcgataagattgagcgggatgccagaaaatatcttgggacctatcttctgattcatatggatcctatagagacaaaagatcaggatgtaattaaggtaagaaaaaaagtggagcatatcgtaacacagacagatccggatgcaagcatccatgatttccgtatggtctcaggagaacatcgtatcaatctgatctttgacatggtgcttcctcacgggtatgataaagaagaagagaacacattgcagcgtctggtgacagaaaaaatccatcgtctggacgagcgctatcaatgtgtcattacaatggaaaagagttttgtggcagaatcaaaagaaaagtaagagagggatcatatgtacgagattaaaacaagggtacggcttagcgaagtatcggcggacggatgcatgactctgccggggatcatcaatacatttcaggatgccagcatcttccagtcggaggatctgggtgtggggacgaaatatcttgaggaacacaaaaaggcatgggtactttcttcctggcaggtagaagtacgacgctacccgaaactgggggaaaccgtcagcacatctacatgggccagtggatttcatggattttttggagaccggaattttattatgcaggataaagatggtgaagtcgtggcatacgccaattcgatctgggtctatatggatctggaggccggccggccgaccaggccatctgaggaagaagtcacccgctacggaatggaagagccgtatccaatggagtacgcgtcccggaaagtagcgatgccccaagaaggaattaaaggcattccggtcaaagtccggaagtaccatattgacacaaaccatcatgttaataattgtcagtatgtccagatggcagtggagcttctggaggaaaacggcgtggagacggactttcagagtctgcgcgtagaatataagaaatcagctgtttacggagatatcctttatcctgtgtacacgacagaaggcggcgcggcaacggcagcgttgtgtgatagggatgggaaaccatatgcggtgattgagctaaagcataaaggagaacaaaagtgatgaaattgggtgaaaaacaagtattgatgatggagaaggaagtggatttcggcgtatatctggggacggagtcagagcatgtcctcctcccgaaaaagcaggtgccaagggggctggagcccggagatccggtggaagtatttttatataaagattcccgggaccggctgatcgcgacaaccaacgaaccgaagctcactcttggcggactagcaatactggaagtcatcgacaccgggaagaatggagcattcctcgactggggtctggagaaagatcttttcctcccgttccgtgagcagacgacaccagtgaaaaagggcgacaacatactcgtaagtctctacattgacaagagtgcgcgtctctgtgcgactatgaaagtgtatgagaaactttcctgcgattctccgtatcagaaagacgatatggtagagggaatcgtatatgaactcagtgaccgattcggtgtgtttgtggctgtggacggcaaatattccgcactgatcccgaaacgcgaagtttatcatacataccgggtgggcgagacgatccgggcgagagtagccgcagtcaaggacaatggaaaacttgatttaagcgtgcgggaaaaagcctttatccagatggatgtggatgcggcaaaactcgtggaatacatggaaaagaacggtggacgtattccatttacagacaaggcgtctccggagacaatccgcggcgaatttgagatgagcaaaaacgaattcaaacgtgcggtgggacggctcctcaaggagaaaaaaatcgaaatccgtgaaaaggatattgtaattgcaggaaaataagctatactaaagatagacaaaataaaaaaaggagatcatcgcttacgaaaaagaagatatcgataagctcgtatcctttatgatttaaggctttgaaatcatggcgaatttagtcttagaagaacagcagatcatactataaggcgaaaggcgaaactttcgccttttgtcgttcatggggacgatagaaatgatttctgtcgtagctttctaaaaggaattcagggacaaaaaatggtaattcatggtcagaaaaacgaaaatactcgaaaaatgtagtacaatcccccatgggggaaaagggaaatgggaggataaaagatagttagccctgggagaaggagtagacagaatgaaagagaccaacgtggaagtcgaagggatcaaattggctgtctcaatgttccgtaagacagatccgaagcgatgccgggaagtccttcttgagagtatccgatggctgaaagaccgttacatacgtctgggagaaaaggaggatctgcaaaaagcccttctccatattcaggcatacggtgatcttggattcccatatcaggatgttgagacagatctgttagagatctttgacagcctgggggctaaaaaggaggtgagaaaggcgttccggaagctgttctgtgaaacgattgtcattaataaaagcgtaatcaaccggctccttgggagctggaatccggcccgacaatctatgcgtattggggatgcggtcaatgacattattcagaaggtgacgaaaaaagaagaaggcacctatttgtatcattgcggaaaacagcttgcacagaacggggaagacggtctgtgggagcatacattccgactcaggatacaggatggcgaggccattttccacaatgtaaatcagaacagatattatctgctgataaaggagggaaaataagatgtttaagatcgtgatcgttgatgatgacagacagatgcaggctatcattcgggacaaaatcaaagagaaaacagatgcattcagagacgcaaaaattcagatcttttcttctgcggaagcctttctggcagaggccaaacaggaagagcacggagaagagggcgatctgttctttgtagatattgagcttggagacggcataacaggactggagttcggacgaatcctccggaagaaatatccgaaccgtggactagtattccttacatctcataaggaatttgccatggaaagctatgagattgaggcggaccagtatatcctaaaagagcagatggacaaacgacttcctggaattctggaaaagttgatgtaccgtctgggtgctgagagaaatcagtacaggatgctgcggaacgaggacggagaacagaaaatctatttccgtgaaatgatctgtatacacaaaagaaagatgggaaaatatgctgaatttgagacgttccagggtacctttcgggagaggatctctcttgaccggcttctggaagaactggacagcaaggaattctttctcgcagacagaagtaatataatcaacctccgcaatgtccaaagtataagggacaatgttatctgtctggaggaaggacacaccttggagctgaatcagtaccggatagaagccgcgaaaaagaggatcgaggcttactggagggaaagaatatggaacgagcaacccacatcataatcttgactctgatctcatgctttgagatctggatgtgttatcagatcctgtaccggactgtgctggagaaacggtatttgcagacctggcagaaaatcctcatctggggaaatatcctggggatggggattgtgctgggtgtaaacagaggaatatttttcttatcaagtgctatattgtggctttgcattttctatacaatagtagtagcagtgattttaaatgtgaagagatggcatcttattgtagaaattgtaggaatttattatctgtttgtagcattattagaccttttctttgctttttgtggaatagcgattggaaatgatttttatcaagtgttttctgcatataactattctggagaaaagtgcatacttttcattttgtcccgaataagcattatatctattttgattttcttaaagaaagagagaaaaggcgaaattatagttgaaaaagcacaaacatttatgcttgttactatgggaattctagtggttattgtaacaggatatcatttcctgatttatgatattttgaacggattgtcagatgttagtggatggagtgcggcctgctccttacttgcgatctttgtcgttgttgcattttgcttaggaattagttggaaaaaccagagtctgaaacaggaaaatcagattctggaagtcagagaaaaactggaactggacaatatgcgagatatgatgaaagcattagagcagaaccggattcaggtacacgatatgcgtcaccatatgattattctgagagaatatgcattgaaaaaagagtatgaagcgatcgaaacctatgttgtggtcaagcatttttgtaacacttatggctaataaaatcggtggattgcagtttggaatctatcggaactgtggaggtgaaaactaacagttggttttcactgtttctgatacaaaaataacgggatcgcagagtattacactctgcgaaattgcagtaggtggtggacgtcatctggtacgcagtaagatgtaaagcaggaatggaacaacagacagcagaagaatggaatcaaagacatgacgggaaggcttgcagggcctttatcattacctatgagaagatgaaacgatatgaaggaagctggcatctgatctgcgagcctcttctgtcaggatatttctttctgaaaacagaagagtcgaaagtactggaggaggcgcagaattccatcccgattgattctggtgaagaacggtttctgaaggagttgggtggaagagaccatcacgtacccatgtcacggggatatatcagagaagggaaaacctgcgtgaccgaagggccgctttgtgggcatgaaagtcagatccaaaaaatcgacagacataaacgtctggcgcatctggactgccggatggatcagtatcagagaaaaggactctgggctggccttgaaattgtatcaaagagctaaaatagtatttcaaacaggaagtgcggacaggacaagaagttccagaaacatctgtggtaagaagccatggctgtggaagagaacggacaaagagaaaatttgaagtctggggtgaaagactaaaaaaatctttcactgtagatatggcgaagctatgtcaaatttggacatacttcccaggagaggagaagtcatgtggtatgtcatacagacgacgactggaagagaagaagaactaacagacgtactaaaatctatgctgccacagacgatatgcgaaaaaagctttttcatccggcgggagacctgctggaggctaaaaggaaaacataagattcaacaggaagtgctgtttccgggatatgtgttcgtgcagacacaggctccggaaactttattttatcaactaaaaaaagtaccgaagctttccaaacttttaagtgatggagaagaagaatttcttccggttcgtgaagatgaacaggaatttctggaaagcctgatcacagtcgaggagaaagatggaaaagaagtttatcttgtcaaacgatcagaaatccaggtcgatgaagaaggaaatatcgtctgggccggaacgccgctctcccgttatatcggcaatgtggtgagaaagaggatacggaagaggtacgtagtcatagaaaaagagctgtttgggaagaagcgaaccgttcttctaagtgttcggctaaaaggggaagaataagggatctgcagaaagcaatatcggacctattatatatagaagaaacacaataggaaaaagcagaaacaggagaaagagtatagagaagaggaggattttcggaaacggagatccttatttttgtggaaaaagtgaggagtgagggaagatgacgaatcttctgattttaggagcaggaggtcacggacatgtagtggctgagacagcaagagccatgcggtattcagatgggaatccgatttataataagatcgatttcttggatgatctgaagtcagaagctcttggaaaactccaggatctgccgctacttaaaaaagaataccaggaagtatttccggcagttggagattatggaaaacggttggaactgtatgcaaaagcaaaacgatttggtttttcagttccagtgttgattcatccagaagcatatgtcagtccgtcggcaacgattggtgaggggacagtaatctttccgaaagcagttgtacatacaggagcaaccatcgggaaagaatgtatcctttccataggaagcctaattgactatgattgcgttttggaagatggagtccatctggactgcggggctataatcaaaggaagcagaattcctgagggagagagaattccctgtggaatggtgatagaaaagcaaaaagaaatgagaaagagataaatagagatggggaagaaaacgaataatcgaacgaataatatgtttaatgatgatagtattttaaacggtgaatttcctattaaaaattttaaagcatacaaatctttttacaacagaatattaaaaaggattttagatatggtgtttgtaataatagcatttcttattatttggcctgtttatatcataataagtatagctatagtgttagaaacgggactccctgttctatatcgagcagagagaggtggatataaagggaaaaactttagaattttcaagtttagaactatggttcaaaatgcagataaaataggaggaggaactacagcgctgaatgatccacggataacaaaagtggggaatttccttagaaaaacaaaattggatgaaacagctaatcttttgaacatattacgtggagaaatgtcatttataggtccaagaccagaattagtgaaatatacagaacaatataaaggtgcagaaaagttgattttgcaggtacggccgggaataacagattttagttctattgaatttataaatttggatgaaattgtaggaagcgaaaatgcggatgataattatgaaaaatatgtattaaaaaagaaaaacaaactaagactcaaatatgtcgcaactgtttcgtttaaaacagatgtagaaatactaatagagactattcataaagttattattaaagcgaaaaaattcataataaaggatgcgaagtaaaagtggaatatataacattaaaaaattcggatttgagagtttccagactatgcatgggaggctgtccattaggagggcatggttggggaaatattcaggatgaaaatttaattaatgctgttcaagaggcgtttgagaatggaataaattttttcgatacagcagatacatatggattaggaaaatcagaagaacttttaggaaagtctttagaggggaaaagagaaaaagttgtcattgcatcaaagtttggagtaagagttgaaaatggaaaaacattttatgataacagcccacaatggattcaaactgcagtagaaagtagcctaagaaggctgaaaacagattatattgatttatatcaaattcattacagagatggaaaaacgccattaagtgttgtggtagataaattagaagaactaaaaaagaaaggttatgtaagatattttggactttcaaatattcatgaaaaagatatagaagaacttcaagagttcaaggggggatttgcgagttttcaagatgaatatagtttggcatgtagaaagaatgaggaagacataaactattttgctgaaaatataggattaacaccttgtacctggggaagcttaggtcaggggattttaactgggaaatacgataaaaatacagcatttcagactaatgatagaagatcgcgagatatatatgtaaattttcatggaaagaaacttttaaagaatttggaaattgtagaagttatgaaaaagatttctaatgacgtaggacgaccattgtcagcaatagcaattaggtttattcttgattatttgccacagtcagttgtattagcaggtgcaaaaaatgcatatcaagtgagagcaaattcagaggcatttggatggaaacttacgcaagaacagctcaatatgttagataaaatttcaaaatagaactaagataggagtggaaatgatggggaaaataacaagtgaacagttggcgtggaagattagacgtcacggtatagaaatgacacatttatcaagaggaagccatgtggcagccataatgtctgtagccgacattatggctgttttatatacagatgttttaaaggttaatcctcaaaatcctaagtgggagaatagggacagaatgattttaagcaaaggtcatgcgggagcgtctatttatgcagcattagcagagaataattttttttctgtagaagagttaaagacacattatcaaaatggaagtagattgtccggacatgtttctcatcatctacctggagttgacttttcaacaggatcgttagggcatggactgtcagcaggagtgggaatggcctatgcggcaaaaaaggataggaaagatcataaagtttatgttgttcttggagatggagaatgtgatgaaggcgctgtatgggaagcagcactcttcgcaaatcattataaccttaataatattgtggctatagtggatcataatcatatgcaaagtttggattattgtgagagaactttagaaatggaaccattttgcgaaaaatggaaagcttttggctggaaagtaattgagattgatgggaatgaccataaagacttgaaaatggcttttgaaaaggcaaaactcgaaaaagaaaaaccaacagttattattgccaatacaatcaaagggaaaggtatttctttcatggaaaaaaatatcctttggcattatcgattccctcacaatggttgggaatatgattgtgcggtaaatgaattgcacaggaataagccggaaggaattgaggatccatatacaccagaaggaattaaagatcctgaattaccggataataatgaagaaataaatgacgatcatacattaggaaatacatggcatcctaattattggaagtagataggagaattagagaagaatgagagatacgtttgtaaagactttagttaatctagcaaaggaagataaaaatatagaattaattacaggtgatcttggatttggtgttttgaaaccatattgggaaacggtaccagaccaatttacaaatgcaggaattgcggagcaaaacatgacttcagtggcagcggggatggcattggaaggaaaaaccgtttttacatattcgattggaaactttccaactttgagatgccttgagcaaatccgtaacgattgcgcttatcatcatgcgaatgtaaaaattgtatgtgtaggtggtggatttgtatatggctctttaggtatgagtcatcatgctacagaagatattgctgttatgagggcgctaccagatgttgttgttatgtgtccgggagatttggtagaagctgaagaagcaacaaaagcaattgcaaaatatcaaggaacctgctacttgcgtttgggacgtggcggagaaaagagaattcatgagaaagtagacaattttgaaataggtaaagcaattaaaattaaagaaagtgataagaagaagattgctattttttcaacaggagccattttagatgaggctagcgaagccgtgaaactgttagaaaaaaaggtaggaggagtagagcagtatagttttccaacagttaaacccttagatgtagaggtaattgaaaaatgcgcaaaatcatttgaagtaattgtgacgatagaggaacataacgtagtaggtggttttggaagcgcagtggcggaggtattggccgaaaatcctggaaaagcaaaattagtacggttaggaataccagatgaatattgtgtgaaagttggagaccaaaagtatttgagaaaagagtacggattggatgcagaaggaattggcaataaaattttgaaggaattagaaaaataatatgaagaacgatttagttagtattattgttccagtatacaatgcggaaaaaacattaaaaaaatgttgttatagtctactggaacagacttataaaaatatcgaaattatactggtaaatgatggttcaaatgatgatagtagtaagatctgtcgaaagtttgcaaaaaacgaccaccgtgtcaaatttattgataaggaaaacggaggggtaagttcggcaagaaatgctgggattgaatgtgcaaggggagaatatcttagttttgtggatagcgatgactatgtagataaagaatatatacaaaatatgtatgagaaaattcaaaaagacaattcagatatttgcttggcaggatactggattaaaaagcatggtttcgttcaaaaaaatgaaaatggaaaaggtagttgtttatacgatcaaagtttatattatgaaaaattactggattttatatggggaaaaaatggaatgtatttcccagttgcaaagttgtataggaaaagtttaataaaacaaaatgaaataaaatttaatgaaaatatacaatgcggagaagacatgctttttaatgtccaattttttagatattgcaaatctatgactattatttctgagtgtaattattactatataatgcatggtggaggattgtctggaaaatatcagcctcgtttttggagagatatgagtatggtgtatcaaaattatttaaagatatatgaggaaaattatccagaaaaaataactgaagcaaaggaaataattctgacgttgttaagaaatactatgttcaatttttattataaaaagagaagtataaaagaaggaacagtctttttgaaaaaatgtagcaacaactcagaagtagcagaaatattacaagaggtaatacctcaaaatagatttaatcaaattattttattttgtattaagcatggattgtattcagctttatgcataggatttaaatctaaaaatccgataaagaaatattttttcccggttttttgttttgtgagaaaatacatttaaaggatgggagtaatgagtatttttgtttttgcgttggttataacgattttattgccgatgattttaagaaaatgtaatgtagataataagcaaaaaaatatatatttgtatataatatttggaatactgattattatatcagggttacgcgctgtaagtgtaggcatagatagtaatagctacttcaatgagtttctaggatttaaatatactaatttgagcgacatcattcaaaatagccctatggatattgggtacataatatatagttacatagtttatattattataggaaatatccaaggcatttttttaatttcaagcattttgattagtattggatttgggtattggatgtataagtattcggaacatattgtgatatctatgctattgtacattgttttgatatttcctgttaccatgaatataatgcgtcaaagtatagctatggcatttatattgctagcgatttctatggtacatagcaaaaatttgagaaaagcaattattttcgaaattattgctatatgttttcatatgtcagcagcaatatttataccagttttatttttttctaaaagacgtaccaaaataggaaaaagtattctgtttttagggacattagcagggattattggaatagcactaggacctaaactaatcgaaatctttgttcaaattttccctagatatgctcaattgttattgtattctaactttacacgaggcgaggatgtttcaacgatattactgattgcttatggtgttttggggctggtgacttttatttttattataatcgaaaagaagactcaagatagtgaaatagaaattatttcatatgctatgtttatctgtttcttcgtgtgctactatctttcgaaatcaattgtaatagttcagaggataaaatattattttattgctagtttgctaattttagttcccttcgttttgggaaaatttttaaatacaagtaaagttggaagcagatgcatctattttgttattgaatgcggattaataggaataggaatttatttctataaacaggatggacaagggttactaccatttctattttattggcaagaaggagttatatgagagaattagtcagtgtaattgtaccggtttataatgttgaattataccttaagttttgtgttgaaagtattataatgcaaacatatgaaaatttagaaattattttggtggatgatggatcaaaagatggaagtccacatatatgtgacgcatttctaaataaagataagagagtgcgagttattcatcagcaaaatcaaggtctatcagcggctaggaatgcaggaatagaagttgcaagagggaaatattttacttttgttgattctgatgattatattaggaaagatatgatagaaagattagttaatttggtagagagaaagaaagtagatattgcatgttgtgaatacgaagaagtttttttccataaaaaaataccggttaattatgaaagaggatcaaatttagtttatagaaatagagtagatgaattaaaagaattatttggaacaaaaaggatttctatagtagtagcttggggaaaagtatataaggccgaattatggaaagacattagatttccaattgggaaactgcatgaagatgaagccacaacatacaaaataatttcaaaggcaaaaaaaatagtgcattctgatagaaagatgtattattattttcaacgatcagacagcattatgggaagcgattttaatgaaaaaaagctcgaattattggatgaattgaaaaagcaaatttctttttttgaacaggaaaatttgagatcagtattaccagatgcaacatttaattatttaagaagaatagcaatgagctatgcttattataaagagtgtcgtggaaaaaagtcaaaattagaggaaataaagaagagatatacgcatgaatataaagaaatgcgtagttatatagataaattagattgtcgaagacaaattattttgaaaattttcctttttgatataaatgttggacgcattgtagtaaagataaaaaagaaatttaaacagataaaaatgttgaaagtgaaatgaaaatgaaagaaatatcattagatgaaagaaaagaaattgaattagagattttattatatgtaacgaggttatgtgaaaagaatagaatagagtattctttgtgtggaggatcattgataggagccatacggcatggaggatttattccgtgggatgatgatattgatatctttttaactagagaaaattataagaaattgattgatttgttaaaagatgatctacactataaactatacgcgcccgaaacaacagagaactatctttatggcttttgtaaattaatggataaaagaactgtaatttatagcgaatacgatgaagaaataggaactcccgaattaggcgtatttatcgacatctatccagttgatctgataccagaaaataaaaaagagcaacgaagttttttacgaaaacttgatttttatttacattgtgcgtacgctgcatcaaacacgatgtacgcatatggaaacacaaaactaaaacattggataaaaaaaattgttctttttccaaagcatttgatatgtagaagaaaaggaacgagatattggatgaagaaaacggaaaaaatagcgtcagaatatttgggaacaaatgcaaaattacgtggtagtgtatattcaaggtatgggagtaaagagattttgccaaggaagatttatgaaaatacaattgaagtatcttttgaaggatataagataaaaattataaagcaatatgataaattcctaaaaagggtatatggcgattatatgaaactgccaccgaaggaaaagcaagtacttcctcatgagtatgatgcattttggagagagtaatgaaagattctataagatatataaaaacaaccggaatatatttaattggaaatgttcttacaaaggtcatttccttttttttgctcccaatttataccagatatttacctcctgcagattatggaacatacgatttaaatattgcatatataacttttcttagttctattttgtttttagatatatggggcgggattatgcgcttcatgtttgattataagaaagcagaagaaaaagcttatgcagtgaaagccggtatggttatcttctcttgctcaacattgatttacgctatcgcagttataattttaggaaatttattaggaatagattataagttctggctttttatgtatggtttgctgacaaatatccaacaggtattcggatttgttgctagaggatatggacaaaacagagtattcgcctttggaggggtgttaggatcatttgtaacaattatctgcaacataatttttatcgtaggaatgaaaggtggctatcaatatttatatatttccagttgtattggattacttgtaaatataattattctggaaagatcagtacgtttttttgccttaatgagatcatgtggattaaacaaaactttattaaaagaaatgactatatattcactacctttatctattaattcggcagctttttggtttttgtccagcttcaataaagttctaattagttacaaattgacaactgttgaaaatggattttatgctgttgctaatagatttagtagcgtaataactctttttacgcaatgctttcaaatggcttggcaagagttaacattttcgaaagcaggaagtactaaaaaagaaatggaacaattttatacgcatgcgactaatgaatatattagctttatgtcgttaggaattatgttggtaattccatgcataaaagtgttgtttccttatttaattgattcagcttattcgagagctgaaggtatggttcctcttgcaattcttgctacattattttcatgtatttcttcatttatggcaagtattataagtacgctaaaaaaaaataaatatatttttacaacaacagtgacaggaagtatagtaaatgtaatattagcttttttactaatggattatttgggagtagaggcagcaaatgtttcgattttgttcggatattttatgataagtgtgcgaagataccaactaattaaaaagtatattaatataaaactgaacatcaaaaaatgtcttttcttatgtttccagacgagttgtatttgcattatttattggaaagcaacggatattataaatggtcttgttatcatttatgtctgttgcttatttatagttatgtataaagaaaagataaaggcaattttagggaaagtgtgaaattgaaaaaaatagaaaaaggaaatgagaatgaaaaaaattggattattaggattgtatttcgaacaaaatttaggcgatcctttaatggtagagtgcgtagaatatatgtataagcagattgatccggagataaaatttgttcatattgatctttttggacggttaggtgaggacaagctatggagggataaaaaaagtcatttaaatgatatttcttgtatcccaattagagctggaatgcatttttcaaggaaaagaagtggagtcctattttcttactttgagcatctttattatttgcaaaatattaatcaaaaaaaaagattaaaaaagtatttcgaaaataaaataaaaggattggatctattagttgtagtaggaggagcattggttaaatacagattaatacgagattttcatgatccaatgaatgaagcaatagaaatagcagaaaagtatcatgttccggcatattttcatgctgtaggagttgaaaatggttataatgaaaaattttgtggttgtcgaattgtaaaaaagtacttaaattcccctacagtaaaaatggttacgacaagagatgatattgagactttaaagaaatatttaagggaaaatgaaataacaaaatactggagagttgcagatactgcaacatgggtagataaaatatttaatgtacaagagcgagatgatacaaaaataattggaattggagtgattacaccacaaaggtttgaacaatatgagcaaggaatttctgcagtttattatgaaaaatggattaaacaaattataaaaggacttttaaaaaagaaatatacaattgcagtattttccaatggtcatgaagaggatcaaaaatttgctgaaaagttaagcgaagaattgcacgtagtatgtgaaaaaagaccacaaaattataaagagcttattgcaatcatagataattataagatggtaatagcaagtagattgcatgccttaataatagcatatggactaaataaatctattgtaggtatagactggaatgataaagtgcttttttttggagaggcaataaaagaaaaaaatagagtttttaagccaaaagataaagacgcagaagaagttttagcgattattgatcattattataataaagggtatgaacaagaggataggatgagatataaaaccagtacaatcaaagctatcgagcaatcgatagctttaataaattaaataaaataaattattgaaaggagaaagcttatgaatatagcattaattatcgcagggggatcaggtcaaaggatgaatcaagatattccaaaacaatttcttaatgtaaatgataaaccagttattatttatacattggaagcttttcaaagacatccgaatatagataaaattgaagtagtgtgtttagatggttggcaggaaatattaagagcctattgtaagcaatttggaatttcaaagttggctaatgtagttgaaggtggagagaatggacaaagttccattcgaaatggattatgggatttgaaagaaatgtatgatgaaaatgatttagtacttatacatgatgcgattcggcctatggtatctgaagaaataatttctgatgctattagagtatgcaaaaagtatggaaattcaattagtgtcattccttgtgctgaagcaatgctaaaaacggaagatggggtgtcttctttagaacagattccacgagacaatttgaaaagaacacagacaccgcaaacatttgttttaaaagatattgttgctgcacatgaagaggcattagagaaagggattacaaattcagtagcttcctgcactttatacatagaacttggtaaaaaattatatttttcagcaggatcagaaaaaaatattaaattaacaacgccagatgatatagacatatttaaatcaattttagtgacaagaaaatcagaatggatgaaataggggtaagaaaaagatgctgtgggaaaataaactctatcaagaagatttaggggaaacatacgaatatttaaagtcgattcttggagagagaaagtctattttagtgactggagttactggattgataggctcatatttaattgatttactagtttattataataggaataataatagaaaaattaaagtgtacgcaatggcgcgtaatgagaaaaaaatacaagaacgattttcacatatttgtaaaaacgatgatgtacattttatttatcaagacttgagtgaacctatacaatgtgaggataccgtagaatggattgttcatttggctagtaatgcggatcctaaaacatatgcacagtttccgataagtactattttgacgaatgttgaagggacaaactatattcttgagtatgcgaagaacaggggagcaaaggttttatttgcatcaacaatggaagtatatggtgaagtaaaaaaagcaactattttagaagaagatacagggttacttgaatttgataatgcaagagccggatatccagaaagcaaaagggtagcggaagtattatgccacgcctattcacagcaatatggtctggaatttgatattgctcgtttgggttatatttatggacccactatgaaaatagatgatagcaaagctgtagcccaatttttaaaaaaagctataaaaaaagaaaatatagaactaaaaagtgctggtaagcagagacgctcatattgttatgtgagtgatgtcgttaccgcacttttctttattatgaactgtgagaaacataatcaaatttataatgtatctaataaagagtctattgttacaatttctgaacttgcacataaaatagcagaaattggaggtacaaaagttgtttatgtggaagctaatttgctagaaaagcaaggatactcaaaaacaagagatgctgtgttagacgaggggaaattaagaaaacaaggatggattcccaagaaaaacattgatcaaggagtggagatgactattcgtattcttcaaaatgaaaagggggtgtgaaaatggcgatgaaagtatctgcatgagtgcggactgcccaaagagcgtgtttatgtaacaggaagtccgatggcagaggtactgtatcagaatctggaagcaattcaaagttcggatattctggaccggcttggtctggaaccgggtaaatatatgctgctttctgcccacagggaggagaatatcgatacagagaaaaatttccgatccttgttcactgcaattaacaaactggcggaaaagtatgacatgccgattctatactcttgtcatccacgttccaggaaacggctggacgagtcaggatttgaactggatgcacgtgtagtacagcacgaaccactgggcttccatgactataatcatctgcagatgaacgcatttgcggttgtttctgattcagggacattaccagaggaaagttccttttttgcatctatcgggaatccgttcccggcagtttgtatccgtacatccacagagagaccggaggcgctcgacaaagcgtgttttattctggctggaatcgatgagacttctttgcttcaggcagtcgatacggcggtcgaaatggatcagaatggagatcatgggattccggttccggactatgtagaagagaacgtcagtacaaaagtagtaaagatcattcagagctatactggagtagtcaataagatggtatggagaaaattttaatagtgtaaatgaaagagtttttcctcctgatccgttctgtatgtctgaatcgccacgatttcccaaagaattttggccggaagacggacatttcctgtaaaacctgatataatattgttacttggagccgggacaaaagagatggttccggctccttttccgttttgcgggcagaggcagcaaagcgcttttacctgcggaggaggggtacgaaacaaatattgagaaagggagttaagggagcagaatctcttacggagaagtgcgatgaagagtttgttaattttaggtgctggtggcttcggacatatgatccaggagacagccttcctgttaggctatgaggatgtggtatttctggacgatgcagtgaaggataaagatgttgtcggaaagtgctgtgattataaaagttttctcgagaagtatgatacagcggttgcggcgcttggtgacaataatatgcgtctctactggacggagaagctgatggaggcgggatatcatgtccctgcgatcattcatccgtcagccgtgatcagtcaaagcgcagtgattggaaacggcacatttgtgatgcagaaggcagttgtgaatacgcacacggtcattgaacatggtgttctgatcaacagtggtgcggttgtagaccatgattcctatgtggcaaaaggggctcatatcagtctgaacagtgtcgtaaaagcgaactgcaatattgcggcaaaacagaaagtggaggctggtgaagtgattttctcgacaaggcgaaagattgatggcgtagaggatcgggatctggaagatgcgatctatgcttttggctttggcccgagatgcagttatgtgaagccgttcggagcaggtcatatcaatgaaacgtatgcggtctatatgccgggagaggacggggatgagctatcctacgtgctccagagggtcaacagtaatgtattcaaggatcctgcgggagtcatggaaaatattttcggcgttaccgagtatctgagaaatgtaatccgcagtgagggtggagatcctgaccgggagacgcttgcatatatcaagacgaagagcggcgccaattatttcgaggacagcgagggagagccgtggagatgctataattttattccagattccgagtgctatcagcttgtggaggagccggaacagttttaccagtccggaagcagtttcggtcattttttgaagcagcttggagattatcctgcgtccaaattgcatgagacgattccggattttcacaatacggtcaagcggtttgaggcttttgaagttgctctgaagcgggatttgaaaaaccgtaaagcgggatgccggccggagatcgactttgtgttgaagagaaaagatgactgtgcggtactggtaagccggcaggaggacggaacgcttccacttcgtgtaacacacaatgatacgaagttaaataatatcctttttgattctaaaagtggaaagggtctgtgcattatcgatctggatacgattatgccgggactggcggcgaatgatttcggcgattccatccgctttggtgcggcgacagcggcggaggatgagaagaatctggatctggtacattttgatctttcgctgtacgagctgtatgtgaaaggatatctggaggagacaaaagacgtcctgacaaaagaggagatcgaaagtcttccttggggggcaaggttgatgaccctggaatgtggcatccgttttctgacagattatctccagggagatacctattttaaaaccgattatccggaacacaatttggtacgagcaagaacgcagttccgtttggtcgacgagatggaacagtgttttgagaagatgcgggaaattgttcggaaatatgcataaataatcagagaagaaagaacggatcttttgccggctgccgatgtggcagaggggcagaagatccgttttttgcattttaggagattttttcagtttttaaaaagaagaaaaagccgatcaggaacatgatagcgagagaaccgacaccgagattcatatttcctgtgagctggctcatagcggagacaagcgtggtgccgaggaaggacgcgcctttcccgcagatatcatagattccaaagtattctcccgaacgttccgccgggatgatccgggcgaaataggagcgggagagagattgaatagctccttggaagataccgacgcagacagccaggatccagaactgatactgctcttttaaagtgataccataaagggcaatcagaaaataggcgccaatgcagatccggatcagaactgcatttttatattttccactcagccgtccaaagaggagcgctgccgggaaagcgacaatctgggttaccagaagggccaggagaagtcctgtcgtatccagaccgagggcggttccgtaagcggtcgccatatcaatgatggtataaacgccgtcaatataaaagaaaaacgcaatcaggaagaaaagcactttccggtttctttttaattctccgaagacgtgtccgaggcggcaaaggccggaggatatcgcatgatggtgttcttcaatacagtggatctggcggtagcttttcagaagaggaacggaaaaacagatccaccagattgcgatgaggagaaaagcaattcccatggccgttttcatcgtaagtcccagtgtctcatagaagagagccaacgcaaggctggcgagaaatggaatacagcttccgatatagccccaggcgtatccgcgggacgacacttcatccatacgttcttcggtcgtgacatcagtgagcatagagtcatagaagatcagactcagagagtatgccgcctttgccaggataaagatcaggagaaaccagatccatgagcttaaaaaaccaagtacgatacagccgcaggctcctgtcaaaagggaaatcaaaaagagccgtttcttccaaccacggaagtcggagacagttccaagaaccgggccaagcagagcagtgataatggttgcggcggaggtagcatatccccagaacgcaagataattgacttctgagacataggcgctggatgcaagataattaaaataaatcggcataatagtggaaacaaggagggtaaaagccgagttccctacgtcataaaaaatccatttcttttccagtgatgttgtcttccatttcattgtgaaagttcctccctgtcaggttgatagctgctttcctcctttggacttagaaccggtatctccctccagcccggtttcggcccgaatgtgtgacggaaatacggtgagagcgggacgcctttgtgcaggaaccccaggtagttggacgtaagggaaaggcagaggggaacgcttgcctccatcaacttgtccagtctcagattgctgtccgtacagagcggattgtccgtttcattcatcagaagtccccctaaacttttgtatgtaaaggtggcatggagggcggccttgaccagactgcggatgagcctgtcggatgtggtaaacaggtcattgtaccagatcatggaggaaatggaagattccacctgcctgacgctaagagtcgggaaaaaggttcgaatcacttttgcgctctcctggcttgtccgaaggtgagaggtcacttttgcgtgcaaaggccgtcgatgctgctttaggagaagatagcggtcaaaatttgtctcgatatctgagtgcgtgacagggtctgtcgtaagctttttctcgatgtagctgtgacagacactgtccagtgtaaaatggcagagaaaacccagaatataggcgagtccggcatttttttcaggcactgtggaaccggaaagaatcacgtctttggcgcgccggaaaaagggagctgcagagacgtcgtgcatccggtatccggtctggctgacacggtttttcagaggggcataataataaaagaacagatccggaccgtgtagaccgatctcaaacaggtctttatgaaggtcaatccgtttttttatatcggaaggaaaattctgtttcatcatttccccgaaggtgtaatgtgcatagatggatggcatcttattacctcctgtattttggtagtgacagttacggctccggcgcctaaaggcaccggagccgagttgccaagtatcgaaacctgtccggatttagatttctcttgtgtatgtcttgagccattctttctcttctgtgtccagatacggagaaactttctcatagacatctttatgataatcgttgagcattttcttttcttctgctgtcatcatatccgggttgatggcatcgagatccatcggaataaaagtgattggctcgaaatacatgaactggccgtactcgttcttctcgccttcacaagtgagaagttcgttctccagacggataccgtggcttccttcaatatagataccaggctcgtctgtgataatcatacctttttcaaatggctggatttcacctgcgcggaactgccatctgaaacctgccggaccttcgtggatgttcagaaggtatccgactccgtgaccggttccgtgattgaagtttaagtttctgtcccagaacggttttcttgcgagcagatccagagtcattccggtgcagccctttaagaaacgtgcgtttgcaagggaaagattactgatggcaaccagtgtaaaatggtctttcataatctgcggaacttctccgagcgcataagtacgtgtcacatctgtggaaccttcatagaatccggcccctgtatcagtcaggaagagtcctccctctttcagctctacatctgtctcaggcgtggaggtataatgaacaatggcgccatgttcaccgtaggagctgatcggctcaaagcttggacggatgaaattgccctgctctgcgcggaactcgtcgagcttgtctgaagcgctgatctcagtaattgtcattttgccgacattttctttcagccatttcataaattttacatgagcgacgctgtctttgatctgagccttgcggatgttttcaatctctacttcatttttgattgctttgaagaggatctccggattgcgctcttccactttggcaactccttccggaatattgttgtaaagagcgtagttcagtcttgcagggtcgatcagcagaacttcatctgaggctgtttttttgatatcttcgtaaatatcattatacggatggaggaccacgccgtctttttccagatccgctttgatttcactgtttaacttagcttcgttaatgtaaaggtctactttgtccatggtgatcactgcataggacagaacaagcgggaagaactcaatatcatttccacggatgttgagtgtccagcagatgtcgtccaatgtggtgaggacatgagcggttgcccctgcctttttcatttcttcacggattctggaaagcttggaagcaacagtctctccggtgtatttcagattcagagcgaaaaccggctcctcggaaagtaccggacggtcttcccagatttggtcgatcagatcgtactcgtaaataactttgccgtttttctgagcagcgatggatgcgtaatcctgtccttctcccatggaaacgacgcggccgtcaaatccgagtactccgttttcaggtaatgtatcaaccaggaactcatggatcgtcggaacacctggctcacccatcttcatcagctcaacagtggagccttccaactgttttgcggcctggatgaaatatcttccgtctgtccaaagataagcgcctgtttttgtgatgacagcggttccggcagatccggagaaccctgtaataaattttcttgctttaaaatgttccccaacatattcgctctgatggaagtccgctgtcggtactacataaatgtcgattcctttctcctccataagagaacgcagctttgcgattctttcaggtacgttcataataaaaacctcctattttccggccataaagccatttctcaaacaaactcattataacacaaaaacaaggggagagttagtattatttttgtgaaacctgtgttatactttcgttatgaaaaatcaaaaccaagaaggaaagggaagaattatggagcactacgcaaggtcgattataccggtgattgaatacaactatgagaattttacagccctggagaggacgattgcggattttttcattcagaacaaaaagaagcgggatttttccgccaaggcggtctcggagcggctgtttgtatcagaggcgtcactttcccggtttgcgaagaaatgtggattccgtggttatagggagtttatttatcaatacgaagatacgtttcgtgaaaaaaagaccagaccctttgcggataatacgaagcgggtgcttgacacatatcaggaacttttaaataaggcatataatttggctgatgagaaaaagtttcagaagatcgcgggaatgcttacgagagcggagaagatttttgtgtgtggggtaggaagctctggaatcgcgtccagggagacggagcttcgatttatgcggatcggactgaatatcaattctttagtggatcgggacatgatccggatgagagcagtgttccaaaatgcgtcttcccttgtaatcggattcagtatgaaaggggaaactgaggaagtgcagtatatgctccgggaggctaaaagaagaggagccaaatgtatcctcgtgacagcccgcaataatccggactgcctggagtactgcgacgaaattattctcgttcctgctctcgacaatctggaatatggggatgtgatttccccacagttcccgattcttgttatgatggatcttctttatacatattgtctggaggagaataaagagagaattgacgcttttctggaagacacggctaaagcgttgaaaaagtaggaggatagagaaaagggtattgcgtacggaagagtttggtgctatgataaaaaagaacaaatgaataaattcttcggggcagggtgtaattccctaccgacggtatagtccgtgacccacgcaagtggctgatttggtgaaattccaaaaccgacagtgacagtctggatgggagaagaaagtttcagaacatggatctcagtaccccgcgtgctgggattttttctattcctttcggaggatttactgtatttgtatcaatcattctgaaaggggaaattagcgtgaaacaaaacaacagaacttattactttattgtcaccgcaatgctttcggctgttgccggaatcctgatgtctttggaattttcgttgccattgatgccgccgttttataaggtggatttcagtgatgttccatctgtgattgccacctttttgctgggaccggtttctggtatctgtgtagaggtgattaaaattttgattaagctgattacagttggtacgaccacaatgtttgtcggtgaattagcgaatcttctgggagtcctgctgtttattttgccattgtggtttttgttccaaaaactcggtaagacaagaaaagccgcagtcgtggcgcttggagtgacacttccatttcgtatagccttatcttgtgtgataaacgtatatattactttgccattgtatgctaaagctatgggtgtttctttagatgaagtggtgctttcagtaggggcagttaatcctttaatcagaaatataccgctttttttggtattggcaacgattccgtttaatttaatcaaacttttattgaactattttattggttatcttctttatgacaggctgaaatcactaagcgttgatagaagaatggaggaaagagtatgatacgaaattatcgagatctgacacggcttgagatggaagaaattgataaggaggaaacaattattctgattccggtaggcgcattggagcagcatgggaatcaggcaccgctagggacagatgatataattgcggaggctatggtaggctatatcgggaaagcattggaagaggctggagagactgattttccgattcttgcgttcccggtaattccaatagggttaagtacagagcataaaaatttctgtggctcagttacattgaagccggatacctattatcatcttctttatgatatttgtgtaagtctggctcgccatggctttcaaaagctggcatttcttatctgtcacggtgggaatgcacctattgtccagattttaagcagagaattgagaagcgaacttggaatttctccatttattctctcttccggagcgtttggacatccaaaagtgcaggctaccatctcaaaaggaaatatatatgattttcatgggggagagatggaaacgtctatggtgatggcggtagatgaatctttagtgaaactagaaactgcggaggctggtataccaagtgattttgttgggaaccagacgttaaaacctgcgggaaatgtaaccatcggttgggtttcagaagattggaaaacagcggagggcaagccgattggaatcggtggggatccatccggagcaagcgctgagaaagggcgtatcattttagaaacgagtgcgagagtactggtgccggggctgcaagagatcagaggatggaaagcatgacactgagcttggaaaatgaaaagaaagagtcttgacaagtaccagagaatcgggtagtatttgtcataagcatatagaagaaacaggcagagaaaagaagaagtagcaacagatcaggttcgtacagaaagtaaccggctgatgagaggtgcaggaaaagtttgttgtgaatacatcttggagcttcacaccgaaagggaagtaggctgtgacgtcaggcacacgttaccgtgtcaggagatttccggggttcttttggatcaggagatgtcctgttaagccggagctgttccgggaattaaggtggtaccacgagtttttccctcgtcctttccaaggacgggggatttttatttataggaactgcgttctaatgaaataaaaatatcctgtgaggtcaatgaaatggaagtatgggatttgtttgatgagaacaggcggccgcttgggaaacaggcaggccggagagagccgatagtaaaaggagaatttcatattgtagtagtggtatgtgttatcaatgagcaaaatgaaatcctgttgacgcttcgctcaccggataaagagaaatatccgggaacctgggagaacacaggaggagctctggaagccggggaggaaagccgtactgctgcggtacgggagctatttgaggagaccggaatccgggtgcgggagaatgaactgcatcttttggattctcagatggaagaatctgcgtttatcgatgtctatgttgtccgaaaatctgtcccggtggagaagatccggctccaggaaggtgagactgtggatgccagatgggtgagccttgatgagttttgcaggcttggagaggaagagaagattgcgccgccgatctatcgaaggttttgcaggctaaagggcaagctggacgtattcatcagggaggagtcaaggaaggagcgatacccggcctgccggggagagaagagacaggaatcaaaaaagatgattatcattggatgcagcgggagtggaaaatccactcttgcgaagaagcttggcaggattatggatcttccggttatctatctggacgctttgtcctgggatgcaggatggaagcgcaagccttttatggagtttgaccggcttacggaggcggagatccggaaaccggagtggatcatggatgggaatttccctcggacagtggagcacaggatggatgtatgcgataccatagtttatttggatttcccacgttggttctgtattctgagtgtgctgaaacgggtgctgacgggctacgggaaaccacggccaagcatgaatgaaggatgtcctgagaagtttgatccgggatttttaaagcggatatggaattttgaccaaagaagcaaagcacactattacgggtacatgaaaaagctttccggcacaaagctgattgtgctgaagacaagaaaagaagtcaaccgatttgtgaagcaggcggaaaaggaaggcaggtttattccgggtaattatcccaaataaaaggaagcagaacagaaaagagttatgatattttggtttctatcataaataaaagaaagaagaggtaagaatgatgcagatttacgaagaattacaggcgagaggtctgatcgcccaggtgacagacgaagaagagatcagagagctgatcaacaatggaaaggcaacgttttacatcgggtttgacccgactgcggacagccttcatgtaggacatttcatggcactttgcctgatgaaacgtcttcagatggcaggaaacaagccgattgccctgatcggaggcggaactggctatgtaggagatccgtccggaagaactgatatgcgttccatgatgacgccagagcagattcagcacaactgtgacaagttcaaagaacagatgagccgttttatcgatttctcagagggaaaagcgctcatggtcaataatgcggactggcttctggatctcaattatgtggattttctgcgggaagtagggccgcatttcagtgtcaataatatgcttcgtgcagagtgttacaagcagagaatggagaaaggattaagtttcctggaatttaattacatgattatgcaaagttatgatttcttcatgctgtaccagaaatatggatgcaatatgcaatttggcggggacgaccagtggtctaatatgcttggcggtacggaactgatccgcaggaaattaggaaaaaatgcatgtgctatgacaattacgctgcttttgaattccgaaggtaagaagatgggcaaaacccagtctggtgcggtatggctggatccggagaaaacgtcaccgtttgaattctaccagtactggagaaatgtagcggatgacgatgtactcaaatgtattcggatgctgacctttcttccgctggaggagatcgacaagatggatacctgggagggcagccagttaaaccaggcaaaagagattctggcgtacgagctgacaaagcttgttcatggcgaggaagaggccaggaaagcccaggatagtgcaagagcgcttttctccagcggaaatgccacggaaatgccgacctgtgaacttacagaagaagattttacagacggaaagatcgatattctgactttacttcacaagagcggactggtgccgtccaaatctgaagcaagacgtgctgttcagcaaggtggggcagccgtaaacggaaaaaaggtgacagatacattcactgcatatacgaaggaagagtttaatgaagattttgtcctgaggagaggaaagaaaaatttccgtaaaatagtggtgaaataatatgaatatgcttattatgattatagtattgacagcattgtcggggattggaggaaccgggatcggagcggcgcttagttccacagtaaagaagagctccaacaaggcaatgagcctgttgttaagctttgcgtccggaacgatgatcagtattgtctgcctggacctgtttcacgatgcactggagactggaatgtctaagggagggatcgccctctttgtcatcatcggttttctgacagtgtatctgctggagcgggtgatggatgagaaggccaagcgggccaaaagccggatgagcaggaagatgatgacagccgggattgccatgatgtttgccgtagcctgccataatattccggtgggcatgaccattggggcgtccgccatcagtcatggcggactgattggaagtccggccatgacactggcggtttttatcggaatccacaatgtaccggaaggaatggcaatctgcgcgccccttttggcagcgggtatgacaaggggaaaagcagtactgctcaccgccttgagcggagccgccattgtagccggcggcatcctggggtactggatcggcgacatgggtcagatggggcttgcagtcagcctgagctttgcatccggtgccatgctgtacgtgaatttcggtgaaatcctgccggagtcgaacgccctgtacagagggaaaacacccgcatttttcacggtacttggtatcctgcttggcatgatgtttatgcatacacattaatgataaacagaataagcgcatagaaacagtcggtcaaagagcttttcaagttcttcggccgactgttttcttttagaggtggttctatatcattatcctgccagttgctataatcaaaaaacatgtgtcttgtcacatgtaaaaaaagggtgtataatgcggtgtaaatgagtaaacagacggaggaaaccgagatgagttctttaacagaagagatacagatactgaaaaaagaaaagcaggcgatgatactggcgcactactatgtgccggatgaggtgcaggaaattgcggatgtgaccggagattcgttttatctgagcaaggtggcaaaggaggcagacgcgaaaatccttgtctttgccggagtttcgttcatgggagagagcgccaaaatcttaaatcccgaaaagaaagtgctgcttccggatccggcggcggactgtgctatggcgcatatggcggatgtagagaagatccgggcaatgcgtaatcgatatccggatcttgcggtagtatgttacattaattcgaccgctaagttaaaacagtatgcggatgtctgcgtgacgtcagcaaatgcggtgaaagtagtaaaagccctgccgaacaagcacatttattttattccggatcaacatctcggaagcttcgtggcggctcaggtgccggaaaaagaggtgattctgggcgacgggtactgtccggtacatcaccagatcacagcggaagaggtgcggcaggcccaaaaagtccacccggaagcatcggttttcgttcatcctgaatgtccgaaagaggtgacagagctggcggattatgtaggaagtacgtcaggaattatccgtgcggtggcagaggacgaagcaaagacctgcctgattggaacagagctgggagtgttatatgaactgaaaaagcagaatccggaaaaggagttttatccactccaggcagagcagtgttgttatgatatgaagaaagtgacgcttaagaaggttcgggactgtcttcgtgacgagacgaatgaagtctatgtggatagagaggtcagcgaaaaggcaaatagagcgatggaactgatgttacagcttgcaaaatgatcggggagtgtacagcaatgaaaacaatacagacagatatcctgattgtcgggacaggagcaagcggcctattcgccgctctccatataccggaagacaagaaggtgttgatgatcacaaaagaagaggtcgaaaagagtgattcttttctggctcagggtggaatctgtgtattgcgggatgagtcagattacgacagttttatggaagatacgctgaaagccggacactatgagaaccgggtggaatcggtggatattatgatccgttcttcccaggatgtgatccgtgaactgattgattacggcgtggatttcgcaaaggaagacggagagcttgtctacacgagagagggatgccactccaaaccacggattttattccacgaggacattacgggggaggagattacaggaaagcttctgaaagaagcaaagaaacagaagcatatcacgatcatggaacacatgacgatgttggatctggtagagaaaaaacagcagtgccatggtgtggtggcggtggacaaggaaggagaggcatattttctgaaagccggaaatacgattcttgcaagtggaggaatcggcggcctttataaacattccaccaattatccacatttgacaggggacgctctcgcgattgccatgcgtcatcatgtggaattggagcatattgattacatacagattcacccaactaccctttattctcagcgatccggcaggagatttctgatctctgagtcggtgcgtggggagggagccaagctctatggagcggacggaaagagatttgccaatgaagtactgccaagagaccttttgacagaagaaatccgaaagcagatggaaaaggatggaaagccgtatgtctggctggatatgacggtacttggagaagaagtgatcaaaagccatttcccgcatatttatgagcattgtttggaggaagggtacgatgtgacgaaggactggattccggttgtcccggcacagcattattttatgggcggaattcatgtagatcaggacagccgcacatctttgaagtgtctttatgcggtgggtgagacaagctgtaatggtgtacacggtgctaacaggcttgccagcaattctcttctggagagcctggtctttgcaagacgggcagtttggcatcttttgaacaataaagaggcggatacaggagaggatttggaagaggttgtttcgtgtgcaaaaaaagcatgggaagagctccaaaaagagaaaagtattccacagcagtaccgaagggaaattctggaggaaatagaaagggtaaggaaagcaaaatgaacgaaattacaatgaaattagtggcggataaattgattatgcaggcgcttgaggaggatatcacaagtgaagatatcagtacgaatgccgtgatgccaaaggagcagatgggggaggttgatttgatctgtaaggaggacggtgttattgccggtctttgggtttttgagcgggtatttaccttgttggatcctaatgtcacggtttcgctctttgtcaaggacggagacgaggtaaagaaaggtcagaagatgggaactgtggcgggggatatccgggtactcctctccggggagcgtaccgcattaaattatctccagcggatgagcgggatcgctacttacacaagaagcgtggcaaaactcctggaaggcagtaagaccaaattgcttgatacgagaaaaacaacacctaatatgcggatctttgaaaaatatgctgtccgtgtgggcggcggatataaccaccgctataatctttccgacggcgtgctgttaaaggataatcatatcggagcggcaggaagtgtcaggaaagcggtggaaatggcaagagaatatgcgccgttcgtaagaaagatcgagattgagacggaaaatttggacatggtaagggaagcagtggaggcaggggctgacattatcatgcttgacaatatgtctccagagatgatgcgggatgcagtagcctatattgacgggcgcgccaaaacggaatgttccggcaatgtgacaaaagaaaacgttgcacagcttgcggcagtaggtgtagactatatctcaagcggggcccttacccattcggctccgattctggacatttcactgaaaaacctgcatccggcagcatagggaccggtgccggggaaaggacggaacagtatggatggagaatttcgcagacagcagattttaaaagagatacagcaaagtgggactccggtatccgggaagaagcttgccggaaaatacagcgtcagtcgtcaggtgattgtgcaggatattgctattttgcgggctgccggaaatgatattgtttctacctgcaggggctatgtctgccagaaaagctcatatgccagacgtacgatccaggtacggcatacggacgatgagatcatggaagagctgaacgtgattgtagatttcgggggaacggcggaggacgtatatattcaccataaggtttacggaacgctccgggcggcactggggatccgcacgagaaagcaggtgcaggattttgtggaaaagatccgaagcggacagtccagtccgctgaaaaatgtgacaagcgggagacattttcacacgatcagtgcggagacagaagaggtacttgatgcgattgaagaagagctccggaaacggcacttcctggaggagtgattggaagatccggcaggaaaaaggtcagaggacatggcaggaaaggagaagaaaacgatgggatggagagaaatcaaaccagaagagtggaaggtaaacccgttcactgcgatcgggaaagagtggatgttgattacagcaggtgagaaggagaattgtaatacgatgaccgcaagttggggcggtatgggtgtgatatggggaaaaccatcggttacggtatatatccgtcagagccgttatacgaaggaatttgtagacagaggagagtgcttctccattactttttttgatgagaaatatcgcaatgcattaaacctttgcggtacagtgtccgggagagaccgggacaagatttcggaggcgggtctgacgccatgtaatgtggagcagacggcggcttttgaggaggcaaaggtgattgttctctgtaaaaggcagttccaccaggttatgagcccggaaggatttgacgtcaaggaaaatgacagtaaatggtatgcggaccgggactatcataccatgtacatcggatccatagagaaaatacttgtcaaagaagaggaaacgtgggacgtgtaatcgcctccgggtttccattttattctctggactcttttgaggagtctttacgggagcaggcgtagaaaatgccgaaacttcttgacaatgcgaaagacagggcttagactaaaacaagacaaaggggagccggaggcagtccggctgagagtagggccgtgtgtgtcctttaccctgaaacctgatccggatcatgccggcgtagggaccatatctgagagatggagtgttggggatagttgattatccatgatccatagatgagaggtggctctgccggattgttccggcagagtttttacattttataaacaacaggaggagaaacaaatgaatgcaagtgtagcgatccaatccttaccggatgcggcaaatgacgaggaattaatccgtattgtagatgaggtcattgcgtatatcaaaagtacgggcctgaattattatgtagggccgtttgagacaaccattgagggcgactatgatgaactgatggacattgtaaaggagtgccagcacattgctgtgcgtgccggagcgccgcatgttgctgcctacatcaaagtcagctacagaccggaaggagatgtgctgtccattgaaaagaaagtttcaaagcatcacgaataaatgctggtctctggcggctattgtcgtaattcttgtactatggcaggcagtgtccgcagggggattggttccgggctatatgctcccgtctccggtggaggtcgtacaggcgtttatcagtgaatttccacttttaatggaaaatgcgaaggtgacgcttgcggaagctttcctgggcttgctgtgtggtgtggcgcttggttttgtgatggcagtcgttatggacaggtttgaccggctctatcaggcgttttacccactcattgtggtgacacagacgattccgacggtggctgtcgccccgcttctggtgctgtggtttgggtatgagatgcttccaaaggtgattctgattgtcattgtaaccttttttccggtaacggtcgggttgctgaccggatttcggtcggcagatccggatatgataaatctgctccgctccatgggagcgggcagagttcagatttttcggtatatcaagcttcctcaggcgatggggcagtttttttccagtcttcggatctccgcatcgtattccgtggtgggagcggtgatctccgaatggcttggcggttttaacggacttggtgtatacatgacaagagtaaaaaaggcctttgcatttgacaagatgtttgcggtgattctgctgatttcagtcatcagcctggttttgatgaagttggtggatctggcgcagagaaaatgcatggcgtgggaacaaacagaaagaggagaagacagatgaaaaagaaaatcattgcgatactgatggcaggatgtatgacatgttcacttgctgcctgcggttctgacgagggagaaaagggaaaagaggggaaagaaaaaattacatttgtgttggactggacgccaaatacgaatcatactggtctctatgtggcgcaggagaaagactattttgaggatgagggactggacgttgagatcgtacagccgccggaggacggagcagacgcccttgtcgcttcggggaaagcgcagtttggaatttcttttcaggatacgatggcacctggagtgacaggtgaggatatgcttccgacgacagcggtagcggcagttgttcagcataatacttccggtatcatttccagaaaaggcgaaggcatggaccggccgaaaggtctggagggcaaaaagtacgctacctgggacgcgccgatcgaaaaggcgatgatgcagaatgtcgtggaggcagacggcggtgattttagtaaggtagagctggttccaagtacggtgacggacgaggtttctgccctggagtccaagtctgtcgatgcaatctgggttttctatgcatgggcggggattgctactgaggtggcaggacttgagacagattattttgcgtttagggatgtaaacccatcattcgattattatacaccggttattatcggaaacaatgaattcttaaagaatgaaccggagacggcgaagaggtttttgtctgctgtaaagaaaggatatgaagacgccattgagaatccgaaagcagcagcggaggttttgtgcgaggcatcgccggagcttgataaggatcttgtcttggcaagtcaggaatatctgaaagaccagtatgttgcggacgctaaaaaatgggggtatatcgacccggacagatggaaccggttctataactggctgaatgagaatgggctgacagagactgagatttcggaaaatacaggattttctaatgattatcttccggaatagcaaggaggaaacatggcagatttagtagtgtcagatgtgacaaaggcgtttggagagaaaacggtcttacaggatgtctccattcggattcaagatcacgagctggtaagccttcttggagtgagcggcggtggcaagacaactctgtttaatgtgatctccggtcttcttactccggatcgggggcaggtgctcctggatggggaagatatcacgggaattccagggaaagtcagctatatgttacaaaaggatctgcttcttccataccgtacggtggaggataacgtagcgcttccgcttgtgatcggcggcatgaagaaaaaagaggcgaggcagaaagtagcgccgtattttgaggaattcggtctcttgggaaccgagaagaagtatccggcgcagctttccggtggaatgaggcagagagcggcacttttgcggacgtatttgttttctgaccgtctggcgcttttagatgagccgttttcagcgttggatacattgacgaagcgtgccatgcaccgctggtatctggatgtaatggagcagatccatctttccacgatttttattactcacgatattgatgaggcggtcttattgtcggaccggatttatattctgggagggaaaccggggcggattgtcgacgaaatccgcatcgaagagccaagaccgagacagaacgactttcagctcacagaccgttttcttttctacaagaaacgaattttacagacgatcgaagaaacagaggagtagtatcctctgtttctgattttaatcaaactgcgttttccaattattatcataatttgcgtcaaagcacatttgaatttgctcggcagtggtcttttcagttgccagattggccggcagttcgtcccgattaaaatatccgattcctgttgtttcgatgttttccgcaaaggaaccaccggtggatttgcataagacgaaaatttttataacaccgtaaacgtagtttctcacattatgcagcctccagtcctgaatggcgatcagtctttcggccgatacatgaagtcctgtttcttccctggtttcctttatcacattggaagctaccgactgatccacatcgcaccagcctcccggaagcgaccaagtaccgttattttcatgcacaagcagaatctttccattctggaaaatcgccgcccttgtatcaattttcggcgtttgatagccactttcattacaaaatagatttctcaccttatctgtaggaatgtcagacatgtggcttatgatctccgcggaaatttcccgaatacgtatatagcgttctttgtcataactatcttttccatatgctaatcccgcttgggcaaggctctgcaattcgattgcccattgcatccatgttttatgttccatcattcacacctcgttttaaaagtcagaagtaatcaacatatgattgccgatccttatcttataataaagacaatgtttcatacttttctgtattatttcggacaattactatgagtattctgccatattttgcggtattcaacaggagtgcagttgatatagtctttaaaaatcttaccaaaataactgctattacctaatccgcaggaaaatccaatttcggcgaccgaatcgtggctatgtgcaagtaatctgcacgcttcttttaggcgataactcctaatgtactctgttggggtagtatgtaaatagttccgaaaaatcctgaaacactcacgttcacttaaatatgctgtgcttgcaagatcggagatggtaattttttctgtataatgttcgtgaatatagatcatcatcattttgagccgctcgtcatttttatcgtataaactacgtttataaagccgctccgaaagtaaatcaaaaagcataagccatatttgtgataaaatttcccgcacttttatttcataaccgagatctttatctgataatttaaaaatgctacataacaagtttaatatatcagcgtgtttacaattatcgggtgaaaatgcaacgatttcaatttgcggtgccgcaataatcggcataacatatgttttttctaccttacttccgtggcaaccggaaatcagttccgggtcaaaaatgtgcagaagttgaattgttttatctttataagaagatatcggctttgtcatatgaagaacattggagtttacaaatcctcccatgccggcggaaaaggaaaggcgattttttggtgtataatattctaaaactccgctttcaatataaaaaagttcgattggcttatgccagtgccaaggaacaaatcttccgtcgtatttgtcgatttcggcgcgagaagagatataagggaaatcagatgaaaacccgggtaaaatttcttctttattttgaagaagttcaattttttttatgtttttcatttgctattgctcctgtttacagttgttttgctaacacttatattatagtcgatcatacaaataataccaagcactaagattcggctgggcaggctgcgaatctgagctgtatggcggaatcgttactacagaattaaatagaaaagatttggtaacaaatctgtaataaaaaagaaaagaaaatagtgaatttattaaaaaaattacaaatatgaatattataaataaaatttaagaattcttaaaaaatgtttccttgacggtccctatcctgggtgttattctgggaactacagtaaacgggtacccaaaatgaacttacgaaagagaaatggaaaaagctatgaatgaacacaaaagaagaacacgaagcagggagagcagaaagaaacaattatttctgcgggtagggatcactgttctgactcttgctgtcctgatattcggggggatgtattactacgtttctacacatcctctgaagctgaagggggacgtggtggagcaggagatgggagagccttttgacccacaggcatatattacgagggtctggcttggaagtccaggtgaagtcagcgtgcggtcggaagtggatacatcgaaagagggagattatccggttgtctatgagtggagagaccaccgtgagaaggccgttgtgaaagtgcgtgatacgacgccgccgacccttgtgctgaaggattacagtacggatctcgccgaggaaattaagccggagctctttgtggaaaagaccagcgacctctccgacgtttcagtccgctttgaaaaggaggatgactggagccaggaggggacgtataccgtaaggattctggcagaagatgcgagcggcaatcagaccatagaggaagccagccttacaagaaagaaggatacacagaagccggagattcagggtgtgcagaatcagacggtcaagcagggaaagagcctggattttacaggcggagtctccgtaaaagatgatatggatcccaagccatcattggaggttcactcggagcacgtcgattttgctacaccaggcatctataaagctgtgtataccgccagagaccggtcggggaatgtggaggagatcgttcagaaagtgacggtggaggcgaatccggagtggaatgaaaagatcgtatatctgacctttgacgacgggccgtcggataatacgaagaagattttggatatattagatgaatataaggcgaaagctacattctttgttacaggacataatcaaaagaaaaatgatatgctccgcatagcgcatgagaaaggacatgctgtaggacttcacacatatacccacgactatgcatctgtctatgagtcggaacaggcatattttgatgatttacagaaaatttctaacatggtcgagaaggtaacgggagaaaagtcccggttgatccgtttcccgggcggttccagtaataccatcagtaggaaatatgctccgggactgatgacgaagctcacgagggaagtgcaggaaaaagggtaccagtattttgactggaactgtgattccaccgatgcaagcggaaataatgttccggtggataagctgatcgcaaatgcgacgtcttcccaggcgaagcatatcaatattttaatgcatgatacagatgcaaaagacaccacggtggaagcactgccaaagatcattgagcattaccggaaacaaggctatgcttttagggcgctgacagtggattcgtatgcgccgcaccaccaggtcaataattaaaggaagaatgtggaaaaggcaggagccgtccggaaaagatccgggcggctctacttttttttgcggacggcaatatcttggaactggaagtagtctgggcggtggcgggactgggtatactcaaattgaatcccgttgtcgtcaaaggtttgattggtgatgacggcaagacaggtataatctttcagatccaggtacgtttcgtccgcctgggtcatgcgctccactgtaatggttcgcttacttgtggagatggagatccccagatcattttccagataatcatagacggaattgcgggcgatttccggggtcagatctcttacctgctccatgcagaaataattgtgatccagaatgagcggaattccatccaagtaacgcagacgttgaatgtagtacaatttggtgccgaaagggaaaccggtctttttagagattttttcgtcggcggataattgagaaaaatgaagtacctttgtaaatggaacctttttgtttcttatggcggattccaggaaggactcgattcctcccacggtaaaagcagcctgatccacgggctggaagatattgcgaacgccttttccgtgcattggctgcacatagccttcggctgtcagttcagccagagctcgccggactgtattcctggaacaatcataggtctgtacaagaagatgttctgatggaagcagatcctgataggcgtacgtttcgtcttcgattttctgtttcagatcgtgatagatgatatcatactttgcttttggcaatgttttgcactcccttttcttgtttaaacatcttaagatacagtataaggacattgggatcagaaagcaagtagatttttagaaaaatgattgacatgtttaaacaagcgtgctatattaaagttgttcaaacaagttcgtaaaaataaatggaaaaggagagagaagcatggcgaaatacgagaatgacgtgaagcagcttttgaagctgatcggcggcaaggaaaatatccaggctgtttcacattgtatgacaagaatgcgtttcgtacttgttgatccgaagaaggcagatgaaaaggctattgaggagattccggcagttaagggaaccttcacacaggcaggacagtatcaagttatcattggtaatgatgtgtccgtgttttacaatgaatttacttcctatgctgggattgagggagtaagtaaagaggcggcgaaggaggccgcaaagacgaatcaaaatgtagtacaaaagatgatgggtgcgcttggtgagattttcgcgccactgatcccggccctgatctgcggcggtctgatcctaggattccgcaatatcatcggagagatcaattttttcgagaatggcacaaagagtctggcagatatgtatcagttctgggagggaacttataatttcctgtggctcattggagaggcggtattccatttgctgccagtgggcattgtatggtctatcacaaagaagatgggtacgacacagattcttggtatcatcttaggtttaacactggtatcttcccagctattaaatgggttcagtgtggcggacacaccgacggccgatattccggtatgggattttggatttgccaaggtagagatgatcggttatcaggggcaagttattgctgccatgatggcaggatttgtccttgtatacctggagaaattctttaagaaacactgcccggaagtgatcagtatgattgtcgtaccgttttgttcccttgttccggcagttatcatcgcacataccgtggtagggccgatcggctggaccataggaaacgccattgcggatgttgtctatggtggactgatgtccagcttcggatggttgtttgctgggctgttcggactgctctatgcgccgattgttatgacagggcttcatcacatgacgaatgccattgacacccagttggttaacacgtatgacggaacgattctctggccgatgatcgcgctttctaacattgcacagggctccagcgttttggcaatgtccattcttcagaagaaaaacgaaagagcacagcaggtcaatgttccagcatgtatctcctgttatcttggtgtaacggagccggcactctttggtgtcaacctgaaatatggattcccgctgatctgcggtatgatcggttctgccatcgcggcgatgatctctgtcggatttggcgtgcaggcattaagtatcggagtaggcggactccctggtatcatttccatcaagccggaattctacctgatttttttgctggcaatggcagaagctatcgttgtaccgtttgttctcacgttttttgtgggaaagaagaagctctctaaggaagacagaggacttgcggcaaaagggacaacagcagcgacagagacggtactaaaagaagaaacagcggagtcagtagacaaagccccggaagaatcactgacagaaataaaagctatcttaagcggaaaggtgattccgattgaagaagtagatgatgatgtattctcccagaaagtcatgggagacggtgtggcaatcgagccgaccgatacgacagtggtagctccggcggacgcggaggtcagcattgtcatggcggagaccggacacgcatgtggactgacccttgccaatgggatggagatcctcatccatgtgggaatcgatacagtggacatgggaggagacgggttcaagctccttgttgctcagggagatcatgtatcatgcggagcaccgttgattcagtttgaaccggagaaaattaaagctgcgggacatccgacgactaccatgttgattctaacaggagaaggaactgcccgaaatatccagatgagaacagggcagacagcagaggcaggaaagacagccgttatctcatttgaatagaaaaatgaagaagaaaagggaggaaagcgcgtgatgaaaacagtagattttaagaaaagtacggtttatcagatttatccgaaatcattttatgacagcaaccacgatggactgggtgatctacgtggagtgatccagaagctggattacatcaaagaacttggagcagactacatctggctgacgccgttcttcgtatccccacagaatgacaacggatacgatgtggaggattattacaatattgatccacgttatggcacgatggaggacgtggaagagttaatccgtgaagcggacaaacggggaatacgcctgatgtttgatatggtattcaaccatgtatcaaaccgtcacgaatggttcaaaaaagcgatggagggcgacccgtactacaaagactttttcttcttcaaaaaaggcaaggaaaacggagagcctccgactaactgggagagtaagtttggcggaagtgcctgggagtatgtggaaaaattcgatgaatattatctgcatctttatgatgtcacccagccggatcttaactgggacaatggaaatgtccgcaaagaagtgcagaacgtcgtgcgcttctggatgggaaagggagtcaaaggcttccgatttgacgtggtgaatctgatcagcaaaggtcagttcgaggatgactacgagggagacggcagaagattctacacggacggaccgaacatccacaagtatttaaaagagctgcacgatatgacattcggcaccgacgcggaaatcgtgacagtaggagagatgtccagtacttccatggaaaactgctatcagtatgcaggagccgataccggagagctatctatggtatttaattttcaccatctgaaagtggacttcatgggaaacgagaaatgggtcctggtgccggcggactttggaaaactgaagcagatcctttttgactggcagacacagatgtcggaacaccatgcatggaatgcggtcttttggtgcaaccacgatcagcctagagttgtgtccagattcggaagtgaggataaatactggaaagaatctgccaaaatgttgggaacagtgattcacatgctgagaggaacaccgtatatctaccagggcgaagagctcgggatgacgaacgcaggctttatggatatttcccagtaccgggacgtagaaagtattaaccactttcggattctccaggaaaagggattaacagagtccgatgcctatcggattctgcagattcattccagggacaacagccggacgccaatgcagtggaatgcaagtacgaatgcaggattcacgtccggggatacaaagccttggatttcggtgaatccgaattatataaagatcaatgccgaacagcagatgagagaggatgactcgatctttgcttattatcagaaactgattcgtatcaggaaagagctggatgttgtggcatacggcgatatcaccccgcttgcaaaagaccatccatccgttttcgcttacagaaggagctatcagaacgaagatatgatcgttgtcaatcatttctatggaaaagataccgactggaagatcgatctggatttgaccgggtacgactgtatccttggaaattacagtgattacacgaaaccacagggagggacatggagacttcgtccttatgaaacgatgatttggtacagaaaataaaaagtcatacaatgggggcagatttctcatacaggaatctgccccaaaaatacgatacagaatatcatgttttcagatcttaaaaccggatccagcgctttaattcctggtagatccgtgcaataggaagtccgacgatagtattgtagtcgccgtggatgcctttgatatagacggcaaaagcgccctggattccataagcgccggctttgtcgtaaggctcgtctgtattcaggtaggccccaatttcttccggcgacatcggatagacgtccacatcgctcgattcgtagaatgtatgcgtcttctcttttgtgccattataaagtatcaaactgaccccggtatatacctggtgtatgtgattctgaagggaagagatcatctggtaagcgtcgcctcttccggatggtttgccgaggatctgtccattatttgccacaacggtgtcggatccgatgacgagaaatgattcgccaggatgggcagctttccatgtagaatacacattctccgctttttgccttgcaagttcctgcacgacttcctcaggacgggaggaggtgatccgctcttcacaggaagatgggagtacggtatgttcgattcccgcctgggtgagcagctccgtccgtcgtggggaagcagacccaagaacgacagtgaggtcagaaagggacaaccgttctgtttgatcctgacgggattctgaggaggagtccaaagcgccacaactctgcactgtttctttttcattccatgcatggatgcatgcagaatcgtattccaggtgagaggccggatcaaacacaaggatctggacactataaggttttaacgtgagctgtccattcatatggaaacgttctcctccaaggagatcctgtacctctccttgaagttcgccatggttggcggtaaagtcagaattttccgcattgatagcaacgaatacccgctcccggtctgtctttcgctcgaaaatgagctgacggttagtgatgaggacattccgatatgagccgttacacagggcgtcgcttttctgacgaaaagagatcagccgccgtaggtactgggtgaattcgttcggctttggcgactcaaagcaaggccggagagcatagtcattgtcaggagcttttatgccttcctctccccattcgcttccataataaatacacggaattcccggcatggtcatcaatgtgccatagactggataaaggtggcgtttatcctttaaaatgctggcgatccgtgtaacatcatggttatctacgaatgtcatcagatgcttgccccggtagatacaccactgttccgggccaaattgacgattcagggaatgggcgatttcaaaaagattcatatcgttaaaactggagaacagccctttgtaacattcatagttcgtgcagctatggagcatttcatcattgacgatctgattgtagtccccaaacagaacttccccaatgagagcgaagtcaggttttaattcggtacagaaactccgcagtcttctcataaatccgtgatccagactgtatgctacatccagacgaagcccgtcgatttcaaaggtttcgatccagaagcggacacagtctaacaggtaatccaccacggcaggatttttaagattcagtttcacaagctcgtagtgtccttcccatccttcataccagaatccatcatcataaccactgtttccatcgaagttgatatagaaccagtctttataaggagaatcccatttcttttcctgtacgtcctggaaagcccagaatcctcgccctacatggttgaacacgccgtccaatactacacggattcctttcgcatggagagagcggcagaccccggcaaagtcctcattagtcccaagacgacagtcgattttacggaaatcccttgtatcatatccgtgattgtccgattcgaaaaccggattcaggagaatagaatctacgcccaggtctgccaaataatccgtccagtccagaagtttgcggattcgggagacggtctgcccgtcgttgtgtacaggagctccacagaatccgatgggatagatctgatagaaaatactatgataagcccacataaaaagcctcctcattctttttggtttctgttattctatataaagaaataaacagtaacagtgtaccatgttaaaaatcaagattcaacgggtggagcccgaaaagggagggaaatgagatgactatgaaaaatggaagaaaaacgcaaaaaaaggttgacacagtaggaaggtaataatataataaaaaagtatgacgtgagaagaaaacagtttgcaccaaagccccggagcggactgatttcccaatatatacatgaatgttagtagaaaatagagaatgtaaacaggaggtcaaccaatgaaaacttatatggctaatccagataagattgaaagaaaatggtatgtagttgatgcagaaggacagactttaggtcgtctttgctctggaattgcaaatgttttaagaggaaaaaataaaccggtttatacaccgcatgttgatacaggtgactacgtaatcgtaatcaatgctgacaagatcaaagtgacaggaaaaaagatggatcagaagatctactacaatcactccgagtatgtcggcggtatgagagagacaacactgaaagaaatgatggctaagaaaccggaaaaggtaattgaacttgctgtcaagggaatgcttccgaagggacctttaggaagagcaatgatcaagaaacttcatgtttatgcaggtgcagagcatgatcacgcagctcagaaaccagaagtgctgacattttaaggaaaggttgagaggaggaaaatacagtggctaatgcaaaatattatggaacaggaagaagaaaaaaatccatcgcaagagtatatttagtaccgggaacaggtaaaatcacaatcaataaaagagacattgacgagtattttggacttgagacattgaaggttgtagttcgtcagccgctcgttgctacagagacaacagataaatttgacgtattagtaaatgtacacggaggcggatacacaggacaggctggtgccatccgtcacggtatctcaagagcattactcgaggctgacgctgagtacagaccagtattaaaagcgaacggattccttacacgtgatccacgtatgaaggagcgtaagaaatacggtctcaaagcagctcgtagagcacctcagttctccaaacgttaatatacagattgtttatcccgggagtttcggctcccgggatttttgaaattcggaatctttatcctatagtctttattcgtacggacggtggtccgatacggccacaatatttagtttctcatttttgccttactatttcagggcagcataccatcaaatttccaaaagacagattttaaccgtatccggagaggggggtgtacggtcagattctcaaaaataacatttatacacgtgctaaagggagaacaggtacggccaaatgtcagaaagtcaatttataaccgtaaagaatagaaaaaggtacggtttaatcgctttaaaatcaattcttaatcgtaaacccatgaaagatcaataagcaaaggagaaaggcatatggcaaatctcaaagaaatgttatcaaaagaacaaaaaagtgttcagtattaccatcatatgtatgacaatgaaaagaatggttcttatattccgaaagcaaagaaggaacggatttgaactcttgcccagaagtcctatgatgaaaggatagtaagattagccagaaagagacttggtcagatcgggagaattttaagggattacgatgatgacgagatagaaaagatctatttaaaagagcatgatgagagaaaaaagctaatccacccggtagagccgacatgggagccgcaattagaaaactggcttggtgaggagtataagaagaaagaattccgggcgggagcgctaattattttaacggagaaaggcgaacgagtacgatccaaatccgaaaaaaattctggcagattacttttatagaaatgcgataccgtatcaatacgagaagcctttgtacttgaaaggtgttggaattgtgtatccggattttacgttcctttccagaaaaacaaaacaggaaatatactgggaacatgatggaaggatggatgatccgtcatacgttcggaatgctgtcagaaaaatgcatgcgaatgaaaagaatgacatatatccgggagaaagattgattctaacatttgagacagaaaaaagtgttttggatactgcgattgtgcaaagaattgtggagaagtatttacggtaatcatataattttcaatgattatcattaaaaatagttgggatacacacaaaatgcgattagaatagatgtaaagctgcatttcagagatgccgaagtgtagcgtgaaaagaaaggaatattaccagacggatgatgtgaggatgcgaacacaacgttagataaacaggcagcgcaggattattcatccgattgtcgtgatccttgggaggttttctttcttttgttagagaattgtggtagaatttagctatattgatatgtggtatgattgaaattaaacggagaatattatgaggcggagttcctgctgccgatttctaattctctcagaatgggtatatgtggatatgaaggtggcaatacatattcagaccaatttgagactgatagagaataattgaaaaaagatgatccgcttcagcggtggagttcgggttgacggtgtttgcaaaaggaaggtacataaaactatttgagatttataagaagagggaattgaggtgaaaggaatgaggaaagaagccagcaaggaagaatggaaaaagttgtatgatgtggcgactcgaatcaaggaattaaagccatgggaggatttctgggatctggacctgatctgtttacgcgaaggcgggcgggaagatgcagcctttgtcagtgtccttggaagaggcggcgagtattatgggattgttgtgtatgaaggatacgaggaactcaacacctttatgatgatgctgaatcgggagcggctcaatctgacaccggagtttgcgatgggaaaccagagtaatctgacttgctactgggggaaccgtgaagagctaacggaggcagaacgggaaatcattaaggagacgggatataaatacagagggagaaaccagtggctgtatttccgttcctgtaaagaaggatattttccataccgtatgaatcaggatgaggtacatcggatgtgctattatttggaacttctggaggaagcggttttgaaatatcggagtgaagaagtcaaggtcgatttccagggcggtgaaatgtatgtctattctattgatccggagacagaaaaccactactggggcgcggaggaacttccgtttatttccttcaattacaggacgttgaagctggatgatccagagatgcgggaggcgttaagagaagtaccgggaaaccgctatgtgagtgagatggatatcgtctatcaggcggcgaaaatgaacgacaaaagttacgacagaccggggaatatgagaatggtagttatcgccgagtccagaacggagatcattatgaaagcacagcttttgaagcctgaggaagaccagattgcggtactggctgacagcctgatcgagtttattggacagtttggcgctccaaaggaaatccgtgtcagtaatttgatcgtggaggctgcgctggaagatatctgcacgctaaccgaaacgaagttgagacgtgtgagaagacttcagtccattgatgattttatcaatgggatgggagagcggatgaaatagtgccggggcaggggaacttgtcagatttaaccgatttcaggtatttgtgtcatgtctataattgcctgaaaattcagactattatagacatggaaagaaaatgacaaattaataaagaaaaaagaaataaatctattgacaaaagaaatcaagagtgctatagtaaaactataaaataacagatcagatttgtaggacggacgcgagccgtaaacagtcggttgttatttctttcaacacaggtgttgaaggttccgggaaaagaaaggcgctatgtatcggaacatcaagtttatgaaagagaggtacggaccaccaaaaacgtaaactttattaccaaaatccgggagaaagaggtaaaagaatgattgaagaatcaaagtagaggcgggtgctgatatatagatatcggtatccgtctttacatattgtatagaaggaacggtcattccgtttctttttttattccaatcttttttttctgtctgggaggaatctcttgaagtgaagaaaatgataaagtataatgattgcatggatccgtttcagagacggaagaaaggaagaaacatgaggaattacttcgattgggacagatttggagaggatatcagacgtacggttcaagatgcggtggattcgatggatttccgaagcctgaatcagacgattaccgatacaatcaacagtgcggcaggcagttttaagaaaagtaagaaagactaccgtcgccggactgctggaaacgggtgtggcacagcaggtaatgactgggcaaaagtagatttgagtaaattgaaacaaccgatgctctatgcagggacaggtggtaagaaagccgcagcaatggcgttgtcgataatagggcttggaattggaggagcttttcttgtaggggtgattttaacaggtcttactatgctgttaatagaatccagcacgggagtgatgtttgggttcctttctcttgtaatgttcactgtgatttttggcggtgtcggaatattagggatgaaaaagcttggacgggtacggaggtttcagggctatctttctgagttacaggggaaagaatactgcaacatcagtgagctggcaaagaggacaagaaagaaggataaggcagtattaaaagacctggagtggatgattgacaagcgttggtttatagaggggcatttggatgataataatacctgcctcattaccagtcacgatgcatatgaagcatatcgtgaactgatgcggaagcaggatgaagttagaagaaacgaggaagaagctacaaaaaagaaagcttgggaaaagaagaccatggaagaggagagggcaaagaaaaggcagcaaatggatccacagatccggtcgatgatggaagcaggacaggcatacattcaaaagctccgggcatgtaatgatgcaattccgggagaacttgtttccgagaagatatcccgtatggaggaattgacaaagcggatttttgaccgtgtggagcaggatcccgattcggtggatgatatcgaaaagctgatggaatattatcttccgacagcagtgaagcttctggaggcatatgaggagctggatcaccagccggtacagggagaaaatattttgaattccaagaaagaaattgaagatacactggatacactgaatatcgcatttgaaaagcttctggatgatctgtttcaggaaacggcatgggatgtctcctcggacattaccgtgctgaaaatgatgctggcgcaggaggggcttacggaagacgactttaagacaggaggaaaataatgagtcaggatttaaaagatttacagaccgggccggtactgacgctggatccgtttctgggagaaaaaaaagaagagttacagccggagaagcaggaagagaatgtaatggatgaaaatgtgctgacggaagaagagcgcaaaatggcagagcagtttgcacggcagattgacctaacaaattccactatgattttgcagtatggagctggtacccagaaaaagatggctgatttttccgagacagcgcttgataatgtacgaacaaaagaccttggagaagtggggaatctgttgggcagcgttgttcaggagttaaaagactttgatgaagaggaagagagaggattttttggaatcttcaaaaaacaggcaaataagcttcagagtttgaaaacgaaatatgctagtgcggaggctaatgtcaatcagatctgcaaggttcttgagggacatcaggtacagctaatgaaggatattgcggtattggacaaaatgtatgagctcaatctgacttattttaaggagcttacgatgtacattttggcaggaaaaaagaagcttcgagaggttcaggagacagagcttgctgatatgagaatgaaagcgcagagaagcgggctggcggaagacgcacaggcggcaagagacctggaggccatgtgtcaaagatttgaaaagaagattcatgatctggagttgacaagaatggtttccattcagacagccccgcagattcgtcttgtacagaataatgacacgatcatggcagaaaaaattcagtctaccattgtcaatacgataccgctttggaagagccagatggtacttgctcttggtgtcgctcattctaggcaggcggcagaagcgcagcgagaagtgacggatatgacaaacgaacttctgaaaaagaatgcggagacgctcaagatggcgacagttgaaacagcaaaagagtcggagaggggaattgtggacatggaaaccttgaagacgaccaacgaatcgttaatctccactttagatgaagtgatgcaaatccaggcagagggccgtcagaaacgccaggaagcagaagtggaaataagaaagatggaacaggagttaaaagagaaactgttgcagattcggtagatatagaaaaacagggacgccagataagttggaacgtttctttggaagcgattgtgattttggattcagaatcataaaaggctgtttggtttttctatgtttattctcaaaaatccggcggacgagcagcccatataactttggtctgcagtttgtgtgattgcacagagagtggtgataaaaagataaaaaaagtcgaaaaaagaagttgacatttataagcacagatgatatgatataacacgttccgctgataagtgtcagaacaaaacatcaaatgcagatgtctggcccgggcggatcccggatagagagaccgggacgccggatcaaaaaactggaaaaaagatgaaaaaaacacttgacacagaggaacagatatgataatctaatatagctgtcgcgagacagtgcccagaactttgataactgaacaatagacaacgatccctgaaaattcaagagaattattcagaacaggaactttaagttccacaaaccagacaacagtaacgggatagattagcgagagttgatcttgaccagaacaagttcttattacgagagtttgatcctggctcaggatgaacgctggcggcgtgcctaacacatgcaagtcgagcgagggagtcgctatggggttcgtcggcaactacgccccttgtggactttcaccacagactgacggcatgcccgtcatacacaaaaaaggagtacgtttctgtactccttctgactcttactcctgtatgccactgcattgtattccttcctgggctggatcatccagaagatttccttcaacatcaaagcgggaaccgtggcaaggacagtcccaggattgttcatccgaattccaggacaactgacatcccatatgcggacagataatatcaacctgcctgatttctccttcctctgttttatacacgcccacttttccctcggatgttgcgacaacggcgccctaccctctttccagagaagaaatagtctcatccggaatctgaaaaaaccgtctcgtcagccccgcaaccgcctttttcccatcttttaggatatgtggaatctcctccgctgaaaaccgtgacggagaaaacacatctgcaaacggattttccctgttgcaaatcaaatctttcaaaatcaaagctgaaaccatggaggaactcatcccccatttctgaaatccggtcgccacataccagttcggtctatcggatgtatagattccaataaacgggataccatctgatgtgatacagtcctgtgcagaccaggctgccgccacatggctccccggatacagctttgccgccgtttctttcagtctcatgtagcatccgccttcccggttctccccggtccggtgtccctcgccgccaagcagaagccaatccccatattgccgaaaggagaacttttcctccccgtctccaatatacataccgtggatttttcctgccccttccagtgccagcacataggagcgctcctgatgcattctcgcaaaatacattcccgggaacttcaaaaacggataatgtaccgcaaacacaatctgggctgccagcacattcccgccagatgttctgatcagatgatcctctacttctgtaactaccgtatcttcataaatctgaagtccatttgccaactcgcatataaatttcaacggatgaaactgagcctgaccgaagaaccgaaccgctcctgtacaatccacaggaatctccagatggcgctccaaagacacatcgatcccaagcctttttgccgcttctgcttcctgcatcagcttcccctcatctttagaataaacaaaagcgtctgtttcctcaaaattacagtctatttttgtttcctgtatgattcttttgtattcctccaccgcctgctggttcgcctgcacatattttctggcggtctcttctcccttttttgcaagaaatgtatgacagaacatcccatgctgggatgtgatctttgctgttgtgttctttgtctggccccctcctatcttatctgcctccaacactacagttcgcactccagcccgttctaactgccatgctgtcaaaattcctgccatgcctccgcctataacagcgacatcaacttcgatgtcctttgacagggcaggtctttttgtcaactcacatgtttggctccaaattgattccatcacgttcctcctgtggtcttttctatataagatttcccaccgggaacgctttatactaattttttctgcctttccccagatccgggactgtctgactatttataaaatcagtctagcaagaatgttacaaacacggttttccatttccattttaatttaactgtcgttgaaagattctcttctgactaaaaaacaacaaggtgtatgggaacagatccgatacaccttgctattctttcgttgctaaaatataatgttacatcattttcttatcaaattcaggattaaagtaatagtagttcttttcatctaatttttcttttgttttttccagtgcttcaccaaacctctgaaaatgcacaatttctcttgctcttaaaaatttcagcggctctcttatttccggatccggaatcatccgcagaagattgtcataaacagtacgggctttctgttccgcagccagattttctgtcaagtccgtaattgcatctcctttggactgaaattcctttgctgtaaaaggtatcgaggatgcggcctgtggccagattcctgccgtatggtcaatataataggcgtcaaatccagccgccttcgcctcctcaatgtctaaattttttgtaagctgataaaccatcgcacagatgatctccatatgagcgagttcctccgtgccaatatcggttaaaagaccgcctactgctttcagaggcatcgtatagcgttgagaaagatatctcatggaagctgacaattcgccatccggtcctccatactgactgataatgagctgtgccgtctttggacaggtctttgtgatcttaaccgggtattgcaaccttttttcataaatccacattagtaacacactccttcccaaggaatcgggccctcctgccagcaatagcatgtggacgaaggatccctttcataaatcccttccatacagtccattgtcaacggataaaactctgtggcaaaatcagacaacatctgcttcctctgaccaagcacacgctttagcattgccagagcatccagatcatccggatgtgtgtccaggtacagtcgcaggtcatccatcacaaagctgactttttgtatttccatcagtctttcattacatttttgctcttcggggctttttaacgcatcttcgctggaagtcagagaagcacggatctgtcctgcagcgaaaaacggcaaatccagttctttgaaaatggtgccggtcttcagtgcgtcatcctgattatagagttcaccccagctctggacaggaaccgacgcaatcgccaaatgttctttttgtatcttcaccaccaacaactcccttcaaaaatgaaattggcttcctgattattatttgcaaattcatttttaatgtttcaagggaattttttcattttatatagacatttcttcttggactttctctgtatagacggcagaatccgcaaaatggttagttacaaaacttactgccctctccttataacctttcagacatacattgtattactccaaaaaagaatgactcataatataaaatgcttcttgtgcatgggtatatttacgttgtttctgaggtagggtatcgtcatagtcaagcgcgtcttcaagagaaacatccatcaccggactatcttgatagtaccacctccggccatccagcacaccttcttttagctcttttactagcatagctgccggaaacttctccccttctacacagatattatgttttttacaacttacaaatccactggatacatagttacatggcatcccaaaaataactacagtatcatatcccatcgatacagctttttcaaatgagtgctgcatcagcagctttccatagcctttgcgctgataatccgcttctatacaaagcggtccgaatgttaaaatatgtttcatatttcctttttcatctgtcaatgtcgccctcgtgtacatgatatatcccacgaccttattatcaagttccaaaacaaagtccagttcaggaataaaatctttatgctctcgcattatgtgaacaagatagtgttccatgcatccgggtatatataaattatagaaagaatttcgtgtcatcctttcaacaatttcataatccctaggttcctcattacggattgtaagcatttctgtcttcctcctttttatacctctatcctgtttacgttttatgttaggatatgggtctgtatccggtttttatatattctatcaacgtctctacatcatcaaagtcgtcataatcaccatttatctcatcccggtgatacataataccatttttttcgcttctttcaagacagtttaaaagaaactctttaccatatcttctggcaaattcagtaaaagcatatggttttattttactaagtaatccctttctacatttttcattgcactcataacaatgttctattttttagaaatagagcattgcctgttttcacaccagtctttgtctggacatgtacctgaatcacagccatcacatgtcatattttcagaacaaaagcaacaggcaagcccacagcgagcaattcctaattctcgtttcattatatcctcctggtttacaggcagaaaatttacttattctgtgcagagactgtccgtcagccgattccaggccctataaaacaggtgcccatatactgctccgaaaatattgtggaaaatcctaaaaaatactgctcctggaaatcccagaatccctgccgccacagacatggcgcccagagaattaaacacagactgccagccgtaagtagcggaaaagcctactccgatccctcccaacattcccaggtaggggagaaagcctttcggaagtagtagaaataaaaggctgaacaacagtcccccgaccaggtttcccggaatcctgccttttattcgttctttcacgtctttctcaaaaggaaccattaccgacatgacagcaatccctgcccacatacctctgggaagtcccaggcactctacgatacagatagcagaagcaatacctaaggccatcgaaagctgccatcttgtgcgaagagaggtaggacgcagttcctttacaatgctgaaaaaggttcttttataggtctgctttctgtgctttctgtaatatacgatttcagtaagcattgcccccaagagcagtcctgccagacgaagcacataagcttttccttccgcgtcgtagccgtacagcagcagatagctcaagaccaatgtggaatgattggccatcatcacatggtgacagccaaacagcaagatcaaagaaatggaaaccacatggacgatcattcctgctccagacgggactatatttgccagtctgggaccaactgccaggataaaaaattgaagaaacagtatcgccagtcccgaacccgtcttgactccgaaatccgcaaatcggaacaccatcaggcaaagaagcaccactacacctacaatgctgttctcacttccgaagatcccgctgtatgcggaaacaaaagcgacacagaatacgatcgtaagaaaaattttgaacagatagaccgtcgtatgccgaagtttattttttataccttctgtattttggatcagttttttggatccggcctggtctaattgcagttcctgataaaaagtcatatacaacatcactcctctgtttttaccggagaggaagtataccagctcatcttcaagatgtcaaataaagaatttctaaactacagctcctcataacgtatctatgcgagatttaatgaaaatcagcagtaatagcttgtctctcgaaaatatgtaaaccatttctgaacaatatcagtactacgcacttcgatcattttcgtcatactaggcaatgtctgtgaagatactcaagtaaatatattcttctggtgtaggtgttctgttcccaaaatatcgtttgaagttcaactgcatatttacccttagttccgatacatgaatcctgtttgcctttgagttctatcataaatgttttctgataattatttataatttgtatatttcttttttcacctttcatgtttcaaacaacgccagacaccctaaagggaagtacataaataaagtcccaacgaaaagcgaggcaaatgataagcacataaagccaatggcagaaccataaccatgtattttttctgaaagagtatcaagactttttacttccccaacagagaatcccccctatttcataaatcaccaatatgaaaaaaggattactgaaatcggtcttgaactctgtgaaaaaatctcatacattttgaaattgatgactgctaatgtaattccaaaggctaccagccatgtattatgcaacatgctttacgatttccgagaacgctcataacctgcgtcaaatgatgatcccctttataagtaggtgctaagataaagggaatgaccaaatctaaaatcaaaactatcggtaatataatcataatgttattcctcatcattaataccactatttattattcttcctcatttgaagcgcccctctttttaaatgaaatacgacatctgctctttttacgatttcattagaatgagtaacaataactgcacatttattcatttggtgcacgctgtcctccagtatttgcataattgacattaccgtatcttcatctaggtttcctgtgggttcatcagctaggataacaggcgcttcagaagccagtgctcttgcaatcgccacacgttgctgttgcccgccggaaagttgtaaaatatttcgcttcatttcttcttttgtcagccccattttccctaaaataggctctggtggtaatttacttgttaattttacattttctatcggcgtcatataatcaatgagattatatgcttgaaaaacaaatgaaacatgattacgacggtgattttcaagccctctttccataatatcttttccgtcaaagaacactttcccttttgtaggactgtccaatccgccaagtaaggaaagaagtgttgttttcccacatccagatgtcccaaaaatcgcatatattttacccaattccatttctgcgttgatgttatgaaatacattcttctttttgtcgtaactgtaacttaaatttgaaaatgataatacgctcattttaatatatcctcctaatccatttttgttaaaatatcttttggttttaatcgaattacagcataggaagcaacgaacactgcaaaacaaacaagcaaaagaccaatgccgtatactcttaccatatcagaagttgcgatagatacggttatatctgttacgttttctcctgccttaccaatgatgtatctgccaattttatccgtcagaatacttgttaaacaagttgttgcacccatagaaagcacccctattaagatgttttccgataataattgtcctgttatttctactttgcttctcccgatcgcaagcagaataccaatttcctttttgcgaccttttgtccaaagcataagaagcagaataatgactaaacttccgataaccgtaatcaataatactgctgtatcaatcatgtttccaaaagaggaaagtggcgttgatactaaatcaaaatcttctgtattaacattgaatacaaatgtttttccctttacttccggaaggtttttaattgtttccatcagctcttttgcttcttccggagtatgtgtataaacatcaagataatcatagccctgtaattcgtaaatttcttttaaactattcacatcaatatatccaagattagcaggaataccatctggtgttattgccgaatgcgtcaatccttccgttccactgaaaattcctacgatagtaaacgtagaggttccatcttcatcaatcccattttgaaatgtaattttatcatcaacggtaagattatttttgtccgccagttcttttgaaatcagagcaacgtatttgtcatctggttttatatgccgtccttcctctaatttgtatgtcccattcagaaatttagtatctaagaacgagtcaagtaaagactgatacggtgttgccagtcccgaagcatttatcataccgggtaaaggttcaaaactttgaggtattccccaaaatccctcggaactttttgcattatatccgataaccttaccaagaccagcgattttatcaactattttttgtgtaataaaatctccgttataggtatagccagaagccccattaccataatcttcagcagaaccatagttattcatgtcatttgtatcaatttctatacgaacagaagctccaaccgtttcttttatctgctttgttccctgctgaacagctttctcgctggaaattgcaattaatactgttgtcgacagtaaagtaaaagttaagaaaagcaataaactgcgaagtcgctgtctaaagcaatatttcatggctcgtttaaaaaaattcatctaaaaaatcctcctaactcattttagtcaatatttctttcggtttaagagaaagcaccattgcacttgacacaataactgttaatgccgtcatacctgtttccgtccccaataacaatattgttttataaaaatcaagctgtagataatttgtattctttgttgtcagttgaatatcctttatggtttcctgcatgactgtagcaaacaagtgtgtatttagcatagtagatacaggaatgaaaataataacagccaacaaaaagcccatgaacaatacaagaacagcttctataacaaattgtccgataatctcttttttgcttctgcctatggaaagcaaaatgcccacttcttttatccgtcctcttatcctcaatgtcatcatcagcattaagattacaattcccagaacagacactattacaattaaagaggtaactatattctgtattgtctgcaactgagcggaaatctttgaaaacttgaaatcattcttttgcacaatatgattattccagtcaatcgaagttaaattttcaactttctctgttatttcattaagaagcagtgggtcagaaataaaaaatgacaattcaccctcataaacatcttgtttttgctctttcaaatcaaaaagtaattgtctgtcggagaaaatcatattttctgctttttttgcagttggatttaatccgctgtcagtcatgtttttaatttcaaaaatccctttgatttccacagtagcaaacgcagtcttttccttaatcagatcaatgtaatctccattttcacttcctaattccgcatgggtgagttgaagtgtatctccgacagataactgattttttcttgcaagttctttactaataagaattttatttttatcttccagcttaatatgacttccctctatcagcctgcattcttcattaaaaaatgtttttgttaagctggagtctctcaccgcaatcacttctcccatgttactgtcttcactatgtcccattccggcaataaatgaaagattttgtccttttgcgaagccgtggtgctcggtgttgtacgttttcagtttcgtaccaatcacatctaatatttggcgaatagcactttcataaatgacaggtgttccattactggaaacttgaccgttttctgtcacgaattgttcataaggtcgaatatcaaaagaagctccaatattagaacgcaggtctttagaaatctgtgaagcacctgcaaacaccgaaattccagctaacactgaaaatgaaataaggaaaaaaatcccacataggataaggtttttcccctttttgcgagttaaatataggaaaacccgctttccaatatgcataaaaacaccgtcctttcttttatgtttctatcataaaaaaggacggttttgttttgatttaatttcaatttaattttgatttggattttgagaatttattgtgattttaaagcagactccattttcatcattatttatcgtatataaaagaccgtgtttttctaaaatattcttaactagataaagccctaatccactgccaccggttaatttattatgggacttttccacacgataaaatggtgtaaatattttattcaaatcttcctgcggaattgtaattccctcgtttttaacaagcaattccttatctgtaagagtaacatatacatttgtttcaacaggtgaatggcggattgcattattgataatgttatgcaatgctttttcaaagagggactgatttccgataacctgcacatcttctgttaacctctgataaatcgtaatatttttttcgtcagctaatggcttcaaatattcgcagacacgttttactatatctgtcacgggcaaagttgacaggttatctatttctcccagctctaattttgaaattgacaaaatttcttttacgagattttccatattttcaatctcatgtaatgtctctggcaggatttttcttgtatctttataacgctcgatttccataatcatactttctacttgccctttaataatggttatcggtgtttttaattcatgcgaagccgtagcgaaaaaatgctgacgctgtttattcagttcttcaatgtgttccatctccaacttcagttgttcgttggcagtttcaagctcattcatagtatcagacaattcttttgacattgtatttaaactatctgcaagtatcccgatttcatcagaacgggtaatcgtacatttccatgtcatatccagttttgccattcgtttcgatacttgactgatttctataatcggctttgcaatcagccgactacaaaaccatgctcccaaaaatgaaacagcaaatatgattatcaaaagaaatggcaatagtttcaacaatgcgttattaagttcatggttagaagaaataggtacaacaatatttattacgtaagtttcaacggtatctgcaaatttaatttcttgagcaaaagacatcatttctgaactatttgaagttaaatttgaagaattaccatactgatgtttttcgccatcatattgaaatatgatagtagcctgattattttcacaaaaccgttcaagtatattttctgcgttttctaatttggtttcagacagcgtttctaccaatctatcaatttccatattagtctgttctgatgatacagcaacataacttttgggcagaaacaacagaatactcccataaataaaaaaactacaaaagagtaaagacccggcgattaataaaaatacttttatacttaaactgtttttaattttcgctttcaaacttatatcccacccctcgtatcgtttgaatacagtcaacatctaatttacgtcgtaaattcataatatgaatgtttactgttttttcatcacctgcaaaatcatacccccacacctgtgaaataagattatcccgtgtaaggacttgatttttgtgtttcagaaaagtcaataacaactcgaattccagttgggttaatttgacagggataccatttttacatacttcatagctatctacatttagttcaatcccatgagaagtcaatattttttgatttcctgttttttcttttatgcgtctaagaacagcctctattcgcattaatacaagttttagagaaaaaggttttgtaatataatcatctacttgcagttcaaatgctcttatttgtgcttcctcttcatccattgcggtaagcataataatggggatatcagactctttgcgcataagctcacatacagcgtacccgtcaattttcggcatcataatatctaaaagaataagagcgaatgactgtgactgaaaaaacgaaagcccctctaagccatcactggctaaggatacttcatatccagcgtccgtcaacaaatcatatcaaacatcctgtatcgctttttcatcttcaataatcagtatatgttctttcatgtaagcaccacctaaaaagattatatcaattttaacatacaattatttagatttgatttagaaacataaaaagcggttgatctcgaaaagggtaaccgcttttactgtgaagtatgatattgtttaaattgagaagttattctttcaaattattcaaagcagacggattatttaattcagcccatagcttcgccgttttttctctcaactcttggtcgtcattaattgtcgcgatatatgcgtcgcatttctcacaatccagtccgcaatatgcaatcatttctttctgcgtatgtacctcctcaacgcctaattttgtatagggcagcatgacaattattactttttatttggctttcttttaatgcctagcaatttaataaaaacaagtattttctagtataacatttcttttttacaagtatatcggggtaacccatgactatgttttccatattcaatcgcttctttcgggcaacgattgatacacgccatacagtgcgtacagttttccgcccatacaggtttcttgttttccatccgaatattattagtaggacatacatcaagacactttccacaagaaatgcaagtatcggttacataaaattttttggcatgaacaaataagggatagaatagatcatttataataccactgctcattctatccccaatagaaatttttgcctgtggaaactcctcgccatttctgatataacttgccaccttgtctatgacaacttctgcccgttctataatctccattgcctgttcttctgttggagtagaaaacagcgcaatatagttctccggcattacaatttctgcacaaccatagtaattcatattcttctggagacataactttttaagatatttccctgcatttccaatattttcaccgcaggtcataacaaaataaatgtctttactcccagtaaattctgtattctctatccagttttgtacaatatgcggtatcctccatgcataagtgggcacaacaatgatccatgaatcttccgagtataattttgaattgtccttatttcttattttttcaaataaatttattacgtcatccattacttcttttccaattcgttttgcaacatacgcactgtttcctgttcccgaaaaatataaaatcataaatcactcctccgttatactaaattgttctcctcttaaaatcctccattattataggctcttgttatcacataagatggttcataatatgcactgctattgtaattatcaattgtattacatatttcatcattgtatacccgaatcattccatcgatataatcttcctctggctgtaacgttgacagaatcagccttgtatatactttccccatctgtgtttctgatgggatcttgtctactagttctaaatcaacatccgtaatatcaaaattccctgttgtcagcttatactcttcgatccattcagcttcaattttcaaaggattgtcgcaatgcaacacattagcaagactgaacaggcgctcccactcttctttcggtatagaattaacaacatatttattcttctgatgtaattttcgtgcaacacgttctaccatatagcacaaaaaataaagatcattctcggaaatttgttcttccggaaaaaatttatttgtcatagcgaataactcccttcgaatttgatagtctgtaatgctttctctgtacagaatacaatctgatgtgtcggatacttaaacttaaccagttcccagaacgcctctttcgaaattcgttcagctatatagtcctcaacataatcccagattgtatcatctgccatcggaccctctacaacatcataatcatgttttaaagcaagccggcagtttacaacaaactgcagccattcttctgtcatcttactaaacgttttaatatccaagctcttatcgggtaaatactcataaaaatttacaatatgcgttccgcgttttgtcaaagcccagcgttttgcctgcttttctaaaattgtacaataaaatccgtatccaaaatctttgtaaaaaccgttttccaaaaatcttcggttcctggactataacattgcttccatgatataaaatcatacactttttactccttcacaaattaggtaatattactctgttcaactccatgataaatggaatttgaagtttaaaactcgtatcttgttccatgtgaaagtaacagtccgtccgttaattccacacataaaattatggtgttttcatcatcaaaattattatgcccattatcaatccattcggcaaaaacaacttttagtttctcagcaattatacgattttcttcttttccaaaataccctaaatttttccccttaccgtgtgcggtaaaccagtcacctgctatcgcaacgtttgggttctcttctatttgttttattttgttagtaagtgcgtatgtaataatataaaatgaaccatcctcataatatgcatttacattccgcacatacggcacttcatgttccgctgttgctaatgcgatcaccgtgtcttttccaaaacgttcaatcataattttttcaacatctgaacctaattttctcatataattatctccttcacaaaaagcaagttgtcaaactgctttaaactattatatcaccctgaatattcctctgtcattctatttctctcttaatacaaaaagagagagcggaacatcagatgtccactcttctacaaaacgcccttatttgtgatatggttccccattgataatccgatatgcccgatatatctgttccaaaaggatcaccctcatcaactggtgtggaaacgtcattttagagaagctcagtgcataatctgcgcgtttccgtacctcttttccaagaccaatggatcctccgatgacaaagccgatactgctgtttccctgtacaccgagctgttcgatcttccttgcaaactcttctgatccaagcatcactccgttaatttccagagtaataacatacatatcatcgtggatgcatttcagaatccgctctccctccttattccgaatgttttcctccacggtttcgcctgcctgatccggcgtcttctcatcagccacctcggcgatctccagcttgcaatatctggaaaggcgcttactgtactctgcgatggcatcttttaaatatttttctttgatttttcctacggtaatcaatgtaattttcacgctgttctccttttcttctgtctatgtaatcattactgaacaatggcccgaaacaccggaatctttttcagaatcagtactgacataacagagatcacataaatcacaaacggcattacaaagcgccaccatccagattccgttccaagctttgtcagattttgcaaagtctgcaataccaacatatgtgtcacatatacgcccagccctgtactggcaagtgttgtaactgccctccgaattcccggattttgttccaattttttccatggcccatatttgactgccacgaacactccgacagccagaaataccgtcgggaacgatagatatccccagaaagcatgattcagtcctgaactattcgttgaccaggccacagtactgatataccggattccggctcctgtagcaccaagtatacaaagaaacatccgggttttctttgacatatctgttgtagaaagcagataccctaaaatcacatacagtaaatatcctcccgccaccgggaactggatatttccattgaatgaaattcccaaaaaagtacaacacactggataaacagaataagctaaaaaggccatcgctgtcatataagccaaaatctgcttgtaatcttttaataaagacagaacaggtatacagagatacatcataaatagcggaatgaaaaaccagtatacctgttccgcagttgtattggtaaacaaattgatcataccagacaaacttggtcgaaactccatctgtcccaaagcaacctttaataccagattgatcagtgtccacgtaataaacggtaaacctgttttacgaaaacgcttcttaaaataagcaccggtctgatacctctctctatagtcaaacagagtcgctcctgatatcataaaaaataccggaaccgcccagtaagcaatcgtttcaacaaacatcctctggcgatataccgaagtatctgtatacggatctgcaatcctgttgcactgcatgtatatcacacaaagacaggcgagtattctgagaatatcgatatagaaataatgctctttttgattgatctttctcattcctttccctcctgtcaggctcagattcggtaaacctccagttcgtgaagcgctcttgtcgcacagatatattctgcctgccttgtcattttcgtctcttctttatgcgccacagtaaacacctggtcaaactccagaccttttgccatataaaaggtcgtcacggtcagtccacgcccaaatctggagctgtcacgatcaatatagtgtacctgatctgttttcttccgaatcatctcgtaccattctctggcttcagcttctgtcatcgtaagcactgccgctgtctcatacccttccggtcctgtcttgacatgctccaggatatgactgatcatctcttctttagatccatactcccgctctgcaaccgctttcccgtggcggttcagaagctctgcatcatccatcccaaccagtgtccttgcatattcggcaatctccactgtattccggtaacttttgttcatctcaatcttccgaagctgtttccccagtatctgaggaaggaaccgtgtcacatcgttttgcttttcctccattgtctgggaacggtctccgagaattgtcatcggacactgaaataaaagccccagaatcgtatattgcaggtaggaataatcctgcatctcatccacaaccagatgtcgtatctgatcctgtcttcctacaccaagtaaccgatatttcagatacagcatcggaaaaacatcttcgtactccagataacgtctgtcatacggtacctctagaagtttcgggaaatgctgttcctccaaaaaccaattataaatccgatatagatctgtagtcgtgtacattgcctgaaacctggtccgcagtttctccacgtcttcctcagaaagtgtcatgctgtatctcgtctcgtactcatccaccacatactccatgactgcatccatccgggccaaaaccggaacatcctgaaatttaaagtaaaacagacgaatcatctcttcttcagtcttttccattccccggaaataaattcctttcagattgacgagccactcctccatctgcgccataaatccttcgaccgcaccaatcagttcttttgactgtttaaagcgatagcggctcaagtcgtcttcctttattccggcaatgtttttttctatctgatgatagcggtcctcgcagtccggtacggcagatttcagttcccggtatgcgaaaagatccaggctcatctcccggatgttctcttccccaagttccggaaggatatgggaaatataatccgaaaacacactgttcggagatagaacgagcacaccggacgatttcaaattctttctatcgtgataaagcagataggcaattctgtgaagtgccaccgatgtcttcccacttcccgctgctccctgaattacaagaattttatcctttgtattacggataattgcattttgctctttctgaatcgtccggacaatgtttttaagctgtatgtcgctgttgcttccaagttcctgtttcagaatctcatcatcaatctttacatcgctctcaaatccatagaccatcttccctctacggatcttgtactgccatttcgcttcgatttccccgcacatccgacctgccggagcctcgtaagacgcctctcctttgtcaaagtcatagaacagagcacttaccggcgctctccaatcataaatcagcggaatcctgccagcctcctcggcaaaattcccgattccgatgtagaaaatttccggttcatcatctccatcgtagcgaaaatctactcttccgaaaaacggcgaatcgagcatcttcttataacgtgaccggaggcgcaaagtatcctgattggcattgatacgctggagcagtgcctgctggttatcgtagtcctcgtacccatactggtccatctccgtataattctcccagtagtactcatgcatactctcgatatctttctgtccggcaagaatctcctgatccatctggacgattttccttttcagctttcgcacgatctcttctaaaaatttcataccttccaatgatgtttccttctttgctgtcacccttcttacctcgttcttccttctgcctgttctagtctgtcctgtttctgatcttttctttcataccatcataaaattgctcggaaagtggcactgcaacgccaagattccttgccctttccagaagataacctccaaacgtctccagctccgacggtcttcccgcctccacgtcccgcttcaaagaacttgtggatcccttactcagtctcataaatctctggtattcctcttccatataatgctgccggatgtgtaccccgtcagccttggccacctgaagtgcttctttcagcagcatatgaaattccactctcctgtcctcgtatgcccgtatctcctccacatttcccaaataatatgccgtaatgacattataggcgcagttaaaaatgtatttctcccacacggcctgtctcacatccgatggtatctcgtattcaatccctgcttctcccagaacaccggctgacactttcgccgctttatgttcctcttcccgcacagctcccagaagaattctggtgtactgtccgagctgtgtgatagagtaatcctcgtttgcggcggcagtcgtgtagatcactgcatccaccacaagtcctttccccagatactccctcactctctgggctgtatccgccccattcattaccggaacaataatcgtatggtcatctacacaagatcccaatgtctggcacacgtcctccagggcataagtcttaacacaaagaaaaatcaggtcctgaatctcctccacttccctcgcacactcccgtatcacaccatcttttacgattttctctccatgaaaatcactgtgcagcactacaccatgctcacgcagcgcctcacctcgttttcccctcgctatcaatgtcagattcttatatttttgtccgaccatccctgcgatgtatcctccaacgcccccgataccgacaatcattatcttcatttcttctctcacttttggtcacccctggtatgatgatatgtattctatttattataccttattttctctttcattccaagaaaaaatgaagctgcagatttgaatctacagctccatgcttctcttttgtaaaattcccgtgggattatttatttttcagatattcgtggatgccttttgctccggcttttcctgctcccatagcaagaattaccgtcgccgctcctgttacagcatctcctccggcatacacgcctcctttggatgtcttaccaaactcttcatccgcaacaatacatttccacttattgacttccaaaccttctgttgtagaagaaatcagcgggttcggtgaagttccaagggacataatcacagtgtccacttccatctcaaattcggaaccttcgatgacaaccgggcgtcttcttccggatgcatccggctcgccaagctccatcttcacgcatttcatgccttttacccagccgtcttctgtcacaatttctgtcgggtttgtcagaagatcaaagatgactccctcttcttttgcgtggtgtacctcttccacacgcgccggaagttcttcttcacttcttctgtaaacaatatgtacctcagcgccaagacggagtgctgttctggcagcgtccatagcaacgtttccaccaccgactacggctactttctttccggcaacaatcggagtgtcgtagctgtcgtcaaaagctttcatcagattgcttcttgtcaggtactcattagcagaaaagacaccgtttgctgtctcacccggaatacccatgaatttcggaagtccggcgccagagccgatgaatactgcctcaaacccttcttcttcaatgagcatatcgatcgttgtagatttaccgattaccacgttagtctcgaacttcacgccgagttctttcaccttttcgatctcttttgcaacgactttctgctttggaagacgaaactccggaataccgtaaacaagtacaccgccaagttcatggagcgcttcgaatactgtcacgtcataccccatctttgcaagatcacctgcacaggtcagacctgcagggccagagccgatgacagcaaccttgtgcccattcttctcttctgctcctaccggcttaatatcatgctccaaagcgtaatccgcaacaaatctctccagtttaccaatagaaaccggctctcctttgataccacggatacattttccctcacactgtgtctcctgcggacagacacgtccacagattgccggaagcgcggaagacagaccgatggtcttatatgcgccctcgaaatttccttcttttacctctttgatgaatgccggaatattgatcgctaccggacatccctgaatacactttgcattcttacaattaatgcagcgtgtcgcttcttccattgcttcttctgcattatatccaagacatacttcttcaaagtttgtcgctctttctttcggatcctgttcccgaaccggtactttctttaatacgtctgccatcttagttgtcacctccacaatttccacatccgccgtgatgtgtattgccctcctgcagtcttaacatcgctcttccttcttctgtcttatacataagctgtctcttcattgcttcgtcaaaatctacaagatgaccgtcaaattccggtccgtccacacatgcgaacttgacttcgtctcctacatgcagacgacaagctccacacattccggttccgtctaccatgatcggattcatgctgacaattgtcgggattccaagatcttttgtcatcagacaggtaaatttcatcataatcattggtccgatcgcaacacagacatcatatttcttgccttcttcttttacaagcttttccaccatagaagtaaccatgcctgcatgtccgtagcttccgtcatccgtacatacatacagatttccggcaaccgctttcatttcttcttcaagaatcaacatatttttcgttttggaacctacgattacatccgcgtcgattcctcgttcatgtaaccatttcacctgtggatataccggtgcggcgccaacgcctccggcaacaaaaagcatctttttattttttaaagcttccaggtcttcatttacaaattcggacggacatccaagcggtccagtaaagtcgcggaaagaatctcctgcttttaactctgccatttttaacgtggatgctccgacaatctggaatacaatggtgattgtccctttctctctgtcatagtcgcagatggtcagagggattctctcgcccttttcatccatttttacaatgacaaactgccccggctcgcagtgacgagcaacacgcggagcttctacatccatgagaaaaatcttatctgcaagttcttcagcttttaaaattttgtacatctctcatgcctcctaattgttatactccatttatcataagatattgtagataaaatatcaagtagattctgacagggaaatcgtttttttcgataaaagattcacaacctggtataaaaaaccgccgcttccgaaaaagcgacggtcataaccggtttagaagtcaacttctgttccgtaatatgtacatgtaaagagtttttccatctcggccggagtaatgcttctcggattagaccctgtacaggcatcgccgacagcaagttttgcaatattggaaattttttctttaaattcctcttcgttgattccgaactctcttaatgtcttaggaattccaagctctacattaaatgcatcgatctttgcaatcaagctattgataagcgctttctcagaagttcccggaagtcccattctgcgtgcgatctccgcataacgctttgccgctacaggatcttttgcattatactgaataacgtacggaaggtagattgcatttgcgcatccgtgtggaatgtgtcctgtagagaatgcggctccagtcttatgagccatagagtgaacgataccaagcaacgcattggaaaatgccattcctgccagacactgcgcataatgcatctgctctctcgcatccatatcacagcggtaagatgccggcagataatcaagtaccatctcgattgcctgaagtgcaagcggatctgtaaatggtccgtttaatgtggaaacataagcctcaatcgcatgggtcagagcatccattcctgtgtaagcaacctgtttcaccgggagacctgctacaagatccgggtcaacaatggcgatatccggtgtgatattgaagtcagcaagcggatatttcacacctgtctgataatttgtgataacggagaatgctgttacttccgtcgctgttccggatgtggacggaatcgccgcaaattttgctttctgtcttaattccgggaaattaaacggtgtacagagatcctcaaatgtcgtatccgggtactcatagaatgcccacattgcctttgcggcatcgatcggggatcctccgcccatggaaacgatccagtctggctcaaactctctcatagcctcagcacccttcataactgtctcgacggacggatccggctctaccccctcaaagagttgaacttccatacctgcttctttcaaataagaaaccgccctgtccaggaatccctgacgcttcatggagccgcctccgacaacaaggattgctttctttcctttcaggtttttcaattcttcgaggcatcctttcccatggtaaatgtctcttggtaaacaaaatctactcatagctcgtctctccttttctaccattgatatttttttaactatcgttagtatactcctgttttttagttatttcaatgcatttttccggtttttagaattttttattgaatcactgatttaataagctatatctatggcaaaaacatcttaggatttaacaagcagattatctttcatccaaagcttcaagcgtatattcatgcagtgtttcccttcggtattcatccagttgaagcatctgagaatacaacatgtccaccataatgagaatcgggaactgtggagaaatggctttcccctgttctaggttttctttcagcgcaaacagcatgatctcatcgcagaattccagaaatttcttcccggtgtgtgccgtcataagaattactttcgctccgcattttttcgcaatcttcatggattccagaaccgcttcggtcttcccgctgacactgatcccgattaccgcacagtctccatccagaaggacggaattcattttcataatatgttcatctgtaatagcctcaatatttgcgccgatccgcataaaacggaacttcatttccatagctgccagaccggaacttccctttccgtaaacatagattctctttttctttgataacatgtccacaatccggttaatctgcccttcatccatcaacgaatagcttttattcaaaagctcctgatagctgttcagaactttcttgatatgatggcttgcgcctgaccgggatgtcgtgccgaagctctgctgatagcgaaacagaaactctctgtatccggtgaatccacatttctgggcaaaccgggatagggaggcttccgagacataaagtctttttgctacatttttagaaaccaggtccgcttttccatcatagtgtataaaataatccgcgattgttttttccagtgcagtaaaggtatcgtaaattgcttcaatctgaggtatgatatttctttcgtattcatccattgtttcgtcccctttcagagttttcctaaaccgactgaagggaagactattgtcttcccttaaagttataaaatgctccgagcaagcccgcccgattctggttttcggcaaagaccagccttgtatgatctgcaaccgacggaatcagatgtatttccagacttttcttgatccgcttctccaaatagcttttctgggccatgattcctccgcctaatacaaccacctccggattgatcacatagcagatatttgcaattcccattcccagaatctctaccatctcatcgatggaccggatacagtctgcatcccctttttttgcctgttcaaaaacaaattttccattaatggaagcaggatcgattcctttgtataatgctgtcttctttacgagaatactgctggctcccagatcctgaaactctccacctggtagatgcatatatccgacttcacatgcactgccggaaaatccatgaaagacctttccatctataataatggccccgccgattcctgttccgactgtcagacagacactgattctggcaccctttgccgctcccgcgtagctttccgcaagtcctgcacagttgacgtcattttctacttcacagggtattccgaatgtcgtctccatactctttttgatttccgttcccgtatagtccggaatcagtggcgccgcataggtaatcaatcctttttcacagtctaccattcccgccgtagaaatgcaaattccttctgcatgataggatttcagatattccctggtaatcccgtggacctttttcaggattccggggcctccatattccatagcttctgtcggcatctcacccgcttcacagaacgtcccgttttcacggattactccatgcttaatggaagtccccccgatatcgatacagatatatgttttcatcctactgctccttttcttttctgaacccgcactatttgattcggattttgaaaattgcttttttgacttttatggagtcatccactttaatcgcagttctgtgtgcgtcttcaggatagcacaaaaggaaatcccccggttccagcacaacatatccattggcgtccccatccataggtaggaagtcgtccttctccacaaactctttctgctttagttgatcgataaagtttatatcaatccgctcttttccctccaacatcaagtggagatccagatagttgcgatgcgcctcccagaatctgttttccgtctctgttgtttcatattctactatatttacgaaaagatcatcaccttgtatctcgtgacttcctttttcgtaactcataagatcatgtttctccgcatatgcaaagcatttcagaatctcttcttctaaatatccataatcttctaaatctctgatatttccgaataccatactcattctccttccacgacaaattatttgttgaagattgttgtatttggagctggctgtgatttatccccctttacctttctccatataatacttgccggaattccgactacaagagatatcgcaatggagataatggagtaggaccagatggagatcgttacatccggagccacaaccggaacaccgtatttgatgaaaatcatcaccgctgatgctgcaataaacgcaagtactgcgccaaacgtatttgctacttttgtaaacgcaccaagaatgaacgttccgatcagaataccaagtaccagtcccatgaaaccgttgaaccattcgtaagcagattttacgcctccgtttgcaagcaccatagcaacaacaatggagaagattccgactacaagggatacatactgaccgatctttgtctgtttttcaaagctcaactgctttttggatagacgttcctgaatgtccagtgtccaactggaggctacagaattcagtcctgtggaaagcgtagactgggccgctgcataaatagcggcaagaagcaggcctgtaacacctaccggaagctcaaacgcaatccaagaagcaaaaatctgatcttgctgggccgccggaggaagttgatttccctgcacctggtagaacacatacaatgccgtaccgatcaggtagaatacagtagcaatgaaaatggaaagtccgccatttgcaagcatcattttattcagtttctttgtatctgttgttgtggtaaatctctgtacgatatcctggctggatacataggatcccatcgtattaaatcctgctcctataatcagaaggaagacactgtctttgaagatgttggcatcaaagatcggctgattttctgccagaaatttatgtccctgtgtaaactcatggaatacagcgccaagtcctccatcaatattgcacaacaggaaaatcaaaccgcaagttacaccgatcagaaggacagatccctgaataaaatccgtccaaagaacggattttaatccgccggtgtaggagtaaataattgcaataatccccatgatgataatcaggatattgacattgatattcatcagactggataaaaccatacatggaagatacattataatagacatacgccctacctggtaaatgatgaacattaccgcgccaaggacacgaagtcccttactattaaagcggatttccaggtagtgatatgcggtgtcgatgtccagcttactgtaaatcggcaggaagaatcgaatggtgaccggaatggcaagtaacataccaagctgcgcgaaccacataatccatgttcccgcataagaatttcctgctaaagacaggaaagaaatcggacttaataaagtagcaaagatcgatacggatgttacccaccacggtaccgttccatcgcctttaaaatactcttttcccttcatttccttttttgcgaaatgaagacctgcaaacaatactgccgcaaggtagataatcaaaataatcaaatcaattacggtaaacccctgcatgtgttctctccttttctcaatcgttttacagattcttttcttttgcttcttttaccataacagcagcttcttttgcaatcgccttgtctgcctcctgaagattctctaacggaaggcgtactccgccgatgtccagtttctcattgacacgcagaatttcttttgccactgcatacatgtttgcatggctggaacacattttgtaaatgatctcattaatcgcgtactgcagttctgtcgctttttctctttcactcgaaacaagaagctcgttcagcttgaggaacaattccggcatcacaccgtatgtaccgccgattccgccgtcagcgccaatcgcccgtcctgctacgaactgctcgtctggtccgttaaatacgataaattctccctttgctgcttttcctgcagctttgaacatctgaatgtcctgtgttggcatggatgaattctttaccgcaaccactcttgggtttttcatcatttcatcaaacagactcatggtcaaagccgtacctgccagttgaggaatattgtaaatcacaaaatctgtatttggagctgcctcgctgattgtgttccagtatgcagcaatagaatactcaggaagccgaaagtaaattggaggaatggaagcgatcgcgtctacacctacactctctgaatgttttgcaagttctgcactgtcccttgtgttattacatgcaacatggttgatgactgtcaattttccttttgcgactgccattacattttcgataatcgtctttctttcctctacaccctggtagatacattctcccgaagaaccgtttacatagactccctttacccctttatcaatgaagtactgtgtcagaacacgtactctttccgggcttacgtttccttcttcatcatagcatgcgtaaaatgccggaataattcctctatatttttctaatttactcattttttcttcctcctgactaccctagtttttccagttttgcaatttcctctgtaaatgattttgtgatcaactgcggacgtgtgatgatcgatcctaccacaacactgtaacagcccagttcaataacacgtcttgccttttctggtgtattgatgtttccttccgcaatcacaggatgttttgctttgttcaaaatcgttctgatgatttcgaagtcattggtttcgattttgtcacccttgctctgtttggtatatccgactagcgtcgtaccaataaaatcaaaaccgagcctgtctgcatgaagcgcttcttccactgtagaacaatcagccatcaataactgttccggatattttttacggatagccgcataaaaatcgtccagtgtgattccgcccggtcttatggattccgtcgcatcgatagcgataatttccggctttacttccatcagttcgtcgatctctttcatcgtaggcgtaatgtacacacaactatcttcatagtcccgcttaataatgcctatgactggaagatctacattttttctgatttctgcaatatcttccggcgtattggcacggattccaaatgctcccccttcagcagccgcaagtgccattcttcccatgataaaagaagaatgaagcggttcatggggtaatgcctgacatgatacaatcagatgccctttgagatgttttaaccttccttccatgattctctcctttctactgatttttgaaactacgcacagtatagcactttagaaaattctttcaataaattgaaattttaaagaaaaatttttcatttcattttcagattcacctatgtttctatcaaaaactaccatgcattttcgtgcaatttgtacaaggaatgaaagatctttcacaacgaaacttgcgaaaatcttataatgaaagaaaatcgcagaaatatattctgcgatttccctcttcatgttcctgtatcaagaacgaatctgatatttccttgtcgtgatctcactcttctttccattgccgtcaatcaatactacattgagttccgtgtcctgataaagcgggaaagcaccggtatatttgaccgactgatctgacggttcgcttccatccgtcgtataataagccgtatatccttccgggacctgtacctcaacactgattggttccttatactgacctgttgtcggcgagactgccggcgcttctgccacagggaatcgaatcatataggttttttgcacctctacactttcaatcccctttttattgacaaagatcgctctgacggttgtctttccttccttattgatttggatcggctccttatattccgtgccttcggtagtcgctttacttccgtccacagtatagtagatcgtgccgtcctcctcgcttgagagagtgagttcctgcacattatcgtattctttctcatcatccagactgaattccggaactctggcgacataatcctgaagttctgtcaaaatctgaccgttggtacaggtactcatcagataggcgattttttctgtctggtccgtatcctcatagtattctaccatagcttgataaacgccgacactatccggatggctatccactgcttcctgtaacaatgcatccgcgtcgtcatccttgttctggtcgtgatagagagaagccagtctgaaataggcctctttcttttccccctttttctcaatcgcttttaaataaagcgcttccgcttttgtatcattcccgtttatctcggctctttttccccggtttactacaccggtatatgtatttcgataaatcagaattcccgctccgactaccgccgcaacaatcaggatcattcccagaatcacaagcctacgcagtcttcttttgcgtcgcatccgttctgctttggcccgtcttcttctccttctgatctcttcctctgacagtctgtcccctggatttgtcattctttgcatggtacccttattctctcctctttttccgtgccgcctccacacagttattcatcagcatcgcaatcgtcatcggccctactccccctgggaccggtgtgatagcctctgccttttctttcacctgttcaaagtccacatctccgcagagttttccgttttcatcccggttcatccctacatcgataacaatggctccttccttaacgtcgcaagccttaattatctttgccttcccgaccgccgccacaagaatatcggcccttcttgtgatctctcctaaattctttgtccgtgagtgggcgatcgtgaccgtcccattttcctggagcaaaagaagcgccatcggctttcctacatgattgcttcttccgactacgacgcactccttgccttcgatagaataaccggaacgccgtatcagctcaatcacgcctgccggagtacaagaacggaatccctccgttccaagacaaagcgctccaatactatctgcaagaaatccgtccacatccttcttcggagaaatcatcgttgtaatcttctcttcatcgatctgccccggcagaggaagctgtactaaaatcccgtctacgttctcgtcttcattaaggctcgtaacaagcttttccagctcctcctgcgtcgtatcctccggcagttcgtaagaacgggattcgatcccgacatactcacatgcccgttttttgttccttacataaatggcagatgcgctgtcgtctccgacaagtatgacagccagacacggtgtaatcccctgcgccttcatctctgtcacttcctgctttaattcctctttgatctttgtggaaattacttttccgtctatcaatactgccatagtctgcctccttttagaacagtcctgtaatctttccgtcatctgttacgtcaatatgatttgccgcaggaacttttggaagtcccggcatcgtcatcactgcgcctgtcagcacaacgacaaatccagcccccgcactgacataaacttctcttacatggatgcgaaatccttccggacgtccaagaagtgtctgatcatcggagagggagtactgggtttttgccatgcagaccggcacatttttaaatccaagctcttcgatttttgcaagctgctttaatgcggctttatcataatccacgccgtccgcaccgtaaatctctctggcaaccgtctcgatcttgtctttcaaaggcagatcgtccggatagagcggatggaattgactttctttcgtctccagtgtatttaatacttttcttgccagctcttcgcccccttcgcctcctcgtgcccaaacatccgcaatggcaaattcacatcctctttcctcgcagaattctttgacaaatcccttttccgcctcagtatccgcagaaaacgcattcagggtaacaacaaccggtacgccgaatttctgaagattttcaatgtgtttttccagattgacgattccctttttcaaagcctccagattttcttcattcaactcatttttcggcactccgccattgtatttcaatgcccggatcgtggcaaccaaaacaacagcgtccggctttaatccgctcatccggcacttgatatccataaacttctccgcaccgagatcagcgccgaatcccgcctcagtgatcgtgatatcactcatcttgagcgccatcttggtagcctgcacactgttacatccatgagcaatattggcaaatggtccgccgtgtaccaaagccggtgtgtgctccagtgtctgaatcatattcggcttgatggcatcctttaacagagccgccatagcgccggtagcctggagatcatctgctgtcaccggcttaccgtcaaaagaataggcaacaatgatcttcccaaggcgtctcttcagatcggaaagattgtccgccagacagaggatcgccataatctcggaagctacggtgatcacgaaatgatcttcccgtaccatgccatccatcttgttcccaagtcctaccacaatatttctgaggacacggtcgttcatatcttcacaacgtttccagacgacctgtcttggatcaataccaagctgattcccctgttggatgtgattgtccagaagggctgcaagaagattgtttgccgatgtgatcgcatgaaaatctcctgtaaaatgcagattcagatcttccatcggtacaacctgggcgtatccgcctcccgcggcgcctcctttgattccaaagcaaggaccaagagacggctcacgcagggcaatcattgctttctgtccgatctttgccattgcctgtccaagtcctaccgtcacagttgtcttcccctctccggcgggtgtcgggttaatcgctgtcacaaggacgagttttccgtttgggcggtccttaatcttgtcccagagctcagcagagagctttgccttgtactttccgtagaattccaggtcgtcttccccgattccgatcgatgccgccacatgtttgatcggctccattgtcgcttcctgtgcaatctgaatgtctgttttcattttccttcctccgtttcttcccctaaacatgttcctctatgtactggtcaaactgttcctttgacatcagaacctttcttggtttggtgccctcttcctctccgacgacgcctgcttcatatagctgatccataattcttgccgcacggttgaatccgattttgaacacccgctgtaacattccgatggatgctttttccttttcgatgataaaatatcccgcatcctggaagtagacatcccgttcttctccctggccacctgccccggatccggccgctccgcttgaggcatttgccatatgcgtctgaacctcctcatcgtaggcagcatttccattatttgtcagcagataatccaccactgcctgcacttccttatcagatacaaaggctccctggacacgtgccggcttctggtagcctgccggatagaagagcatatcaccctttcccaggagcttttctgctccattcatatcgataatggtccgtgaatctactccagaagatacagagaaagcaatcctggacggcatgttggctttaatcaggccggtaatgacattgaccgacggccgttgagtcgcaagcaccaaatgaatccctgcagcacgggcaagctgtgccagacgacaaatggattcttccacatcccctggagccaccatcatcaagtccgcaagctcgtctacgatgatgacgatctgcggcatcttctccggccgctcctcctcgttgtcaatatctttgacactttccacctttgcattgaaaccatccatatcacgcaccttgtactgctcaaagagctggtaacgcttcatcatttcggccaccgcccagttcaaggcgcccgccgccttcttcggatccgtcacaaccggaattaatagatgcggaatcccattataaacgcttaactccaccacctttgggtcaatcataatcagcttcacttcctgcggggaagccttatataagatactcataatcaaagtattgatacagacggacttccctgatcccgtcgcgcccgcaacgagaagatgcggcatcttggcaatatctgacactaccgtccgtccgctgatatcttttccgacagcaaagctgatcttggattttgcggctttgaactcctcactctccagaagatcccgaagctgtacggtggaattgcccttattcggcacctcaataccgaccgctgctttccccggaatcggtgcctcaatccggatatccgccgctgcaagattgagctttaaatcatcggcaagacctacgatcttgctgacctttactcccatctccggctgaacttcataccgggtcaccgcagggccgcaactcacattcgtcacggtcacattgacaccgaatgtctttaatgtctgctgtagcttagctgccgtctctctcaaatgcgcgtcggaatcgcctgtccccttctttccatgggtcagcaggctgatcggaggcgcatgatatacagagactggctttgcgatggatttctcaatctcagcggttacatgctctcttgccgctgcctcctgctccttattctcagcttttactctggtcctgatctttgcctcttcctttggattcacagcctctttaaaagcactgattccctcttccggaaactcagagagatccggaacagcctcaaacgcctccgtcagaaccggttcccccggttcttcataggaggatgctcttgtaatcgtaagctctccgaccggagcttcttcctgggtctttggtgccgcctgttgttccgtctccttttccctcttttctgctttctttttcaggcttttttcttccgtcacaacaagctcctggatctccggactgcgtccctccaaagtcgtatcaaaagaaactcccgccaccttatgctcctgccgcttggcttctttgacctttttcttctcctcacgctgtacttttcggtgctccctgccagtctttgccttactttgaagcgttcgtccggcgttctgcacactttttaaaagcgaacgctgtgtaatcagaatcaaacagatcatcatcaaaatcacaataatcacatacgagccgactacgcccagcgccgggaccgttaaatgcgccatcttctcgccaatactgcctcccgcccggttgacaagctccaaaaaggcacaaatcaaggctacaagaactaccgcggcgccaagcttcgtgtatgctttatgattcccccgattggataggaaaaatgtgacgcctgcaaaaagcaggaatgggaacaaatacgtcatctgtccgaaaagtccctccataaagtccgaaatcactcttcctgctgctcccgcaagtccaaaattactaatcaaaagaatgatcgagaccgccaaagataccaggattacaatctcctctctgacgatcgtctcccgctccatctgagctttcgtcgctcttgtagaacggctggatttggaccgggtggatctggtagtctttcgccctgctttctttgctgttgtactttttttcttcttctgtggcgtcttctgggccatgaaatatcccccttattactttcccgcttcagacgggcctttcccattttcactatatttcattatagcatttttaaaatatgctgtcattatctatttttgtgctctcgttccccgatttccttctgattccgccgttcatcaatcagggagtaaatcttttcaaaggcctcgtggatccctcccacttcgtcgatgatcccctcccggaccgcatcctcaccctctaaaagcgtccctacatctttgacaagctgagacgaatccagcatcagctcttccagacgctctttagtaattcgtgaatgactggaaataaacttggtaatccgatcctgtgtacgctccatattccggtaactttggatcaccccgataaacatcccgttggaacgtaccgggtgtacaatcatagttccgctcggcacaataaacgaatagtccgaagaaacagcaagcggccctccaatggaatggcttcctccaaggacaagagatacggtcggcttgcttaacgaagcgatcatctcggcaatggcaagtcctgcctccacatctccacctaaagtattgagcagaatcaatactccctcgatctcatcactggattcgatctcggcaagtttcgggagcagatgctcgtatttggttgctttcgtactgccagagactgcttcgtgcccttcgatctccccgataatagtcaacagatagaccttatagtccccgtgctttgtctccagctccagactccccgtctccttgatctgctctgtttctttctcttgtttttcctgatttcccataaaaaacacctccacattttttgcttagtatgcggaggtatttttctaaatatgcattatacgagggcaagtgcctgttccagatccgcgatgatatcgtctgcattctcaattccaacgctaaaacggatcagatccggctgcactcctgcttccaggagctcctgatcgttcatctgacggtgcgtatggctcgctggatgaaggacacaggttctagcatctgatacgtgggtcacgattgctgccagcttcagactgtccatcattttgacagcgacatctcttccaccctttaatccgaaagtgatgacaccgcaggtgccgtttggcatgtacttcgctgccagatcatggtatttatccccttccaacatagcacaattcacccaggcaacctttttatgtcctttcaaataggaagccaccttctttgcattctcacagtgccgcggcacgcgaagatgcaacgtctcaaggcctacattcaaaaggaatgcattctgcggcgcctggatggagcccagatcccgcatgagctgtgcagtcgccttagtaatataagcaccttttccaaatttacgagtatatacaataccgtggtaagtctcgtctggtttggtaagccccgggaatttttcggcgtgggcttcccagtcaaagtttccactgtccacgatcgctccgccgactgtcatggcatgtccatccatatatttcgtcgtagaatgagtcacaatatcagcgccccactcaaacgggcggcagttgattggtgtggcaaaggtattatctacaatcaacggcacaccatgttcgtgcgctaccttcgcaaatttctcaatatcaagcacggtaagcgccggattggcaattgtctccccgacaacagctttcgtattgtcacgaaatgccgcgtttaactcctcttctgtgcaatccggatccacgaatgtagcctctacacccattttacggatcgtgtgggcatacagattataggtgccgccgtaaagagcggaagaacatacgatatgatctccttcctcggcaatattcatcaccgcatagaaattggcagcctgtccggaagatgtcagcatggccgcatagcctccctccaggtcgcaaatcttctctgctaccgcatcattggtcggattctggagtctcgtatagaaatatccactgtcctccaggtcaaacaatcgtcccatctgttcgcttgtgtcatacttaaacgtcgtactctggtagatcggaagaatcctcggctctcctttttttggtttccagcctgactggatgcatttggtttcaatgttaaactgttcattcatatccttgttcctcctgtttttctctgcggatcaggagaacagatagtcctgctccagatcctgaatcatatttgtatatacggttctacacgccgcaagctctcctgcctcgatcagatggatgcatggattcagatactcttcccagatcttttggtagataacgtcggcttctgccattcgttcgatccgttttacaatcgtcggcgcaatattatagtattcccggatggtctcctttcccccctcggaggaaacaagatacccgtcccggtactctctgagcaatttgagctcgtagcactcatccggcttctgtaaggaccggcaaaccgcggtcgtcacatagcaaagacgcttacggaatcccccgttgatctcctcaaaggtagatttacccactttcatcgtcaccgtatcaatccggttccaggaggaaatcatctcgtccgccaccgcctccagctcgggatcccggctgtagagcagcaatggaataaaaaatgtcaccaatgccagattgtaatccaagatccgattttctctcttcctcttgtccgaaagcttatgaagctgctcgcttgcatactccggaacctctgttccaagaacctgaatgagctgctttctccttccttcgtccttctcccggatctcttttaacatcctggcaagctccgggcgtcttctctcaaaaaagccacggaaagtcggctcatatgtagcctttttaaactgtgaggaaagctctatcgcttcttcaaacatggatatcatctgtttttctggtcctgtctgcataagacggcctcccttactgcgaattccggctttctctactcttcccagttatgatatacttcctgcacatcatcgtcgtcgtcaagaaggtccagtgtcttctggatatttttgatatctgtctcatctgtcagctctacatacgtctgcggaatcatagtgaccgaagcctccatcatcggaattcctgcctcctcaagcttttcgcggacttcagagaagctgtccggatcagtaatgatctcaaagctgtcctcctcttccgcaaaatcctctgcacctgcgtcaagagccagcatcatcagttcgtccgcatccatctcaaactcttcccggtcaatgaggatctgtcctttcttatcaaacataaaggagacgcatcccggtgtcccgatattgccgtttccctttgtgaaggcactccttacattggaagcagtacggttcttattgtccgtcagagcctccacgataatcgcggtaccgttcggcccatatccttcatatacaactctctcgtaattgttggcgtccatgtctccagccgcctttttgatactccgctcaatgttgtcgttcggcatattgtttacttttgcctttgcgatcacgtcacggagtcggctgttgttcgccgggtccgctccgccgccttccttgacagctaccgcaatttcacggccgatctttgtaaaaatctttccctttgccgcatcgtttttttcctttttatgtttaatattcgcgaacttggaatgtcctgacatttctttctacctctcttcgtatgtaatctctcttcctttttcaggaaaactcatgttcttcattttatcattctttcgtttctgtggcaagttccgttttggtgatcttcaccttccggatgatattgtttattacctgctggatttcaaaaagatacccctcatagaaaacactgcactcttccttctccgccggaatccgctcaagcttcacaatcaggaaaccattgagtgtctcatactcattgtcctcatcctcatcttgaaagacgatgccaaggacgtctgaaagctccgtcaggccacaaaggccgtcaaccaggtaagagccatcctcgctcttgcggatcatctcttcctcctcatcatactcatcccggatatttcccatgatctcctcaataatatcttccatcgccaccaatccggaagtctgtccgtactcatcgatcaccacacaaagatgggtctggttggctttcatctgcataaaaagtcggctgatctttctcgtctccggaataaatcccacaggcataagtgcgtccccgatctcctttaactttttcccccgcatgtccggatccagataaaacttcataatatcccggatatgtacaatccccaggatattatcgatttcctcctcgtagaccgggaaccgggagttctttgctttggatgcaaaggccgccgcttcctccagcgtatcgtcacagtttaatgccacaatatttttccggtgagtcataacatcttttgcgtcctgatccatgaaagaaaacacgttgcggatcattctgtattccatctctcggatacttccgtcttgttcgccctccttgagagctcccagaacctcttttctgattgtgtccctttggtccatatcttctccttttatgtagaaagtgcgatactgattctcagggcctcgtcaaccttctgcatgatttcctgatccagatggcatacactttctttcaatctctgcttgtcgattgtccggatctgctccagaaggacaaccgaattttttacgacaccataccttctcgcgtcaatctccacatgcgtcggaagtttcgacttgtgcattctcgaagtaatagccgcacatatcacggtcgggctgtgtctgttccccatttcattttgtatcacaagcaccggacgaacgcccccctgttcggaaccgacgaccgggcttaaatccgcataaaaaatgtctcctctatgaacctgctgcactttcttcacactccattttctaagatataatgagtatttccatctttcctttgaagtattccaaaagccgtgggtcttttatgcgaaatagtcgacctgctcgatgacttctccatcttttacatattctctcggaatcctcttgtcgaggtcacagagaaattcataattaaatcttccggacagggcgcttaagtcatccacggtgatttcttcccggccgctttttcctaccagcaccacttcatccataaatgctgcctcgtcgatctccgtcacatccaccatcatttgatccatgcagactctgccgataatcggggcccgtttcccgcggatcagcacataccccttattggagaggcttctcggatagccgtccgcatagccgaccggaatggtagccacacgtgttttcttctcggcacggaaacatcctccgtaactgacaaccgcccctggctcgatccactttgtatgaacgatactgctcactaaagaaagtaccggctttaatgcgagatcacgctttctcacctcatcggaaggataaagcccgtagagtgcgatgcccgcacgcacgagatccagattggcctcagggtggtcgatgatagctgcgctgttagagcaatgccggtactgtggctcaatcccccgttctttcagcttcctcgtcataaaaagatactcttccatctgtcggttggtaaacgtcttatccatctcgtccgctttggcaaaatgggtaaagagtccttccatccggattcccggcagataaaagatcctttcaattgcatcgatagattcctcccccgtttgaaatcccagtctggacatcccggtatcgagcttcacatgaatccatgccggttttttcagctttcctgcaagctttgaaactgcgtttgccgactgttctgtgtagatcgtcatacggatctcgtggcggatggcctcctcgtactgctccggaaatgtacatccaagcaccaatatcggcttttgcactccagcttttctcaaaagcaccgcctcatcaagcgttgcggtggcataaccccatacacagtccaatctttccgtctctttagcaattcttgtggcgccatgtccgtatccgtctgccttcaccaccagaatcatgttcgtgtccggtgaaatatgatgcctcatctgctctatattgtatgtaatatgattcaaattaattttcgcgcacactctgctgtaagttttcattttgtaagaacctttcctcaatggatttcccgcagcacaatcggtatcatttcaatcagatctgtcgcaagtacactgtgagccccatagcggtctcttgcttcatccccgcacagtccatggacaaacacaccaaatgccgccgcctcaaaccgctccataccaagcgcaaggcatcccgtgatcattcctgcgagaacatccccggatccggctttggccatggcggaatttccggacagattcaaatacggaatcttcccctttcctgctactacggttctggcatcttttgctgctaatattatattataggttttggcatactgttgtgcaagtcccatcctgctttttttcgtttcctctgtcgtttttccaagaagtctggcgaattctttcacatgaggagtgaaaatcaagcggctccccgcaccggaaagcaacatttccctctttttttgttccattcccgcaatattgttcaaggcgtccgcatcaaggacgcatggcttctcatggttttccagatagataagcaatgtctccaggacttctttggtccgctcatccatccccagaccgcatccggcacaaataacgtcagcccagtcaagcaacgtttccatctgtctggaaatctcttccttgtaaggcgtgacgatgacttctggcagcttcgcctgtaatactgcctggttacacctcggcgtcaggatcctcaccaatccgcttcccatccgataagctgcgcttgctgagagaattgccgctcccgccattccttcgcttcctgtaatcatcaagactcttccgtacgttcctttgtgggcatctgcgccccgcttggggcagagcgttttgatatcctcccgttcataggaaagataccgaggtccttccacgccgccccgcaaatagatgccgatatccctgacttgcacgtttcctgcataaagcgcgcctgggaacagtgccatccccgtcttcagataagcaaatgtcaccgtcagatctgcctggaacgccgtcccaagcacctcccccgtcgaagaatcaatcccggacggaatgtccaccgccactttggctgcttccatctcattcatccgctccaggatcccggcataccgtccttccacctttcgggaaagaccgattccaaacagggcgtcaaatactgccgtgtagctttcctgtggaatttcccgttccacagttccgccgattgcctgaaagatgcggatctgttcctttgtctcctctgtgcaatgatccggattgcctgcgagcaccaccgtcacctgtgcccctttctccaacaggagacgtcctaccgcaatcccgtctccgccgttatttccactgccacacacaatcaggcttctggtgatgtcaatcttttcctttttgaccgtttctaccacctgcaaggccgcccgctccatcagtacaagggacgggatcccgatggtctcaaccgtgtaatggtctgctgctttcattgtcctgccgtctataatatagttcatccttatcgctccttcctttaagttctggtatccggacagaaaaaaggacgtggaatcccgcagcttactacaactctctcacgtccttcttgctcttattttttcttctgatgcttctcctcatagcggagtacattgtaggagagtctcatcagactctcggaaagatgtacgttttccacgacaatatgctccgggagattcagatccgtatgggcgaaattccaaattgcccggataccgttttccaccaacatatttgccacagcaaccgcctttgtcttcggtatagtcaggattgcgatctcaatatcattatttcggataaagctcttcagctcgtccatcatgcggatctcaatccctcttaccgtcacaccggccagcgtcggattgacatcaaacagtcctttcagcataaacccgctgcgctcgaaagcagtatagtttgccaaggcctgtcccagattccccgctccgatgataatcatattgtgctctctgtccagtcccagaatctttcctatctccgaatgtaaatacttcacattgtatccatacccctgctgcccgaaaccgccgaaattattcaaatcctgacgaatctgggaagcggtgactttcatgcgcttgctcaagtcgttggaggaaatgcgctctacaccgtcttccagtaactctcctaagtatctgtagtatcgaggcagtcttcggatgactgcctgagaaattccttttccttccacttcctgcaccttcctgttcttctcaatatccttattatatgtaaaacctgatataaagtcaaacttttcatgggattttatgttgtattttgtataaattccgttataatgaatacggaacttttgatttatcaagggaggattttatgatacttgcatgtcacaatctggaaaaatcatttggggaccaggtcattgtacgacatggctcttttcatatagaaaaccacgaaaaagcggcgctgacagggttaaacggcgccggaaaatcaacaatcttaaagatgatcaccggggagcttccatccgattccggtgagattattcttgcaaaagggaagcagcttggctatctttctcagcacccgatgacagacagtacccggactatctatgaggaactccgcacatccagacagtatcttattgatctggaaaaccagattcgaaagacagaggaggaacttgagtctttaaacggtgatgctctgacagaaaagctttcctcttatcacaagatgacgtcccggtttgaacgagaaaacggatatgcttatgaaagcgaaatcaccggagtgttaaaggggctcggctttacagaggaagaatttttaaagccggtctcctccctctccgggggccagagaacccgcgtctcgcttggcaaacttcttctgacaaagccggatatcctgcttcttgacgagcccaccaaccacctggacttaaactctatcacctggcttgagacttatctcctgaactatccgggcgccgttctgatcgtctcccacgaccgatatttcttaaatcgggtcgttacaaagattatcgagatcgaggccggaacccttaccatgtatcttggcaattatcaggatttcgcccagaaaaagcagatgttacgggatgcaagactgaaagaatatctcaatcagcagcaggaaatccgccaccaggaggccgtgattgaaaagctccgctcttttaaccgggaaaaatccattaaaagggcggaaagccgggaaaagatgcttgcaaaaatcgaccggatcgaaaaaccgatggaactgaaaaccgatatgcacttaaagctggagccatccatcatcagtggcaatgacgtcctaagtgtcagccatctaagcaaatcctttccggaacagacactctttgaagatatcagctttgaactcaaacgtggagaacatgttgccatcatcggagataacggcaccggtaagacaacgcttttaaaaatcttaaatgaagtactgcctgcagacggcgggacgtttacccttggttctaacgttacggtaggctattatgatcaggagcaccatgtcctgcacatggacaagacggtgttcgatgagatctcggatgattatcctcatcttaccaacacccaaatccgcaatatgctggccgcatttctttttaccggtgacgacgtctacaaactgatcggggatttaagcggtggagagaggggcagggtctccctggcaaagctcatgctttctgaagcaaattttctcatcctcgacgagccgaccaaccacctggacatggcgtccaaggagattctggaacacgcgctgaacgattacaccgggactgtgctctatgtctcccacgaccggtacttcattaataggactgccacacgaatcctggagctggtcaatcagaagttcgtcaactacattggaaactatgattactatctggagaaaaaagaggagcttacagccgtctacgctgctcctgccccggaggccacggccgaaaaggaaactcctttatcctccgggaaactggactggaaagcccagaaggaggcacaggcaagagaacggaaacgacagaatgatctgcggcgtacagaggaaacgatcgaaaagctggaaggacgaagcgaggagatcgatcatctgatgacccgggaagatgtctactccaattccgtccgctgccaggagctcgcaaaagaaaaagatgaaattacagcaagactggagactctttatgagcagtgggaaacactcgccgaggatccggaaaattgataaacaaacatagaaacgtagctaaggcggggccaatttgatcccgcctgttttttgttcgcctatatttgatagatccgctttgtttctttcagcaatcctcagaatatcttccttatcttgcgttgtatatttattcccctttttcctgatcaaatcagaatatttaccaaacgcaaacacatagccggttaaaacaagcgaaaaatcaattcaaaataataacaatctaaaacttatccaatacaatgctcaagtatctttttcctcatactagaataataaataatgtgctgaatagtttcttcaatctgttccgctccgatttccttttcgtcagatccacaatcaatacctaaaacacgtttaatattatattccaaccattctaatctaccgttattgcaatcatatagcgtttcccaatctacaggtaattcgccgcctgcgtttgcatatccctgcaaaaaagcctgaaacagtccaaaattaatccggcagtcctcataccctgaccagcacaacgccaattcaaacaattcgataaatggattgccgtaagctagacattccaaatcaattatacggtaatcatctccattccaaagaacatttttacaatccatatcgttatgacagatagatacaattgggggcagtttctttcttgccagattgcccctattttgactatctttgattaccggcaaacaatctttcatcattatataaagccctctattgacttttgccatttcagcaagatagaactcccaatcaataggtgtttcagaaaagttttcgttctgaaacttcttgtctatactatggatttcagcaagtacatttcccatctctctgcaatgatattctgttatctcatcgctctttaaagaattaccgtcaaaataatcaaacaaataaaagtatgtaccgtctatttcctgcattttctttccccctaaagataacgcaggaagaatacgaatatcttgctgctccaataaaacttctatctgttcagcgtttgtgtaattcgccatggctgtttctctttgcataacaaatgggttcagtaatttaagcgcgtaagtaccttgctcagtttcaatcttatacatcttgtgcataaaaccgccattcaaactgacaggctcaccctttaatttccaattatattttctctctatctgtgtaaatattgacataatggcttgctccagttctagtttgcttattgctcataatgatacatcaaggcagtactattctgtcagtctctttgcgatggctttgatgaaatcctcgctgtttaatacgaccggatccgggatagtggtaatcagcgccagatcctttgtcatttctcccgcctcgatcgtatcgatggtagcctgttccaaacggtccgcaaaatcctgaagttccttgttcccgtccagttcaccgcgctttcttaatgctccgctccaggcaaaaatcgtagccacagagttggtggacgtctcctctcctttcagatgtttgtaataatgtctctgtaccgttccatgagccgcctcatactcgtagtatccgtccggagatacgagtactgacgtcatcatggcaagagaaccgaacgctgaggaaatcatatcactcattacatccccatcataatttttacatgcccagatatatcctccctcagatttcatcacacgagctactgcatcatcgatcagtgtataaaaataagtgatgcctgcctgttcaaactgatctttgaattccgcatcaaaaatttcctgaaaaatatccttgaatgtatggtcatacttcttggaaatcgtatcctttgtcgcaaaccacagatcctgcttcgtatctaacgcataatggaagcaacttctcgcaaagcttgcgatggaaccgtttaagttgtgcatcccctggataataccagggctgtcaaaggtatggatcagctctcttgtctcgcttccgtcttccgctgtatagacaagctctgccttgcctcttcccgaaatcttcatttctgtccctttatagacatcgccgtaggcatgtcttgcgattgtgatcggttttttccagtttttcacgcacggctcaattccttttacaacaatcggagcacggaaaaccgtaccatccagaatcgcacggatcgtaccgttcggactcttccacatttcttttaagtcgtactctttcatccgggccgcatttggcgtaatcgtcgcgcactttactgccaccttgtatttctttgtcgcctcagcgctgtcgatcgtcacctgatcattcgtttcattgcggtactcaagccccaggtcatagtattttgtattcagatcaagaaacggaagaagaaggtgatccttgatcatcttccaaagaatccttgtcatctcatctccatccatctccacgattggtgtctgcatctgtatctttgccattcataccatccctttcttttctaaatttcttccaggtgcagatttaaaacaacgtgatgaatgtgctcttccatcagccgctctgccctgtcctcatcctgatcccgaattgccgccaagatctgcgagtgctcccgaattgatttttccgccctgttttccaccttgacagacatccgccttgccatctgcacataacggtgaaaatccgtcagcacatttttcagcatcctgctgccgcaggcctcgtacaaaataaaatgaaatttgccgtccagattggagagctgttctgtcatcccctttttaagataaaactctgataaaaaaatcatctcctccatctcattgatctgctccggtgtaattcttctggtggctagccgtgcagccagcccttccagcctggaccggatcatatagatatcctgcacgtcatccctggaaataccgttgacataggtccctttattcgggatgcttgtcaccagcccctccagttccagtttccgaaatgcttcccgaaccggagttctgctcacgccaagctcctttcctacagtcacttctcgaagctcatcgcctgtttgatattttccggaaaggatctgctcgctcaatgtacgaaagacctttccgcttagcgaatagtcctgactcgtttccatcacgcttcctttctactacaatataaatatggttaatatcccttacagccagtaaagatttatccatcttgttgcttaagctgaaaaaggctccgtggtcaagcggttaagacatcgccctttcacggcggtaacacgggttcgattcccgtcggagtcatttataaaaaagcttgcattttttgtaaaatgtgataatataatatagtgtatggcgcagtagccaagtggtaaggcataggtctgcaacacctcgattcaccggttcaaatccggtctgcgcctctcaaaagagcttgtatttacaagctcttttctatttcgtgttgcatagttcaatgaaatgctggtttgctatttgattcatgcgtttttcggggtcggacattacatggcgatatacattttttagtactccatcattcccccatccgccccttgccatgatatagctgtctgggataccaagagcatgctggatggaagctgaataatgacgaaggtcgtgaaaacgaaaatgcgggagtccagcacgttttaatattcttgcaaagcggttagtaataacatctggagtcatggatgttatgttcccttttttccatttccatttttcagccacaaaatctggataatcaatatatcgatctcccgcataactttttggaacacgtatgatccaatctccgttttctgtacataccatattacaacagacatgaacgatgtttccatctatgttttttgtattaatcgcacatatttcgcctctccgcatcggtccaaaagctgcaagaagaataggtaattccatttctgtaccttttacatattctagcaaacgccttatgtcgtcatctgacgggatgtaaattgctggacgtactttctttggcaaggcagtatttaaagcgaaatctggtcggtattggcgaagtacggcagatattagaccatgcatattgcggaccgttttagggctatgcgtttttgcatatagattcacctctttttggatatccgcttgtgtaagacagctgactttaatttctgctatcgtttggatgtcatttttccgaatacgcttataatccataattgttcggggagacaatatagcttctctgtttttgatatattgatctgtcgcttctccaaacgtaaagtcgtctctggcctctttatgactttctttgtttgccgcaaattccgcagccatctgctcagctatccgcttaccctttggacctggaacatcagaggtaaaagactcatagatccttttctttttgatagtcccgtctgcctggataatctcttctgtgtgactgaatacctggcatctccatgatccggatggtaattttcttgctgttggcataacatcatctcctttgtattttgggtataaaaataacagccaaaacagaacgaaagttctggattgcgaggctgttccgaagatgatacaatatttttgacttaatataggcatatcttcggatatgtatcccgtcctggtgttggcgcgccggggcggtttttttattgagtaaatttcataaactatttagagtacgccaattttgcggaaatcccatctcattcattatttcgcttctggttagcaaattaagttttttatctagagttccgatggcgcggtaaatttctttgctcatacgtttataatcatttttggataaaagtctttttaaagcgatcaaacaagcgaacaaatcacgcttaccttttaaatattccccactttggttttgttcgatggctagtagctgatgataaggtgttgtagataaaggtttttttgttcgaaaacaatagagtcgatttccatgagcgcaaaagtttcttacagtagaaatatatgcaagggaactttcgagttctttatccattatattaaaacagcgagatatattttgccgttcctgcgggagcattaaactataaaatttactaattgtaccaagagttaatatattgttcaaaacccataacggaatgtagccgtgagttttcaagtaatgtgaaatactcggatcgttgctgtgtgttgctgtttgtcgttggatttcagcaataaggcttgttatcttagattcagaatctcgtagtgccgtgttgaaatttgtatagattaaataattcttgtgcccatgagtttctgaaaaatagtaagatattaaactttttacgtgagtttctgcctctaggatatatctaaaaaagatatcccgaagaactctatcgaactgataaagtgcattgatttctttcattgtagttccagctcgatatcttaccgtttcggattcggtatctaagaataatttgttatacccatttataagattgtaataaccatgtttctctaaaactctctttgcgtagtcacgggaagaggcatcagaaatatcaacaccacgttcttccaagagatctacaagatcatcaagtgttttaaaaactttttctaccataaaacctccataaaataaaagaccccgggcccgaaggacaccggagtacgttccataataatatatacataaatgaagataatattctccatttagatgattacataatagcacaatacatcctttgtgtcaattcagctaaacaaattttagtatttatttaacaatagtaatatttctattaagaacaatatgcggtagaatcacgtcctggtgttggtagcaccggggcggtttttctttaacgtaaaagacctcgtattgctacgaggtctaaatttgtgccatactgccagtaaatggctttgtattatataaaagataagttatccagccgggtggcactccggcatctctttaagaccactggggcgtgatagctgcctgttctatccttgaataacttacctttataaactatattattatctctgtgtaaagtataatacaataaaaatatagttttgtcaaattagaccttccaagctcgtccttgttttatgtaattgtataattgcgactcacgtaaagggtacattgttctgtatgctaatcgtccatctgtggataagcgcacggcaacagatatgtgatcgatgaacctacaaataaaagaaatactgtctttatttggatggatgctgataaattctggattctgtatgataacaggtatctgctcaaaacacagttcatattcttcattagatacaaaatcttttcgatgtctttccgtatgtttgacacggtctttccaaaaaagaatttctgtatctgccgaaagaatatctgtaaattcaggatacttttcaatgatagaatcaatgatatcctgacgtatacgcccgatagaaacaaattttaatccatcgtcaaacagatctgtcgataacgttgtgacttcttttattacgattcaccttctttcttttgcgaatgccccggacaatgccggggcggtttccattttatttattatttttaggcttttttactaatgatacaatagcaagaatggcgcatactaaacaccaggcagcccatatattcaaatctgtgtaactgccggcaagagtaaatccgcataaagcaccaattccaaaaagaactataagggcaatattaccgcctttactaccattttttgtagcgatagaaacaattccacctacaagaagcattatggcgactataagaccggcagaaccgcttacttctccgttatcttgcaaagtgttacttactccagcagcacaggactggaatgacaccattgcgaacaagacaatagacaagattcctgatacaagtttccacgttttcattttcatttcctctctttctcttgtaattgtgagaaaacccaaacttatttatgtaagcgccgaagcggttataccttttccatgactgccatattcggaataaaataaattatgtaattatctatttcggtacaaataccgtacttatcacgatagcagtcgatgcattcttgtaaatattctactgttacttctaaaaattcagcagcctcatatgctgactgacatcccgattcaaaagcattgacgatcccggtcagcccgatcaacttgttatatccccagagccgtgcctgacgctcctgtttccggtttgacagatcttccatatttaggatatttccgactgatgtatgatggtgtccaagttcttcagcaaggacacttttcttttctgacatattgaggtttttgctaatggcaattcggtttttgtaaatccgtccgttatatccaggaagattcttttcttttactatcagattttgactttctgattctataagtaattcttcataagtcaaatacatcactcccattccgaatcatccaacatgattgagtcgcctgccagtcgttcttctggtgtgctgtttttgtcgaggttggcggcgttgacttccagatgggatggcatctctacaatgttcgctggcgtctgttctgccagagtctttgagcgttcatattccttttcaagggtgaaatccaccatttcctttccgtgagaatcgaggagacggtatttctcgatgattatatattcgtccacggatacgctgttcttcataactggcatatcaagggcatcttgaaagagataatttgcatcgcaatttaaaatatccatgattttaaatagtataggttctttaggagaactgacttcattttcataattggaaatagagccaacggttatgcctaacaaattagctaattcccctcgcgaaagacctttattttccctaagctcctttattctgcttccaacactcattacctcaccaactttctttattctatacaagcattgtagttcagttttcttgttgtgtcaatataaataaacaagaaatttattaaaacactattgacaaaacaagaaacttgttatatattcgtaattgacaagaaacttatttaaacgaagggaggaaacaagttgcttgatattcagacatctaacagtattgtagcaaatcgtgtccgggaaatcataaaggaaaaaggccttaaacaaacggcgatagcggaaaaagcagggttttcaacgcaggagtttagcgatatgttgaatggacgtcgtttgatgcgggcggtagatatagcatctatcataagcgcattaagaggagtcggagtagacgcaaactatttgtttatggtcgattctgctgaaatctatgaaggccaaaagaagggagagtgatagagatgtacatacatgaagcgattgcgaaagcggtaaaagaagaaaaatacatagaacgaaagaagttcgaaaatgaaaccgcatatcgtaagctgaaaataaaaccaaccaatagtagcgcacactgtatggcctatacattcgatcaaaacgaaaaagaagtccaccactgcaagaattggaatccttcagcggaggacttaatggcaaatgactgggaattatccgattaaagatttgattttcttaatatactgatatcccttttttaacatggtattttcttcacaatcacggattgcggcaggatgcaaagttgttatgtaagctattgcgtcagcgataaaaacggagaccagaccatcgtgatccaataccattagtgcgtcagaaatatgtttttccgtttcttctgggaatagagataagaaaaaatccatatcgaatctatcccgttcggattcatggtaagacataaccattgcttttaaagcattatctgcaattttttgcaatttcatagcgcaactactcctttcatactcggatctggcgggagcctgtatttcaagtataggagattgaatgaagaatgacaagagattaaaagagaaggaggtgtataaagatggaagaaaaaattttgaaagagttggaattgataaggaaagagcataatcggttaaaagaaatatcttatcaagatcttaaagaaatctataatacatgcatcgtgctggaaaaaagaatggatgtcataaaaggcatccaccggaaaaatactattttattccttgcaatcttagtgatctcttttgcttgtcgtttatattcttttcgacagtatcgctaagagattttgattttccaaagtcataaaggatatcgactaaaatatcttttaattctgactttgaaaacgtatcattctgaaaatggttactaagatgcttatcaacgatatgttcaatttcagatttaagcatacaatgtctcctttcttaaaaattaggtgctgtaacacctgtaaatacattataagagaactgaaagagcaaatcaatagagtgggaatagggataatagcaaagccaaagatgatatgacgttggaacaagaaaatctatcctacagcttgcaaaagagtttcacgaaagaaaggagaatgatagagatgtacatacatgaagcggcaaaaaaggcaatggatgaaagaaagtatataactacgccagaatttgccgggagcacaaaaatcaaaccgacaaatgaatcaggaaactgtgttgtgatgatgcatgacggaagccacccgtcaaaatatggatggcaaccgacagcaaatgacctgataagggacgactggatcatagttgattagaaccatgatcgaatctctttttgagctgtataaccctttttgatgaaagtatcttcttcagcattccggatagcagacggaagcaatgttgttgtataggcaacattgtctgcacgaaaaacggaaacaaatccatataagaaaatggaggacgatacatggatattatgacaattctgtgcaaggttatgttgtttatgtgcttgatattatcgtttccagcaataataggatgcataattctaactgttgttggagattggtttgatcgaattatatgtcctatgattattgtggtattaattatagcagttgttgtgatatggaaagctttgggcttctaaaacagaaggaagtagaggtgagctgagtgaaaacaaatggaacgacagatgtaagaaaagaaagaaacaaaatagttgcaataatttttgaagaaactggggaacgattcgagattgaaaaaaggatcgcaattcctatgattgaggctctgagaacgcggaaaagaataaaagagagcccggagaatatggatgttgacataataagaactgcaaaattattgtacacactctccgagctaaatcagatttaagaatcatcatttcctgctgagtgaagaaattcacaagcttcatcataagcgtccatatataactgtattttttccgagatggacaactgataagacgaagaagcgacaatagctaatgcaattttttcgggatcgaattttttatccatatgaggtctcctttcataatactcggcatggcagtgcttgtatttcaagtataggagattgaatgaagaatgacaagttacttagttatttatttcagatagccgaaaggaggcatgaattatgccaaaagtactattaacaaaagcacaggaacgacaggagcgtgcatctagggtgctgaagatcagcatcatggaccagcatacggatcagcaacagttatccaaaaagacggggatgccgtatggaacattgaacaaacggattaacaagccagagacctgtaagctggaagagttatggagaattctggacgcattgaacgtcccagcggaagaacgggcaaaacttttaatgtgagagggaggtgataacgatgcatcgaagaaaactgcggaaataccggatcttgaaagacatctgtgcagtggtcgggggaattgccgtactggtgatggccggatccgctgacagttacagccagaacattatctcaacggcagagtttttgctgtcgttcgggatcgcgctggatatgacggttgtagcgtacatgttgcatggctgtgtgaaagacagggagaagcattatctccagatgcgggaactgcgccggagacatcggctgcagggcatgaaaaagagtgcatagggacggcaatcccagatatgcactcgctaaaataaccaactttattatgacagataagaaaggaaaaagcaaatggagaaacaaagaaaatatgaactgaccaaagaagacctggaaacactgatcttcttggcagcaaacagaatatgcgaccagaagaaaacgagtgaggagaaagagatagagatttgtgggtacgcggcggagattacaagagaactaatagaccatctgacgggtgagaaccctttcgatcaggatcagatggagcttgtagatgctgttttacataaaagtacaactatcataatcggaattccaagatgaaaaagaatggaaacgaagaaaaagaaatcctttggattgtccgctatgaaaacggagatatcgggtgcctgtatgggacaaggcaagcggctgaggagtacgcacagagagaagcggaaaagaaagggaccggatatttcattatctgagataggacaatccgaacagaaagaagaaataggaaatacaataccctcccggagcccgacagctcaagggagggtaagccatacatcttagacatactcagtatagcatgtatggcgggaaaagacaacgcaggattccggagggtacggatccgcatttgaaacagggggaagccaatcccctttgagactcgataagggtattatttcaaggacaagaaaccggaggaaagaggagatgccatacatcaagacgacctgcaaggcgggaaagacaaaagagtatgaattttattattcatatcgatttgaccagaaaggggggagccggaaaaagaaagagaacaggactccagaagcacagagacaagtcaaccggaggatggccgaaaaaaaactcacccgattgatgaacgccaacctttccggggaggattattaccttacactcagctaccggaaagagaagcggccggatcgggagacattgaaccgggacatccgaacacttttacgaaaactgcggaggatctaccggaaacacggaaaagaactgaaatacatatggacggcggaaaaaggggagaggggagctgcacaccttcatattgttgtcaatgggatcgatcatatatcacacatcataagagatctatgggaaaagggatggatctgtattaagcctttggataagagcgggcagtaccggaaactggccgggtatttcatcaagtattcggacaagaccatgaagacggagcaaggattcatcaacaaaagatactgtagcagtaaaaatcttatcattccagaaccggagaaaaagaagatccggggacggaacgcctatagccataaaattgaggttccggccggatggtacgtggataaggagagcatccgggaggcttggcacgagataacagggtatttgtatttttcctacacgctggtacaactgccggacaacaaggcagaccgggaacggcagagggaagaatcttatatcctgaatctggagaccggagaagtggagatcacagaaaggaggaccgaccgtggaaaaagcgccaagaatcacaagaagaaccttgcggaaacatctggaagaggtcacagaaatcgcgtgggagcatgacgcggaagaggcatatcgaattgtaaaagaaaaatgggagattgggagcagtaggtccttccgggatttcctgaataaagagcatattacgacatatcagagaacggcagcgtaaaccatgacactggaagacaaggaaagattttccagagagtggaacaaagccatagagatgataaaggagtggaggagaaagaagtgagaaattaccgagtcaaggaacgaaagacaccggatggccggatccagctcaccggatcggaagatgcggagcaggagaaggtggtatgctgggccaaactgatgagcaacgcttacccggacctggaattgctctaccatgtgcccaatgggggcagcaggaacaaagctgaggcgtccaaattgagacggatgggagtgagggcaggggtgccggatttggtgctcccggttccccgcgccggatacgccggactgtacattgaactaaaagtcggggagaaccggccaagtaatagccagaaagactggctggagaaattgacgatccagggctatcaggcgttggtctgttatggtgggaacgaggcgatccgtgcactgcaacagtatataacagcgtcaaagacagctttagtgaagcagaatgaagattaagatggagatacattcagaaatagggaaaccgatgagaaggagaggtggatggcatggcaggatttgacgtaatagagacgctgaatggaaacagcatccaagcggcgggagcgcggaaatggtatcaggaaacgaattatgaagatgcgaaagagatcatacgggatgagctgggaaatattcggaactccttcgtcaaggtaggatacttcctgaggaggatcaaagagacagaaggatatcaagaggatggatatgaaacaatctgggattgtgcgaaagaccagtttgggatcaccaggacgaccgccagcagatggatggagattaaccggcgtttctccgaaggaggatacagtccatatcttgcggaagaatataaggggtataacaagagccagctacaggagatgctgtacctcacggaagaaaagctggaagaggtggatccgggaatgaccgcaatggaaatccggggcagcaggaaagagcaggaagaaaaaacacaggaaagtgcggaaacgcacagagaagagtgcgaggaagaggacaagataccaggacagatgagggaggacgactacctggaagaatcagaagaagtagacactacagacatagcggacgaaaaaacgagtgagattcagaggatagtagaggaagagcggcagcggcaagacagggagaacccggatccggggcggcaggacacaaaagagaaagcgttgatccgggaacagaaaacagaaagcatcctggacaccgcaacgaaagaagaggatgaaacgtatgcaagaaagctccatgtattgaaaatgctggaaaagtattacatttatctgaatgaagaggagatagagattctcaaaggtatggtacaggattgcaagagaagaaaacaggagtatgcgttggaagactgtggaacaacgtcataggaaacagaaaggagggacaaaaaatgcggatcgagggggatcagtgccggagatgcgggtcactccagacagaagtcatagatcgcagatatcggaaaaaagtagacagagttatccggaggcggaaatgcctggaatgtggatataagtggaatacagtggaagtctatgcggatgaatgggaaaggctatcagaaaaggacgataattaaccagaacaaacgaaaggagaacgagttgcgcgcataataaccggtttctcctgagtgaatgatgacagaaaaagagattagattggtagaagagaatgtcccgcttgcggggtacgttgcgaaacgctgggtgaagcaagctgggatagagtgggaggatgccctgtcggcagcggagtatgggcttgtcaaggcggcaatgagctttgaagaggagcgtggcttctgtttcagcacttatgtggtacgtgtcatggagaatgaaatccggatggagctgaggaagaggaacagacgaaaaaaagtcgtgtattttggggatccggtcagtggggcagaaggattgacactgggagacacgattgcagataccagggaccattttgggatgtcggaaacagtgcatgatctgatccgaaacagagatcttacggagaaagagcgggaagcggtactgcttcggtttcagcatccagagaagacccaagaggaatgtggccagatgattgggattggacagtctgcgttttcgaagtacttgaacagtgcaaggcggaaactgaaaagggtttaaaccagaacaaacgaaagaagccagcctccggccggggaaagggtatgccgggattattgaattatgaaaattggactacatgatgcagaaaaagaacatttcaaacacaagaccttcccgaacttggcactgatgaagatatccgcataccacaagggaaagggcgatgacgtagagtggtggaatccgctgtatagatacgacagagtatatagcagcaaggtgtttgacttcactccgattgatccgtatctgcccgatgatgcaatcaggggagggacgggatatagggatattccgatagatagaacactaccggatgaggttgatggaatgttcccggactacagtatctatccgaaatgtgattatgctgttggatacctcacacgtggatgtccgaatcactgtcggtggtgtgtggttccacgcaaagaaggaaacatcagaccctacagggaatggcaggagattgtcagagatgactcggacaagctagtgttgatggacaacaatatccttagttgcgactatggaatacagcagttggagagcctgatcgggtctggctaccggattgatttaaaccaagggatggatgcaaggctggtagatcgagagatagcacagatcctttcaaaactgacatggatacggcatatccggttttcctgcgatcagaagagccagatcgagccgatacagagaacaatagatctgctaaaagagaatggagtaaaaccgtaccgtgtatttatatatttactggttactgaggagcttcaggatgcatcagagagggtagaagcacttaagaggtataaggggatcaatctatatgcacagcctgagagaaatgaaagacttggcgtgattccgaataagatgcaactggaatttgcacagcggtatatctacggcgggtgttatcggacggagacatgggaagagtattgtaacagaaaacgatttgtaccttgataattgaatattgatggttggaagggtataatatcattattctactttgggggacgtggttatgaaagatataatattatggtgcaatgagaatgaaggttttatatccgcagtattaagtatagtgactataatacttagtggagtagcggtattctttacgtataaaattggtaaaatgccatataagaaaaagatgtcagtgataccatgttattattctgatgaacaaaaggatattattcagattatggttgtgaattatggggttgtcccattggttatcagtactattaccattgaagatgaaacaggattaacagtaggaggagtattaagtactaaacctattgtaatagaaccttcaaaatgttttatggaagatgtggaaattactgatgagaataggattatttccaataacgcaataaacttgaataatcatattaaaatatgtatatgggaatatgatgatactaaaacgtgttttaaaaaaggatttcctgtggggtaatttttgccaaccatcaatattcggtggttggttttttgttgcccgaaaatgggtgaatgtaggaattttgcatgtttttaaaaattggcttggtcttgaatactttgattgggtaaatgaatataaaggaggattgacatgacagcaagtgaaacacttttgttagattatattatgcgctacacctattcatgtccgataaaagatgatacggatatcaatttttaaaaaagagtgtgtcggattcaaagaattaggatgccgggattgtattatgaagcatttagaggagttaagatgatatgcaagaactagagaagattctggaagagatgaagaaaattaaagatgggaacaggaaagaaaacttatacgcaaagtatccaccaaaggacgagcaaggaaaaatcctcaacgggtattcgcagggatatgaagatggaacagataatttttacaatgtgatggtagatatcatccacaagcacatgggaaatgacggctggattccggtggaggagcgtttgccggataacagaagatcaaattatgaagtgacatttataaacgagtgtggatatgaggaacatggtttttcacaatggtatgacggagagtttcatattcctgctgttgtgatagcgtggagagagcatctaaagccataccgcccggaaaggagcgaggaagaatgatggagaaattgataagaaacgaaaacgaggctattgaagcgataaaagcaaatatgccaacaagtgggtatcagatgttgagagagtcgcttgatatggcaatcaaagccctcgaagaaatccagcagtaccgggaaatcggaacggtggaagagtgccggaaggcgagagagaagctacctgttgcagaagaagcgataaggaaactcctatgcagtgaatacggctcatcttgtcaattttgtatacatgatagtgacgaggacgccgtgtgctgtaatataggcggcagtggtagctggtgctgcaaaaatgcaaaatggaacggtagattggagtgaggaagaatgagactgattgacgctgatgaactgataaaggacagagtagaaaatgaccctgtgagaatcgcggctatgtgtgcgccgactgaatatgatgtggaagcagtttccaaggcgttgaaaaacgagatggaatttccggataatcattatccagagtggcgaacgaagtttttagaaaagtttgataggagaatgtaaatacaggaggactaaaaatgaaaataaaagctcaggacggaaacatttatgaagcaagaaacttagaaatggacgtgtgtgttttaaagtgtaatgacatcaaagacaggagaaaaaacataaacttggtaaatacaaaagccttgatagagcaagggaggtattttcagaaatagcatgttgccaagaaaattattttgaaatgccggaggaataaaatatggatttgtgcattctttgattcgaaaggagaataaaaatgcaggaactagagaagattctggaagaaatagaacatcttgaaaaaatacagttttcaagttatacgaaaccgcttattacgatagaagatgttgaaaaaatcatccgcaagcacatgaatgataaaagtgaaacttacgcgtttgactttgcaaacactgaagcgtttgattgtccgtgcggacgtcattatgtacatttagcaatacctcctaaattagagttctgtgaaaaatgtaaagagaaagttagaaataatagaactgatatatgtcctaaatgtagaaaaaaattatacgaatatgagaaaaaatataattgtgttgtagatatagggatgaatgggtgtgatggggcgcgcggggagaaatacatcctaccgcacggagaaaggagaagaaattgaaacgaaacagaatggagcacgaaaagaagattgatacagcgaatcactatgactgcctggagacagatgtgcgggaagatgccaggaagaacttcaaacgtcagccgtataagtcggttgatgtggcgaagtacatagcgaagaagtttgggattggaggtgaaggcaatggacaagaagattcttgaagactacatagatgcctgcgagtttatcaaggagacagaagcagagatcaagaagctggagaagaaaaagaggtttgttcaggacaaggttcgggggagtaatccagactggccgtacgaagagcggtcttttagcctgggcggatcggttgagacggcagcagatgcctttacgctggcaagagagaagaggatcctggaggagcagaggaaggtagcttcggatctgaagcttggagtggaagagtggatgaaggagatcccctttcggatgcagcggatcatccggtacaagatattcagtggactgagttgggaggaaacggcgacgctaatgaaatgcaagggtggcggagagacaattcgaaaagaagtacagagatttttgaagaaaaattgaaagttgtccgttttgtcccggattgtccggttttaaaatgctatagtatatgctgaaagaagtggatgacgtaatgtctatgcgtttctccaactcatacttatcgaaaaactgagaaagacgctttgcatggcagagcgtcttttgttgcatagtggcataaaataggatattataaaagtaaatcaattaagtatgagagtgggaatgacgatggaagaaaatttggaatatatgctgggtagtttagataattatacgaatcaggttattaacagattggtaaagaatttagttaccaatggagtggcaacagaaaaagaagcggaacaaggtgaaaaagtatatattggagacaaattatcaaaaaagcaaggtttacgacattgtctttcgataagcagtttggcagttcaaagtgttgaaaaatgggagtttgaaaagaattacaaatattccttttttttgactcaagaaaattttagtgaaaaaaaattaaaaaaacttatagaaaatgaaaaagtaaagttgtatgatgatttaaaaggatatgaacctttatatgtagtggctgaaaggccaactgtgagattttatgaggacaatttatatttaaaattcctaataaagttgaaagcaactgatactgaagggaatcaaagcaaatgtagatatccgattattgttataatttattcaaagagtgatataatcgaagtaaggtttgattcaatgggctcaatgtattatcgagacaagtttagatatgtatatgagactattgcgtggttaagaaataatttggaaacaaatataaaactattagatttaagggatgttgcgtattttattagggaaaatggtaaagataatagagttgtattagcagctcaagatatgagaatggcgaatggtggaaaagcaacagttgatgtcgggaatgatgacacaaatgttttaccttttatcggagaattaaaggtattgttagaggagtataaagaagagtttgataaagcacccattataaaagacgctttagaagaatttatttataataaagaaaatttatcagattttccttggattaaatttagatttgaagatagagatattgaagtaaagattacttttgactatggaaaaagaaaaatttcattgcttcaacattatcagagtcaattagttaagaatgttggaaaggagagaatggattatgttacctcatacctacttaaagttagaaacaatattaaagaactctccgataacaacgaaggaaataaatagttttttggatttattcaaacattataaatttagacaatggatatatccaggggctatccatagagttacaaaaattaatatagaaaaagtttacttcattttaaatgaagctgagaaggcgggtgttgttgagtcatattttgaaatcatttgttcagaatgcaataaaagtgttggaagagtatataaaagtcttgatgagataccagatgaatatatttgtgataattgtgatgctataattaagggaatagaaaatgttgtattaatatataggatgttaaataatgagcaagtttaatgaagggcttacacttgaagaaatactaaaaatgctagatagacttccgggagatatggagtgttttaatagacttggatatttatcgcaagactattataaagattataaaacgcactatgaattatttgtggaagttaatgagaatggagatgattatacaaaagctgataagggaaaagctttagaaaatctagtacagttattatttaaagctactggtagttattatgaagtatatgctaatgtgagaaatggatctaacgaaattgacttaattttaaagttatctgacaaaggggttacattacataaactgttaaatgagaagtatgataaaataatcggagaatgtaaggactataaaaaagcagtaacggttacttacataggaaaattttatagcttaatggaaacaacaaattgtaattttggaataatgttttcatatcatggaatttctggacagagttggggtggaggaaggggtttgattaaaaagctatatctgttgtctaatagaaatcaatttcgtacatatatacttgattttaataaaaatgattttgaagaaattcttaaaggagagagcctatttaagatgctggataagaagtgctttgagttagagacaggtgttgattgtctggaatatataagaaagcatcccaatgaagataaaataaaagcgatcgtaatttaaggcaccctccggggtgcttttctcgtacaataataaaccagaattgaaggtggtgaagttgtaaagaaacaaagtaatatgattctgtgtttattcatacataaattttaatataagggggaaaagacgcattttgttgaagaacagaacaaaatatgttataataaacaatatcaaagctattgtgttgaggagtaggtatgagtgaagaaatgaaagcgtctattttttcttttataaacattattgcaataggaattgttatttctgcagcaacaaatccagttgatggagtaattgttgcacttataattatacttttagtttgtttgcttgcatgttcaccatatggaggaattttagctaggctttatatgaaaagtaaagggcaacatttagccgaagggaagcaagctttttccgaaaaattatggattttaagttttgccgcatatatgataattgcaaaaatcataggaattattatggcaatagtaatgtttattggaaagtttattattgctttttgtatctgtatagctacaggaaaattgataaacggtggattagttgatttttgggcctcaaagcaatatgcaaatgttatcgttgaagtatatacgatttgtacatcaataactgataagatacttgaatttataatgcgaacagaagctcaagttataggaattcggtatagcgaataaaaaagcagtaatagagagcatccgggaaaccggatgctttttgaatgggggtgagatatgagacagttgaaaaatttctataaattaaaacaatgggagaagaaaagggaacagatacttagacgggatcattttcaatgtcaggaggcaaaaaggtatggaaagtatatggaagcagtgatagtacatcacatctatccattagaagagtatccagaacttgcattgaagagctggaatttgattagcctgtcgaaagaatatcataatcagatgtatgacaggaagacaaataaaatcacagatgttggtgcgtattggcagagaaaaagaaaaaaagattttgataaatggaaagaaaggcacccccctccctttgtgaaaaaagaaatcggtattggagaaacgggctagaggactttttccaatagcgggaatatttgaaaatattttttccggaggaaaggaagtggacaaaattggcaaaaagtacgcccacaagggacagtataaaaaagaggacgatcaattacatgaaagagctgggaacctataaaatacagtataatcaagtggttgaggtttattccgatatgctgtaccagtataatattctaagtaaaaaatttgaagaagaagggtttgaggcaactatcgatacagaaaaaagtggtggaaaaaaatcgccaattttggcaagcctagagaacctgcgaaaggatattggaacctattcggaccgtctgatgttaaatgctaaaacatacaatgcggagatagaactgccgaaaaaagagaagtcagtatttgcgaggctcttagaagggcaaacataatacatggatttaactaatatttcttcaccgcattttcagacggctgtgaaatacgcaaagaacattgtatcgaagaagattctggcaaataaggaccggattcttgcatgtaatagatttctaaaagatttggaaagatcggatttggatttcaggcaggagcaatttgattttgtgattgctatgattgaggggacgatacatcatgttcaaggagaagataaggaaggcaacagctacaaagggaaactgatgaaattaacagattggcagaaatttgtaattgttaatctgtttggtttcttccgtaaagggacagagatccggcgctttaatgaagcgcttatttttttacccagaaaacaaggaaaaacctcatttagtgcagctttggcagaagcgaagagcatcctcgacaggcgatctggggcaaaaacatatattgtggcgaattccgtaaagcaaacattagagagtttcaatttcctggttgataatgtgttgggtttgaaaccggatgtaaggaaactgagaatccgggataataatcaggaacattccatcgcggtcgattttggagacggtacagcggatattttcgctattgcaaatcaggaagataagttggattcattgaactgtaattgtttgatcctggatgagcttcattcttggaaacgcgccggagcaaagaaatacacattgatgaaaaacgcgatgaaagcatatcggaataaattgttgattggaatatcgaccgcgggagatattccagacggatttcttgcgaatagactggaaacattacaaaaggtgttaaatggaagtataacagacaagacatacgattcctatttcatatttatttgtaaggcggatcaagatgaggaaggcaatatattaaatagcaaaggtaagatcacaaggatggatgatccggaagttttgcggatgtgcacgccatcaatcggtgtaacggttactctggaagatttgatttccgatgcggagcaggcaatgaatgaaccacagttaagaaacgaatatctaaataaaacgctgaatatcttcacgaacgcattgaacgcctattttgatatcaatgaatttcgggcttcggataaccagtatgaatggacattagaagaacttgccaagcttccgattaattggtatggaggagcggatctgtcgaaattgcatgatctgacatctggtgccctgtatggttcttataaaggtgtggatatctgtattacacatgcgttctttccaagagctgcggctgtgagaaaagcggatgaagatgggatcccactttttggatgggaagaagatgagtggcttacaatgagcaatacagcgacagtacttccggacgatattgtaaattggtttctaactatgaagaaaaaaggatttcgcatcaaaaaagtgggatttgataaaaaattcggacgagaattttttctgaagatgaagaaagcaggattcagaattcaagaccagcctcaatatttttatgtgaaatccgaaggatttcgacacatagaggtggcagttaaaaataagaaattttactatgtacattccgaagcatttgagtattgtgtgcagaatgtgcgagcaatcgaaaagacagatgacatgatacagtacgaaaaagtggatggagatggcggtgttcgaagaatagatctatttgatgccggagttttttcatgttgccaatatcttgaagatctggcgcttggaaatgcggcaagcaaatggctgaatagatagcggtaaaaagaggtgagggtatgtcaaaaaaaaagaagaaaaacaagattcgttctgatccacaaaatgagagtaaagtattcgtttataagggcgcaacattttcagattttatcttgccatcaggatacgtccggctgtcagagaatccagaaatccgcgcggcttgccaaaaaatagcagatttagtatctgggatgactattcacctgatggagaataaggagagtggagacgtcagaatcaaaaatgagttgtcaaggaaaatagatatcgaaccctattctttaatgacaagaaaagcatgggtgtttaatattgtctattctatgcttctcccaggtgatggaaatgcggtagtgcttccgattatggaaaatggactgattcgggaattaaaatcccttaggccgaatggagttagctttatggaagaaaacggtggtgattcatataagattctatatgaaaacagagaatatgaggctgatgaagtattgcattttacgatcaatccagatccagaacggccgtggaaggggacaggatatcgtataccgttaaaagacgtggcgaataacttgaaacaggcaaatgcgacaaaaaagacatttatgagtgggcagtatatgccaagcgttattataaaggtggatgcaaatacagaggaacttgcgaccgaagcaggcagggcacaggtaaaaaagaaatatcttggagaagccaaaccaggtgaaccatgggtgattccggctgaattaatggaagtatcagaaataaaaccactgtccttaaaggatatcgcaatcaacgaatcggtggagatagacaaacgtacagtagcagcattgctggatgtaccagcttttattttaggagtagggacattcaataaagatgagtacaacaacttcatcaggaccagaattaaagcgattgcggatactctgcagcagactttgacgaaaggactgatattaaatccaaactggtatttcaagtgtaattcaaagagccttttagcttatgatacaagagaacttgctgagattggtatgaatctttatatccgtgggatttatacaggaaatgatgtattgaacttgattggggattcgccaaaggaggggctggatgaactggttattctggagaactttattccacagggaatgataggagagcaaagtaagttgaaaggtggtgatggaaaaaatggaggaacgtaataaaaaaagtctgacaaggacggcgaaaacggatttccagaccagggatgagaaagaagccggcaaggtgatagaaggatattttgctgtttttaattcagaaacagaattgtggccgggagcatatgaggagattgccccagacgcgtttaataatacacttggaaatgatatccgggcattagctaatcatgatactacattggtgttaggacgaaataaatctggaacactgaggctcgcagtggattcacacggcttgtggggagaaatccatgtcaatgaaaaggattctgacgcaatgaacctttacgaaagggtaaaacgtggagatgtggatcaatgttcgtttggatttaacatcctgaaagaagaaaccgactggcgtgaagatgggacagtgaagtggaaaattgaggaaatcgatctgcatgaagtttccgtatgcacgttcccggcctatgaagacacaggaatacaggcaaggcataaagagttagaacaacatagagaaaaacgtatgcagcagtggaaacatgaacagttgaagaaaatagggaggtaaacagatatggcattaaaacagattatgctggcgaagaaaatcgaaggaaaggaaagagagcttgagaacctccggaatctgacaaaacagtttgaaaaaagagaaaaggaactggagaccgcgatcagcgaagcaaagacagaagaggagcagagaacaatcgaggaagagattgacaaatataccaaggaaagagaagctcatgacaataaggtaactgaggcggaaaaagaattagaagggttgcgggaggaggaaaacgagttgaatagaggaaagccgggaaagggagaaggtcatagaaatctcgggaggggaagtgaagaagcgaaacttgaggaagcgagagcgggaattaatgcttatgtaagatccagaggacagatgagggatggatttacgtccgtagatggtggagcgttgattccagaagaactgctgactccgcagatgaagccggaagatgtggttgatctcagaaattatgtaaagattgtgtctgtaaatagcgcgtcaggaaaatatccggtgattgcgaagtctggaagcacaatgaatacagtagcggaactggcggaaaatccagaactcgcaaatccggaaattgaagaaattgagtattccgtacagacaagaagaggatatattccgatttctcaggaagtaattgacgatgcagattatgatgtaacaggtctgattagggaggagatctcctcacaagcacgcaatacaacgaataaggatattgcggctgtgttaaaaaaggcaactgcgaaagaggtaataggggtagacgggctgaaggatcttgtcaataaagacattaaaaaggtatatgcagtagggttttacatttccgcctctttgtatgcggaactggacaagctgaaagataagaatggaagataccttcttcaggattcgatcacggcggcaagcggaaagcagttgcttgggcgaccggtaatcgttttggatgatgatatgattggaacagaagcgggaaatctagttggatttgttggagatgcaaaagcattttgtgccttttttgaccggaaacgcactagtgtggagtggatcgataaccagatttatggaaagcttttagcagggattattcgctacgatgtagaaaaaacagatgaagatgcgggattttatattacatataaaaatagtacggagggaaactgatagacccgtcagtagttagcgttccaccagagacagatcaaatatatgggaaactggtatctgagatgattagtaacactgccgttctggttgatggcagcgttacaggaacgttgaaatacgtgacgggctatactgggtttaaccaagaaaaggaggaagaacaggaagggtatttcttcccgtttatgcttggaggaagcggtacatctatgacattcaaaaagaatggaatggtatcaaaggaagcaattccgtgggagaaaacgaacgtattcagagtgacgcaagaagacacatttactgtattggtagatgataatgaaatcgttacgtttaactttaaaaaagccaaatttgaggaagtggagggagcataatgaaatatatcgtaatcaaaaaatttcgtgatttgaaggacgaaggacgcatttataatgttggtgatgagtataaaggaaaaaagacaaaagcacggattgacgaattggcaacggataagaacaggattggaaccccactgattaaaaaagaagagtaatttatgtggtggaggaaagaatgttgaatgaagaaatcatgccattattaaaagcgagactgggaatttcgacagacgtaagggataagcttctgaaagcattgattgatggaatcatatcggaatgtaaaaatacgtatgggattgaactggatgagtggccggagcatattatgtttgttttggattgggctacatggaaataccagcatccggaggatggaacgacaccaaggagtatccagtaccgactcaaaaatatgatcatacaaaaggagtgcaggaacgatgaatctgacttgggatgaggaagtaattctggttggaaattcaggcttcattgaggatgaactagggcagcagataccacaaataagcgaaagaacggtgtcgtgttgcagacttccggtatcaggcgtcgaattttataaggcaggtcaaaatggaattgagatttcagagatgcttacggtacacccatatgaatatggcggagaaaacatcgttatttttcaaggaagaaaacttcgggtgcttcgggtatatcggaaaaatctggaagaatgtgagctttcttgtacggagaaagtaggtgatcgagatgccgagagaggggattcggccagaaaaacttgcgtttgagatcgaaaagcagctaaaagaatacaccgatgagataaaagaaacagtctgggatatcgcgatggatgtgtcagaagatgcggtaaagagactgaaagaagaaagccctaagggaaggcggagtgggaaatatgccaaaagctggacccgtactacagaccgaaatgggatcattattcatgctgggagaggagagtatcggctgacccatcttctagaaaaggggcatgcattgaaaagagggggaagaaaagttgggaaaagtccagcatatccacatattgaaaaggtggagaaagagtgtgtggaacagtatgtggaggaaatagaaaggagattaggacaatgacattgccagagctgaaaaaagtgttgaatacgctgggattgccgctggcatatctgaaatgggctccgggccaggtaccggaacttccctacatactgtattatgcggatgaggatatcggcttctatgcagacgatgaagtttataatgaggggtatgcggttacgatcgaagtatacacagaagagaaaaagctggatttggaagaacaggtaaagaaactattaaatgaaaaccatcttgtttatgaatcttatgaggattatttggattcagaagagatgtttttaaaagcttatgaaattagaatttaggaggaaattatgccaggagaagcaaagaataaagttgagtttggattaagaaatgtacattatgcggtaattacagaaggggacgacggagccattacttacggaacaccaacgaaaattccaggtgcggtgtccattacgatggataaaagtggagatatggttcgatttaaggcagatgatattgactattatacggccccgaataatcagggatacgaaggtactttgacaatcgccaggacgccggatgaatttagaagcgatgtgcttggtgaggaaaagacagatggaggtgtgatgattgagagtgccgatgcaaaaacaaaaagaatcgcactgctctttgagttccaaggggatgtaaaagccacaagacatctgttgtattattgttctgttgacagaccctctatttcaagtacaacaaaagacagtggggatccaaatacgacagaacttgccattgtagctagtccgcggccggataataatcttgtcaaaacgaaaacgacagagactaccacaacacaaatttatgataactggtataaaaaggtatatgaggaagagagtgaaatagaatcggcgtaaagagggaatgggagatgttatttttgaaaggagtacggaatggagaaaacggtatatattgatgaaaaaccagtacgtcttaaatcaactgcggcattaccaaaaaggtataaggcacaatttagaagagattactttgcggatttgcttaaaattgcgaaagtatttggttcaggggcaaaaaagagagcagatttacgcacaatcagttttgacgatttaaaccattttgatatggatgtattgtatgatattgtttggacgatggcgaaatcggcagatcgcacaattccagatccgatggaatggttagatggatttgaaacgtttccattaaaggaattgctccctgaaatcaaagatctgttggaaaattccatgccacaaagtaaaaaaaaataaatgatcaggactcttctggtgatgaaatgttcacggtagagtccttttcttatgtttgtaagcagtgtggtcttactacagaagaaatggaggaaatgacgatcggagattgtttggatttcattcaggaatttgtggataatcaaaagaaaacaggggagacaaaagaaaaagtacggaaagcgacacaaaaagattttgatagcttctaaaggggtgaactatggcaactaaaaaaataaaggggattacaataaagcttggagcagataccagtgccatcgataaagcgcttaaagatatcaatcacacatccgctgggttaaatacagagttgaaagaagtaaataaactgctgaaattcgacccaaagaatacaacactgatcgcacagaaacaagaaattcttgcggatgcggtcgaaaacacgaagaagaaattagatgcgctgaagcaggctcaatcagaagttgaaaagcttttcaaatccggagaaattgggataaatgaatatcggcaatttcaaagaacgttggaggaaacagaacaatcactgaaatcttataagcagcagcaggggagattagagcaagaacagaaaaaattgggggagagtacaaagcaactccatactttattggaagcaacaggaaaaagcctggacgagttccaagatattttaggatccaaactaacaaatgcattgaaaaacggcacagccaacagtgatgaattaacggtagcaatcaataaaatcgggaaagcagccctgggatcggatacagatcttgggaaaatgcgtgacgcactgaatcagattgatgaaggatcgatcggcgatgtgcgtagagccttggaggagctgtccagtcaatcagagaaaacggaagaagatctgggcaagattggagaaggtgtcgcaactggaaatctcttggatgcggcagatcagttttccgaagttggggataaggttcttgatataggaagcaaggctttggaaacgtcgcaggatttagaaaatgcttcaaaaaaagtaaacgcatatttcggagaaacaggggcggcagcgcaggaaaatgcagatattatcaaaagagtgtatgaaagtggtgtaggaggctctctcgaaaccgtggcagatgcggtaatagctgtaaaggagaacctggagggcttggacaacgtaagtcttgaaaaaattgtatcgcaggcggtcacactggaagaaatctatggaatagatatgaatgaatctctccgtggtattaacgctctaatggagtattttggactggacgcccaaaaagcaatggatcttcttgtatcggggacacagaatggacttgataagacaaacgagctgggagataatctgtcagaatattccgggaaatttgcggaagcaggatattcggcagaggaatactttcagttattggagaatggactggatgcgggtgcttacaatctggacaaggtcaatgacgcaatcaacgaagtgacgacaaggattgcggatgggacgatcgaagactccatgtctaaaattgatgaaaaaacaggggaattggtagaaggaacgggaggatggagtaagtccgtcgaagacgtgtttaaaaaatggcagaatggtgaagccacacaaaaacaagtaatagatgcaattgttcaagatattcagaacacagaaaatcaacaggagaaattaaataaatcggctcttgcttttggaacaatggcggaagatggaagtaccaaatttgtatctgcccttaccactgtaggggacagctatacagatataagcgggaaagctgcccagatgcagaaagaaacaaccacctccgcacaggagatggaaagtgcggccagaagaatccaagacgctttcgctccaattggtggggatctggtggatatgctaacaccggcgctggaagtcctggcagagttagcggagatgttttccagtctgccagaaccagtgcgaaattttgtcgaaatttttggtgggattgcggcggtagtcgctgtgattacaccgattataggggcaattactatattgaatggtgcgcttgtaactctcgtgggaataggattggcaccggtattgggaattgtcgcggcggtttcagcagcgattgtaggaattatagctgtcataaaaaattggggagctattacagattggttgtcagaaaaatggggatcgtttaaagagtggatttccggactttgggaaagcattgtagaatcagcatctgagacatgggaaggaattaggacatttttttccgacttgtggacaggtatttcagataccgcatctggaatttggacgggaatgtcgaatacagtaaggaatatctgggaagggattgtcacgttttttcaagaggtatggaatcggatttataatgtaattgcagtaccattaaaccttatcaagggaatcatagaaggcgttatgtatgctatttatgcggttatttatacggtttgggaagtagttagaataacactccaaaatgtatggaacggaatcagcagtatggcagcagcgatttttgtaccgattgcacagtttttcacaggattgtgggaaggaatatcttctacggccgcaagtgtatgggaaacaatcacgggaacgttgagtggcgtgtggaatgggatcaaaagtacactgggaggaatttgggacagtatatatggaaaagcgaaggacgcctttgggaagatattttcttttatcaaggatggtttccagaatttgaaaaatacgattggggatattgtgaaaggagtggcaaatgccatcatttcaccaattgggagcgccgtgaatggtgtgatttctggagtaaactggatcttggacaaggtaggatcaaaaaaacagtttgccaagtggaaagtgccgaagtttgcaagagggacaggaggactgaaagaagatacgattggcgttgtaaacgatcaaaaaggaagcatttataaagaaatgattgtacctccacatgaagatccgttcattccggagggcagggatgttgttttgccgatggaaaaaggaacgaagattcttcctgcgaaagagaccaagtcatttcttgaagaactcccgcactttgcggatggaataggagaatggtttaatggggcctggtcaacagtgaaagatatcgcgggaactgtgtgggattatgtgacacatccaggggatctggtaaagactgtagtgaacaaatttgttaaattttcggatgctttggagccgggattatctatcgcaaaaggggttgtgaatacggtttttgattctgtaacggggtttgtaaaaaaattatttgaaacagaaagtccgtctgtaaaatataatccatcagcgggggtggaacaatggagaagtttggcggcaaaggctttaaggatgacaaatcaatactctgaggcgaatctaaatagattgttgatgcagatgcaaacagaatcaggtggaaacccgaacgcaattaataactgggatatcaacgctaaaagagggacaccctccaaaggattaatgcaggtcattgaccctacatttcgtgcaaatgcaatgccgggatatgataaaaacatttacgatccactttcaaatatgttggctgctatcagatacactgtaagaagatacggtagtttagcgagaggatggaaaggacatgggtatgaaaatggagtcggggaaattaatctcgaaaatctgttttctgtacctgtacttgatgtttcctggttcaaagagggaggaattttgacaaaaccggctgcttttccgatggggaatggaagaatgggcgttgccggagagggaaaggaagcagaagcgattacgccgatatcgaagttaaaagattatgtgaaagatgcggttggggaagtattaagtgataaagaatttcatattacgatacatctggaacagaagattgataaaaaaaccttggcgagagagttgataccaatttcagtaccacttacgaagcagtatcagacgagaaaaaataggttagggggtgtgagagaaaatggggcttctaaaagctatatttaacgaaaaagaattaccgattatgatcaccaaagtcaatcgtaatatcacgccatcctttacaaatgaaacggtttccattggaagtgcaaaaggagaaatttttcaatataatgtgtacaaatcaaaacagattgagatttcatatcaaatctataatcgacgcgcggaatatttggtgaattttagaagaggtctatctgctctgatttacacagatgagcctaaaaaactaattttcagcgacgaacctaatatttactacaatgctattttggatggagagcagacattagaggaagaagaatataaaagctcagggattcttcgatttttgatcccggacggagtagcccattcagttgctcagaaaaccgcagagaattatggcagtaatcagatcactctggagaataatgggacagagtcggttcctatcaacatcaaagccaccatgaagtcagataacggctacatcgcgtttaccctgggagaccggttctaccagatcgggaaaccggaagaggtagacggaaagcattatgaggagtcggtgaagctgtttgatgaccacctgtatgaagataaagggtggttagtaaaccaggggatcaccccaccggttacatctgagcggttgcagaatggtgttgttaaatatgtaaaagagagtaccaatgaagggtatgcgacgacaaaggactatggaagtggtaattcttggcatggggcatcccttaccaaaatagttccgaaagatgtaaataacaaatatccggtcaactggaaagttgcgtaccgttttgactttaatacggatggggctgttttcaaaggtgtacaagtcgggcatacttccgtgacaatgatcgatgaacatgacgacattatctgttctattatttttgaagatacttctccggtaaacgagtattattacatggcggtatttatcggtaataaaaatgtatggcatacggacagtacattcccaatggcaaaaaaaggagttacagcaagaggagattatggtcctgctgttacagcggaaaaaataggaaaccaggttacgatccggttcaataatttcggtatctgcaaaacgttttatgtagataacccggaggcggagctgagaaaaattacatggtatggggcagcttataaagataactttcataccgaaaacaatgtgttgcgcgcgcttcatgtgataaagcataatgtcgagcggtatgaggatatcccgaactatttttccaatggagatattgtagaaatagacggggcatctggaagtgtttatattaatgatgcttatgatacggatgtggcggatattggcagtcagccgcttcttctccctccgggccagcatacattgggaatcattacatccagttttgcgtccgtaccggatgtggaagttacataccaagagaggtggatttaatgcaatggtttattatcggacgggatatgcatgtgctgtgtaccccgtccacagatttgccacagacacttcccattgatgacagcggggatagtctgggacaggagatctctatcacaaataacagtgcggtggggacctatgattttacgacggatccccggcatccggattccgtatatatcacggagggaaattatattgcgttccgggataagtatggcaaggatcggctgtatacaatcatgtccatcgaaggagatgaagaatggaccgttcattgtgaggatattggattggatctgatcaatgagtatgccgttccgtgggattatacagcaggatctattgaagacacgctgagcgtagtgttgtacgattccggctgggaaatcggaatcaatgaagtgtcaagctacaaacgggcgaccaaattcgaggggactacagacagccagctcacccggattggggatgtgtgtaatcagtttgacgcagagtgcgaatttgccattgaaatgaaaggcgcaaaggtgacaaagcaggtcatcaacatttacaagacactgggggaagataagacccagcagcgtttcatcgataatatcaacctgatctccctgtcccggtccgggagcatcgaggatctgattacttgtatccggtgttacgggaaagaggacgagaatgggaataagcttacgattgctgatattagctacgatgatgggcggtatttcagtccgaaaggcgagcatcggatttacgaccgggaggcaaggaataagtggtcccggttccgcgcatatgactatgaagggcaaggcgagtttgacggctatatcgttgggacatttgagtacgacacagatgatgccaacgagcttttaaaccgaggactgacagagttgaagagccggaatgatgtgaaagtgacgtatgaagcaagtctgtatgatctaagggcggatatcggagataccgtgcagattgcagataaccggttccaggaaaaagtctatctttcagcccggatccagtcagtgcgtaatcattatacggtctccggacaggatagtggggtgcttgccaattataagatcctgacatcgaatccgacatcccaggtgacgcagatcatggagcagttaaaagatcagattgtcagtgtaaaatctaccgagattacataccagattggcagctccggtgtggagccgccagaagggcagtgggtgccaaatccgcctcagaccagccctggacagtatttgtggacgagaaaaacaacaacttacacaaatggcagccagacaacggagtattctgtatcaagaaacggcgatgacggaaaagacggagaggatgggaaaccaggtccagccggacaagacggaagaggtgtgagatcaacctctgtaacctatcaatcgtcttccagcggaaccacaattcctaccggagtttggagttcttcgattccttcggtaagtgcggggaagtatctttggacgagaacagtaattgaatatacggatgatacttcatctaccttatattccgtgagtaaaatgggtggaaacggaactgatgggaaagggataaaatcaatcacagagtattatctggcgtccgcaagctcttctggtgtaacgacctctacatccggctggacgacaaagatccagacgattacaacaagtaaaaaatatctctggaattatgaagttacccgctatacggatgacacaagtaccacaacgtctccgtgcattatcggcgtttacggagacaaaggcgcaactggaaatgggattcaaagtattacgaactattatcttgccacagcatcagggagtgatgttacaacagatacttccggatggactacaacagttcagaccataagcgcggctaagaagtatttgtggaattatgaagtcgttacttatacaaatggcaaccagtctgaaacagccccgcatattataggagtttatggagatcaggggaaaccgggaaaggatgggcatgatggagaagatggtgtagacggaacggatgggatcagcatgatcctttcaaatgaagcggttgcgttgccgtgcgatatcgaagggaaccctcttgattactccccggccaccggaacagcatatgtctataaaggagcgtcggatgtcagtgccagtgcaacgtggacagtctcctggagcggtatgacaggaacatggacggcatcatcccggacgtacaaggtaacggggatgacagcggatgtcgggaaactgacgatcaaagctgtatattccgggattacactgacgaaagtttttacggttacaaaggcgttgaaaaatatcaaggtcaataagctatcggcgattagtggagtgcttggcgaagtgactactggaaaaatcacaaatacttccggcggtaagaaagcacttgtgataaatgataatgcggtcgaattttacgactacacgacaaacggagaattctgcggaagaatccgtggcagcaagttccaaaatgacggagtacataagtgtatgcggcatgaagtggagtacggagttgagtgggtaggcaaaattccgggatcatcagattatacggatatgatgtatctttttccggacggttttgcacttgaagtcccactttacaactacgggagaaatatgacaagagtatttaataatcttccagatgatacgcaaggaacaatcgaccgtttaaatggaagaatacaggcattttcggcatctgtcagcatatcaaaagcgaatacctgggagacgcaggttgtgaagtttccaaaagcttttgagaaagcaccgattgtaattgtgcaagcacagacagggcaaagcggtaccttggtatgggctgacggtgctactactacgcagtttacattgcacaagtaccggcctagtacgaccgcttttggaattcaaataatagctgtttctgattaggaggatatatgagagtattgcatttctcagtgaatgaacaaaatataaaaaaatctggagatttctccggtattgtaaaaggttccaaaggatacctgaaagcagaattttctttcggatctgaatggagccgtagaaaggcagccgcttccttttttacacagggaaaagaatatgcagtcccgatcatccggaaccggtgcatagttccggacgatgtgacagacgcagactatttccgtgtgcaggttgtcggtctggaaaaaggacagatcaccaaaacaaataaagtattggtaagacaggagggataaagtgacagcagaagaattattaaaacaaatgtcagtcgaaccgtatgcggaagagatggtctgttgcgttattgatccggaaacaagggtcattgatgttccagcagaataccaacttctcggtgtcgaatctgacgagaaagtggagcggatgtatttccagtgcccgaagattgtcggagacaatattgacctgtccaaattggctttgcgtgtcaatttccggaacgcaaacgatcagaaagatcaatacattgtggatgatgtagaaatctctggggataacattacgttttcgtggctcctttccagacgagtgacgcagtataagggtaacgtcagctttattgtgtgtgcggtgaaagcatcaggggaagagattacaaatgaatggaatactacgcttgcaacagcccaggttttggaaggtctggaagcagatattacacttccggaagaagatacggatgtggtaaaacagttaatcgctgttgcgacacagaaaattacagatgtacaaaatgcaacttcttccgccaataccgcggccagcaacgcagatataaaagcacaggaggccgccaatgccgccgaggatgcccgtggagtgatagaccagatcacgaaagacagttatctccacacgactacgcagacgtttgtagatacggtgaaagcgagtcctaccgcctatggaaacgccatcccggaacagattgaggggtacatcaaacaggatacgacaaaagggttacagttgtttgatgcgaaaactgttttatcatcacaaattcaatctaaagtactcacgtgtaataatgatggaagcgtaacgcttgacggagaaattaccggtagcaatcgtaattttactatacaattaagcgctggaacatattattttaatgaaaaagataaaatttttcacacattagtcaacggcgacgatttatggaacaaaccatacacatttgaaacagatactactataaaatgttatattgccaacggtgagtatggcaatataaagatttatccgatgataaataaaggggattctcctctttcgattgaaccctacactggaggacagccttccccgaatcctgactatcctcagattgttcatggtgtgggggatatgggattctttgatggggagttgttgcagggatattaccaggtatcggatggaacgtttaagcctgccaccgtagcactttgtaacaaaaatcctattccatgtaagccgggtgataaaataatatttgagtatgaaaatgtaattaatggatcaggtatctcgatatttttctataaatccgatggaacatttatatcacgagtaaataaggttggcgtcagaaaaattgaaggcgttgctccacaagataccacatattgtaacattgtaattaatccggctagcgagcctataccggttgcatcagccaaacacattaccgtaaccatcaatgataaatacgccgtatgtgtcaaatctaagggaaagaatttgcttaatttaaccggagaaatactatacagcttcggaagagaaactatttttgacaaccaagtaacaatacggccgactacagacggcaggtcagctcccggagtttggttcgttttaggtgacattaaaaagtttttaggaaaaacaatatacgtcaaagctgatgctatccagcgatccggtaattataatccccgaatgttgttaatgacgataaagggtaatacatccgtgcgtacctatttaacatattcgtatagcaaggccggacaggtgatgagtgttaaaataccagatgacttggatacaaacgaagcatctgatttggctttaaatatgtatgtaaatgacggatcgtcgcaggtggatgctgacgcatatgcgatatttacaaatgtctatgccgggttgtcggaacccactaacgaattcgtcccttatcagtccaatgtaacgtatatccctgtcgattacccgctgtttgagggggataagatcgtaaggcgtaatggggagtataagctgttaaggaaatggaaacaggaggttttcgatggttcggaagatgagggttgggtgcaaggtaaatccaacacaaatcaattttatactagtcaatacaaagaaaagaaagtaaatgccgatatagtatcaaatcgatttaaacatgctacctctgttgaaccgccatcgatatggattggaaacgacattaatatatattttgaatctggatacttagacaataatactatagccggatttcaagagtggttacaagagaatccggtttcttgtgtctatgaactagccacaccaaccgaagaacccctttcatccgaagccatgaaagccctatacagcatcatggcatgtgatgaggaaacggagctgacgattgtcggtgttccgtcggatgcggaaatccagaatcagtttttattgccacgaaacgaggacggggctttaaacacaacagcgtattgcacggccaagaggaatgaaattgcattggaagagctggaaaacgcaacagccgcaagattgtcggcattggaaacacaggcattgcaggaggtataaaatatgtatgagattatcaaacaggttatcttgtccggggactatgagttgtcggacatgcttaacaagattaagaagaattgcgtccggggagatatcacggacgagcaggaaacggaattgatcgcacttgcaagggaaaaggcgacaccggaaaacagctatgctggattgccgtctcaggttgacgaattacgagagttactagatgagacgatcggcactgtcgctatattaaagcaggatgttgacgcaatcaagaaagctctcgaagagggcgggacagatattccagaaccggagccggaaccagaaccggacaagtacccggaatataaacagcctacaggagcgcatgacgcttattacaagggtgatggcattacttggaaaggcgaaaaatatgattgtatcgcaccagatggagtggcagttgtttggaaccctgacgagtatccggcgtactggaagaaagtcgaagagtaggagggcatttatatggagatcagagcgagaccgtgaaccggtcttatttttgtgcaaaaaatgataggagagaagtgggtatgaatactcagtggattgcgcttataatatcgctgttgggatttttggcatcagtatattacagcaataaaaacagcaaaaaaacagatatagatgatgcagggagtcgctatggggttcgtcggcaactacgccccttgtggactttcaccacagactgacggcatgcccgtcatacacaaaaaagccggaaaatctcttttccggcccccatgttaccatatttccataatttcaatgtcatcttggttcttcggattcagataaagatctaaggattctatccatggactgctctgatagcttccgatctcaccttttttcagatccttcaaaatcatatcacgaagttccatcacttccttcatctcgtctctatcttcatccgaatctggataatcaaatccgaccgctgcatcgtgctgccaaaacttcggcttgactttcttcttattatactggatacggtacctgactgtgttttccggtatggaatcatcccagttaaggttcagataacgggttccatagcccaaatagaatctgatgtcctctccctcagacaaatatgccagctcttcttctccttccatggtggccatctcagtctcccctacgatacgctctcctacatagtcaagtgaaaaaaactccataagcccaatgcctgcgccgattccactgatcagaacaccaaccacaaaaatcagcgccagcagttttctcttctcccgcatctactccacctcctctgcctctaccgggacagtctcttttcttggcacccgtttccgatacttcttcctaaggccaaaggtcaggattccaagagcgcctcctgacatggcggcaccaaagcagaagagctcagctcccagaagcggataccctccaaacaccaaaatcagcaagataccaaagccgaacaagcagcatgccgccagtccaatcagcaaacaggtgatcagaatccaggtaagattccagatcagaatacagaaattccaggcaagccgtttactcgtatcccagaaatatcgctcccctctcaccgccctggctttcttcttttgaagcacgccctcctgcgtcgttccccggaatgccctccatcctcttctcattgcctcccacatatgatggatggagtctttcatcccagcaagccagcctccgatctttccggccagcttcttactcccctcggatacactctccatatccggcttgcggattgtgatgcctttcctgcgctcctcaaatcgcggatccacatggtaagcctccaatatatccgccgccagctctccaatattgccaaaatcccgaatcgcttcctcttcgcttaatccgctcttcatcttcaggtcaatgtgctgagcgtactcatcgagaatgtcctgctgttccttatcatccagaaccctcagatgactctccagttcttttaaaaacccttctttattcatgctttccctcctttaagaagcggcagacccgctcctgaaattcattccactctgcctccaactgatccccatacaggatcccggccgcagttagatgataatacttcctgggcggtccttctgtggactccctcaggtatgtctcaaagtagtgctcgtttgtcaatcgcttcaggagcggatagatggtcccctcattgacgtcgatcaccttagatacttctgtcacaagctcatatccgtacatatcccgatctcggaccgatttcaggacgatcagctccagaactccttttttaaactgtggattcatctcatcccccctttgttattatactatacccactactatacattgtcaagtaccaaaaatattataatagcggacggcatacgccgtccgctatgtttctgaatgaaaaaaactattcctgctctttttccgtctgtttcagattgtccttgtcaaaatcaagcacatttggcaactcggaagaaacgagatagacgttctgcttttccttgtctgtcagatagtaatccgagtcagctccatctccgatatagagcgttcctgtgtctccattctcccctgtcactatgatggtataggatgcttcattcagtccgtagctctcaagtggatccggatctttgatctgcttttcggcctttacatcagataccgtatccgcgatatcctggattgtttcctgcacaagggctgtttccttatcgtttttcagataccaggtgccgtcctccttgacaaaggacatactgcttccatcatcggcactgtaggtgatttccaccgggttctcaatatccaggacctgaatcgtcttttctttttctttctgatcctctttttttgcctgtgatttattgtagcttttcagtccgaaatacacaccgcacagagcaagcagaatcactacgagtatgattagaccttttttctgtctcatttttatccacctatgcctttctgcgtttcatccagatgacaaatccaccgatcagcacgaccgcaggcacaccgaaaataagcgctgtactgatggaacccgcatgctgcactgtgttcatctcaactgacaaactcttggggtcaatggagagattttccacatcgtcaaaattgttcaataccatgtttacaaaaagtctcttattgtccagattggaaaaataatctgtaatctgggagttgatcatactctccgaagcaatcactgtcagctttgcctctccctcttcggccactgcggcaagcgtgtattccccctgagtctgttcatcctccgtaaccgcgtacccatccggggatgttgtcatcacttcatccactgtcaacgtatctccgagatccttcttgaccgtaaagcctgcggaatttacaagcagtaccatattgttttccagtccgtcaccaagatctccggatgccgagatttccgggaaaatatagtagtaattaccctgatagtttctctgcgtatccgcaatgtatcctttcgtctttgtcatgccatactgatccatcaccgagtccagattcggcgtatctgacatagcgtctcccatgacatagatcactttgcctcctcctgaaaggtattcaagaagcatcgtcttttcctgctccgagaagtctccggacggagcatcgatgagaagcaggtcacaatctgccggcatctctttcaccatcaaaagattgagctcttccgttgtcacactggatccttcgagttcatctgtcatttctgtggacagtgttgtctctccatgtcctgttgtatagtacaactttttgcttacatctgtcgtcacctggttaatggcgcttgtaagctggccgtccgcgtcaaattccgattcggacgtggaacctgacgtatagtaggaactgtaatcttgtacaatgatatcgctaaacggtactgttaccgactttcccgtatcctcgcaagacacaacgatcgagcttgactgtgcgtctttgttctcctgaagtgcctgcggatggtctaccggattaatccattctacaccgatctgatccgtaagagccgtatagcggtctaaaaatgtcttaatccgctcatccgtggtagatttgtctgcataaactgtaaacttgatcttatgtcccagatttttcaaaagttttctggacgtcttggacactccgtaaatattcttattgctgacatccacctgtttccatttctccggaagctggcccacaatgagattaacaaccactgcgattactatcacgaccgcgatcatacccacactgtaaaatccatggcgggtttgcacactccggaattttttcagtaatttcttcatgtctccccctcctaactgaatcttcttttctgtatggactgtacggtcaggaataaaaataccccgatcaatgtcagatacatcacaatccctccgatatccagcaaactgttctccgccgcactggtaaaggtagagacaagcgcgaatttcccaaaaattgtcgaaaggagaccttcatagagggaagatttcacaaaataaagcaccaccaggatgatggttccgatcagttccagaccacctgcaagcacgccgtttttcgtcatgttgtagatgaacaaaacgcaaagtgtcagaatcatccagatacccgccatgccgccaaacgcggaagacggcaggaatcccagcagtccgtcccacaaatatacaaccatcaataccccaaaagtaccgatcgccgcaataatctggctctccgtcatggcggagatgaagcttccgatggcaatgtatacacacccaagaaggaagaacaccagaatggacgcgtagtccgccttaaaatacgccttcccctgtgtactgataatcagcggataagcacagaacaacatacatgggataagaaagacactcaccattgcaagatatttcccgatcaccatcttccctacgctcacaggagacgtcaaaaggagctgatccgtccggcttctacgctcctcggaaaaactccgcatcgtgagcaccggaatcgccaccagaaatacgaacatgaccccctccaaagaataagagaaatacggatatccactgtgcagattataagccatgaaatagattcccgtcataaacgttaaaaaggcgataaaaatactccccgtcatggaataaaaataggatttgaattcccgtttataaattgccagcatgtggacgtcctccttcctgggtcagccggaggaagatatcctccaacgtgtgttgttttttgtacatggaaatcaaagaacagtcctctcgcgcgaacgcttggaaaacctcttcccggatatccgtatcttcatccgtctcaattacggcttttgtgattccaggatctccggataagtacgtcaccttctgtattccggaaatccctgacaaaatctcttccgtgcgctccggcaaaagccttgtctctatttctacaggttcattccccgcaaactgtctttccagattctccggtgtgtcgctggccacaagttttccctgggagatgatgataatgtagtcacatacctcccggatttccgcaagaatatgggagctcaaaatgaccgtgtgatcttttgcgagctccctgatgagttctctgatctctataatctgctttggatccagtccgacggtcggttcatccaggataatcgtttccggaaatcccaggactgcctgtgccaatcctactctctggcggtatcctttggacagatttttaatcagcctctcccggacatcgtagatcttcaccatcttcataatctttttgacttccgcctttctactgttccttgccaccttctttagttctgccgcaaacatcagatactcttctaccttcatttccatgtaaagcggcggcatctcgggcagatatcccaccgactttttggcaagctccggttcttttaaaatatcatggccgtcaatcagaacctccccttcggtggcgccaagatacccggtcataatattcatggtcgtagatttacccgccccattcggtccgagcaggccgtaaatatgccccttttctatccggaagttcagatggtctaccgcagtgtgactgccgtatttcttcactaatcccttaacttcgatcaatgtacttccctcctctgttttagtctatgcaccaccttaacaggaaattgtgaccattctgtgcaaaaaatgtgataaaaaaagaaactctcgtcttgtcacggttttcggattataatatagtagatgcagcaagagcatttataaggaggaaacaaatggaatacgcaaaagaacttcagatggattcacaggaagctgctgtcagaatggaggagggacggctctatcttccgtccgacgaagagattatgaaaaaacagtttgactgtctggaaaagctctatgattacaaccagaccagaccccatgaccaaaagctccgggcttccatgttaaaagacatgtttgccaagctgggggacgggtgctacattgaaccgcctcttcgatctaactggggcggataccacactcacttcggagatcatgtctatgccaacttcaacctgactttggtagatgacggacatatttatgtgggaagcaagaccatgatcggaccaaatgtcaccattgctaccgccggacatcccatcgagccaaacctccggtatttagagatgcagtttaatatggatgtccatatcgggacgaatgtctggattggtgcgggggctgtcattttaccgggcgttaccattggggacaatactgttattggcgccggaagcatcgtgaccaaggatatcccttccaatgtcgttgccgtggggaatccgtgccgggtgctccgtgaagtcagcgaacacgatcgggagtactattaccggaaccgcaggatcgatcttccgattcctgacgttcttcctgataaatcaaatgctccgctgtaatcaacggggcatcggacttgtaactcgaaaaagcagtaaaaagctttgtgcgattggtaattttcctgtccgcacaaagctctttctatcatggctgtaagccaaaatctaatctccagattccatcccatgttcctgtgggcgctcaaagtccagatcaatctcccgtacttcctgtctcgttgggatggagtcggccgccccctctcttgtgaccgctatagccgccgccctggtggcaaccatcaggcactcccgcacatccatccccgaaacaagggaagcgagaaagtatccggtaaaagtatcccctgctcccgttgtattcttcacgggcacatgcaggctgtcctgataaaaccgtctctgtgcgtcctgatagacacaaccgtccccgcccagcgtcatcacaatgcctgctttcggatatcttgtaatcatctcgtcaaggatgtcagagagatcttcctttcctgtcatctgtgctccctcaatctcatttacgaggaaaagattgactttggaaaggtcacaggaatcgatctgggtattatatggagatgggttcagcacgatccgcatcttccttttcgctgctgcctcaatgacataatccaccagattaatctcattttgcagaagcacaatgtcgtcctccccaaaatccgccaacacttcatcgatataattttttgaaaatttccggttggcgccgccatagagcaggatactgttctggcctgtctcatctacctggataatggtatgaccggacggtcccgccactttccatatataatgggtgtgaatgttttcctgacggcagagattcacgagcatctctccgtcctcaccgatcatcccggcatggtggacgtccatccccgcccttgcaagtgcgatagactgattcagtcctttaccgccacagaagatttttcgctctttcgtgtcctgagtctctccgggctccacaatatgatccaccgagtatgtgtaatccagattcagcgagccaaaattgatgatcctcatctgtacatcctccttttattcctcaattttcaaaatctccctgtcataggtccacagtccgttgacctcttcttcaatatcggaaagctgggtgtatactgccgcgcacagacctttccgctccagttcccggacctcttcccaaatgttctcataggcatgacgcagctttttacgcccggtatagatccggtatccgtatactttcggacacatactgtgtcccttttctctcatggaaaaaccgccaaactccgaaagcaccgaggcacgttccttctcaggctttaccccgaggcgaaagaaatagttgtgcgtacttctcacatccccgcatctttggtcaaaccatccgcttgccgcatccaccagtcttgtaggatcaagctgtttcagttctttcgtaagccttactgtgtcaaactgcccccatccttcattaaataacgtccagagaatgatggatggatgcccgtagagcgtgcggactgtccttcgcatttcatgttcaaactccctgcgccccctctcccgtttccgggaaagcagacgtcttacccggtccatgactggaagatgccaaatactcatagcggtagccccataagtcacataccagtgatggtaagtctccccaccgtttaccatatcctgccagacaagtattcccaatcggtcacagtggtaataccaacgctgtggttcgatcttgcagtgctttcgcagcatattgtatcctaaacgctttgcctcccggatatcaaagaccatcgcctcgtcagacggcgctgtataaagaccatctggccagtatccctggtcaagaagtcctttctgaaacaagacttcgtggttcagacagattctcggaactccttttttatcatgctctaccgtgacacatcgcatggcaaaatagcttttcactttatcttttcccatccgtacctcgaaccggtacaaatacggatcccatggagtccagcttctgcgtgcccgcagacgaatccgcactttctcattcgtacgggcttcgcagacccgctcttccaaaatgatcttaacccttttgcagacattggcaaacactgtaatctccacttccccagtatcgtaaagggccgtacatttgatctcccggatataattgtgcggcaccgcctccatccagacagtctgccagattccgctctgcggggtgtaaaacataccgccttttttgattttctgttttccttttgcatgccatgcctgatctgagagatcccgaacccgcacgcaaagatcattcatcccgctcccaagatacggcgtcgcatctacagaaaaaggaagatagcctcccttgtggcacccggcccgatgtccgtttacatatacgacacacatctgatccaccgccccgaaatgaatcaggactcgttccccggaaacggccggattcttaaaagtacggtgataccagagcgtctcctttggtccaagtcttctgttcactccggaaagcggactctccggtgaaaacgggacgaggatctgtccctcataagaagcgggcgggcgtcttttcatctccttacaaatccggtagtcccagtatccgtttaagttcacatagcttttccgccgcatcatcggccgcggatactctgaaaggacatgctccggatccaattccttcccccatctcgtataaagcgttttcattttccctgatctcctttcagactctgttccatcttcagaagatactggtataacctctccagctcctcctcgtcgaacgacttccaccagatttcatctcccttttcaaagatatgctgtacctgcacagctttttttcttccttcttccgtcagactaatcagacaggaccgtctgcattccgggtcaatctgcttggaaagcagacccgccgccaccagacgatccaccgtacgggaaatcgtcgtaacatcgacaaaacaacaatccgcaagttctctttgtgtcatagtaccatattttctgagagaattcaaaattcttggctggccttgccccaccgtcagtccaatttcctgaaaatacggcctcagcgctgcccgccgcaatgtattgacctgaaaccataattctctgatcttacatttatccatattcctctactccagttcaaactgccctgtataaagctgataataccgtcctctttgttccagaagttcctcgtggtctccccgctcgatgatttctcctttttccagaaccatgatagccttggagttgcgtaccgtggaaagccggtgggcgatgacaaagacagttcgaccctccataatagcatccatccctttctcgatcagccgttcagtccgagtatcgatggaacttgtcgcctcatccagaacaagcaccggaggctttgcggcagcggctcttgcgatcgccaggagctgccgctgtccctgggaaaggttactgccatccccataaagcatggtctcataccccagcggaagtttacggataaaagaatccgcattagcgatccgcgcggcctccgtcacctcttcatccgtgacatccagatttccgtaacgaatgttgtccgcaatcgtccctgtaaacagatgggtgtcctgaatgaccatggcaagagatcgccgcaggtcatcctttcggatatgccgaatatcgattccgtcataggtaattgtaccgctctcaatttcgtaaaaccggttaatcagattgacgatcgtcgtctttcccgccccggtggaccctacaaaagcaatcttttgtcccggctttgcatagagagaaatcccgtttaggatagtcttccctttcacataagaaaatactacattttcaaaccgcacatcccctgtcagaggagtcagcactgtccgtccatccctttgttccttccaggcataaattcccgttttctcttcacactctgtcaagatcccattctcctctttgacattggaaagcgtgaccattccctcgtcgatctccggctcttcttccatcatctggaaaatccgttccgcaccggagagggccgccagaaggaagttcacctgctgtgtaaactggttcatcggcatggcgctttgccgcacatataccagataggaagaaagacttccgatatccagaagccctgacagagcaaagaggcctcctacgcatgcggaaaccgcgtaattgacaaaggaaaggcttacaatggtcggtatcatcattcctgcaaatgtcagggcgttggtagattcccgccggagagtttcattcagttcgcagaattttttaaaatctactttctcgtggttgaatactttctccaccttctggccagccgccatctcttccacgaatccgttaatcttcccgatctcctcctgctgccttgtaaaatattttcggcttctgctgccattaaatttgataaaagccgccatcagaagcaggaatactacaacaatgagggtcagccgtacacttaacacgagcatcatgctgatcgtccccacaagcatcagaaaactctggatcagcatggcgaaactgctgttcatagcctcctgtaccgtatccacatcattggtaaagcggctcatcagttctccatgagtgtgagcatcaaaatatttaaggggcagcttttgtacatgggcaaacaaatcgtggcgaatctccttgatcactttctgtgccgtcattaccataagctgattgtagccaaaagtcgccgccactccacacagataaaggatccccattcctgccaccgccgtcagaagaccttttacatctcccggcaggataaaccggttgatgaccggtttcaacagataagtccccagaatattagctccggtgctgatcagcaccaaaagcgccaccagaaggaacatccacttgtgtccgccaagatagtgcgtcagatgtctcatagtccgttttagatcttttggtttcttatatccgagatatctcgccattacaactccgccccttccttctgagattcatagatttcctggtaaattttgttccgtgcgagcagctcttcgtgagttccgatatccgacaccctgccgtcatcgagaatcagaatctgatccgcatgccgcacagaggaaattctctgggcgatgatgatttttgtcatctccggcagttcttctttgagcatagttctgatccttgcctccgtcgccgtatcaacggcactggttgaatcatccagaatcaatactttcggctgttttaagatggctcttgcaatacagattctttgcttctggcctcctgatacattcacaccaccctgtcccatctctgtctcgtagccgtccgcaaggcggtcgatgaactcatccgcacaggcaatgcgacatgccttttttatttcctccatcgtagcatcctccttaccccatctgaggttttccaaaagggtaccggagaaaagagtattcttttgtaagacaaccgcaatggcatcccgcaaatgctccatcggatacttccgtaccggaatcccgtcaatccgtacttctcctcttgtcgcgtcataaagtcttggaattaactggatcagagtggatttggccgacccggtctgcccaatgatcccaaaggtactgcctgccgaaattgtcaaagaaatatctgtcagcacatcctccggggcatctttacggtaccggaagtaaacatggtcaaactcgatctctccacatttgacatcatagtcttctgcctctcgatccgtaatatccacttcttcatcaataatttccagaatccggctgccagatgccatagaccttgtcagcgtcaaaaacacattggagatcatggacaacgaatttaaaatctgcatcacataacttagaaaccctgtcagctctccgacctgcatcccaccggtctgaatcattctgcccccgaaccatatgatacttaaaatcgtcccatacattacaatctgcatagcaggcatatttaaagccgccagacgaaacgcccgctctgactgattcttcagattgtcgttgacttcctcaaatttttccgtttcatattctcctttgacataggctttcaccacccggatcgccgtcaggttttcctggatgatccggtttaccagatcgatcgctttttgcatcttcgtataaagaggctgcacatgtcccacaatcgtaaacagcatgatcgccagaaccggaagtgccacaagaaataccaacgccagcttggcatttatagaaaaggccactgctgtcgccgccaccagcatcaccggccccctgcaaaatggccgaagccccgttgataccgaattctggatattggtcacgtcacttgtcagtctcgtcacaatagacgacacccggaaatgatcaatattagcaaaggaaaaaccctgaagcttttcgtactctgctttgcgcagttgggctccaagcccctgccctgcaagtgctgaaaacctggagcttccgattcccagaagcagggccagcacagcacagatcaccatctgaaatcctttcatataaatataatggcggtcctgattcgccacgccaacatcaatcagatccgccataatgagcggcacaatgagttcaaacatcgactccgccgccacgcatgcgatcgccagggccgcatactttttgtactttcccatataagagaaaattctcctcagcaatacccccacctccattcaatagttgcatatacaattattgtatgttcacttatgaaagatgtcaagacgctcacaataatagaaacacgttttcaagcgaacccggggtattgctctaggtctattgagttggcatattggactgggcttatctggctgcattccccttttgcttatatgccacatacagtaaaagtgccaacaaaaggattgtaacgataacaattgaatagcgttcaaagaccgctgtgatctgataccaggagctcccggccttctttccaagactaagcaaaagaagattccagacactgcttccgatcaccgtgcgaatgagaaaacctgcaaggggcatccttgtcattccggccggaatggaaatcagacttcgtatgacaggcacacatctgccaatcagtacggctgtattttcatgtttatcaaaccagtttagtgtttttttgagatcttctgctttgaatccgattttctgaatccatcgtttagacagaatacgctccagacgttcaagcggaatgagccgtcccgtcagatacagaagcattgcccccgctgtggagcctgccgtcgccgcaatcaccattcctgtcagagtcaggcttgtatgctcagtcataaagcctccgaaagtcagcaccacctccgatggaataggcggaaagatgctctcaatcgtaagaagcagaaacattcccggatacccgaaccgggagagaagcctcagcagttgtaattccattttttcttttccttttcgatttctctatgacactgtatcgctttttccacctctttatgcatcaccgtcccctgttttccacatccgtatacaaaatctacatgctcactgctcttcttttcaacttgttcaaaaatcttgcacaaaaacacccactgtattaatcctgaaattggctttattcctaataagcctgcaatttttttcatttatttgcacaaaaaatatggaaagaattcggatataattgtataataattgcagagcaaaagaaaagggaggactcacaatgaagcaaaacagtatgttagcaatgattttagctggtgggagagggtcacgtctgcatgacctgactacaaaagtagcaaagcctgccgtatcatatggcggaaaatatcgtatcatcgatttccctttgagcaactgtgcaaacagcggcattgatacggttggggttctgactcagtacgaatccatccttctgaacagctacgttgcggcaggccgccgttggggacttgacgcaaaaaacagcggggtctatgtacttccgcctcgtgaaaaagccgatgccaatctggatgtttacagaggaaccgcggacgcgattacacaaaacatcgatttcatcgacacctttgctccggaataccttctcgtactttccggagatcatatttacaaaatgaattatgcaaaaatgctcgcttaccacaacgactgtaatgcggatgcaaccatcgcggtcattgaagtaccattaaaagaagccagccggtttggtattatgaatacgcaggatgacggacgcatctacgaatttgaggaaaaaccggagcatccgaagagcactctggcatccatgggtatctacatcttcaactggaagctgttacggaaacttctgattgcagacgcaaaggatccggattccaatcacgattttggtaaggacatcattcctcagctccttgcggatgacaagcgtctgttcgcttacaaattcaaaggatactggaaagacgttggaactatcgactccctttgggaggcaaacatggatctgctcaacgcaaacaatgagctcgatctgaatgatacttcctggaagatttatacagaagacgcaaccacacttcctcactatgtaggacctgacgcggagattcagcgtgcctttatcacccagggctgtaccatcgaaggaatcgtgaagaattctgtcctgttcaccggggctaagattggcgcaggtgcaaaaatcatagacagcgtcattatgccggacgccgagattgcggaaggagctgttgtaacacgggctcttgtagccgatggtgttaagatcggcaaagatgctgttgtcggaaacgctgacagcgagcacattgaattagtggcgaaaaacgtaagggggattgaataatatgagtagagcatttggaattgtaaactctgccggaaatcatatctgggtagacgggatgaacgattatcgcccgattggagccttctctttcctcggaagataccgtgtcatcgacttcccgatctcaaatatgacaaacagtggaatcgaccatatccacgtatacgtaagaagaaaacctcgttcccttgttgaacacatgggaaccggacgtcattacaatctgaactccaagagaggcaagcttctcactttgtttactgagttcagttcagacaacgacgtctacaatactgatattgccgcttacctgaacaatcttgagtgcatcgaggatgcgccatatccatatgtaatccttgctccaagctatatggtttactcagagaatttcagcactctgcttcagaatcatattgattccggcgctgatattacactgctctaccatacagtcgataccgcaaaagaagagttcttgagctgcaacatcctgacgcttaacaagcagaagggagtcctatccatagagcacaataatggaaacgccaagaatcggaacattttcatggatacttacgtgatgaagaaagagctgttccttgaactgatcgccaaggcaagaaagctctcctccgtctataccctggcacaaatcgtcaactttgagtgcggcgagctggatgtgcgcggcgtatctcatcacggatacttcgcttctataacagactttaagagtttctatcatgcgaatacagagctgattaatgcaaaggcagcagcaagcctttttgataataattggccgatctacacaaggaccaatgattcctgtcctacccagtatttcgagacggcatctgtgaaaaattccgttgtctccaatggctgcctgattgaaggaacagtggagaattccgtcattggccgtggctgcatagtgaagaaaggcgctgtcgtaaagaacagtgtcatccttcctggcgcttccatcggcaagaatattacggtagagaattatgtcattgacaagaacgcagacatccgccatgtgaccagtctgacaggaagtccggatgcccctggctacatcaagcgcggagatacaatctagcagtctgctgtcagaaagaattctttataagagtagagtacacaaaagagggggatacagataaactgcatccccctcttttctgtctgatagcagaaaattcttccctcgtaattctctccggttcgtatctctgaatgtctatgtatgtgatgtatcccgttcttctgtcactcttataaacttaccatcagaatcccgttcaaagttcagtacagtttccgtctcctgatcccctttctcgtaacggactattacctgttccttatcctcgcccttctcccccggcgtcatttcttttaccttgatgttaagcccatcattttctgcctccaaaaggtaaaccagtgcggggccggaagaaagaaagttctccaactgcccttccgcaaaataggttcccacctcttcttcccatctctcctgcactatatcgttcttctcctgtgtttttctgaccgcatcctcatcttcttccacaccttctccgattacacttggcgtaaaaagcagatccggattgggcgccgtcatcatagtttcaatcactgcctgcgcctctttgctgacctctccagcctcggacacattctctttctttttatcttcttccttcttttcactagatttaccggactcacatgctgtaagaagcagcgacaaaatcagtatgaggacacatcttacttggaatcgcttcctactcttcatctctttccctccttccgaaaagcattgttttgtttgtttcttttcgtaattaaaatagggaaatatccattttgttggagagatattccaagatctttatccccccggcgctgttgcccttctcatccagggccggaccaaaaacaccgatccccatccgatccaccaaaggtactgcaatccctccgcctacgccactctttgctggaaaaccgactgtcatggcaaactctcctgaaccatcatacataccgcatgtcaacatcagtgcccgaatcgcctttgcatactgcggctcaatcaactcctcctggtcttcgggatctgcaccgtgattagcaagtaccagactcatatgggcgatatcatgcgccgtcacatctacagaacacatccggaaatagaagtccaaacattcctccacatctccctccagtatcccggatgccttcagataataggcaagtgcccggtttcgatccccggtcgcacgctcggactcatagaccgggtgattcagttcaatggcatcattatcacagagctttctcgtaaattccagaaaccgcccaaacttctcatccgcatccttccccttaatgcagcttgccactgtaatcgctcctgcattgataaacgggttaaacggccgggttcttgtctccagttttacgatagagttaaacggatctcccgtcggttcgactccaaccttttcatggaaaagatggtctgcgccacagtcccggatcgccagaatcaaggacaccagcttagaaatactctgaatggtaaacggaactctcgtatctcccgcctccagcaccatcccatccagatccatagcacaaacgcccagataatacttattcacttccttaagctgtggaatatactgcgccgtctttcccagctttgtaaatgcctttccatagtgtagggcgtccttgagaatctcctctgtcagcatttcacttctccctcccttttgccagttcatactgataaaattatccataattatatcatctctgtcaagcagaaagtcagggcgtaaagggagtcaaaaaagaaccttcccacctgtttcctatcggttataagcctcctcgtagagctgctcctgggaattaagcggttcatcttcattctgtactttatagtagagtccgtcccctctcagttcccgtgccttctgattatcccggctcatagtatcaaaaatatgctccagcttttcctgaatgataggatcataaaccggcgccgcaacttccacacgcttcaccgtatttcttgtcataaaatccgcggacgcaatataatacttcctcctctccttcgtcccaaacatgtaaatacgggaatgttccaggaatcgccccacaatactggtaacgcggatattttccgtcttatctttcacaccggccaccagacagcagattccccggatcatcatctctatcttcacgcccgcacaggacgcatccaccagcttgtcgataatcttcttatccgtcagtgaattcatcttgatgccaatatatgcaggctcaccgttcttcgcatgattgatctccacatccatcatatccagtatcttattttggagacacttcggcgcaacgagcaaatactctgtattgtcaaccacctcaccttttgcaagtgcacggaataccttggccgcctcaaccccgatgtcggtatttgccgtcatcagtgaaaggtccgtatacagacgggatgtcttttcattgtaatttcctgttccgatttgggtaatacattcaaactgcgtatccgtctttctcgtaatcagacaaagcttggaatgtaccttgtaaccgtccagtccgtaaatcacctgacatcccgcattttccaactgccgggaccattcaatattattctcctcgtcaaaccgggctctgagttctaccagaaccacaacttccttgccgttttctgccgcctcaatcagcgcctcaatcaccttactctgctttgccagacggtaaagcgtcatcttaatggaaacgacattctcatcctccgcagcttcagtcagaagccgcaggaacggccggatggattcatacggatacgaaagaagcttgtcaccctccttgatttgctcaatcatactcctgccatcctggaacatcgtggacttctgcggcgtcctctttgcgtagaacaggttctcatttttccgaagcatatcctgaatctggaacacaaaagaaaagtcaagcggaaccgaagagtggaatacatacttctcctccaaccccagataattatccagcatcatcacacttccaatatccagatttcctgacatctccaggcgaatcggcgcaagctttcttctctgtttcatcaggtctgccataaattcccgataatccaggtcctcatcgtagagggcgtccgcgtcaatatcagcatttctcgtcacacggatcagtgctttaccctgtatccggtaaccaggaaacactttggagataaaatgaagaatcaaatcctcacaaaggataaaagcgcctttttctcccggtatctcaatcatcctctgaaaaatattgctcgtacacggcacaataccaagacgtacctttttgctgcttttggttgtaagcgctacgaccgcatagatctctttattcttcaaaaatgggaatggctgccttctgcccactactgtcggcgaaatcaaagggagaatctctgactggaagaaacgctccatttttttctcatccggaagctgatctgcccgatacaggcgaattccttcctttgcaaccttttcaatcagtttctgatatactttttcttttctcttattcagctttcttgtctctgcaaggatcgcgtcgatctgttcctgagaggacatcttcgttttattatccctgatctcctgcggcagcagtgtctggtcatacaaagaacccacacgaaccataaaaaactcatccagattcgtctgataaatcgatacgaacgtgaaccgctcacaaagcggtacggatttatcctcggcctcctccaacaccctttcattaaatttcagccatgaaagctcccggttcatatattggcttgccataaattttacccgctccttcattccttttctacagtatgtttctttcatggcagttcctgtatggaacactgcggaatacctttttcgcattcctgtccaccttggtttccatacaataataacggactaccatgtcgtttctaatctgttttctactgcgtttttctcttttcatcatataccccttttcctcaaaaatcaatttctagtttctgtttgagtatataaacattgcaacaagaaatagaataacacagttgctcatggttcatatcaaatccatattaaatgcaggtaaaacgcaaaaaaacggcaaaaatccgctattttagcgtattttgccgtttctgactgcggatgacaggaatcgaacctgcacgtcggggacaccagatcctaagtctggcgcgtctgccagttccgccacatccgcatatttgattatcagcgttcccctgccgataaaagaatagacaagcaattctgcttgcctaaagtgagcgtgcggggattcgaaccccggacaacttgattaaaagtcaagtgctctaccgactgagctacacgcccgtaatataaatctaacctgggctagttggattcgaaccaacgaatgcaggagtcaaagtcctgtgccttaccgcttggcgatagcccaacagcccatattgggactaaggtggatacagggattcgaaccctgggcctccagagccacaatctggcgcgctaaccaactgcgctatatccaccatgaacgtgcctgcggggattcgaacccaggacctacggcttagaaggccgttgctctatccagctgagctacagacacatagttttgaatctcaaagcctcgattgctttaagaaagcgggtgatgggaatcgaacccacgtatccagcttggaaggctggtgttctaccattgaactacacccgcagatcacaatatggattcctgttattatcaggaatcggggtgacaggattcgaacctgcggcctcctggtcccaaaccaggcgctctagccaagctgagccacaccccgttctcaattcatcattttcctgacgacaaaagttattatataggaactcctgatatttgtcaacaactttttttgtttttttctacatatctctaacagttcagccataacagctcggattagccgctatgcggcttttctcgccacttacgtggcgaaatcctcgctaatggcagagtgccatatacaaagtacacaaaaaatcttcgttttcaaacaagtttgaactcgcatttttgtgactttgtgcatggctgaactgttacacatatctgatctcgccctccactctgccttcctcatccatctccagaacgatataacttggaagtcggttctcctggcgtggataggtcagactcccaggattcataataatcatgtcctcttcgaatttcagacatggcttatgtgtatgcccgaagatcacaatatccgctcccctggctcttgcttctctcttcaggtgatcgagtgtcatagagacaaagtaatggtgcccgtgggtcataaagatcttatgcggccccatcttaatttccacctcaggcggaagttggccgaaaaaatcgttgttacctgccaccacgtaggccggacagccgcttccgtactcaatttcccactctcgtccttcaacatctcctgcgtgaaagagaacgtcaaacggtttctctttttccaagacaagatcaaaattgacatgcattttatgggtatcgcttactacaagaattttctgtttcttcataggctacctctcctcgatccgtttcctcatttgctgtaatcctctgcccctgtggctgatctcatttttcttttccggcggtagctctgctgtagtacagccatactccggaagatagaaaatcggatcgtatccgaatccatgctctccctttatctcataagccactctgccttcgatcacgccaagggtcacttcctctcctccgtctggaaagactgcggcaatagcacagacaaacctggctgtacgcttctcatccggtactccatccatccttctcagaatttcattgttcttgatatcataagaagtatcctctcccatatatcttgcggaataaattccgggttccttgttcagataatcgatctccagccccgaatcatctgccattacgatatcatccggcaaaagtgcatggacagcccgcgctttaatcagtgaattctcctcaaatgtcttcccattctctacgatctccgggttgacacctgcctctttcatggaaagaatctccatcccaagatctttcagaatctcccggatctctgccattttatctgtattgcctgtagcaaaaataattctactcatcttttcccttctttctcggaggcttcggccccataaattgatagaaatacgttttaatcatgccgttataaatcttacggttcttatccgcctttcttccaaaccatttctcggcatcctcatagctcgtgatcatgtaagctgaccagtctttcaatccacgaaaactatcgccaaaatctcggtaaatctccggcagtgcctccttctcctccagtcgctcgccgtatggtggattggtgatgataaaaccgtaaggcctcggatgcctcaactccttaaccggacgtctttggaaatggatcaaatgatccactcctgcttgaaccgcatttttccttgctatccggatgacattctcgtcaatatcatatccctggatatccgttgtaatattgtttcgtattcgatcttgagcctcagtcaccgcttcgtaccaggtctttctcgggatcagattgtcccaattctcagcggtaaactcgcggttcatacccggagccatatccgccgccatcatggccgcctcgatcacaaacgtcccactcccacagaacggatccactaaaatccggtcacgccgccatggtgtcaggagaaccagagccgccgccaatgtttcagagattggagccttcccgctttgagggcggtatcccctcttgtgcagggactcgccagtggtgtcaatccctacagtaacgacgtcttttttaataaatacgcgaaccggatactctgccccttcctcgggaaaccacttctgatgataatgctccttcatccgctccaccatcgcctttttcattattgactgtatatcagatggactaaagagcttactcttcacagacgccgccttggtgacccagaactttccgttctttggtatgtagcgctcccacgaaatctgcttcgtcctctgaaagagctcctcaaaggtccgagcctcaaattctcccacctttaaaagtatcctctctgcggaacgtaagaacaggtttgctctacatagcgccagctcatccccataaaatgaaactctgccgtcctccacctgtgcaatgtcgtatcccagatcctggatttctcttttgagtaccgcctccaggccaaagtggcacggtacaacgtattctatctgcatttcgtatctccattcccgattttgttcttcctatatcttacgtgctgaccgccctcttgtcaataaagtctttggctctaggtcttttgtctcttctgttttacatcttcatatccttctttttattttttatagccaaaaacctccccgctttcttagtttggaaagcgaggaggtccttgtcagtgaccatattccttagtagttgccgttgttgtaatcgctatagtccttggtatggcagtcggatgtcttgttcatgttcttgttcttcgtagtgttcttcgcgcgctctgcatttttgctgttctgctgctcatttgcgtaagaagaattgtaagagctgtttttgttcgtattatttgtgttgttataattttttgccatttccatgtcctccttttgaattatggtacgctgttagtatgctcttatcgggccgatttatacgccattctttttccaaaaagtggtcttccaaaaataagattttcttccaaaatttaagcattttttaacattttacttgcttttttggttatcatatattatactaatttttgtagaaagcaggctttctacaccccttattaattatttatactcccctcaaaagaccgatggctcccccatcggtcttttacttatacacgttccagcatcataggtggctgccagaattttagccgcctttggactttgtctcgtcgccggtacgaaaataggaggtgctgccttcatcaggacaacacctccttcctttaacgtccactcatcatacgcaggatcagcaccagtatcaaaagcggcagcgcaaacggcagtaccgcagcgatcagtccagtaattacagctacaatgataaagaggacaatcacaatgcccgcaaaaaacaaaatcctcttccaccaggtgtcgattccaatcaaatgcagaataggatgactgttgttctgctcctcctcttcttccgtgtaggtattctgcacggaactgtacgtaccggaggcggaaccatagtactcccgctcgttctcatcggtatcgataatcgttcgggcaatcatccacgggtctcccaacatatccaggacttcctgctctgtctttccatttcgcacctcgctttggatataggaatcataatactcgatattttccctaactaccggaccgctcaaatcattttccagggcttctctcagcttatctaaaaactcgcttcgattcatactctatacctcaaaaatcagatctccataagatggcatcggccagatttccttgtccacaatcatttccagtctgtccaccggtgtacgaagtgcctccatcaccggaactacttccttatagaaatactcggcctgtgcttgtccttctgccttgaaagcagcttccgacgttacctgttccagccgcccaagagcctcttttgtctcctttaagagtccgcttgtctccacaagcagctctcttggtacctccgcgtccactccagcctgtaccactgcattgaccgtatctgccagtacctttgttccacggatcacagccggaatgatatgcttacttgcaatatcaatcattgtgcgtgcttcaatattgatcgctttcgcgtaagcttcatacttaatctccgcacgggaatgaagctctgcccttgtaaagacatggaacttctcaaagagttctacgctcttttcctccacaagtgcaggaatcgcatctaccatggatggaagattcgggagtcctcgtctctttgcctcctcaacccacttatcggagtagccatttccattgaacacgatcttctgatgctcagtcgcataggacttgatcagatcatgcaaggcctgctcaaaatcttccgcctgctccagcgtatcgcaagcctcgcagagcgcctcagccacaatggtgttcagaacgatatttggcgccgcagccgaatctcttgatccaagcatacggaattcaaacttatttccggtaaaagcaaacggcgacgtccggtttcgatcggtcgcatccttattcaatccaggaagagctttcacccctgtctgaagcttacctcccttgatgctatgggtcgcatttcctgtcacaacaagctgctccaatacatcttctaattgttctccaaggaacacggaaatgatagccggcggagcctcactggaacccagacgctgatcgtttcccggatccgcggcagattcccggagtaaatccgcatgtctgtcaacagcccgcaacacgcagagcagcatcaaaaggaactggatattctcatgcggtgttttcccagggtcgagaaggttcttcccgtcgtctgtcgtcagagaccagttatcatgttttccggaaccattgacgccggcaaacggtttttcatggagcaggcaatgaaggccctgcttttccgctacctttttcaaagtctccataatcagttggttgtggtctaccgccacattgcactctacaaagatcggggccagttcatgttgagccggagccacctcattgtgctgcgttttcgccgtcacaccaagtctccataactcctcgttgacctctttcataaatgccgcgatccgtgcccggatacttccaaagtagtggtcatctaattcctgtccttttggcggcattgccccaaacaaagtacgtccggtaaatacaagatctttccgtttcagatatttctcccgatctacaagaaaatattcctgttcaattcctacagaaggtttcacgcgctttgaggtggtgtttccaaacaaacggaggaagcggagcgcctgcttattaatcgcctccatagatctcagaagaggagtcttttgatccaatgcttctcccgtgtaggaacagaacgcggtcggcacatagagtatacagccattttcatctttctttacaaaagccggagaagttggatcccatgctgtataacctcgtgcctcgaatgtcgctctcagccctcctgacggaaaggaggaggcgtccggttctcccttaatcagctcttttccggaaaaactcatcaacaccttaccgtttgccatcggtgcagagatgaatgaatcatgtttctctgccgtcacgccggtaagaggctggaaccagtgtgtgtaatgagtggcgcccttctcaatcgcccattctttcatctcgtgggcaatgacgtccgccgtattgatatccagctccttgccctcctcgattgtacgtctcaattccttgtaaatcttcttcggcagacgctcctgcatcacagtatcattaaatacgttctctccgaaaatctcagccacattgatatcccttttgttctcctccatttgttttcctccgtttctttatacagaaaaaggcactccatgcaagtggaatgccttgtattctctttttatgaattattctgcttttcctacggaaccgaataattccatcttttcttttactttttcaacgatagcttctgcacctggttttaataatttacgaggatcgaagccttttttctctttatccttacctgcttcaatatacttgcgtgtagcttcagcaaatacaagctgacattctgtattaacattgatctttgctacgccaagactgattgcctttttaatcatgtcatccggaatacctgtgcctccatgaagtacaagtggcatatctcccgtcagagcctgaatcgcgtcaagagtctcaaagctaagtccctgccagttctccggatacaccccatgaatgtttccgatacctgcagcaagcatatcaacacccagatcagcaatcatcttacattcattcgggtccgcacactcaccggctccgacaactccgtcttcctcgccgccaatagatccgacctctgcctccagagacattcctttttccttgcagattgccgcaagttcttttgttttagccacattctcctcaatcggataatgagaaccatcaaacataatggaagagaatcctgcttcgatgcacttctggcatccttcataagtaccatggtctaaatgaagagcaaccggaaccgtgatcttcatctcttcgagcataccattgaccattccaaccacagtcttgtaaccagccatgtattttcctgcgccttcggatactccaagaatcaccggggactttgtctcctctgctgctgtcagaatcgcttttgtccattccaggttgttaatgttgaactgacccaccgcataatgtcctgcttttgctttctttaacatttctgctgctgatactaacatattctctcctccattttcaaagatatgacccccaggggaatcgaacccctgattccaccgtgagagggtggcgtcttaaccgcttgaccagggggccatgtgccagtgaagaaacacatccgtgttacctcactcgcttattgtatactatctgcccaaaatatacaagtctttttttcaattttttaaaatttcttttcctcctcttcatccagttcctctaaagccctccttttcaggctttctttatatggatggtgaatcagctcatatgccttttcctccggtaccatgatgcatagctcctgctgacggttctggatgcggactttgtcaaactctcccccgaactccccgtctagcgtccacggaatttcttccagggactcaaaggaaatctccctggctttgatattatatatataatcggaattcttttccttactcatcagcgaagtcacaatactctgcatctccagcaggtttttcggcgaccggacaagtgtcacttcaaattctccatcatcgaattctacctcatggccaaacatgttgcggaatccgcccatagatctggagttggtgacggaacaaaatacaaagtcatcctcaatgtcattgccgtcgtactctactctgacgtgataggatgggatatcgaaaagccgctttgcaccctccatgacgtaagccaggtgcccaagcatattcttcatctcctgtttggtctgataggagacatctgtgaaaagaccgaacgctgccacatagacgaaataatcgtcgttaaactgtccgatatcacagtggaacggctttccattgaccgctgcgtccgctgcgctcagaagatctttcggaatatgcagactgttggcaaaatcgttcgtcgtccctgtcggaatgtagccaaccggagtctttcccccacgcttcatcatgccggtcactacctcatcgagcgtcccatctcccccactgcacacaacgatatcataatcttcctcgtatcgttttactttcttataagcatcatggtaactctgggtcggatagatgactacctcacatccgctttttacaaaaagatccacaatatcggaaagctttggctttaaaagccctttccccgcgttcgggttgtaaatgaacaaaatctttttcatatttacattcctcctctcggtcgtgccttttcctttcctgttatgacaggaaaaggatgttcacctccctcgtggtaacacccttttacactctactctctatgtacgtatcggaacttatctcgcatgttccaaaaacttctcaatgccttttgccgccgcttcctcatcgacgccttccgcaaccactgtcagatcctcgccgccgcttaacttcaggctcatcatacccatgatgctcttggcattaatctttttgcttccgatctcaatgaacacgcggctttcatactgacttgcttcctgtacaagcaaagcgatcggtcttgcatccaatccgtcgtcacatttgatcttcaatggtttcttaatcattttgtacctccttgaactccatttgcttttcttaattcctcagcaatttcgcctagacggcgcagcctgtgattgaccccggactttcctaccggctccggcatcagctctccaagctcttttaatgtcgcttccggatattgcagacgggccatcgccatatcccttaatccgtcagaaagcttctcaaatcctatatagtctttgatgtatgtgatatcctccatctgcttgactgccgctgagacagtcttatggatattggctgtttcacagttcacctttcggttgaccgtatttctcatctcctttaagatgcggatattctcaaactccatcagggcaaccggcgcatccatcacattcagtgccagtgaaatctgagtgccttcctttaaatatacgacaaacgacttcttccgtttcaccactttcgcatccatctcgaatccctgtatcagcttcttcaaaagctcggctttctcctcagacgcgcatacaatttcaaaatgataagatttgtggggatcactcatcgatccggccgtcagaaaagctccccgaaagaaagccctcttgcagcatccattctggtaaacaaggctgctgactccaagaaatcctccatgctttggttcatccagaaccagctttgcagcctgaagaatcctttctgtctgtttccgaccaccgactgcgatcaagtataaaatactttttttgtcctgatttctacggatagaaatttcagcctttatattaaacgctttttccaataatgtaaagtactttcttgcaactgcaatattttccgtactgagctttaagacgggatgctcctcctcttccatagccgcgcccgccgaaaaatacagaattgccgcacattccgcgatctggcaatgtctggcgttgcttatctgccccgccagttcttcttttacgtttcccgaaaatgacatgtacttatattcctttcactctcgcatctttttcaatgtccctgtgctcaatcttcagaccatagccctcctcctgctccagagcataatatagcgcgtttgccagggtgactgacctgtgcttgccgcctgtacatccaatacctatgaccagttgattcttaccttcagccacataattcggaatcagaaactgcaccatatccacaagcttatccagaaacttgcgggctgtctcactgctcatcacgtagtccctgactggagcgtcattgccgctcatcggacgaagatcctggatatagtatggattcggtaaaaaccggacgtcaaataccagatctgcatcccccggaatcccgtacttaaatccaaaagacaaaatcgtaacataaagatttttataatttttattctccacaaagattttcaatatctcagaacgcagttctcttgtcagcatctgactcgtatcaatgatgtaatctgcctgctgctttaaaaagatcgtcctcctgcgctcttcatcgatccctttatcaacccggccatcccccgcaagcgggtggctccgtctcgtctctttgtatcgcttgatcagcgcttcatccgaagcgtccagaaagagaatctcaaacttgacgtctttctttctcagagtttccagggtctcccggagctgtccgaacttctgactgctccggatgtcgattccaagccctactttcgtgtactctgatcctggcagaatcagcatctccataaacttcggcagaagtgggaccggaagattgtctacgcagaaatatcccgcatcctccagcatcttgagtgccgttgattttcctgctcccgaaattcctgttacaattacaatccgcatattccataccgccttttcttattgtgtctgtctcttttgtccaatctaatcctttttaggtccgaaatctccaaggcggcgtacttccggctccagccggacgccaaacttcttatacacccggtcggaaacctcctgcataagacgattaacatcttccgctgtagccccccctttattaatgacaaagccgctgtgcttttccgatacctgagctcctccaaccgcaaagcctctaagccctgtgtcctgaatcaacttgccagcaaaatacccttccggacgcttaaacgtgcttcccgcactcggatattccagcggctgcttcgttgtccgtcttctcttgaaatcttccatctttgccgcaatgtcctcacgagcccccttctgaagccgcagacacactgccactacgatgtatccctgcttcataatccggcttgtccggtatccaaactccagctcctcccctgaaaggacgagggatcgtccatcctgatcgagcactgtcactttctcaatcacatctttcatctctccaccgtaggctcccgcgttcatcacggcagctccgccaatcgtccccggaataccggacgcaaactcaaatcccgcaagcttatgctcaagtgccgccgaagcgatctggctcatcagagctccggcctgtgcccggatcgtacatccatgcacttcgatgaccgccatttccctcccgatcgcaataatgacgccccggtaccctgcgtcacttaccaggagattactcccgtttcctacaatataatatggcacctcttctctcctgcatagactgatcagcgcccgaatttcttcctctgacttcggcatcacatagtaatccgctgttcctcccaaccggaaggtcgtgtgctttgccatcggttcctgcactttcactcgttcctgttccatgcatccgcacagtttttcataaaactctctgttcatatctattctccaaatattctttgatactattctgtttccagtttattgtcttatcatacatcaaaggctgtccaaattcaatgaactcttgcaaaatcggttaaaatacgataatatagaaagcagtatcatttattatatttatcaaaaggagtgaacttttcattggactcgtcaacagtcatacaaattgtgattctcatatgtttattagcactttccgcattcttttcttccgcggaaacttcccttacgatggcgaacaagatccgcatgcgttctcttgcggacgaggggaataaacgtgccaagatggtactctggctttccgaacattcctcccaaatgttaactgctattctgatcgggaataatgttgtcaatctttccgcatcatcccttacgaccagtattgcttacaaattcggcggctctgctatcgtcattgccaatgccgctattacaatcctgattctcctcttcggggaaatcacaccgaagacgacggctaccctttatccggaaaaagtctctctgatttattctccgatcatcaagacattcacccggattatgactccgctgatctttttgatcaaccttctttccaggggagttctggcgttgcttcacattgatcccagcgctcagagccgtacaatgacagagtccgaacttcggactatcgtggatgtaagccacgaagacggtgtgatcgaatccgaggaaaaggaaatgatttacaacgtctttgatctaggagacgccaaggcaaaggacgtcatggtgccaagagtacatgtgacctttgcggatatcaacagcacctacgacgaactgattaatatcttccgggaagataaattcacccgtcttccgatctacgaagacacaacggataatgtggttggtactattaatatgaaagatcttctgttatatgacaacacgaaggaatttcatatccgtgatattttgcgcgatgcttactttacctacgagtacaaaaacatctccgagcttctcgtagagatgagagaagctaaatttaatattgccattgttctcgatgagtatggtgaaacggcggggcttattacattggaagatattttggaggagatcgtcggggaaatccacgatgagtatgatgaggatgaagaagatgacgtcagagagcttggcactaatgagtatatcgtggaaggttccaccaatctggacgatttaaatgatgagctgggacttcaaatggaatctgatgattacgattcgctgggcggctttatcattgaaaagctagatcgactcccttcagaaggcgacgaagttacaacatcggacggggtccgtttagttgtagaaaaactggataaaaatcgtattgaaagtgtacatgtttaccttcctccagactgggtacacccggataaggaagagaattaagttgataaaacctccatgcgtttctgttaaaacgcacttaggagaaccggcgcatccggttctccgagaccgtttcaagttttgtgtaaactcgaaaaaactgatataagatatgtcattagttactccgggcagagctgatcagcttaagcaacaagatggataaatctttactggctgtaagggatattaaccatatttatattgtagtagaaaggaggaacatttgtctcaagaagattttgcggagatgtttcatgtttcgagacaaacaatatctaattgggaaaattcgaagagttatccggatttagaaacaattataaaaataagcgatagttttcagatttccttggatattttattgaaggaggatttgattatggtgaaaacatttgatagcgaagtaaagagtacgagaaaatacgcaaagatattgttggtaattgcggttgtatttgcgttggtgatcgggagctttgtaatttattcgtgtgtatatttcaataccaaaaataaattagaggggaattttacgcagcagttaaaagaaaataattttcataaaaatagaaatggatattattcaatgagtgattcgaaaggaattacatatagtgtcccgaatcaatccatgccgggactattggacttttctttgcagtttcatattagtaatgtatactgtgaaattgatcttgaagatactattgtggaaattgtgtgggaagataacaatgaattcactgcttcagcaatttctaaagatgataataaaatagtaggtagcacgtcggaatttacagaaagtgactttacgaatatgaagaaacttggtaatgaattaggaatttcagagagagaaatgactagaatcattgaaaagggaaatgagttgtatcaagagttctatttataatagaaatactaaatcattctatatttatttggagcggttgattttgaattgaccgctttttttatttcataaaaatatagaattgttacttgaaggacagaaaaaagaatagtatagttatataaataacttatataactaatttatataaaggagaatgtattatgccaaaacaaaaaatcacgaaagaaatggttgttgatacagcatttgatattgccaggaaagatggaatggatcgggtactcataaagaagatcgctggaaagcttggctgttctgttcagcccatctatagttattgccaaaacatagaaagtctgaaagcagaagtagaagctcgggcaatgcaatttgtgtgggggttcatagaagaacagatcgacccggaagatctgtttgcgagtactggaagagcttatgtccggcttgccaaagaagagccaaatttgtttcggattttcattttgcaccgaaggcaggggatcagttctttggaggagttctatacgaaagagacagatccggggatggcggaatttctttctgacaggctccatatcgatgtggagcgggcaagaagtctccatttgcacatgctgatctatacggttgggatcgggacaattttttgtacgacagccccggggatatcactgggagaagtcgtgaagcaacaagaaagcgcaaccaagatttttttggatacggcgctgagagatgcgtcatatagggagcgatcagaatggatttagaggagggacggatggaaaaaggaatgatactatatcagtcgaaatatggagcggcacgaaaatatgcgggatggctgagagaggaaacaggatttgaaatcagggaagtgaaaaactgtaagatagaggaggttctctgttttgagaggctgattctttgcggtggaatttatgcgtctggtattgcgggaatatcgtttttccaaaagaacatagaaaaattacaagggaaacagctttttgtttttactgttggggcatcgccttatcatgaaaacgcattgaaagaactcaagagaaaaaatatgaaaggcggtctttgcgctatccctctattttatgggagaggaatgtggctagaagagaagatgacatggaaggaccggacgctttgcaggatgctgaaaaaggcggtggcgaaaaaagctccggatacgtgggaaccatggatggctgcactgatgagtacaaatggtcaaaactgtgactggacagataggaagtatttgaaaccattgctggatgcattggggaatagggcaggattggaaaagcaactcgactctttttgatttatagtagagatatgacaaagaagagcaggggtgagatgcatgacaactggggaaattgttgaacaaagtaaagagtatataaaaaagaatatcgaaaggtcactgacagtggcagagatcgcaggagcggtcggatattcagagtattatttttccagactatttaaaaatgagacgaggacttccgtgatggaatatgtaaaacgggaaaaacttcaaagagcatctgttgagatccgtagtggcaagaaaatcatggatacagcgctgaaatatggatgggagtctcataatgggtttacaaaggcttttaaaaaggaatttggctattgccctgctttacttcgtgctatggtaataagtatgcaaagattaggaggtaaaagtatgggcaggacagttaacgggcgagtcgatgaacatgcgacaaaggagcaactatttgagattctaaagaaaaaagtgatacagatgtatccttctgtggatgaaaaagagatacaatacatttatgagtatgcatgcgaaatctatcacggaatggagcgttattccggagatgaatacattacgcatccattgcatacagctattctgctggcggatatggagacggaataccatacgatctgtgcagggctgttttgtgacgtcatgcagaagaggcttgtggacagaaaagaacttaagaaacacttggcagaggcagtcgtggaattggttgtaggagcaggaaaggaagatttggaaacccgggaggaaagaaaggaacagatcgtgcttatccgtcttgcaacgcgtcttcataacatgaggactattgactacatggacgggcagcaaagaaaacggagagctgaagaaacctgcgagatttttgtcccattggccgaaaagactggaaattatgaaattgcaaaagaactgagggagttatcaatgagagtgtgaaaagtagaaaagggtaaaaatttatagttggtaagcccttattttcgctgcaagattatgaaataatggatattaaaaagtataagagtggttgatacagttgtatcatctgctcttttttattttgtataaatacggttgctttttagctgtccatgtgtggacggtagattacaaatatacttttactaaataaattactaaaacctgaaaatgaatttagtaaatagagtgaaaaaataaatatttttaaagaatattgaaaaaattaagagtgaaggatatagtagtgtaaaaaattaaatgatataatttagagcgataaagaaaaaatacagtaaaaaaagaaaataatttagtcaacaggaggactggatggcaacattaaaagacgtagcgaaacgagccggggtatctccggcagcggcttccagggtcttaaatcaggacagacatttttccgtatcggatgacacgaggatgaaaatacaggaggcagcaaaagcgcttggatacaaaggacgggtggaacattatcaagataccactttatgtattcctaaagccaaaataggaatctttcttttatacaatgaaattttagaaattgaagatagttactatcaaattgtacgcctaaatattaagagtgaactggaaaaaaatggattacaaattaaagagttttttctggggactattgaaaaaggaatccgacaatttcatgaatttcaaggagtaatactagtcggacacccaggaatctggtttcgggcaagtgagttgcgggtcatgatgaaagaagcaggaattcctattgtttgttctgattttgaattggaggagggagaattaaatgcggattatgtcgtgaatgattttgaaagtattgttaataaagctctggattgttttgaggatagaggatatgaggagattggatatattggcacgtatggaatcgagatttacggttctctgaaagcagacagaagatatcttgcttttaaaaatagaatggaggaaaatggaagattccgggaagagttcatatggcttacaaaaaacagtcttgtaagagacggatacgaattgggaaaaaagatcataaaagaaaagcgtaggcttccaagagcaattattgtggaaaatgataatcttgcgataggatttttgcgaactttaaaggaaaatgcgatcagtgtaccaggagagattgcccttattggatgcaatgatatacaggcagcagcatttgttacaccgcccctgacgagtgtaaaaatttacaatgacgttacaggaatcatgtcagccagattattgatggaacgcttacttaccggacgaaaggaaggcgtaaagctgattgttccaaatcggttggttgtccgtgggagctgcggtgagagtagggttgtgtaggaggaaaaattgacaatggaatttatttataaacatgcagactggagcaatatcaatgtattagaacgaaataggttgccaatgcggccattctactgtggatatcaaactgtgaaagaggcgcggataggaaagaaagaagaaagcggaaagtatagacttctgaatggagagtggaagttcgcaggatttgaatctccatttttggctttggatgaatatgtaaaagagggaattgatgattcttcctggagaactatgccagtgccggggcattggcagttgaatgggtttggaaaaccgtgttataatgacgctttttccttgttcccgatcacagatgatccggctattcagatggataatccaactggaatctatcgaaagaagatcgaaatcaataaagaagaaggccaggaatatctgttgcgatttgatggtgtggaaagtgcttatcatgtctgggtaaatgggattcttgtgggttatagtcagggatcaaggaatacggcagaatttgatattacagagcaggtccgcagtggaaaaaatatacttgccgtgaaagtatatcagttttcagatggaagttacctggaaaatcaggatatgtggtggtttgcgggaattattcgagatatttccctgatttcgagacctcaaatccatgtgtcagattataaaatagatgcgcttcttggtgaggatctatgtacgggtcattttcatgtaaatgtgacagtggagaatcacgccgggaaagagaaagagatgaaattaaaactaagtctttttgacaaggaagaagccgttctttcagaagaacgtaaggtgcgggcagttccgggagaaacagatgtttcattttgcatgacgatcgatcaggtaaacgcatggtctgccgaatatccctatctttatgatgtaatcatggagttagaagaaaatggaacatctgtcgaaatttatggtgtgaaatgtgggtttcgcacaatctgtctaaaagatggtttgttttatatcaatggcgctcctttaaaattgaaaggggtcaatcgtcatgactggaacgagtatacgggccggtgtgtgacaagagaagacataagaagggatctttatcttatgaaacaatatcatgtgaatgcgattagaacggcccactatcctcctcatccagattttctggatttgtgtgatgagttgggattttatgtgatggaagaggcggatctggaatgtaatcagatggcatatacgaagaagccaaacaggctaagtgatgatgtgatgtgggaaaaaagctatattgatcgggcagagagaatggtgaaaagagataaaaatcatccatctattatgttttggtcattaggaaatgagtcgggatttggaacggcattcgtggaagccggaagatttgtcagacagtatgatccgacaaggctgattcactatgaagaagacagagacgcgtcgattgcggatatttacagtaccatgtatacacgccacaaagatttggagcttttggggagagatagttcaaaaataaaaccacatattgtatgtgaatatgcacatgccatgggaaatggtccgggagggctgaaagaatactgggaaatttttcgaaagtatccaaggcttcaaggcgggtttatctgggaatggatagatcatggtttgaaaaagactgatgaaaatgggagaagttattatacatatggaggtgattacaacgattatccaaatagcggtgctttctgctgcgacggactgctgcaggcagacagaacgccgactccggcagtgcttcaggtgaaaaaggcatttgagccggttgcattttgcaaatttaccagaaaccgtggggcgatttgcgtagaaaacagatatgattttttatcgttggatcatttgaaagcgatgatcacgattgaaaatcaaaatgaaataaagatgagcagtactgttgaactggatggagtgaaagcacatgagaggaaagaaatcgtactgtttgatcctcagaagcttttcctgccagaatgttcgggagactggtggctcaatatccgtatcgtgtacaaagaacgtccggcatgggcagaggaggaatacgaggttgctttccatcaggagttactaaagaaaggagaaaggagagagaaaaaaagtgcggatggaccactgcacgtggaagaaaaaatgggaaccctgatcatttctggcgaagaattttgtctggaattcgaccgaattcagggaacgatttcacgatatgaatttgcgggagagacgttgattaaaaaagggatgggaatgaacttttggagagcgccggtagataacgataaaaatgtaagaaaaatatgggaagaagggatgctaaaggcagtatgcaatattgtagataaaatttcggtggaggagggagaagggaatgtagaaattaagataaagcaaatgtatgctccgattgtgctggaatggaaaattcttattgaagcaaagtacattgttgcaagtaatggggagattgagatgatgtatcgtggcgtccctgtagggaatcagctcccagagacatttccaagaatcggcctgagatttctgttggacaaagcgtgtgaaaatgtgcgctggtacggacggggaccatgggaaacctatgtggacgcgaaagaggggaatcgttttggcgtttttgaaagtaccgtgtcagacttttatttcccttatgtagtgccgcaggagactgggaaccatgaggataccagatgggtagagttcgaaggaaatgcgggatgtgtacttcgtgtggaagcagaggaggagttttcctttggagcgcttcattatacacaggagcaactgacagaggcacaacatacaaacgaattattgccggaagaggatatcatgttgtgtgtggacgtcggacatcatgggcttggaagcgcaagctggggtgcagagtgcctggagaaggaccgtctttttccaaaaccgtttgggtttcgctggaaactttcggggaaaaagaagatttgatataaaaagggggatgggaaaatgatgaccaaaaaaacagcgccatatttgtttttacttccaatggttatactgtttgcgatctttatggtttatccggtgattaactcactgattcttagttttcaggattttacagaaggtagatatgttttctgtggtctgcagaactatatcacaatgcttcacgatccggtattctggaagtctttaaaaaacacgtttatttatcttgtgatccaggtgccggtgatggtggtgctgtctttggtacttggggtactggtagaacaggcgtttttgaagtgccgcaccggattcagaatcagcatatttcttccggcggtaactgcgctggtagcctatgccattgtttttaagcttctttttaatacagattttggactggtcaattacgcactcagagcagtgggggttgagggcgtagactggctgaataccgtatggggagcccggattgcgatcattgttgcaatcacatggcgctggacgggatacaacacgattattatgatcgccggtctgaaaaatattccgacagaactttatgaatcagcggatatggatggagcctcctttctccagaagctgatgtatatcacgattcctatggtgaaatcgattatgttgtttgtcagcattacttctaccattggaacattgcagttgtttgatgaatccttcatcttaacggggggtggtccggataacgcgactataaccatagggcattatctgtataatactgggttttcctattacaagttcggatatgctgccgcacttagctatgcgcttgtgattattatagggattttgtcgattctgcaattcaaatttacgaaaggaggagaagactgatgaaacgcccgacggagagaaacggattaaagattgtcacatatattgtgctgatcgtagctacatttatttcattatttccattttattttatgtttgtatctgcgaccaatacgcactcggatattttaagtgcttcgcccagattgatattcggaagcaacctcgcggagaactttaagaatttgaacgagcgtctggatcttgtgcaaattttgtttaactcatgtattcttacctttacctatacgtttttgtctatgcttattcattctatgtcaggatatgcactggcaaaatttaacttcaaagggaaaggcctatgttttggtgtcattatggtaacgatgatgatacctggacaggttatgtatgtaccgttatttacattgatgaataggatcggatgggaaaatacatatcaggctgtcattttaccggcacttggcggtgcgttcggaatgtttatgatgagacagaatatgctgtcttttccgacttctttgattgaagcggccaggatcgatggatgcggagagttttctatttttatgcgggtagttatgccttctatgaaaccagcgctgggggcgcttggaatctatatgtttatgagtatgtggaacaattttatgtggccattgatcattttaagtaccaaatccatgtacaacttccctgttgcattgtcgatgctgaatggggttgcgtggaggaaagactatggtgttattatgctggcaaccgtatttgcggtactgccaattctgattatctttcttgtgtttcaaaaacagtttgtcgccggcgtgatgggcggagctgtgaaagaataaaaagtcaaaagtaaaaggaggaaaaaacatgaagaagaaaatcttatcagtcctgatagcggctacgttgactctttccttgactgcatgtggaggaaacggggaacaaaagggcggggactccggagaaggaggactgtcgggggagatcactgtctggagctgggacgtagcgttggctcatctggaagctcaggctgaaaaattccaagagaaatatccagatgtagaatttaattttgaagagatgggggtgtcgcaggtctatcagaaaatgacgacttgtctccagtcgggaattggccttccggatatcgtatctattgaaggagagcagatggcaaaatttggggagaagtttcctggtaaatttgaagaattttcagatatgatttcgaaagaagactttttcccgattaagatggcggaatgtactgtggatggaaaagtaattgcatatccatgggattctggtccgtgtggtatgttctacaggtctgatctttttgaggaggccggaattaaagcagaagatatcataacctgggatgatttcattgaagcaggaaaagtattaaaagacaagacaggagcagatatgctctgtatggcagaatccagaaatgacaatacctatcggatgcttatgatgcagctcggaggtttctattttgatgcggagggtaatccgcaggtaaattcagaggcgtcaatacgggcgatggagatgtgtcagaggatgtatcaggaaggaattacgtttaataattcttcgtgggacgatatggtgacaggaatgtccgacgataagtttgcctgcattgcggaagctgtatggatggtgggatcaatcaaagacgcggttccggaccaggaggggaaatgggcggttatgccattgcctcgttttgacgagaatcaggaatcgatgggagcttctaatggagggtctgtacttgcggttccatcggcaagtaaagccccggaggccgcaaaagaatttgtaaagttctgtatggaagatatagatgccaatgtagagggattccaaaattatgggctttatccttcttatcttccggcattggagtcggaagtgtttaaagagggagacgactattttggaggacagcagatttttgatgtgtttacagaaatagggaagacagtgccgggagtaaattatacggagaatttcgcggaggcaatcgagatgtccaaaaacagtgtggcaaaaatcatccttgacaacgaaaatgtagaaaaagtattaaatgatgaacaaaaagagatggaagctaaatttgtaaaataggtgagacagagatgttgggaaggggggcccgacatctctttgtaagacggaggttttggtgtacaagacaaaaacaataaagagagaaatctaccatattattattcctatgattcttgaaaatatcctgcaaatctccgcaaatctggttacgacagctatggtaggacggttgctggcgaatgatatagcggcacagggcatttgtgtaagaattacagatacactttgggttttttataaaggagttgcgatcggtgcgacagttctgattgcaaaagcatatgggactggtaaaaaagaggactgtagaaaaatcatggagcagacacttctgacagagttgatccttgtgtttgtgtttcaggtcgttttgttttttcgagctgatatttttcttgggttcttttcaaaagatgcagaaattttaatgttggcacagaactacatgaagattattgtgtttggattttccggttgtgtgattatgacggttgcgacggctgcgtttcaagggtatggagatacaaaaacaccgatgatggtagctgctgctatgaatcttgtaaatattatatttggtttcggactgatttttggatttggacctttgaaaggaatgggtatattcggagcggcgaccgcactggtacttgcacagacctttggggcagggatggatcttttccttttgtaccggaaaaagaaggggctgttttttggaacagatcctcagaaaaaatggttttatattgacaaatcctgtatttatgaagtatacacgacagggattccggcggcactggagagtatgttttggcagttttcagctatcatattaagtaaaattatcctttcttatggatcttctgcgtttgcggcatatcaactgggaattcaggcagagacaatcacagagatgccggcaatcgggttcagtacagcatctacaacgcttgcggcaagggcaatcgggaaaaaagacgagaatctccggaagatatattttagggaattgattcgggtagcatttacaatcagtgttgtcacgtctatacttctcgttctctttccgggtgtgtttatgaggatgatgacaaacaaagaagagctacaaagtatcggaatccagtatgtttttgtcatgggatttattcaaattcctcaaaatctttccagaatatataacgggacgatacgtgcaatgggacataagaatacaccaatgattgtcgccggatttgggatctgggttgtccggattccactttgcctgatagtggcatttttgttaaaactgccgattacactgatctggattgtgattgcgctggatcagttatcaaggtttggactcagtgtgattctttacaggcggttcggaaaggaggtctatgatggctcggcgttatgataaggagatccgagaatttttgaaggtctatcaggaggaactgatagaaaatgtatgtcaacttgtacggattcccagtgttgcaggtgaaaaagaaggaacacatcggtatggcgtggaatgtgcgaaagcgctggaattttgtatgcgccttgcaaaagaaaagggactctatgcagaaaattttgatgactacggtgtggaaatcaggctgtatgaaaaaccaagaaaaaaacgcctgcttttagcggcccatactgatgtggttcctccttctggtgaaaatacatatccgccatttggcgggacggtagaccggggatatattataggaaggggttctgttgatgataaaggacccttgatggccctcctttatgcactgttttttttcaaagaaacgggaatcagtccggagtgtgatcttcgcctttttgtcggagcacatgaagaggtggataggaaagatatcgagtattacctcaaaaaagcaggacagccggattttggaattgcggcggatgatgattttccgatcaccaatggtgagaaacacattctatggtttcgcttaaaggcggaacgctcttgtatggacttatggcaggaattagaggcggactcgcaggggatacagtttggcatacatagtagaagcagacggtatggggagtcacgctgcaaacttcgggcgaagaatgaaagatgggcggagtttgacgcccggttccctgtgtcgattccgattgcgagaggaaaagaaaatatagagaaatttgccggagaacatgctatgcaagtagaatttcttaaggaggaagaagggtattatatttctgaaaaggacgggattcccaatctacttctgcgactctacagggaagagacgggatgcgaggatgcggcttacattatggaaggaagtacttatgcgaggaaatttcaaattggctgtggatatggggcaggcaaaagaaatgaaaaaaagccgttcccctatggtgcgggagcggcgcatggaccggatgaagcgcagaatattgatgttctaatgcaagcattaaaaatgtatattctggctgttatggagattgatgaatattggaagaggcagtcataatacattgatagcctgcacgggattccgggcaggacgttgctattcatgcaccatctgtcctgtctggaatcccataatcaccagttccaatgtcttcggatcgagagtccggtatttcagaaagtagtaaagggtatccagaaagcttaagaacgtttttttggaagcttcgtccagaatcacggacttttgctcccgtgtcaggaaggaggcgattcttgtaaaggaaaacttttcgttcaggaaagcccagaattcctcattgccgttatttatcataacctgaatcggcttacggcgcagaatccaataggtctcataggcgagtgctttccgttcgctgatatgtttcacatgatggaattctttcatccgggagatatcggtaaagtagtccatcaccgtatgagtgagaatcgccttatcaatgcgggtgtggtcggaaacgccaagactttccagaaaggcagtacactcccggtagagagaagcatattggtttttgatgacctgttcggtaaactcggatacaatatcttcatattgcgtgtaaatagtctcgacatcattcatgtgtttcttccccttttagttttataatatcgaaaaatagcttggactttacaaagtcacagtaggaattcacggagacattcatcatggcgtgatcgtggacatgagaagtactgccaagtagatgttttctgatctttccgctctggatttgttccatcatctgatcggcggattgtaaaatctgttcgggaattccaggtaatggtttctgattcatccgaagtccccctttttattctttcagaatgctgtcgatggcatcctgcactgtctgaatagaacttaaatcaatctcatttaacttttctgccggcttttcgtagtcaagccgcggattgactactgtctgctttggcttgaaattctcgctggagacgtcgcagagccgtttgaagaaagaggccatttcatcacccataccggacagacggtttaatagttcggaaaactccgtgagcatcgggtcgctctttttgtacggatatagaatatgatggtcgatctctccccacccttcctcaaatagagtacggatttgtatttccatgtaaacgccctgatatttcacaatatagtggacagaacggtaatgtttccggtcaaatatattgtcgcttgcgatccagtcagagtaaatatcactgaaatctccgagccgcatatgcactttgggaggctctgccatataacggtccttatctggataatagtctgcgatacagttatgaatatagaggtccggattgttctcaaagtgccggatcagatacttgtggaaaacgacccagtcctcccggtacaaaatcaatccccggaaaccaatcgtatcggtgacgaacttcatgtaattgtcttttgtaagggtgcggtatttgagatagttttcacatcgtttccggatgatcttttcaaccagatgccatggcgtcttgacccgggtgcggtaagaatgaagcccggttctttgatccttattcttaataaattcctgtaaaaattcgtcccggatccgccgaaggtcaggcagacgtctggcatagtcttttgcgatatagcaaagatcgtcccagctaagtccggcttcacgaaactccgattcgctgatagaaaagcgctccagaaaatctttttttaacatacgattctacccttttattccgttcaattccctgatttgtcaagatactttcctatcatagcatttttaaccggaattatcaacgtcccggatgcaaaggcgtcaggtcatatctgtaaaagaatcaggtatgccccccccaagtattataaattgtaacgaaatatgtaatgaatctttaagaaaaagtttaggattctttgtcctgttttgctgtaatataaaagcaggggaaagatagatatggcggtgtagtggatgaaaaaaagaaagaagatacatacgataaagacaagaaagttctggctttctgtcatactgtttctggtactggttactgcaatgtatgtgctgatgctcccacagggtgcggtgcgtttcgcgattctgcggtctgggcatccgctggcggctttgacagcaaagatgacgacagaaggatatccgcaggatctggatgacggacagatcggctatgtactactggacgctccgtacgacagagatcggggcgaagagatgggtacctggcttgtgtaccggtatggtatgatttatgtaggagagtacgacggtcactgagagaaattgcaagtaataaaaagtatttgaaacatatcactattcaggctatgcagttggatagttagaaaaaaagaaaaaaagtgttgacaaatatacatcgaggccatataatagtccatgtgctgatcgcacagaagatgcccagatagctcagttggtagagcagaggactgaaaatcctcgtgtcgctggttcgattccggctttgggcatatgcgggtgtagttcaatggtagaacaccagccttccaagctggatacgtgggttcgattcccatcacccgctttttttcttgccaaaaagtaaaagccgccggcctgcggatacaagatcaatcgcaggccggcggctttaatatgccaggtgtccgtcccgggccgcatgttatttagtcaatacttcggcaccgtcctcagtgatcagcaccatatattcgatctgggcggacagaccatcgtcctcggtatagacagtccagccattatcctcatcgatgaagaaatccggacttccttcattgatcatcggttcaatggtgaacatcatgccaggaacaaggagcatctcgcttcccttcggagtgacatagctgacccaaggctcctcgtggaattccagtccgactccgtgtccgccaatatcttctactacagagtagccgtttgctttggcgtgggtgttgatggcgtcagcgatatcgcctaagtggttccatggttttgcttcttttaatcccagttccacacactcttcggtcacgcggacgaggcgttttgccctttcacttacttcaccaatgcagaacatccgggatgcgtcagaaaagtagccgtccaggatagtggagacgtccacattcacgatgtcgccctcctggaggatgatggattcatccgggatgccgtgacaaatctcattattaatagaggtacacacgcttttcgggaagccctgatagtcaaggggcgccggaatgccgccgtgcactgtcgtaaaatcatagaccagtttgtcgatttcggctgtgctcatgcctgcatggatatgctcagctacatggtcgaggactgctgtattaagcttggcgctgatacggatcttctcgatctgctctgcggttttaatcatagagtgatccggtacgatctcccccttttcggcatgtagagcaatctgctcgtctatcgccatatgacattttttgtattttttgccgcttccgcaccagcaaggttcatttcgttccatacttctatatctcctttgttttagtaaatttgtgaatctctcagtcatcggaagtatccaaaggtacattccggaattgtaaccggtcgctaaagtcatggaaaggaccggactttgatgagttaccgttacaatagcagagtgagtataaagcctctcttttcctattatatcgcatttcgcagttgttagcacccataaaataagatataataaggacatatgaacagaaaggacgtgaatatatgctgagaatcggtatgctgacaagcggcggagactgtcaggcactcaatgccgccatgagaggcgtggcaaaaggagtttttgccaaagtaaaagatgcagagatttacggatttaaagatggatataagggattgatttactcttcgtttgatatgatgacggaacgtgatttttccggtattttgacaagaggtgggacgatactcgggacgtccagacagccgtttaagcagatgagagtgatcggtgaagacggagtggacaaggtggaggcgatgaagcacacctaccacaagttgaatctggactgcctcgtgatccttgggggaaacggtacgcacaagacagctaacatgcttcgcgaagaaggattaaatgtcatcaccctgccgaagacgattgataatgatctttggggcacagatatgacgtttggctttcagagtgcggtggacattgcaacggatacgatcgaccggatccatacgacggcaacatcccacagccgtgtgttcatagtagaagtgatgggacataaggtcggatgggtgacgcttcatgcaggtattgcaggtggtgcagacatcgtactgcttccggagattccttatgatctgaatgtgatagcggagtatatcaagaagcgttctgaggcgggtaagcgctttacgatcattgcggttgcggaaggagccgtttccaaggaggacgcagagcttccaaagaagaaattaaaagaagtaatggaaaagaagaaggcaaaatatccatctgtggcttacgagctggcggagaagatccagaagaagtgtgatcaggaagtccgcattactgttccgggacatacccagagaggtggatctccatgtccgtatgatcgtgtactatccacgagactgggagcggcagcagcggagatgatccttcggcacgagtacggatatatggtagctatcaaagaaggagagacctgcaaggtccctcttgaggaagtggcagggaaattaaaaacagtggacccgaagtctaagatcatcaaagaggcgcggactatcggtatcagttttggcgacaagtagacggaaagttagaatcagcaaagatcagacaaggagaatgaattatgtcttatactgccttatacagaaagttccgaccagcagagtttgaagacgtaaaggggcaggatcatattgttactacactgaaaaatcagatcagatcaggcaggatcggacatgcgtatctgttctgcgggacgcggggaaccggaaagacgacggtggcgaaaatttttgccagggcggtcaactgcgagcatccggtggacggcagtccatgcggagaatgtgatatgtgccgtaatatcgcatccggcgcatatatgaatgtggtggagatcgacgcggcgtcgaacaacggtgttgataacatccgcagtatcagggaggaggtcgagtatcgtccggcgcagggacgatacaaggtgtatatcatcgatgaggtacacatgctttccattggagctttcaacgccctcttaaagacgttggaggagccgccggagtacgtgatctttatcctggctaccacggaagttcacaagattccggtcacgattttgtcacggtgtcagagatatgatttcagaagaatcaccattgatacgattacggcacgcctgaaagaactgatgataaaagagcaagtggaagtggaggagcgggcggtccgttatattgccaaggcagcggacggttctatgagggatgcgctgagtcttctggatcagtgtattgcctttcatatcggcgaaaagcttacctacgacaaggtgctggatgtcttgggggcggtggacacggatgtgtacagcgccctccttcgcagaatgatagaccgggatgtaaaaggggtgcttaagacggttaatgagctggtgatggaaggcaaggagcccgctcagttgacgaccgattttacctggtatttaagaaacttgctattggtgaaaagttctgataatatggaggatgtgcttgacgtttcgacggagaatcttgcacagttgaaagaagaagcacagatgatagaaaatgacgcactgatgcgttatatcaggatcttttcagatctgagcaatcagcttaaatatgctacccagaagcgggttcttttggaggtagctttgattcgggtctgcgtacctcagatggagacgagacaggatacacttttggagagaatccgcgctctggaggagaaggtagagaaaggacttgtagtcccggcgacccttccgaggcacattgatggcatggccatggcaccgggaggggaggcacaggtaccggccccggcttcaagagagatccctcaggcacttccggaggatgtgaaggaagtggtgaaaaatttccgtatgatcgcaaatgacgcgtctgggatgctgagagtctatctcagacaggcaagactcagtgtcggaaatgcgggacagctacagattatccttccggatgatctggcagcaggcgtagtgggaaccgcggagcataagcaggagattcaggacctgattgccgaaaggacaggtaagaaggtggagatcgagatcggaaagattgagcagggacgcagatttgaggacagctttattgatctggaacagttgatccatatggatatcacggtagaagattaggaggaagaggatatggcaaaacgaggtggttttcctggcggaggaatgccagggaatatggcgaatctgatgaagcaggcacagaagatgcagcgtcagatggaagagcaggcaaaggaactggagacaaaacagtttaccgctacagcaggcggcggtgctgtcaaggtgacggtatccggtaagagagaggtcttaagtgtagagcttcaggaagaagtggtggatccggaagatatcgagatgcttcaggatctggtggtggcagccgtcaatgaagcacttcgccaggtagatgaggcgaattcttccgtaatgaacaaacttacgggaggcattggcggaggaatgccaggattattctagtccgggagtgaaagagaatggaatattacagtaatcagatcagccgtctgattgaggagctctcaaggcttcccggtattgggacgaagtcagctcagagactggcgtttcatttgatccacatgccaaaggagcaggttgaaaagctcgccgagacgatggtgagcgccaggaatcatgtccgctactgtaaggagtgttgtacgttgacggacgatgagctctgtccgatctgccggaacgagcagagggatcacaggacgatcatggtggtggagacgccgagagatctggccgcctacgaaaagacgggcaaatatgagggcgtctaccatgtgcttcacggggcaatttccccgatgctgggtatcggtccgggggacatccggctcaaagagctgatggtccggctggagggtgacgtggatgaagttattatcgccacgaattccaccctggagggggagacgaccgctatgtatatcagcaagctgatcaagccgacagggatcaaggtcagcagaatcgcaagcggggttccggtcggcggagacttggaatatattgacgaagtgacacttcttcgcgccctggaaggacgtacggagctgtaagataaaagggattgcaaaagctgaggacttctgtagatccctttctttttggaaggcggagactgaaatgagaaaaaagaagaccacatcgacagatattgcgaaggcggcgggagtatctcagtccgccgtctctatgatcctaaataagaagtataatgtctccttttccaaggagactgtggagaaggtggagcagatcgcaaaggagcttggttatcagccgccgaaacgtaagatccgcaaagagagcaggcgggagaagcttctggttgtcttttgctcaaatttgacgaatccgtattacgtcatgctgcttcaagggattgagacgagggcaaaagaggcaggttttgggctgtttatttgtaacacacagcggagcctcaagatggaggaacgatacctgcggatgatgccggagctttcgccgcttggtattatctacacatgcaatccgagtcgctgttacatggagatgatagaggagctggcaaagcaaatccctatcgttgttgtcaacaatcaaaatgaacagatgagtgtggatgcggtggagattgataattctaagcttggacgtctgatggcgagtcacctcctggagttggggcaccgggatgtggcctatattgcgcctcctttgacaatccggcagaaacagcgctccaaacgggtggaaggattcttaaaggaattcgaccgctggggtctgaaggagcgtgtcattatcaaggcagcagatgaagcttacgatatgaacgtggcaaatattgattccgagtacaagattggctatgatctgacaaaggagcttctggccgaaaagcgtcgggtgacggctatcgtggggctgaacgatatgatcgcctttgggatcctggacgccctacatgaggaaaagtacaaggttccgggggatatctcggtgatggggtgtgacaacactctgtttgcgaggatgcacaaactggcgcttacgacggtggaacactttgttgtttttaagggaagggacgcttgcgatattattatgaagaaaattgacagcggccagatgaagtattccggcatggagccggtaagcatctaccatgtagagtatgagccgagactcattattcgtagtaccacatcctatgcaaaaaaatgaattaatgaatctgcttaaattattagtaataagaatgatataaaatccgttgaaacaaggaaatagtgccctgaaaatccagaaaatggttggtaggagaacaaaaaaatgttctttgtagtgctggggtaacagataaaaaattaataaaaatacaattattaatttggaaaattactaataaaaattggcggtattgaccggcttattttcaggttttataatgaaattaaatgaacaacaggaacctaaaataaggaggaacaggaagatgagattttttatcgacacggcaaatgtagaggagatcagaaaagcaaacgatatgggagtgatctgtggagtgacaaccaacccgtctttgatcgcaaaagaaggcagggattttaacgaagtcatcaaggagatcacatctattgtggatggaccgatcagcggggaggttaaggcgacaacgacagatgccgaaggaatgattgcggagggacgcgagattgctaaaattcatccgaacatggtagtgaaaattccgatgaccgcagaaggattaaaggcggttaaagttctttctgcagaaggagtaaagacgaatgtgactttgatttttacggcaaatcaggcgctgcttgcggcaagagccggcgcaagctatgtatctccgtttcttggacgtctggacgatatttcggtggtaggagcagagctggttgaggagatcgtggagatgtttgctgtttccggaattgagacacaggttatcgccgcaagtatacgcaatccaattcatgtgacagagtgtgcgcttgcaggggcagacattgcgacggtaccgtacaaggtaattgaacagatgacacatcatccactgactgatgccggaatcgagaaatttcaggcagactacaaaaaagtatttggggaataattctcccgaaagacaaagacaggaggcattgtcatggacaatttagaattacagaaaacagccaatgaagtccgcaaaggcattgtgacagcagtttatagcgcgaaatccgggcatccgggcggatctttatctgcggcggacatctatacatatctttattttgaagagatgaatattgatccaaaggatccgaagaaagcaggcagagaccgtcttgtcgtttccaaggggcatacgtcaccaggatactattctgctctggcgaacagaggattttttccggtggaagatttaaagacgttccgtcatgtaggttcctatttacagggacatccggacatgaagcacattccgggggtggatatgtcaagcggctctcttggacaggggatctccgcggcagttggaatggccatttccgcaaagctttccggggatgactaccgtgtatacaccttagtgggagatggtgaaatccaggaaggccaggtatgggaggcggcaatgctggcagggcacagaaagctggacaatctggtagtaatcgtggacaataacaacctacaaatcgacggggcgattgacgaggtcaattccccgtatccgatcgacaaaaagtttgaagcgttcaatttccatgtcattaatgtagatggacatgattttgattctttgagagcagcatttgagggggcaagacagaggaaaggaatgccgactgccatcatagccaagactgtaaaaggtaaaggggtttcctatatggagaaccaggcgtcctggcatggtgttgctccgaatgaggaacagtataagatcgcaatggaagaattagagaaagcaggtgaagcattatgtcagaagtaaagaaaatcgcaacaagagagagctacggtaatgctttagtggagctcggaaaagagcacgacgatgtgatcgtactggatgcagaccttgcgggtgcgacaaagacaggaatttttcagaaagcatttccgcagcgccatatcgactgcggaattgcggaaggaaatatgatgggagttgcggcaggtctcgcagccacaggtaaagtgccatttgcaagttcatttgccatgttcgcggcaggacgtgcttttgaacaggtgagaaactccattggatatccaaagctcaatgtaaagatcggtgcgactcacgctgggatctccgttggagaggatggtgcgacgcaccagtgcaacgaggacattgcgctgatgcggacgattcctgggatgactgttattgtaccatccgatgatgtggaggcaaaggcggccgtgaaagcagcctacgagcatcagggaccggtgtacctgcgatttggtcgtctggccgttccggtcattaatgataatccaaattacgaattcgagatcggcaaggcaattactctgcgggatggaagcgatgttgcgatcatcgccgctggtctggaagtaaatgaagctttagtggcagcagaaaggctggcagaggatggtattcaggcagaagtcattaacatgcataccattaagcctttggattcagaggcagtcttaaaagctgctgagaagacaggaaagattgtgactgtagaggaacactcggtgatcggtggacttggaagtgcagtctgcgacatagttgctgagacggcatgtgcgaaagtaatgaagattggagtcaatgatgtatttggagaatccggtccggctggggaactcatcaaaaagtatgagctggacggcgagagcatttataagaaagttaaagcatttgtagaaaaataaatcataacagcaagaagagcgcaacctgacgaagcgctcttcttttatccgttttttcattcggtgcattgggacacatctcagttatgcagagcaatttccatttctttgagacctagctttacagacctgcatctcattgcgttggccttatgcgaaccagtaaccgctgtaggtgtatttgaagacacggtaccaccatgtctcgccgcttccggtcagggtctggatcaggttgtggttcctgtcaaattcgctggtcttgaacttgcttccgctgttaataatcagattgccgccggtctgctgtacagagctgacatatcccgaataggtgaccgggagactttccaccagcttaaaggtaccggcattctcatcgacgagatatttatagtagtaggattcgtccccctcggtaccggaatacgttccattgtaatggtcatccgtagtgtaatcgtagtcccgggtactgatagtagcattgttgttattatacatcgtcagatagtattgtccctgcgcgagctcatcggaagtttcgtagtctacgcagtgctgtcccgcctggagagtaaaatcgccggattgggaaagaagcaggttttcatatccggtaccctcccagaactgatcggaactgatgaggtaatccacagatggattgtcgtaaatgccactgatcttgataatactggatgtctccctggaactaataatcagcgtatcgtctcccgcaagacagagagaattaatatgcatccagtccagttcgtcttcctcgtagtcgatggagtgaaagtactcctcaaagagatccgctaggtcgatcagttctgtgaccaatccgtcctccaggctgacacttacgatccggtcctcttccgtgttggaagcagtgtccgtggcgaggacgagaagatcattctggctgccaaaaatataatcgtggtgcagcttgtaatcatccatttcgtagagagcggtgatctggctgtcagcgtcaagggccgcaatttcatcagcagaagtactgtaatacatggtatcctcatcgaaaagcaaacggcagcttcggtaactcttgatggggatctcacttctaagcgtgccgttgttgtcatagacaaggataaaatccacttgctcattgtcttcgccgctgcggttgccaagcatcgtatagaggccatctgataaagcttcactgctttcgccgtcggtaacggtaagctgggcattttcggaatcaacgagaagttccggcgctgtgtagctgagggtgagtgtttgggtcttggctccgctttcgtctgtcgtagtcaatttgattgtgttcttggttcctgcaatcacaccgatgatctgatgttcatgctcgatttcatagccgcctgccgccgtctgcgtaaagtcttcacagccatcggcagagatagtgtaggagaggagagttggggtatctgttgtaaaatatagataaagtccggtcgtgttggtgccataaggatctgcaatgataagaggatcttccaacgtatattccctctccgatttcagatcttcaatctgatcagagatatcggattgatattccagtgtataaatggtgtcaatatcctcttcgaaatccaatgtaaggattccctgattttctgcctcggaagtcccggaaggggtggacgcatcctcagatgttccgtttgaactgaaacaggcagataacatccagccgcttaaaaaaagcaaggaatgatagaaaagtgtctggattttactttcacaaatatcacctccactactatgttgcgataagtttgtgaaagctttgaaattaattcctgaaatttttgtgatttttaaaagtcggcaggaaggcggagtggatgatgacaaacaccgatcctgcgttatgtaccagggcgccgacaaccggatttaaaattccaagaatcgccagaacaattgcaaagaaattcagtgccatggaaaaagtgagattacatttgattgtaaacatcatttttttcgacagagcaatcagatgcggaagctcacggatgtcgtcatttacaagggcaatatctgccgcgtccacagcaatatcgctcccgataccacccattgcaattcccacaaaagcctttttcagagatggggcatcgttgattccatccccgatcatgcagaccgggagatgttgctcctgggagtgttcgatccaggaaagtttttcttccggcaggcagttcgagtaaatctcatcgatgtgcagaagcgtaccaatgtgtgtggcggcatttttgtgatctccggtgagaagaaccggggagatacccgtagcgcggaccgcatcaatggttctggcagcattttcccgcagggtgtctgacaaaacaagaaagccggccgccttgccggaaacagaaacataaatcacagtacatccctcatcccgataggaagaagtttccataagaagtgtttcgtaagagggaatttcgtaatcctccataaactgcccgtttcctgccaataccgcctgcccatttaccacggcggagacgcctctgcccggaatcatctgaaaattttccggtgagacggaaagcatttcctcggttttctggaactgggagacgacggctttgccgagaggatgctctgacctcagttctgccgctgccgtcagacggtataggtctcgatcggaaagttccggaagaatactgtggacggttttcacgtggagattcccttccgtgagggttccggttttgtcaaaggcaattttttttaccatggaaagacgctccagggcatctccctcgcggacgaggaaaccatgccgggtcgcattcccaatggcagccatgatggcggtaggggtggcgagaacgagagcacacggacaaaatacaaccagaatcgtaacggcccggatgatttctccggtaaaaagccaggtaagagccgcagccaaaagagcaatcacgacaatccaggtcgcaaagcggtctgctaggccgacgatcttcgcttttccggcatcggcagactggacaaggcggatcatccgctggatagagctgtcctctccgacttttagcgctttcatatcaaaagagccgtaaagattgacagtaccgcttgagacctcgtctccggcgctcttgtctacgggcagggattcgccggtcattaccgcctgattgatcgaagtcgttcccgaaagaatctcgccgtccaccggtacggtttccccaggcaggacacggagatgatccccgaagcatacgtcgcttgcgggaatcatctccgtaccaacaggagtcaatctgcgtgctgtccggggcgtgagatggataagtttttcaatgccggcgcgcgcccgtgagaccgtcaaatcctccagaagagctccaagctgcataataaaagcaacttctcctgcggcaaagtcttcaccgattaacagtgaggcgataagagcaagtgagacaaggacatcagccttgatgtcgaatgttatcaccagtccgataatcgcttccagaacaattggcactccgcacaagataacggaaatccaggccagatcaaaaataaatggacggatctcaaaaagacttgcgagcagtgctatcagggaaatgatcagtaaggtaatgtctttttttataccgccccattccagaatacgttccagtgctttcataaaatatcttttctcccttccttacctctgtaggtatataataaaaaaattatacctataggggtataggttgtcaagagagaaaaaaggaaaacaatcgatccagaacggcctcccaattaatcacatgaaaccaattatcgatatagctgctgcgtaaattatgatatttcaggtagtaagcatgttcccagacatcaagtgggagaagggggtaaaaaccacaggtaagcggattgtcctgatttgggagcgcgatgattccaagagagctgtccggacgcacaaccagccatgcggcgccggagccgaactgtcccagggcagcggctttcatgtctgcgaaaaactgttctgccgaatcatagtaatctagaattgcaggagcgatatcctgtcctggaggggccatcagatcaaaatagagatcgtggctataagcccctcccccattattgcggatggcagtctggagcggttccggcagagatccaagttcggttagaagccttgagagagtccaggaatggtactgtgggacattctgaagtgcgttgttcagattatctacataggtttggaagtgtttgtcgtggtgcagatacatagtctcccgatcgataaacggctccagggcatcataagggtaggggagcggtgggagaacaaacgggtatgtcatttctgtgatcaatctagtatacctccttgtgtgttctattggtaatatagtcaactgcagagaaagaaatgacaaaaactcagatatttttcagatcatattggcaaagcgctcaaccgcctttgtaaactttgaaattgtctcatccgcatcgccgtgctcaattccatcccggacgcagtgctggatatgtccttcgagcactacctgccctgctctatgaagagcagatttggcagcattgatctgagagagaatgtcctcacagggaatgtcttcgtcgatcatccggtcgatcgcctggacctgacctataatcttcctaagacgtcggtgaagattttgggaatcaatacattgtttcatgggaaagcctccttcactaatactcttacaagaatatgtattttattattatccgctgaaatgagaagggtgtcaagtcaggccggatagagattgtaaattttcgatttttaaacaaaattatgtgtaatttgttttctcttatggtataattctgttaaataaaaacgaaaggggcgtttcttatgaagttgatttttgcggttgtacatgacgatgatacgaataaagccgtcaggcacctgaacgaaaagagataccgggttacaaaattatccagtaccggaggttttctgcggaagggaaacacgaccctgatgattggtgtggaagacgaacaggtggaggaagtctttgagatccttcaaaaagagtgtgcgaagagaaaacaggtggaggtaaccactccgtacccgcagggggatctttccatgattagttactcttacattcctatcacagttgaggtcggtggagccacagtatttgtattgaatgtagagcagtttaagaagatttgatttgccgtacacaaaagagaggcgcaaagttgacaaaacatgtcccggaaatacaaaattcatgaaaaaaaccggaaggttcgtgcaaaatgctacgagtcttccggtttttttagattgcatgtcggatttttcttgggaagctctgacataaaccgataaattcggcgtttccgctatgatatgatgagaaaaaatatgaatatgaggtgagaatatatggaaaaacagtttccaaaaaatgtacggcagataggaaatgtatgtgacagccccaaaatttatgtagaagattatgtggatacatttctgaaccagctttgcgataaaatggaggaagagccccagggtgcttttctgatcggtgaaaaaggccaggtagaggaccaggactgtgtatacatatccggcgccgtcaggatatcggaaattgtaaaaaatgaaagtaaacttaatattccggaggcggctgtagaagccggtatgaaagactgtaaggaatatttcggtaatcagtctttgatcggatggtttctgatcgatccatcccgtgtcccaggtactgatgagaatctggaggcgatccataaaaaatattttgctgaagaaaacacaatttttattatgaaagatccaaaagaccgggatgagaaattttatgcttacaaatatgaagaactgatggagatcaacggacattatatttattatgagaaaaatccggaaatgcagaattatatgatttcctcccgaaaagaaaacaagattacacccagtgaatctattacagatcgagctgcgaaggattttcgtagtatcgtaaaagcaaaacttgaaaaggcagaccagaagcagaataatcgtttcctgtacgcagccagcaccttcctgctcattgtgattctgatcatcggagtgacaatggtaaacaattatgataagatcaaagcggttcagacgtctattgatcagattacaaagactgtggaaaaagcggaaaatgaaaaagaagcacaggcagcagaaggcaaagtaacaacacaggtggaggaaactacagaggaggaaaccggtaaaaccgatacggcaggaacgactcagacaccggacacagacagcaatggagaatactacgttgtgcagcgaggagatacgctcgctaccatcagccaaaagctctacggtgacacctcccatatcgatgccattgcccgcatgaacggactcacaaacggggatttcatctatattggccaaaaactgctgttgccataagaaaaagtatgttatgataatcagaaatagaacagtataaataaaatacaaaggggaaagcaagatgaaggataagaagcaggagtcgttccatgtcatcccacgggtggatgtcccggacctttccggaaagagaagctctgtacggatcagacggaaacctgtccggaagtctcaggtagaaacatggaccgtaagaccttctattgagacaccggatcaggaagaaaagattcctgagaagaagagaaaaccattgagtgtcagagcaaagagaaccatccgcaggtggatcgtcgtaggggtagtgacggcggcggtggccgtggcgtacctgacgatcacactgcagacttacacagggatcgaggtggtggagcagatacaggaggcgagagccgggaacagcttttatgtaaggtacggggagaacattttaggttgtgacgcggacagcgtttctcttttcaatctggagggaaaggagctttggaaagaaagtattcagtttcagaagccaatcatggaggtgagcagaagttccgccgctgtggccgagctgaggggtaatgagattgcggtattcggggaagacggcttgagaggacagataaagacgatactcccgatagagaaaatggctgtttccagccaggggatcacggcggtaattcttgaaaatggcggagcgcccgtgatacagtgttttgatgtgtcaggaaatgtcctgattgagtataaagtgtcagcggctacaagcggctatccggtggatcttgcattgtctccggacgggacgaaacttcttgtctcctatatgatgacacagaacagtgaagttgatacacagcttgcctactatgattttggaaatgagcataaagatggagattaccggatcggaggcggcacttatgaaaaccagttgatgccgacggtatttttcaattctgaagagcagtcggttgcggtgggggacggaggattcgtcatctatgacggagccgagccgaaagagaagaaaaagattagtattgacaaggagatccgaagcattgcttacaatgaggaatatctggcgtttgttttggccgatgagggctcttccggcagcgagctgcggttttatgattacagtggtgatgaggtggtatcaaaggaattcgagggtgactatagtaacatgaagattgatgacgggcaggtgatactttttgatggtgagagcgcgagcatctttacagaaggcggtattcaccggtttgaaggtactgtgggggcaaatatcaaagacctgtttgtcttgaaagggatcaataaatatttattgatgagtgacaaaggaacacagacagtacgcctgacaaaataggagaacagcatgaattggttattatatggaacgataggaattctggcggtcggagtgattgtaggatatatgaagggggcgctgaggattgcgttatcccttgctgccgcagtagctacgtggattttggttgtgatacttacgccgtacgccgcggatgcggtcatccagtatacccctgtggacgactggattgaggagcgatgcgaaagcgttctgacggcaaatatgacggaggcgttgagagaacagacggggatcgagactcaggcaaacggtgaagaaaacttggatctttcggacttgatggacaggctttcggacatcgaggtatctagacaggagcaggctgagatcatcgagaattctaatataccggagattttcaaagaatatctgcaggaaaataataataaagaaatatatggtatgattggagcaaacagcttcgcagactatatcgcaaaggggatcacacatttggttgtacagattctaacggcgatcgtactcttcctagtgatttcgatcgtactcaaaataatgatctacatcctggatgttgtatcgtggcttccgattattggtgggatcaaccgggtagtcggagcagtccttgggtttgcaatggcgttgattttggtctggatcgtctttctgatttttacgatgctttatacgacacaggcaggacaggaaattttcagacagatcaatggaaacgctttcctacgatttttgttccagaacaattatatattgaagattcttatggggcttcgctgatacgtgaagcctcttttataaactttctaaaatattcatgcataaaaggaaggcaactggatattatatgacctggaatcaataaaattctctttgggtaagaatgttcctgctcgtatttagttgagatagtttgattgtatatatgaaaaagaaggtaatgattccaaaatacagctcagattcgtggcttgcgctgtttttcactgcatacacagataagtctccgttttttgctaagcgccatatgtcttgaaacaccgaaaatcttctacgggcaaaattgcgacagatttttagtatttcaaccgtgcggatgactagctataaaaagataaaaaaagtcgaaaaagaagttgacatttataagcacagatgatatgatataacacgttccgctgataagtgtcagaacaaaacatcaaatgcagatgtctggcccgggcggatcccggatagagagaccgggacgccggatcagaaaactggaaaaaagatgaaaaaaacacttgacacagaggaacagatgtgataatctaatatagctgtcgcgagacagcgctcagaactttgataataatacttcctcttttctctgtaagatgattatatcttattagccacttctgttacaactttattatagcacttcactatctggatcagttactggaaagctatgtagaagttcaggaggaaagatggacaagaatccggaatctggatattctgttaagtgaaaagaagaaggaggctaatttggagaacatccggtttcagattgaagcggatgtcctccaaagtctcccattcaaggagacagaaacgagtgttctctttggaaatcttctggacaatgcgatagaagcatgtaaaaagatgaagacagaaacaagatggatccgggtggaaatcagacagaggaaaggatttctgttttttacgattgctaattcgatcgggaaacgtccgcaggaaaaggatggggaatttgtctctgataaagaagacaaaaaagttcatggttatggattgaaaagtatccgacgtattgtgaagaaatacgatggatcctttcaatgtgatgtagtagaagaagaggtcaagatctcgatttctttttccaataagtaaagagagaataggagagaacctatgaaagaaaacaaaaatttagaatttgcaggagatttattggttgagatgcaggaagtgcagaaaataaactgttcagataatgtagtagacagaggaagaacatatacacttcaatgtacagcctttttaacaatcttttgctgctagtcaaacaaaacaggatgttctttggaacatcctgttttttaaaaccaaggaggtgtaaaagtgtcggatacctatttatcagaacgtatttatcaaaatatagattccagtaaaccagaaaatgtagaacggacgcagtactggaatcaccttctgggagagacgacggtgaaggaactccgggaacataatagggcgtttgtgatgtatctacaggatgctccattcgaggaaaaacaggaggtggacagaggattcctgcacatttcgtttcaagaagaaagaggaaatacggattccgttcgcagagagatcggggagaaaaagctgttctttgcagaattttataaaacttttttaaaaattggaaaacgtgagttggaaagcagatggagtgggctgggagaagaagtggaggaaatgttgtatgaagcatttgaagatgtactggcgattcggttacagaacattgcttttcgcacactgattgctgaattacattcctacaaacagaaaggaaacttgagcggagaaacttctgaacaggagtatgagagcttttgcaagatttgtggaagccgtgagtttttcggccatatttcggagacgtatccggttcttatcagatgtctgaaagaatgtacagaaaagacgatctgttattatgaacaggtaatgcgatgggtcattgaagatcgagagagtctgtcctgtttgtttgggaaagagaaggatttggggagtattgtaaaggtagagtccggcctgtccgattcccatcacggcgggaaagaggtattaactatctattttgcaaacggaagtcagatcctgctcaaaccacgttctatggaaaacgaacagttttatcagaaattactggattggatcggagagcgaacagggacagatcagtactattatccgattttgtccggcaaagatcatagttggtgccagattgtggaatacaagccgtgtaattcggaggcagagttgcaccagtattatcaaagacttggcgaacagctttttctcgcctatctcttgggaacaaatgatattcattttgaaaatctgatcgcctgcggggcatatccagttttgatcgatctggaagccctggttcataattccagagggcgaagtgaggagtctattcgggatacagtacaatcccatctctgggagtctgtattagctaccggaattctcccttcctacacatggaataatgagggagaagggattgatggaagcgctattcacagcaaaaaagggcagaagcttccttttaaaattccaaccgtcgcaaaaggagagacctctgaaatgtatgtcacttatcgggaaggccattcctcagaaggaaaaaacctagcccatgcaaaagagggaatggaagatctggtgctgtatgtgaatgatattttggagggattttccacagcgtatcaagccgtggaaaaagaacgaacgatttttgaaaaggagcttcggaaaggaacagagattcaaagccgtacagtgttgatgcatacacagcggtatacgatgctgctgaacagttcttaccacccggcgcttttaatggacggagcggatcgtgagattttcttgtctgctattggtcagggacgatgggagcaggacgaggaaattgtaaaggaagaaatcggttctctgcttcggggagatatcccatacttttcctttgctatgggagagaaggatttgtcggcggatgggagaatttgcgtgcggaatctgtatgacaaaactgcctgtgatcggatcgtaaagcgattgcaaggtttatgtggcaaggatcgaaagaggcaatgcgattttattcagacgtctgtggaattgattccggaaaacagaagtggattttctaataaaatttatcccgcaagcaagagtcctgcaaaaagtcaaaaagatatgatccaggaaaatataaaagagctgactgaacgactttgtgattatgcgatatggaatccccggagaacagaagtgagctggtatgcacttcggtttgcaagttccggaaattatgcatgggaaatagaaccgatgggcgtctatttttacgatggatggagcggactgttacttttgacgacaatgatccaggcaaatcaaaaattaaaacgggttgaagaaatccagacagcgttgaagaagcaggtctttcaatacacggacaacgggctggtatcattgaatcatttacagtctcaaaataccggagcatataccggggaaggatctttgatttatgcttatctgaatttatatcgactgacaaatgagaaagtatacctgcaatatgccgttagacacgctggaattgtgtcgcaaattctggaagaagattcctgctcagatttattaggaggaaaagcgggagcggcatgggtgtttctgcaactctatcaagagacacaaaaccagaggtatatccaggaagcggagcgcgctatctgtctgatgttgcctcaaatgattaagactgagcgtggagttggttggaatccggagagtgtcgatgtcccgatcggaggaatggcgcatggaaatgcgggaattctgatgccggtccttgttttatgggaacttacaaaaaagaaagagtacggatggctggcagaaaagatctgggaatacgaagagtcgttgtatcgggaggagaccggaaactggatggatatcagggatcatagcgatgagggggaagataccgttgcatggtgccacggggcagcggggattttgttgtcaagactctggtgctacgaaaaagttaacgattcaaagtggaaaaagcgtttaaaaaaagatatagacagagcgtatcagaaaacgtccgcgttctggaaacgggacagttggagtttgtgtcatgggaacagtggaaatctatggattctgaacctggcagatcggatgttggggaaggagagaaaagagaggggaaactatgaaaaaatccggcttctcccacaggaaaggatgaatccaggactaatgggaggatatgggggagtattactgcatttgttagttaaattaataagataaaatttaatggactgaaaaaatagaatcatggtcatgaaattgacagataataatgcggaatgtaaaatttaactataatattaagaacggggaatgatagatgggaagaggaggagaagccaatggttttgtaaagaaaggtaggataatgggaacgagataaagaaaggagatacaatttatgaaaaagaagtttagaaaattttttgctgtagtagcggctacagttatggttttagcaatgggaatggtatcagtaaacgcatctgatgtacagccgagaggacctctctgtccttgtggaggaacattactgccatcgaagtcttattctacatgggtaacatataagtcagtaaaatgtgtgcatggatacgcatatggcacagatcagcatcaaaaaagaacagttactactacaatgaagtgtaatcgatgtggtagcgggtatacgacgggaacaactacagaaacacgtgtacaatgtacaggacataattagtctttgaagggaatgtactcaaagtggaattattgggagacagagaataaaaacagaatactgttgttacaaataacgaatgagtatatttttagaagattctaaacgttttttattaagccatgtattttctttgaaagcaggaatacatggcttaattaataaaagtaacaagaagaggtgaattattatgaaaaatatagcgagaagaactattgctttaggatgtgtaggactacttttagcaggaatgagcggatgtgataagacaatagagaaaaaagataaaattgtattaagagtaattacagatccatcaattcagaaagaggtgaacagtatagcggattttatggagaaaacagaagagatagaagtaaaagtggaggtacttcctcttcaagagagtgggcgagattctgagattcagaggcttcagacacaaattatggcaggaaaaggggcagatgtttatttgctggatacgagtccagatgcagcagagatgaaaacggaactatttgaaaatccatatcaaacgatgcagagtggggcactggcaccattgaatgaatatatgaaaacggattcctattggaatgatacgacatataataagaatattttaaaagcagggcaatatgaagggaaacaatatataattccgattacttgttattattatgtattatcggggccaaataatgttgagaagataacaggagatactttaaaagaatggctggaacaggcagataaactggataattctgaattaaaaaaggcaattaatgaaagcctgtatttaacatcagggcggtggtttcaacctgcggtagattatgaagcacagcaagttttatttaataaagggaaatggaaggcatttgcggaatcttacttatcgcatcagcaggaaagaatgatggatgcagttaatgacatagagaaccaatatcaaatacagccgatccgttcatttataggaggaaaaggaatttctgccaagattattccggatttagaaggaagaagaatggcatctgttatgacatatggggccgttggaatgtccagtgatcacaaggagaaagcatatgagtttttaatgctgtttttaaataataagatgcaagaagaaagaaacgaaaatgtagaacaagtcctcaacggaagtgctggaatcacagtagagaaaaagaaaattagtaattggttgtccgaccgctctgaggaaactatttcggcagtacaagaaagttttgaagaactggatggagcatattttataacggatgccgaaaggacattaatatcgaatatccgggagacagtagaatggggagtagaaccgacaaagggatgggaaaagtttttgtcggatttggcagataaagtatgggagcagtatgagatgcaggttaaggagtagtgatgaggagatcgaaccgaattttatgttttgtagtatgtatactctttaaatgaaaactaatgacctatcagtgtaaagaaagaagcgtttcttgttaaaagttaggaaagatgctattctatggatatcttgatcggcgtttttgaatctgttccggatgaatatttaggaggagaaaaactggatctggttaatctctttttattgtacgggggttctcctcgatatgagcatcgagtttttatattgtcgttatcgggagacagtgatgcatcctgatatatgagagaggtgaaaaagattacggcttcttgttgtgtttgggaatactaggggggattttatgagaaaaaccgttcttacgcttgctttttttattatattatcattgagcttatcgggatgtgatgaaaagaaggaagaaaagcctgttctgacaattttgacagaaagggagtatgaggaccaggtaaaggtagcacgtcatggatttaatgagaaatatgatgatgtggaagtaaaaattcagacgctctctgaggaacctgaaacgagagaaacacagattcagaagctaagaacacagattgtagcaggaaaagggtacgacgtatatattttaaacaatttacgctatggatccggagagccgttggatgaactgcctttgtttgacaatccttataaaacaatgcaaagtggcgtcttttcgcctttaaatgataatataaatcaggatagttactggaaaggaacaagctactttgatcctcttttaaaggctgggcagtatgagggcaagcagtatattcttccactttcttttgagtcagagctgtttctatcaaatacagaggggacaggaaatctgaatgggaaaacgcttttagaatggttggaatacgccgacagctcgcaagatctggatttacgggggacgatggcgcagcaagctttacatgtgaaggggtggtatcagccggcggcagattatgagaggaaagccatactttttgacgaaaaacagtgggcggatttttttgttttaatggaacaattctgtacagagtatttttcggaatcggtcgactggtatggtgaaatgacagtaaagggtattacgaatgaaatcaagagaatggaaattgtgccggatttgcaagggaaccggataatggaggttcaggccttcggagccgttggcatgtcaagtgacactaaacaggacgcataccggtttttgatgctgtttttgaaccgtcagacagaaggattggaagatggaataggagggcgtgataatccggctgaccaggaggccataaagtggatgctgaaaagatcaggcttatctgatgagacgatagaagggacgatgaagatactgtcacaattcaatctggcctatttttccacggaaacagaaagtatgctacagacttctgtagatcaagcggagcgggagaaaagatgggaggtcaccaaagactgggaagattgtaaaaaaacaggtgcagaaattgcggagaaaggacgcaggaactacgaaacacaggtgaaagagtaaaagcaggggaaaaacgggtaagcgatatccataatcgtttaactgacagggacaaaggaaatagagatgattttgttaatgaactcaccaaaatgtaaacccccggatggtagtccgagggtttttatttcttcacggtggaatcacgctgaggttagtggtaattgccgtcgctgtctaatcatttgatgataaaaatccaccgccatcctttccaacagagggagggttgggatcttattaagtaccccaataactcaaaaaataatttgtatataaatgatttttattatgtagatgtaaaatttaaatatagaaaagatattgacatacataaatagttagttaataatagtataaatagaacaatataacacttaattatgtagataaacaagatttacctgaaaattattagagaattaggaattgatatatggaatataagtggcagactggcaccatatataaaaatactaaggaggagacggtaaatgaggaacaataagggaataagagtgttagtaatttgtgtatatttggctttggtaatgactggatgcatgggggagaagcacacggataaaaaggcaacattgaccgtacttacggaacaggcatttgaaagtacagtacagatgcgggcgagcgcaatggaggatgagaatgaaaatctggatattcaggttgaggtattgcctctggatatgacaatccgtgaaaatgaaattcaaaaattgcaaattgaaattatggctgggaaaggaccggatctctatgtgctgactgctcctatggagatgtcaacagtggaacctgatttgttcgataatccgtatcagattatacaaagtggtgcgtttgccccgttggactcctatatggatgaggattcctattggaaagagggaagttataaaaaagaattcttggaggttgggaagcatgacggcaagcaatatctgcttccctttacctgctcctattacgttctggaaggaatacaggatattgatattctagaggggaaatcgcttggagaatggctggagtacgcaaaacaatctgaaaatctgccattgagacagtgtatcttagagggactgtcacaatttggaggacgctggtttcagcctgcagtggattatgagacaggacaggtacgatttgacaaggaaaaatggaaacaatttggtgaaacatattttgtgacactgaagaaattccgggagcaagaacaatataccgaaaagccgacgtaccgaatcagccatatgaacgaagtggatttgagcagcgaggaaacccattttcaagtgatgccggatctggatgggcgaaaaatggcggcggtgtccgcttatggtgcggttggtatgtcaagtaataagaaagaaatcggctatgactttttgatgggattcttatataataaaacagaagatgggaaatggacagaagaggcaaaattacagggaatcccagtacaggagaactgtcttaatttcatgcggtttccagatgaacagatagaggctgtacggaaaggatttcgtgagctggaaggagcgtattttattacgaatgtggaaaagaacatgcgggatgcgctggtagaagaaaatcaagtgggactgccggaatgggattcaaaggaatttgtcaatcgtattgctgaacaggcatggacgggctttgaaatccaagtgaaggaataaccgtatagggtcaggagattaaaaggttttaaacccctgatataaatttgtaaaaagttatatatgtaaattgttgaataagtatatgtaaaatttcttgttataatttgtacacgaatatataatatatgtaaggaaaatgggggatttgtttttggaagataaatataaacatttggaaatgatacaaaatattatacaaagaatggctactaattcttttatgcttaaagggtgggcggttacgcttatagtagctatttttgctcttgcagacaaagatatgaatcagaattattttgggcttacatatattccagctataactttttggtttttagattcctattatttgcagttagaaagaaaatttaaaatgctttacgatattgttcgacagaaggcagtagtggagtttgatttgaatatacaggatataaattataagaagacaaaagataaaaaattaaggtatttaaactgtttatttgctacttgcgagtggttattttatatgccgttaatgataatattgacatttatatttcaaaagtcgatattatcatttctgaaatgataaatagcagggaggatgaaattgtgaaaagtacatgctatttttcgtactgttgggataattcaacagaaataatggaatatctaaaaaaagaagtagaaaaaaagtctggggggaaagtacaagttattttcgataaaaaaagttttatgtgttctgaagattttattaagagagaaaaagaaataatttcatgtgattctgtagttgttttcttttcaccagagtataagaaaataattgataaaggggacataacaagaggggtttatcgggaatatcaactgatcaaatctaagttgaaaaaagaagaagattcgattttggaggttttgattaaaggaactctaaaaacggcagtaacagaagatttcagtagcaaaatagcggtagatctttctaaggggaatgtcattataaaagcaaaaaacgggaaaaaagtagttaatactatgtataggacagaaatgactaatttagtatcaactattataagcaaaacattttcagcaagtagaagaaaagattatgattttaaatcaaaagaagaaatgtatgaaagtttgttttgtgatacgaaatctaatggtaaattgccaaaagaatgtatgttcaaaacaaatgcatatacaagtataatgtctcagagatgtacatttattatcgggagaaaaggaagtggaaaaactactttttttgaaattcttgagaagtatgatgaaggagaagttaaattcgcagataaatataaaatattaaagcctattagtgcggattgtattgatatatatcaagtgtattcagttttagaaaaatataaagatgatagaagacttttttcaagatctaaaatgttgcagttgttttggaatgtatacatctatttgtgtggtatatacatagtctgtctggaagaagaagagtgcaatatcaatgatgataggcagcctatctttcatcaagtgggaaataaactgaaaaggatttttaatattaatagttttgaagaagataatattcaggaaactatatttacacaatgcgtgactttttttgaagagttcattagtaaatatatcatagattatgcgacaccagaggcatttgaggcctctatggtagctaattttactgttcaaaatgtatttagaaaatttttaggaaaaaaactgttttcaaattttcaattagctatagcaagatgcaaaaaaaggattatgattgctttagatggatttgatactttaagtgaggattttcgtatagagacaaatttcttattacaaaaagagaatgaaaaagatagaatagaaggtgaaaaaagggcggaatttgaaagactattttatagaagtatggttagagctgtagaaattatgaaatgttcaaaagatccattagtacaagatatacatttttgtattgttttacctaaagataggttggatcaaattgaaacggcagatcgggatatttctaaagttaattttacagatttatcttgggacgcaattgagttgctggaggttgtagttctcagattagaatatatttttagtattccccatagatcagatatggacttatgggaaaggctttcagttataatgaagaaacatctaccggcgatacctgaggaggtaggtatagagatcaatggagcagtgataaatattcccctgtttgaatatctgttaagggtatcattttggagaccaagggatattctgaaatattatgctttattatacaatgctaatcagaatatggctaatccagaagcgaataagattgatatgcaaacaatcaagctgattataaacaataaggctgatgatattattaaaacagaatttctatatgagtatgataaggtgttcctaaatattagtaaagttttacttgaatttaatggaaaaaatattattttaacaggaaaagagttatttgatgtgttgtcaaaggtatcatttattacgacgtttgcatttgactgtgaacagatacttaacaagattagcttattgtatgaactaggggtgttgggactgaaaattcctgcaaaattgatgagaatgagaggcataggaagtgaatggtgcttttcgtttaatgagggcttaaagcctttggaattattagaatatggattttcgccaaaaaatactgagattaaatttgtattaaaccctatttttagtaaaaaattggcattggtatttaatactaatgaggttgtaggcgtatttggcaaggaatatcttgtagataatcatgcaaggaaaatggcaattaaaagattttagtaaattgtcattggcgtttatttaggaggaaaaacagatcatgcatgtattagaagtaaaaaatttaattcggaattatcagaaatcagcacagaaaaagagtggggaggatatcaaggttctgaaagggctgaattttgctgtagatgaaggagaatttgtcggcatcatggggaaatccggttgtgggaagacgaccctgctgaaagttctgggtatgatcgacaagcaaacagacggagaggttttctttatggaacagaatacgacagatctttatggggataagctggcggatatccgaaggacgcagatcggattcatttttcaggacttctatctaatggatagtctgacagtagaagaaaatatcatgctgccgatgatcctggggaaagagaacgtggaagtgatgacaaaggctgccgcaaagtacgcggagcagtttgagatctcccatctgctgaagaaaaatccatacgaactgtccggtggggagaagcagcgggtggccatctgtcgtgcgctgatcaatgatccagacctgatactggcggatgagccgaccggaaatctggactctaaatcagggaaaatcgtaatcaatgcgttgaaccggatcaaccgggagtttggcaagaccatcgtcatggtaacacatgatccgcagatggcaagtaattgtagccggatcatcctcttaaaggacggagtgatcctggataatttggagcgcggagaggatcaggaaaagttttatcaggaaatcatcggccggatggcggatttataatatcagaaattatacagtatacgacgggagatggtgtacgtgctgaacagcatctcccgtcctttctgtggggcggattagagattcgtactcatatcataatcttgctgaattccttacagaattctttttgtctcctgtttccggtgcttcttttttctgctataataataccggaaaaggaggaaaacaatgagttttgtacatttgcatgttcatacagaatatagtttgctggatggttccaataagatcaaagagtacgtggcaagggtcaaagagcttggcatggacagtgccgccattacagaccacggcgtcatgtacggagtgatcgatttttataaagaagcaaaaaaggcagggatcaatccgatcctggggtgcgaagtttatgtggcgccgggatcccggtttgaccgggagaccggacacagtgaagatcgttactatcaccttgttttgttggccgaaaatgaagagggctaccacaatctgatgaagattgtgtccaggggatttaccgaggggtactattataagccacgtgtggacaaggagatcctcagacagtacagcggcgggctgattgcgctgagtgcctgtcttgccggggaagtacagaagaatctggtacggggactctacgaagaggcaaagcaggcggcctacgaataccaggacatttttgggaaagggaatttcttccttgaattgcaggatcacggtataagtgagcagcagacggcgaatcaggggcttttgcgtcttgcaaaggagacggggattgagctggtggcgaccaacgactgccactatacgtatgcggaggatgaaaagccgcacgatattctgctctgccttcagacagggaagaagctctccgatgagaaccggatgcgttatgagggcgggcagtactatgtcaagagcgaagatgagatgcgggggctgtttccgtatgctttacaggcgcttgagaatactcagaagattgctgatcgatgccatgtggaaatcgagttcggtgtgacaaagcttccgagatacgatgtgccggacggctatacatcctgggaatatttgcagaagctttgctttgacggattaaaggaacggtatccaggaagtccgcaagagctcgtagaccgacttggttatgagctggagacaatccgcaccatggggtatgtggactatttcctgattgtatgggattttatcaaatacgccagagaccacgagattatggtggggccggggcgtggatccgcggcgggcagtattgtggcatactgcctgggaatcacgaatattgatccgatccgttacaacctgctttttgagaggttcctgaatccggagcgagtaacgatgcctgatattgacgtggatttttgtttcgagaggcggcaggaagtcatcgattacgttacaagaaaatacggccccgatcgagtagtgcagatcgtcactttcggtactctggcggcccgtggtgtgatccgggatgtggggcgcgtgatggatcttccgtatgcttttgtagacgggatcgcaaagatgattccgacggagctgaatatcacgctggaccgggcgcttacgatgaacccggagctgaagaaagtttacgagacggatgagcaggtgaaagagcttattgatatgagtaagcgtctggagggtctgccaagacatacatccatgcacgcggccggagttgtcatcagtcagaaatccatcgatgagtatgtgccgctttcccttggctcggacaattctccggttactcagtttactatgacgacgctggaagagctgggacttctgaaaatggatttcctgggattgcggacactgactgttattcagaatgccgcgcggctggcggaggacagtacagggaaacctctcgacatggcgaagatcgactacgacgacaaggcggttttcgactccctgtgcagcggacgcacggacggggtgttccagttggaaagtgccgggatgaagagctttatgaaggaattaaagccaaggaatctggaggatgtgattgcggggatttcactctaccgtccggggccgatggatttcattccccagtatgtgaaggggaagaaccatccggatcagattgtgtatgactgcccgcagttaaagccgattttggagccgacctacggatgtatcgtgtatcaggagcaggtcatgcagatcgtgcgggatctggcaggatatacacttggaagaagtgacattctaagaagagccatgtccaagaaaaaaggcgacgtcatggaacgggagcgccagaattttgtctatggaaatccggaagaaggggtgccggggtgtctggctcgtgggattgatgaaaagacggccaataagatttacgatgagatgatcgattttgccaaatacgcatttaacaaatcccatgcggcggcttatgcggttgtttcctaccagaccgcatggctgaaatactactatcctgtggaatttatggcggcgttgatgacttcggtaatcgacaatccgggaaaggtggcggaatacatctattcctgtaaagaaatgggtataaaactgcttcctccagacataaataaaggatacggaaacttttctgtagatgatggcagcatccgctatggacttgcggcgatcaaaagtattggaaaaccagtaattgatgatatcattgctgagcgggagcgaaacgggctgttccagaatctccgggattttgcggagcgtatgtccggaaaggatattaataagaggacgattgaaaactttatcaagtctggggcatttgactgttttgacgggacaagaaaacagcacatgatggtctatatccagattctggatcagctcagccaggagaagaaatattcgatggcaggccagatgagtctgtttgatattgtggatgatgagcagaagaaggagtttgatatccggcttccggaagtgggagaatacgagaaggagacaaagctggcctttgaaaaagaagtgctgggtgtttatgtcagcggtcatcctctggaggagtatgaggacagatggaagaaatctatcacagcaacgacccatgacttccagtacgatgacgagacagggcacaccaaagtgcgggacggagccaaggaaaccattgggggtatgattacagcccgcacaatcaaatacacaaagaacaataaagtgatggcgtttatcacgattgaggatcttcttgggactgtggaggtcgtcatcttcccacgggactatgagaggaaccagcagtatttggaagtggacaggaaagtctttgtaagggggcgggtgtccgaggaggacgaaagcgccagcaagatgatctgcgagacgattattccgttcgaacagacggaaagcgagctctggatccagtatccagataaagcatcttttctccaggaagagcagcttctttattccatgctccatatgagcgagggtgaacagaaagtgtttatctattgtcaggcagagcatgccgtaaagcagctcccggcaggacgaaatgtagaaatttctgaggaactccttggcagattgacgaactattttggcaaagagcggctaaaagtagtcgaaaagtcgaagatataggaaagatattgaaaaaccaaattaaatagtttagtatattacatggttagaatattcacaaaaaaggcacattcagggatcagggaacgacctaatggaggtaggaatcatggcaaaagaaatcagaacagttggtgttttaacaagcggtggagatgcaccgggaatgaatgcggcgatccgtgcggttgtaagaacagcgcttgggaatgaattgaaagtacgggggatccgaagaggatattcaggacttttgaatgaagatattattgatatgactgcacgggatgtttctgatacaattcagcgtggaggaacgattcttcagaccgcaagatgtcaggagatgtgcacagaggaaggacagcagagagcagcggcgatttgtaaaaaatatgagattgacgggttaattgtgattggcggagatggttctttcaagggagccagagcgttgtccaatcttggcgtcaacacaatcggtattccggggacgattgatttggatattgcgtgtactgagtatacgatcggatttgatacggcagtcaatacagcgatggaagcgatcgacaaggtacgtgatacgtccacatcccacgagcgctgcagtatcgtggaggttatgggacgtgacgccggttatcttgcgttgtggtgcggaattgccaatggggcggagagaattctgcttccagaggagcatgattataatgtagataagattatagaggacatccggttaaacagaaagcgtggaaagaagcactacatcattattaatgcagaaggtgtaggaaattccgttcagatcgcaaagaccatcgaggaggctaccggcatggagacgagagcaacgattctcggacacatgcagcgagggggaagcccaacggcaaaagaccgtgtttacgcatctatcatgggagcaaaggcagtggatcttcttgttgaaggaaagacaaaccgtgttgtgggctataagcatggcgagtatgtagactttgacattgatgaagcgctgaacatggaaaaagggattccgcagtaccagtatgatattgcgaaagaacttgcgctttaattacgaaagatacaaaaaagcagggaatttccctgcttttttgctacccatatctgtaaggggattacaggtggttttgccccagaaggatttctacttgaaaagcaaaaagagaaattgtacaatgataagacagaaggtaaaaaggagacaggaattgtgaatatcaataaaaagacggatccgatcggcgtatttgattccggggtgggaggattgacggttacacgggagattatgcggcagcttccgaatgaaaatatggtatattttggggacacagccagggtcccttatggaagtaaatcaaaagacaatattatccgatacagccggcagatcatccggtttctccagacaaagcaggtgaaagcgattgtcattgcctgcaatacggcgagcgcgctggcgttggatgtggtcaaagaggagacggatattccggtgatgggcgtgattgccccaggtgcggcggcagccgtgcgtgtcaccagaaatcagaagatcggcgtgattggaacggaggcaaccattcgaagccacatgtattctaaagtaatggaggagatgatgccaggggtggaggtaattggtaagccatgcccgctttttgtcccgatcgtggaagagggatttgccaagcaccatattgcggaggaagtcattgattactatctggcatcaatgaaggaatcggatatcgatacgatgattttgggatgtacccattatccacttctgcgctcacggattatgaagtatttgggggatggaatcgagcttgtaaatcccgcgtacgagacagctatggagctgcgtaagcttttaaaaggaatggatctgttaaacgaaggaggaagccgcggcaaagaaacaaaaggggaggaacagaaagggcctgcatgcgcaaacggctcttacgagttctatgtgagcgatacggcggacaagttcaagcagtttgccaattccatccttccttatgatatccgcacgacacagcgaatcaatatcgaagaatattaaaataaaatcagaatacgatgtagaggacggcaggaactggatatggaaagagaaatattactgggaattacaggaacacagtgggagatgttggatgatggaggacagggaccgaaagatgctgaggcagtggaaatgcttacttctgctgattatttctttaaaaatggaaagcattatttcgtgtatgaagaggcgtctgaaagcggcagaaaatctgggaaaagtaagatcaaaatcacaggagaccgaagtgtagagattatgaaagcgggagagatgcgagggagccttttttttgagaaagataagcgcactctttcctgctatgagacgccgtacggacaacttcattttggagtgtggacgacgggaattgatctggatgtaaaagaagatgagatttttgcggaaattcgttatcgaatggaaatggaggatcatccgatggcagactgttgtgtaaaaatacacgcctgtactaaaggtgaaaaatccgctcagatggtaaaagcgatgatagagcgccaaaagaaggaattgtctgaggaatgagaagcttcgggattcattaagagtatatggaggaaaacatatgaaagaggcaaaaatgacggaaaaagaacttgactgtctgacgataccgggattttccaaagatgggaactggtataaaggcaatcttcacagccataccattcattcagacggtcatttgacgccggaagaggcagtaaacatatacagaaaacacggttaccattttctttgtttttccgaacatgatctgtataccgattaccgctcccaatttgactgcgaagattttattattttgccgggaatggaggcgtccgcggttttatttgagtcgaaatcctctccttttgggaaaaaggtacaccatatccatgggattctcggtacggaagagatgcagaagcaagcggctctcccgttatacaaccatatggaaggccacgctgtcagaaaatattatggagagtgggacggtgcgggtgtagctcaggagcttgcggatgagatgacttccagaggactgatcgctacatataatcacccggtctggtccagagtgcgagaggaagaattcattcatacgagaggaatctgggcgttggaaatctataattacggtacagagaatgaaagtgcgaccggatatgatgaggccaggtgggatgtgatgttaagagaaggaaaacagattttcgcgtttgcctcggatgacaatcacaacaacgaagaggtggaagacacgtttgggggctatattgtcgtgaaagcacctaagctttcccacgaggagatcgtgaaaaatatgctggccggaaattattattcttcctcggggccggagatctatgactggggcatcagaaacggtcaggcgtacataaagtgcagcgctgtaaggcgaatagactttattacggggaatcgtatcaatgacgggaggtctattttaagcaaatctttggaggagacgattcaaacagcagcctatctgctgaaagggcacgaaacttatgtgcgtgccgtctgtacggatcgatacggaagaaaggcatggagtaatccgatttttctggatggatggcagtaaagaatacaagaattgaaaaatcgccagaaccgacatgtgccggaactggcgatttttaatgagcatccttttcgtgctctccttacggtttttatttcttttttgatttggaagcattctccattgcggctttctttgcggattccttcgctcttgcgagaaatccttttttcttcttcggcgcctcaagaggacctctcacgcctctgactgctgtgatgtagataccgcttacagttgctttgacttccttttttacaggaatcagcggaaatactttgtcatcacacatgaacgtcataatcttcggtccgacttttgcctttacgacataaactttggatcggcgtaaatattttggcgtgctttccagtacaatagaagggaaaccagcctctttgagtttcatgcgtcccttgtctatgacaagtatggaaacggtctgtgccatagcgtcgatcttttcctgctgttcttgctgctttttctgggcacgcttgccaagaaaataaagaacaatcagagctacaaccagaataacaagaatcacgagtgatacgataaaaaacggactcatctgaataactctcctccaatcttttgttacacatgttgtattgtagcattgtttccaaggaagcgcaagtggtttaaaggcagttttccgggagtttgcgtcttcgtttgcggctgaatggttacggtactttttgggtgggttgcatcttttttttcgtacaagtataataggggcaggaaacgaggtgagaaagcatatggaaatgttatgggatattacaaaagcattgtttctatggattttggataatctcgtcttcatcaacattattctgtccatcctgattattttctttcagcggagaaatccgacggcagtctggacctggcttctggttctctatttcattccgatcgtcggtttccttctctatttggtagtaggccaggactacagaaagagcaggatgtttaagatgaaagagatcgaagacgaaatcaaatatgcggtaagaaggcaggaggaatccatttacaggaggaagctgaggctgaagacgcccgagatggagcggtttcagagtttgatcctttataatctgaatacggccgaagccgtgttgacggacaataatgatatccggatttttacagacggtcgggagaaattcgatgccctcatagaagagatgaaaggcgcaaaaaattatattcatctgcaatattacattattcgagacgatgagctttggaaggaaatcgaggagatactgttaaaaaaggcggcagagggcgtggaagtaagggtgctctttgacagtatgggatgccggaaaatgcgggaaaagtcatggaaacggctggaaaaaggcggcgtggaggtggccgagttttttccggcgtttctgggacagttccagtttcgggtcaactaccgtaatcacaggaagatagcggtcatcgacggcagagtcggttttgtgggcggttttaatatcggaagagagtacatcggactggacacgaaaaagttcggatactggagagatacccatctttgcatcgagggatccgctgtgacttccctggcagtccgattcgttctggactggaactatgcggctaaggagaatctctttctggaggaccggctgtttgagattccggagtacgaacgggatggaagatctcttgttcagattgtatctagcggcccggactccaaatatgacagtgtccgtgataactatttgaaaatgattcaaatggcagaacatcatatttatttgcagacgccgtatttcattccagatcaggcaatcttggactctcttaaaatcgcagcaaagtccggcgttgatgtccgcattatgatcccttgcaagccggatcatccgtttgtttactgggccacttactcttatctcggagagatggcggctgcaggcgcaaaatgctacacatatcagaatggctttctccatgccaagacattgacgattgatggacttgttagctgcgtcggtacggccaacatggatatccgaagttttcagctcaactttgaagtcaatgccacaatctacagcgaacggacctcacagaaacttagagacgcctttgaaaatgatatgcttcattgccaggaagtgacagaagaaagctatcggcaaagaggcctttccataagaatccgggaacagatctcccggctgttctctccgcttttgtagttttcattggcggggagaccggaacgaaacgaaagagatggatgcacgtcaggtcggagagatgccttgtcaaaagagtggaagtatgatataaatggtaggagataacagcaaaggagaccggggagaatgaggaatagaaaaagcgctctgattgccggagtgtgtacaatggcgtctgtattctggctggcaggatgcggaccgaaagagattgaaaatgaatatgtcaaaattaatcgatatacagggcttgaagtgaatgaaataacggaaagcaaggtgactgacgagacggtagattctcagatggagcagatccgcgggaattatgcgacgtacaaagagatcacagaccgtccggctcagaaaggagatagggtaacgattgattattctggaaaggtggatggggttgcctttgatgggggtacggcatccgcacagcaactggaattaggagcgggcggatatattgatggattcgaagatggaattgtaggacattcggccggagagacttttgatattaatacgacgttcccagatccatatcagaataatccggacctgtccggaaaggatacggtctttacaatcacgctttctaaaatcgaggaagtcactcttccggaaatgaatgatgagtttgtaactatggtaaagggagaggatacgactgttgagcagtatacgaaagagatacgcgggacactggagagtcaggctgtagttcagaaccaatccgataaaaagtcggtgatcatagacgagttgatgaaacatgtggaactgcttaagtatccgaaggacaaggttcagaaatataaagacaaaatgactgagcagtatcagcagattgcgacatccctaaatatggagtttgcggattttttggagcagtatatgggaatggacgaggatacttttaaggaggagctggattcgcagatcaaagagtatgtcaaacagcaggaagtgctggatctgatcgcgaaggaagaaaagatcactgtttcagagaatgagatcagcgagtggctggatgagaacgcacaggcgcagcagatgacagtggatgatctgaaaagtcagtattcagaggacgagataaaggatcagacgctggcgaacaaagtgatttcctggttgtgggacaaggccgaggtgacaaagagcgattcagctaaagaataaagagatcagaaaagggcacggtagttttccgggggaaaattgtcgtgttttttctgtttatagatagaagatccttctggcatcttggcatccgcatggaaattcattggcttcaaagggaaaatcagagtggaaaagaatgaaaatcacaagaatctgttgcgtaaagtggggaaacatatgataatatgaagtaaggagatgaatcattccatgggctttcggagtcaggtagagtggtttgaccggattaccggaggcacaggaaatggctgaagaacaatgcatggaaagttgagtgggagcagatatgaaagaaagtttaaagttggcagtggagctggccaagagaggcgaaagcgagggaatcggtacggtctaccgggaaacctgtgcggatgtctatttccgggctagactgatgatgggaaaccggggtgaggcaagagagctggttcgtcaagtctatctcgttgtattccggacgatcagcactctgcaggatacgacgaagatggagagatggctctatacagttctttataagcttggtgaacgggaatgtcgtaagaaggggatcattctggaagatgagaagacggctccatcctgggaaggacaggaggcaccggagacgccggcagagcgtcagcagattgtccggattttaaagtccagttacaagcagattggaacagcgggacggcttgtctgtctggcgcattactacgagggatggagcatggaagagctttcccgcctatggaaatgtccggtcgaaaagttgcggggaatcctggagtatgcgagaattgagctgggactcatgtgtacacaggcaggatacctgcatgtggatatttcctttgatatgatggttctcatgtttgagcttttgagagaagacgcggaagaagagatccgacaggccagactgggaaagatctatgaggatctggtagaaaagctcgagatggaggacggggatgagccggccgaggagaaatccttctttcgaaaatggttcgtgatgattattgttgcggcagtcgtcctcatcgggcttgcggcggtgggcggcaattaccttggcaagatggtgacgagtagggaacatgagcaggaggaagagcaggtagaaagagaggagaagaaggagtcctcctggagtctgaaaaactataaaggagcatggtgtgacgaggcgaatgtggagtcggaagtgatgtccacagacggcatgtgtgaagtcaagatcaagagcgcggcggatcagagagtcgtctttgatatcagaaaaacctacggaaacgatgaagattatgtgttccggggagcaaacgatgtgacgggagtcgtaacggataagatagcttcttttactttttccgatgaatacagtaaccggatggaggggacgattgagttccaggacgaggcattaaaagtagtggttaagagagcgtccggcgggcagtctgaggggctgacggctgagatggactgcacgatgaagaaagatccgtattccgatacgagaacgaagccgcagaaggaagaggaggatgaagactacatcttcccagaaagcgataaacgacttctgacagagagagattttgaaggtaaaacaaaagaggagcttcggtttggaagaaatgagattttcgcgaggcatgggagaattttcgagacagaagatctgaacgcatggttttcgtcgaaagaatggtacagaccaaaatatactgcaaatgaattttcgcaatatgtgcagctcaatcagtatgagagacaaaacaccaatctgattatggctcaggagaaaagagcggattaggaatgaacttaggacaggactcctgcatatgtatgtaaaaacgacatatgcaggagcttttatggcagtttctattatgctggatgccggacatgggggaagagatccgggagcggtttacaaaggaagacaggaaaaagacgatacacttcggatggtactggcaattggagaaattctggagaacagaggaattgatgtacagtatacaagaaccacagatatttatgagactccataccaaaaagcaatggaagcgaatgaggccggggtggactatttcatttccatacaccgcaattcgtatccgattgacaatgcggtatccggagtagagagtctggtgtatgatctttcgggtatcaaatacgagatggcggaagatatcaatgaccagttggagacgatcggtttcaggaatctgggtgtgaaagccagaccgaatctggtggtgctcaagcggacaaagatgccggcagtcctagtagagcttgggtttatcaattccgacacggataatcagctctttgatgaaaattttgacgccatagccctggcgatcgccgaaggaattcttgatacgctgatgcaaaatcctgttgttgacatggacagcgtcccggatgtcatgccggagctgactccggaagtggaaccggaagaagaagaggcaccgccgcgttatcacattcaggttggagcctttagaaatatggaaaatgccgaacggctgaaagaagaacttctggcagatgagtttccggcctttgtcaaccgcatcggcccatattataaggttctggtggggcagtttacatctgttgacaatgctgcaagcacagaacaggcgctgcgaagagcgggataccagacggtggtcatttcgggagactgatcccgtaagaacccgatacaggaatgaaaaagaaaaggagaaatacagatggcagacagactggaatttcagggaaaacttggatggattctggaggaagcaaaggagcatgctaacaggatccagaaagaagaaatcgaaagatattttgagaatgatgatttaagtgacgaacagatggagcttgtatacgactaccttttgtctcagaaggtagccgtatcaggatacgaaagaaagcatggaagagtctatgcggcggaagaaaaagaaagtaccctgacgcaggaagaacagacgtacctacagaactacgagagagagcttcagacgcgagtcggcgcagaacagggaagttttctgccatttttggaacgtgtgctggaaattgcaaaagagcttcacgacggaagcgtctttctgggcgatctggttcaggaaggaaatgtcagcctgatgcttgcgcttaaggagtcaggagaggaagagaagattctgaacgcggttcgtgagggaatcgaggcattccaggaggagcagcgggacgtccatgtccgtgaccgcaagatggtggaaaaggtggacgagctggatggacagatcaaaaagctgaaagaggagatggggcgcaagattaccctggaggaacttgcgctctatacagacagaagcgaggaggaactccgttcggtattaaaactggccggtgaggaagtagaggatgccaacgaagagggttaaatcattaccggaagtgcgaaagctgcatttgggaattggcaatataaaaaggagaaccgggagtatcccaagatttgtgtaaaccttcaaactgatgtaagatagacttaccagtttggaggtttattttatggcatcagctctgcccggagtaactaatgacatatcttatatcagttttttcgagtttacacaaaacttgaaacggtctcacgcattcatgtcgatttcaaaatggattcactctcaatgttcttttcaacagtccggaaagcaaattttgtgcgtgggtttgctttccagacatatcgcattgatgcacggtcaatgtacggggttatcggttaaatagcacatcgcacaagtatagtgccgccgagagttcttgatggaatggcgaaaaggcgtaaaaacaaaaccatctgcggagcgaccgcataaaaaacaaccaacgggtactctggcgagtcgttgtaaacaagaaccagatagtgccaagcatgacacgaaaaacatcaatgcaagccggggtaaccggcttatcggaacatagcgcaatggtagagcgcacggcttatatccgggtggttgtaggttcgagtcctgctgttccaattttgaactttgataattgaatattgatggttgggatggtataattttctcataaaaatagggaggagattatatgtcacaaaatataattagatatgaagcaccgggatttatagaaatgaaaaccgagagcaatgaggttaaaaaatacgatccagattgttctcatactgtgtttttggttcaaaaagcgtataagcctggagaaacaataaaaattgatgttgataccaacgagtatgcagttgaaggcgaatatgaaatcatatgggaagtaaatcttaactccataaaaggtggaaaacattatgaatattgcttcactacccaagacatcggaaagcgctttagaatagcttgcaaaattgtttccctaaaaaataattggcatagacatggaaattacgacgattcaatagatgcctatataaatgttattccggaataattgttcaccaaccatcaaatattcggtggttggttttttattgcctgaaagtgaggatagaggatgaatcctgttagatttccagaacataatagtgtatttcgtcatcctgattgttcagacctgccagctcttcatattcacaatgagaagttcgacacagatgaggtggtctcctgttgggagtttaccgatgaagaactggtgcagattttgaaggatgtgcaggacggtaaacgtccgcagatattcttgtcagtgattggcggtcagccgccggtggcactgaatatgagaggtgaaaagaatgagtgatttgagaatatttacaaataatattgaaccagaagccttgagtcagatttacacgctgattaagcagcctgcatttgcggactgcaaagtgcgtatcatgccagatgtacatgccggaaaaggatgtgtgataggatttactgctgatttgggaggtaaagtgattccgaacatagtcggcgtggacattggatgtgggatgttgtgctgcgaaatcggtaaaactgatattgattttgcacgattggattccgttatcagagaacatgtaccggcaggacgggcagtaagggatgaagaaattccgtttgcacagtttgatgatttgtattgcaaaggccagttaaagaatgtggactggctaaaacacagtcttgggacgctcggaggaggaaatcattttgccgaagtagatgaggattcagacggcacaaagtaccttgttattcacaccggcagcaggaatttaggtaagcaagtagcagagatttatcagcaaatggctattgatgatatgcaaggattgaataaactggcagaggaaagccaaaagctgattgaggaatacaaagcgtctgggagacagaaagatattcagaaaggactttccgaactgaaaagaaagtggcagccggataagttgaatatcccaaaagagctttgctatcttactggcgaacatagagaaatgtatatgcatgacatgaaaatttgtcaggagttcgcaagaattaacaggagagcgatacaggatattatattttattatatgggatggacgttttcgagaagcacgatggaacgatttcagacaatccataattatatcgaccatgacaccaacattgtccgcaaaggtgcgatttcagcaaaggcaggagaaaaactgcttatcccgataaacatgcgagacggctgtatcattggcattggaaaaggaaacgaggactggaactgttcggcaccgcatggagccggacgcattatgagccgttcaaaggcgaaggagaatgtcccactggaggaatatcaggaatccatgaggggaatttacacaacctcagtcaatcagtctacgattgatgaaagtcctatggcatataagccaatgggtgaaattattgaaaatatcaaagatactgttgaaatcttaaagattatcaagccggtatacaattttaaggcgagtgagtaagcatgggagaaattaaaaacggctggtattactgcccccacgggcacaaaacagcacagaaaatagagaaaaattcaaacatggaaaatacgccgatttactgcaagcattgtagacgggcgtattatccgatgattaaagatgggagtgttcaaagctatggaagcacaaggaaagttaatggttaagtgtaaaatatgtggacgaggctttccacctaacattgaatcgcattataaggtcagagatatagaggtaacagggctgtccacgattaacagaaaagaagaggttaagcattatgacgcttttgactgtccgtattgtgggtgccaagtaatagcacaggagcgaaaacatagtattaaataattatagagccagagctaacgagccagagccgattaacctgtaaaagattacaggttgtcggctctttttttgtttaaggagagatttcagtgatttcaggtaggaacaaaagaattatcaatgcgatacaaaaactgaatccagaatacgaaacgctcaatgacctctttggcatggcacgggctgtatatgaagaggacaatgcggaacttccgtactgcttgaaactgacaaagtacgtgaaggacatgcttgtgtgtctgtcgccggcggataatctgaatgagctgtactggaatgtgcttcactgggaagcgccgttcctgtttgagagtttccttctgtatatggagaaaaacagaccatttaggaagaaattctatgagcccagggcgaaaacactgaaagtagttgtggatgatcttcaggacttggaagatggcgtgattgaattttatggattgtccatgccaccacgagtcggaaagtcaacgatctgtatctttttctttgcatggatttgcggaaagcgtccagccagtcacaacgctatgagtggacacagtggcattctggcagacagattctataacgacatcataaaactgacggacaatgaggaatacacattccatgagattttcccggatgtacgccttgtgagtaaatcttctgaaaagaatgaactgttctatgacgatgtagagagctttgccaccgtaacgtgccgtggtattgacggaacatggacgggtgctgttgatataagcggtgatggttatctgtatgtggatgaccttgtgagggaccgtaaggagtcattaagtccacggcggcttgaaggacgctatcaagattacctcaatattcttgttgaccgtaagaacgatggttctaaagagctgatggtcggaacccggtggaatgtgatggacccgcttggtcgggtagagaaagagtttaagaatgaccctcgctatcgtttccgaaagataccagctctgaatgaacagggagaatctaactttgattatccagtaaagggcttctccacaaaatattatcaagacatgaaaaagaaacttgataagaacgagtgggaggcgaaattcatgcagaacccgtttgtcagagaaggtctgttattcccagaaggctcattacggtattacaacggggtgctgcctgaaggagatcacagagtggcttctgcctgcgatgtggcatggggtggcggtgacagcttgtcaatgccggttggctatgaatatgagaacaaggatgtttatattccatcctggatattcaacaaagggaagaaagaagctacattgccacttgttgttgggaaaatcatgggagagaagattcgtcaaatccagtttgagggaaacaacggtggggatatgtaccgcaagtatgttgatgagaaattacaggagatgggctataagtgtagctgcactgataagaaagcgccgggaaacatggagaaaatggcgaagattatcgcctattccgggtatatacagcaacatttcgtttttcttgaaccaaacttgcaggacgaagaatacagcgaagcaatggacgagctgtgtatgactgtacagatcgggcagaatgagcatgacgatgccgcagacgggctgacacagcttgcaatggcacttgaaggtgaattatatgctcagtgtgaagcgatggagaggccgttttaggaggcatttatgagagaagaatcttatgatattggtggttatcaacgactggcagtggcagttgtaaaacaggctgttacagattatgaaattgcgctgaaaaagctgaaacgtaacagaaaagatatatgggcatcacagatgcgtaatgattgtgagcgattttttgaagacgaaatatcaatgtatacagatattgatgggaaagcgattatgagcgcaatcaaaaagagagtagggtggtaagcatggatagatctatcttttcaaggtacaagcggaataaaagagagcttgtccttcttgaaaaagctattgagaaacttgaaaatcgtttggaagatgtaccaatcgtaaacggaaaagtttctggatcatcaaagaattttccgtatattgagactcatatgaccgtacagatggcagagccaaaagcggcagatgagataagcgcaagattaagagataaggtagtgcgaagggatgctgtcctgaaggaagttgctgaagtggaagcatttatttctaagatgccggatggagaaaagaaagaaattttcagtatgttttatctggatggggtttcgcaaagggagattgcagatagtgttggctatacgcaagcgagggtatcacagatcataaacacggtctaaaaagatttatcacatttatattttaggtgtggtatcattataatgagaaatcagacaagaagccttgtgcgattaatttcgcatggggcttttttgatgcggaaagtgggtgagcaggtggcaagtttatggcatgagaacagaaaagcctttcacaaagtctgtcgcgggcattatgggcgaaaggtgatatacagcaatgtaagagaggttaatcgggcaaatgtccttacagtaaggggaagtgcgatgacgattcataaccagaaccgtagagagattgattacctgtatcactatgttgccggagatcaaccgattctgtatcggacaaaggatgttcgcccagaaatcaagaatgatgtggttgaaaatcacgctttggaagttgtgcggtttatgaccgcccagacctacggcgaacctattcagtatgtaagcacgaaggataagcaaggattatctggcgagattgacaagctgaatgattacatgagggtgcttgataaatcattctacgatatccaaattggagactggcagagcacttgcggtacagcttatcgggaagtgtggagcaagcgccgggatgaactggaaaagaatgaaccggcaatggggattgactgtgctgacccacgggacaacttcattgtgtattcttcaaggcatggacacaaagctcttgcttcgttttcccggtgttgggatgagaatgacgaagagtattggctgtgtacgacaccgaaaagagtatttgagataaaaggtgagaagattgtaagcgatacaccgaacgggcatgggcgaatccttcttgtggaatatccgaacaatgtgcggaggctgtctgatatagaaatcaccatcacaatgacagatgctattaatcagattcagtcaaaccgtgtagatgggatagagcagtttgtacaggcttttgtgaagtttgtaaactgtgagattgatgaagatacgttccttaggatgtgtaagattggggctttgaaagtaaaaacagtgaatccttcattcccggcggacgttggcatggtatcttcacagcttgatcagcagcagacgcagacctcaaaggacgacctctacaagaatttcctcatcattcaagggatgccatctagagagcagaataccggcggtgatactggacaggcagtgtacttaagaaatggctgggatttcgccgagcagagagcaaagattgatgaacctgttactatcaaggcagaaaaagagttccttcggattgcgctgaacattcttaagacgaagcagcagatttccgaggaactgaccatctccgatattgacgtcaagattactcggaataatacggacaatatgcttgttaaatcgcaggcattgatttatctgcttgaaaaagggattcatccgaagattgcaatacgaaccgttggactctggagcgacccggaaaaagtttatctggaatctaagccgtatctggatgccaagtataaggtttcggaggatgacctagaaacgcagacaaagcaagcagaactgttcgtgaagtacctcaatgccgggttctccccggaagaagccggagaaaaatctggtatgggaaaggttgacgcttcaaaaaacccaagttttcagaagtggtcgtatgatggcggagacggcgaggaatagtggatgtatgagtacataggcgaaaatatagaaaaggtgaagaagcaaacacaggcggcgttcaacaatttcaggctgactgtgttgaaattcgatgagcttaatgtgatgagcgttaagacggaaacagaaagccttttcaagaaattgaagcggcagagcgataagttctactctggtctgattgaatatctggcagaacagaacggatttgaagctgataagtatgatctggatgaactgctggcgacatacagcagaacacttctgtatgctttctcatcagagatggaacgtaaacaatctcggtactttgaaacaattttgtccattggagatttgtcagacccggaaattctggttcagcagaaaaagaatgtccgaaactggaatatgcaggtagaagaatttgcagtagatatggagaggacgatttttcttagggaattgcaagattccggcgtgaagcgagtccaatgggtaacggcacaggatgacaaggtgtgtgctgaatgcgctgacttgaatggaagagtattcgagataggcaatgtgccacgcagaccacatattggctgccggtgctggctgaagggagtttagagatgattcataaaacaaacactgtgaaatcacagaggagtcgggatgacccagcgaaagaaaagaaaccaagaaaaccaagttatctgaaagacagaaagacttcaagcggtgtcacgtttggagtgtaactgtctttttattttgcaagttcgagcgtaagaggacaggaactatacggagcgcaccgtgttaaaaaagtgtatgttctgaaagaaaaggagaaatcgaaatgacaagagaagatatcaaaaagagctttccggatgctacggaagagcagattacggcgattctgaatatcaacgggaatgatgtgaaggcatggaaagataaggtgccgaaaaaagcagattatgatgaactggttcgtaaggctaaagagtatgacaagttagaagaagccggtttgacagacgaagagaaagtgcagaaagccttaagagaagcggaggatgcaaaagccgactttgcgaaaaaaacaaatagactggatgcagaaaaaattctcgtagccgcaggactggcagaggaggattacaaggatttgattgacggcattgtgtctgatgatgcagatacaacaaagtcaatggcaacaaaccttgcaaatctgattacaaaacagaaagaatcagcagtccagaaaaccaaggaagagcttatggatggaacaaatacgccgggaggttctggcggtggcgggggagctgatgacaagacagacgcagagaaatttgcggagtctttggtaaaagataaaggatctgatgcggaaagcgcagaggacattatcggaaattacaagtaggaggtatgagattatggctattcaggctatgggtaacgaaaatattacagtggcggatgaggtgaatatactgaaacgaccgggatttgaagcgattccgattacacttgattctacagcatttagggatggtgtttgcaaggcaggggcgccgattggtgcaggtggagtgattaagaacgataagaattgtatcggaatcctgcttcacgacgtgccacagacaagaccgcaggggacaatcctgaaaaaagcatatgtccgcaatgatgtgattacgaaacattacggaacggctattgccgatgcggcaaaaacagcacttcctatgatcgtgtttgaataagggaggtaaagaaacgatgattaacctgaacgaagtatatgattcagcggccattgccgtatatacgaaaaatgacaagagtaacagcattccagatcttggtctggcgttctggccgaacaaaagaaagacatctattgatctaaaatggattaaaacagcgaatgggctgccggtgtctcttgctccgagtaactttgatgcgaaggctactatccgggcaagaaaaggattcggcatcaacaaacaggaaatggcgttcttccgtgaagcaatggttgtttccgaacatgacagaatcgagctggcgaagctgtctgacatgacatctccgtttgtgaaagatgttgtcaacaatattttcaatgacacaaagacactggtggatggtgcaaatgttgttcctgaaagaatgaggatgcagctcctgttcccagaggctgacggcccatctatctacatttccagtgatggagtggtgtatcagtataattatgatgctgatggtcagtgggcgaagaacaacagaaaggttttgagtgggacaagactgtgggcgaatccagagacggcgaaacctcttgatgatattgcgaaaatcatcgaggatgcaaatgagccgattaaatacctggtaatgtcccaggcagagcttacgcttctgaagaactgcaagcaggtacagcaggcgattcttgcgcagaatccaactgcaaatgtttatatgacaagccagcttgtgaagaacctgatttccgacctgcatccgggtgtggaagttgttgtatacaagaaaaaatacaaggatgaagcaggggttacacatccgtttgtgccagatggatttgtgacatttgtacctgaaggaaatctcggaaacacatggtttggtatgactccggaagaactggcgaagatggaagcgaaggatattgatgtgacgattcttccgtctggtgtggctgtcgcagtagttactacatatgattccactatgcagacaatgacggttgttgcggaaacacttcttccgtcttatgaaagaatggattctgtgtaccttctggaaacaggaactgtagatgatgctacagatggtgaaatcggagaactggatgtaacaagtggtgcaagtgcttcagaaatgggaaaaacagcaatcactgttgatccggaacttacggaaggaaattcttaccgctataaggtaggaaacaatgtgaccattccggaatacggagcaaacgtacggatgtacagtgcatggaacggcgaagatgaaatcacagcagaaacaggcaagaagattctgatcgtagagtgtgatgaatcatacggagctgtgaaagccggaattgccacggtaacagcgaaagattcataggagtgatagatcatggatattcagggtgaagtatatgcggatttggtgtctgaactgaatctaacaaaagagaatgataagtcggctatgcttgtgaaagtgaaaaatgctgtccgggaggtgaggaaccggcggagttatccgtcgcacttcaccgaggaggacattcagaaagaccttggtgtactttactcgaatatccgtggactggctctatacgattataaccagattggagcagaagggcagagcgcccattcatcaaatggaacatcgaggacatggaaagacagagaggattgtctgaaaggagtttttgcatgggcaggattctgaaaagaaaggttcggtgatccaatatctcccggcggcagggtaaagccgcaatttagtcttaggctagtcattgattagtcataggattagtcaaagaagattgtgcgtggtgagaaccgcagggtgcgttcggtattggtggtgggaagagcgtaaaatctcgtttaaaattattctcttttatcgtataatagcggtgaaaggagagtgaaggagatgtgttcaataatatatgatcttatcattggattggtgacaggaggtctgtctggagggtttagtggatggttggtaacaaagtattatcgcaaacaggatgacaagagagaaggcgttgcgtatattcgtaatttaaaaaggagaattaggtgtatacgaaatatgcttgtgttaatgaaaaattgtgatgatgatgaacagcgtatgcagtacttatctgatattgagcatgaattagacgatgaattggcttatgaagagagatttggattagatgatcagaacaaaaaattttctgatgaatgtggacagtgcttaaaaaatctaaaggatgaccttaaacaatatcgtacagataaaagtactattgcaaatcttgaaaaaacaaaacatcctgatgtttcatcatcggaattattggccctaaaaacgaaaaacaagagttcttatgaaaatttatgtgggtatgcttcagtattacaagatgtgattttgaagtatttttaagggagtaatatgcgttcattaaagaaaaaccaacgacagctctggtacgcattgtaccgagacaagattcctattgtggatgaaaatggagacgagaccggggattatacggcagggtatagtccgccggtttctttttatgccaatttatcaccggggaaaggttcagcgcaggcggcagtattcggaacagatatagactttacacggtctatatcaacaacggatatggacttgccgattaccgagacatcccttgtctggtatgagacagagccggttcttctggaagatgggacggcagacccggattcagcagattatgaggtggcggcgcctccggcagatggtctgaatgaactggtgattgcattgaaagcgagggcgaagaacgcccagtaaggagagaacatgaagaaattatttatttcacagcctgtgaaaggcaagtcagacgaagatattctgaaagaaagagatacagcaatcaggaaagcagaagcggtagttggagaacccgtggaagtgattgattcatttttccagaacgcaccggcagacgcaagacccctgtggtttcttggaaagtcactggaactgctgtctactgctgatgtagcctatttcgcaccgggatgggatgaagcccgtgggtgcaaaattgagcatatgtgtgccgtagaatacgggattgaccgtattgaagagtagctatgcaaaggtataaaacgggtttatccgcaaaaggcttccgtgaccttgcgaagaaagtccgagagtatcgtaagagcctgccggataagtgtgaagagttcgcttatcggttggcagaagagggtgtggcaatcgcccagttaaagatacttagctttgacgctgtgatgaccggggagcttctgaacagtatgaatctggagccaggagacattgtttccaatggagcttcctattatatatacacggattgtgattgggcggctttcgttgagtttgggacaggcgttgtcggaaagtcaaatcctcatccagatacagggcttgcgaattggaagtatgataccaataatcacggagaagccgggtggtggtacttcaatgatggagaatggcactggacaaaaggtatgccgtctcgtccgttcatgtatgagacagcacaggagttgcgggatatgagcgtgataatgaacattgcaaaggatgtgtttggaagtgattaatgttgagaacagggtgcttaccaatgtaaagacctatatttctgatgtttgtcagaccgtgcagaatgacaacacgaaattccccatttcattcccagcagtcagtgtggagcagattgacaacccggacacggcggttgatttggagaacactgaaaatgcggtggtttccatgattgagattcagtcgttttccaacaagaatatcacggaagctaagacgatcatcaataaagcctgcgacgctatgagaatcatgggctatgagcggaagtatggtccgtcaaaggtcacgaacgccgcggacaccaatatctatcgcatggtggcaaggttccgtagaatcgtgtcatcggtggatgaaatagagaagtttgaaaccaagggagcttaacagctctcttttattatgcaccggctactgcaagaggtagtcgctaaccggcaggagttagccggtagaaaggatggaaatattatggcaggtggaagaagtacaattaataccgtactgaaatcaggagcaacagcgagtgcgctgacaaagctgtgcagaattaaatcatatccgcagcttggtggagaaccggagcagatcgaaaccacggacatggaagacaaaatgcagacctttgtagagggtgtgcagtcgtctgatgctatgcagtttacaatcaactacgagaaagattcttatgatgcaatcaaggaaaggattgagacagacaaattctttcagcttgaatttggaacgaatggcattgatggtatcttctcatggcaggggaagatctctgtgttcgtaaacgaaggtgaggtaaacggcgtacgtgaagcaacgattactatcacccgttctacggaggtttttgacgaagcggcgtccgaagcgtttggatcaggctcatgatacggatggtctgggataacaaagcgtgaggagcggtcataagactgctccttttttgaacaaataattaaggagaaataagcaatggtgaaggtaaaaatcaacaacaaggaatataaggccaaggagcttacaatcggtcactataccaagatggaagagcagggattttctatcattgatgcgtttagaaaaggacaggtgacactaatcgccatgggattcacttgtgcggtgacggggcttgatcgtgaagaagcagaagcgctacttacacagcatgtacttggcggcggaaatcttcaggatatcacaaatgcattcggaaaggcattgagtgaatctgattttttcaagaaaatgctcggaatggacaagatgatgaaccaggacgaagcggaagaaaccgagacggggaccgaggaagagacagaggcaaccgagaaagaatccaagtaaagagtttcacggaagcgattgagaagttctatcttccgatcgctgttcggtgtaaaattccacactcagagtttcttaacatgacacctcgattattgagaatctatcagaaagagtatgaaaaagagcgtcaggaagaagcggatatgattgattataccgcttggcttcatggcgcttatgttttccgggcgatcaatgcggcgttgtcaaagaatggaaaatacccggaagaagcattatcaatgtcagaggaagaaaaggaagaagattcttccgtggcggctatgcggtttgcagattgggctaatgcggcaaacaaagcttttaaaggcaaggcaggtgagagtaagtgagcaatgaaatcgatagactggaaatagtggtcgaagcggaagcgaataaagcaagtaggtcgctgtctggaatggaaaagcatcttgataagattgcgagtagtctggagaaagtggttgcgcttactaccggtcttgataaaatcggaaatcttgacttcttcgggatggaaaagttcaaaaaagaaatggactcgatattccggacgcagaagaaaatgagtagagttactcgtggtccgcgaattgaccgttcggatttgaaatatacagagaagtctttggacgatttattcgataaatttaaggatgttggaaggaatattgatttttcaggacaaggacttacagagcttcaaagcggtctgaaaaatgcagaagcgcaggcaacaaggttgaatgaaaggcttgataaaaagattagtctggagggaactgataaactcggaaaatcctgggagagtcttgtttatgatattcagaaagcaacaaaccaagcagaaggatatcgggaagcaatagagagaatcaaaaaagaaacatcggctttgaaaataacacattgggatgattttgataaaaaaagtactggtagcgaaatccccaaggtaacggatgtatcgcctggatcaatgaattacaatccagatgctatgtctatggtatttggagaagaattcaaggatatccggaatctcaatgatttaatgaaacaatttggtggaagtgcgcaacaagcaggacgagctatcaaccaatttgaaaattctatggagactgagaaagtcaatacatatgaatccaggattaagagcttaaaaaaggaacttggaggactggcttttcaaggttttaaacagggagatacggagtatgatactgtagcaaaacaacttgcgagactcactgctgagaaaaagaaatatgataagtctattgggttgtcgaagacagaagcattatcgtcaaagttgtccaaagtaagtgcggtgatgaaagaggctggtgtaaacgcaaaaaagcttggaagcgttttaaaagaagcttttttgcttccggtcagattcggacaatctgcggtaaaggcactctctaaggttggtaatagaatctcgtctataacaaagagtgcaaaaaacatggcgaaagcctttgcgacgccgatctctcagcttggtaagttgaagaacgctttgcttggagtacaaaaacaaaccaataaaggaatgtcatggggacggatgatcggttcatcagtcctcttttcttttgtattccagggaatcagcatgattcaaagagcgattgcggagggatctaacaaccttgtgcagtacagcaatgcgtataatcagagtatttcatcgatggtatccgcattgacatatctgaaaaatgcgtgggcggcggcatttgcacctattgtgaatgtggtggcaccatatattcagagtttcatcaatatgattgccggggctttaaatgcaatcggaacattttttgcggcgcttacaggaaagggatttgttgtacatgccaaaaaggtggtgcaaaactacggagcatcacttgcagatgttggatcttctggaaatgatgcagggaaagggctggatgatgccaacaaatccgcaaaaaagcttcaacgaacagttttaggatttgaccagttgaatattttaaatgatcctaacgcaggatctggctccggaggtggaaatggttcaggtagtggcggaggtggtggattagatctgtcaccgtcagaaatgtttgaaaccgttaaggttgatggcccattagcagactttgccaagaaactgcgtgaagcgttccttgccgaagactgggaagggcttggagaaatcttagccgatggagtcaacacaggattgcagaagttgtacgatgcaatcaattggaagaacgtaggtccaaagattacttatttttgcaatgctttcacgactacattcaacagccttgttgataatatcaactgggatctgatgggaagaacggtaggagcaggaataaattcaattattaatacgttgaatcttttaattaccggtatagattggaaaaacctcggatcaaagtttgctgaaggtgtaaatggaatattttatgaggtagaatgggacaaccttggtcaattcgtaggaaacaaatttatgattatctgggacattttatatggaacagtaatgaatttggattacgagacaattggaatttcatttgcaaatgctgtaaatggagttttttctacagttgatttcggaaccattggtttgacattatcaactggattaaatggattggcaaccattttgcgtaattttacttctacggttgattgggattcgattgcaaagaatttatataccggaataaacaatttcattcataatacggattgggctacgcttgccactacgttgagtaactttgtaatgaatttgcttggcactattaatattgtagttcaaaacacagactggaacgcaataggtgtggcgatcggagagtttcttggaaatattgactgggccggaattttactgacagttggagatattatatttacagcattcagcggagttatttcaggtttgtttgatacaggaacaggaagagttttccttgcatttgttgctggattgacactgttaaaaggagtattcggctttgttgacttatccgcagaaattctcggatggatcacaaaagcctcgaatacgtttggcggattcggtgatctgattaagaccggagtagttcctaaagtctcagagggaattggtcatatcacaggagaaggtggtttgttctctaaaatcggttcggtggcttctaaggttgcagatttagcaggcaaggcgtttacgggtattggagattttattacaaccacggcggctcctgcgataaagactggagttgattttatctctggtacaattttccctaaaatttcctcagcggcgtctacggttgttgcaaaagctggcccgatattaaccagtatcggaacgaagattttcagcccaacaggtctattgattgctggaattgctggtggagttgctctgatcgtgactcattgggatgagatcaaggatgcagcatcgaaagtgaaagattgggtcggagaaaagtggaatcaggtgaaagactggacatcgaaaaaatggtctgaaatcagcacttcactttctaaaacatgggacaatctgaaatcatgggcttctgaaaaattcacgaacatcaaggacagcgtttccaaggcttgggagggagcgaagtcagcaacttcaaatttgtggtcgagtgcgaagaaaaccgcaggaaatatctgggaaagcatgaagagtggcgcatcaaatattttcggatcaatcggccgcaaggtaaaagaaacttggtcaggaacggaatccgatacgtcaaaggcatggtcgaattccaaaagacaggtggattcttcgattaacggaattgatagctctgtgaagtcaaaaatgaactctgtgaagagcatcgtatcaagtacgatgaaccaagttggaaacatttttgagtcaaaatggcgttctatcagttctacatcgaccagtgcgataggccagatgcagacaagcgtctcacaaaaaatgggaaatatgaaaaatagtatttcgtcttctatgaactctattatcagttcctatcgagcaaattggaaatcaatggtgaacgtaacaaaaagtgaaatgaattcatgcgtgtctgtatttcggtcatttccatcaaaagtaagtagcgcaatgtcaagtatgtacacggttggaaaaaatgcggcaaattcattcaaaagaggattgcaatctgtacatattcctactccacacatgaatatatcatcttattccaagcaaagtgttggcgataaggtaatatcaatccctcggttcaaagtcaagtggtatgctcagggtggtttcccaaatatgggggaattgtttatagccaatgaacgcgggccagaacttgtaggaagaatggggaaccgaaatgtggttgcaaataataatcagattatttctggtattgcagaaggtgtgggacctgcaatctacaatgcggttttagcggccatgtctcaatcagtcggagggaaaaatggggatgttcatataactcttgagattgatggcggtaagctggtcacaaaaatcgtaaaaaaatataatgagatgaaaggatcggatccaaactttggatttgtgtattaggaggtggtatcgtgagtcagcctcttgtgattggcagtgttacgatgccaaccttgaaaaaagaaggattaacgattacaaaagaaaaagtctggtctgcgaatacagggagggcggctgacggtaatttaataggagatctagtagggatcaaatataaattacagtgtgagtggccgcctttaagtcgggaggatgtggcaattattgatgctgctatttcccccgcctttttttatgtgactttcctggatccaggaagtaacagtcggatcaccaaaaggttttatgcaggtactccgacatatcctgtatacagttatgtaaatggaatgcttacatataacggtgtaaaagtagatttgattgaaaaataaacagaattgagaggaaaaaacgatgttaaaaggaacaaaaagtatatcattatcttatcaatcaataatccataatgaagaaagtggagatcgaatcgcagtttatatgtctgcccaaatccctgagtctggccggagcaacagcagtaagaccattcaggatttggatctgtacgaggcaaataaggcggaatgccgcaaagatatggttgactttgataacttgctatttgatctggaagaccagcagacccaggaggcaggaggatcagaagatacagatgacaatcaaaagaaggaggaagcagagtaatgaagatcaagaataaacagatggtggcagtttttaatggaattgccaaaatcaaaaggaagcagctcccgatcaaggttggctttgcaatcaacaaaaatatgaaagctatggaatcagcggcacaggcatatgaagaggcacgtgctgagattctggaaaagtactgtgcgaaagatgaaaacggacagaatcagacaaatggaaatgagtatgtgctgaaagaccggaaagcctatgctgaggagatgaacgagcttctggaaattgaaatagagtttcagatccataccgtaacattggaagacatagaacggtgtgacgatggtaaatttgacgcccttacaccagaagatttggaaattttgcaatttatgattgctatgtaaaaaacggatggagtgataggaaatgtatcaagtttcagatgccttttctcagttgattaaagaagactccagaacatttaaggctcttatttctattgatgatacaataataacgtctggaataaagagtataaaggtaaacggcggttctaatcgtggagatgatttcacggttggatctgccgtttctcaatatattgagatgactcttgagagcatggatgttcaatttgaaagtaaagaactattacttcagtttggcttggaagttaacggattggttgaatatgtgccaatggggtattttacaactaagaagccggacaaacaagaggatgtcatttcaattattgcatatgatcgcatgatgaaaatggaggttccatgttttctaagtcttccggacaagactaccacaacggcggttttatcagaaattgaaaatctaactggagttccggttgtaacggaaggtttagattctttaagtatagacaagccagttggctatacgtgtagagaggtactttcctatattgctcagatgtacggtggctttgcaatatgcaatagaaccggagaaattgaaatcagaacatatatagattctaattatgaaatcaatacgaatcggtattgggatggttttacacatagtgatattccatacattgtagagaaaatcacgtgctatatgggacaagatgaagaaggaaatgatatttcagtaagtgcagggagtggcacaagagaaatcagcttctctaatccatttatgacacaagctattttaaaatccgtatgggacgttattggagattttgcatatatgccgggatcaattcggtttctgggagacccgtgtattgatccatgggatattctaacagtaaaagacaaaaacggaacatcctataaagtgccagttatgtctttaactgtagaatttgatggtggtcttacaacggaagtggaagcgtctggaaagtcggaatctgagcaggtaaatgggtttataggtcctaaaacaaacgaaatggatcgatactatgcacagcttgttttgatcgatcatgcgctgataaacaaactcgatgttgatacggcaaaaattacatatgcaaccattcaaaatttggaagctgttaatgcccacattcaaaatttggaagttgaatatggtgaatttgaagatttaacagcggggaatttggaagcaatccatgcagtcattaatgtcttagaaaccgacagcgccaatatcaagtccttgctctccggaaatgctgggatcggcgacctccaaaacatccaccttacatcggccaatgccgtgattgacagcgctctgatccgcaacgccgtcatgcaggcggtgacagtcaacgaccttctggccggaacgatcagcacaaataagttccggatccagtcggatgatggcgggatctccattgtcggcgccacacagcagtggaaagacaaaaacggcacagtccggatgcaggcaggtctggacgcaaatggtgactttacctttgctctgtttaatgcggagggcaccggaaccctgatcgacgatgaggggatccatcctggggcgattgccgacgggatgattgttaatgatatggtagcggacgatgcggccatcgcaggaagcaagctggatatcgtcagcctttttgaggaaatgaacggatccacggaggttttaaagagcagccggatctggtttgatgagaagaaccagaatctgagccaggtttattctcagatgtcaagtgagatcacgatggcagggtcagcggcggatgcagcccaagacgctgcacagaaagccctggaagcggtcaaagggattgatacgctggatgcgatcagcgccgtactcagcaacgaagcgcatgtggtacatacgaatacggacggatccggcggggactattcggactgtagcacaaaaatcaccgtctactccggggatgcggatgtatcggcaaaagcaacgtatgaggtcaccaagtccaatggcgtgaccggaacctggaacgcccagacaaggacgtatcaggtaacaggcatgacaaccgatgacggatgggtggatattgacgccctttacgggacaggagatatgtacctgacagaccaatccggcaacaaactgacaacccgagatggaaagtacctggttgtccgtaccggcggcgcacacatcaagaagcgcttctcgatcagcaaggctccagacggcaagatcggtgtgtcctacaatctgcggtgcagcacgctagtgatccggaaacagcaggatggcacgatgatgccgtcccaggtgactttttatgcacagtataacgatggagttctgctgacggactacataggccgttacaagatcgaggagagcaccgacgggacggactatgcacagaagtatatgtctgcggctgatgagctctggaagaattacacgccgtctagtgggaatgtcaaggcgatccgctgtaccctgtactcgtcgggcgggctgaatgaactggacagccagagtgtgattgtgctgacagatgcggaagggctggcggaggatatcgacgaagtccggaaagggatgcagacgatccggacggacgtgacaaacatccagacgggcatgaaagggatacaggcggatatatccagtatgcagacagatatcataggagtaacggacaacacgctactctttaacgtccagtacaacgacaatgggaataacaccgtgacgttgacagcgaaagtctataaagaggggaaagacgtgacaagcacgtttacaagccggtggtttacctggtgggcgaaaagcgagtcaggtgagaagtacatcggctacggatatgggatcacggtaaaaaaaacggatgtaggcttcgggtctacctatattgggcgatttattacctacgaaacaagatatctgaaaacaaggtcaggagcctatttgaaaacgagaaaaggcaatagactgacgacatggatagaaacgtaaaggagagattaaacgtggcagatcagatgattaatgcattaccaacaaaaacggagccggtaacaggtgacaaagtacttctgtcaggagcgtcggaggagtatctgattgattacgacaagctggcaacggcaattttgaacaaattgacttccaaaacctttaccctagaccaggggacaaagacattggtggcggcgcttaatgaactaaatagtaagacaagcgtatatgcaacgtccaaacaggattttcttaaccttggaaccaaattgaaagttggaattagttatccgctctatttgtcagcgactgcaatgcaagaaataactaacgctacttatacaattaccggaaaaggtattgtatatgtaggtgccggaagccaaatggatattctttgtatgattggggcaggagatgtaattctgaccgggcgtatttatgctgaccaagatccactattataccgaattaaaaccgaaaaaattgtgtagtcgtacaaatagaaggcagggaatggaaagaatttgacagaattaactttaagttttctatgttataaaaacttccaatctttccattgcaaaggcgatccagattttcctcttaccgcaatgccagacgccccactgaatgatccaaaaactaactgcgacattactgagccatagtcaatagtaagtgcgaatccataaacggatttttggtttatcagagcgccgtttacatacgaaatcttggttttctccatttcgtcaagttgtaagatgtctgtcacaacatttgaagcttcaaatgtcttactatttagttcactactgtctgcttcctgtcctacaatgggaacaggaggtgaatggagaatgatagagaaagtaattaatggagtggtagcggcgatgcaggaagatctgacagacgaacagcttcggaagttggaaaatgtattgttggtacaactccacgggctgaaaatcgaggaggaatgtatggaacttgttgttagtgagaggcactgggagaagatcctgcggttgtatatcgccagtaaacggcttgagaattgtgcagaaagtacgttgcagaattatgagcggtgtatccggatgctgatggaggcgctgaataaacggcttccggacattacgaccaatgacttgcggttttatttggcgatatatcaggaacagaggaagatttctatatcttacatggaaactctgcggcattacatatccagctttttcagttgggcagcggatgaggggtacattgtccggaatccggctcggaggttgaaacgagtaaaggtgccgcagaagatcaagaagccttacacggcggaggagagggaacatctaaaggatattgccaagacgcaaagggatctggcgatcatggagttgttgtatagtacggctggaagaattggtgaagtggtggcaatcaatcgggaggacattgacttttataaaaaggagattgtgatctgggggcaaaaggggaagaaagaacggacggtgtatctgacggacggatgtatctaccatctacggaagtatttggatagtcggaaggacagcaatccagcgctgtttgtttccctccggcgcccatacaagagaatcggaaagaacggtattgaagcaatgctgaggaagctggggcttacagccgggatccatgcccatccacacaaatttaggcggacgatgctgacggacggaggcgcacgagggatcccgcttcaggaactacaggcatacgcaggccataccaaggccgatacgacgatgttgtatatatcagttaagcaggaggcggtaaaagcatcgttcatgcggtgtatcgcataaggaaggtataaaatataggagttttaaagccggccgtatgggtggcttattcgttgcgccggcgcaaaagtagcaagtggaagagcgcatatttaacaaaatagtaagacgtcaagtgaaattaaattcgcatataaaaattataaagtaaacacatttgaaaacattgactcaatgctacgtcaatgtgcagatgatatgccgtccgattctaaaacttatattgtccgaattgtttacggtagtgtatttacggctattgtgcaaacctatgatgatgacacatatcgagctgtctgggctttcagctatacgatcagcgagccaaagttccaggtaaagcgaagaggagagtgggttgtctaatcacctgcacaaacaaatgcaatgcactgtcttaaaagaaagccatcttcaattttgattgacgtgctggcatatatttgaacttcgccggttgttgacgatatatttaaaaacattggctctccatcttgtgtaatgtagttaatcataactgttgataccggacgtaattcttccggaagagtgaaaagtgtaataaagcttctatattttgtgatggttccttggacgttaaattggatataagcagctcttccgattctccgcactgtagcagtccataattttatttcaatgccatctacatttgatggtttcgaaattgattgcgcattgaattttgtcttactatttagttcactattagaagaatctattctaaagggtatccgtaaagggtgccttttaacatggattttttacaagaaagacggtgaaaacagtgtgcgatttgaaagagagataaacatatacggggatgaggccgttctgaaacgattcaaaacaaatgagacaagtatctctgtggtacagggcaagctctcggcgttgatcagtgaatcagagcttgtggagttggaaaacagtaacgccactatgtacagcaaattggcgtcggcggttatgaagatcgattccctggagctgaacttttcggatctgactacaaaatataatacagtatccgggcagtatacctccttggacagcaaggtggcaacgtacaaggcgagcgtggacggattatctgctaatatctcgacggtacagcagaatctgagcaagaactacagcacaacagcacagatgaattcggcaatcaacgctaaggcgaactctattactgcatcggtgtccagcatttacgccactaaaagctcacttaattcagctaccggacggatctcgtcgctggaaacatggaaaaatgaggcgagtttaaaaatcacagacagcgccattgttgccacagtgacgtcctccagtgcatgggagggaaaagcggataaaggcaagttgatagcacagatcaacctgtcatccgaaagtgccacaattaaagcatctaagattaaattagaaggattggtgacagccaactccaatttcaaaattcttacggatggaagtattgtagctaaaaacggaacattcacaggaagtattacaggtagtaaaattactggttcggatattaattttgaaaatagcgaaggaacaattaaaataaatgctgatggattccatgttaagaataatagtggagctgggcttggcgtttatcttactccgttagatccatttaacggtccatatctcattatagtagatgaaaaaaccgatggcactttttgcgttcaagcgcctgttaaagatccgattcctacttttggatctcaatttctttgggcaacgaatacgagcatcgatttttcttttagtatggatacatatggaataagtttttatagaggagataattcttttatactttctttggatcctattagtaaatatgaacctcttgtatttgagattgatggaataagatattgtggcgttacttccgagcgtagtaaatatgcaagatgcttaaattttgtcaataattcaggtgtatcatatggggaaatagttacaattacaaaaacgtatacctttgatgtttcagaatcagatgcaagattaaagaaaaatatagatatctgtacaacatcggcacttgataagattgatagaattgctttctatcagtttgattataaaaatggtggtcatcaagatattggtgtgattactcaacaactgaaaactgttgatgaaaaatttatcagaagtgtagggcaaaaggacatcagaggaaatgtactggatactatggagcagcctataatcagccagcttgtctttctattattaaaagcagtgcaggaactatccgacaaatacagaaagattgaatctgaggtttcaaatacgaggaatatcatgctattaagcgaattagctagtgatagcaatagtccagattatatgcttgaagaattaagagagttatcaaaaaatgatatcatatttcccaagaaagggtgagagacgtgatagagatcagagcgagaccgtaaaccggtcttatttttgtgcaaaaaatgataggagagaagtaggtatgaatactcagtggattgcgcttgtaatatcgctgttgggatttttggcatcagtatattacagcaataaaaacagcaaaaaaacagatatagatgatgcattttgatacccttttgcaacctgtataaaattttcaaagttctttcaatttagccttgactttttatttgcaggcttattttttgaatgttacttcctaatgtcatgatagttctcctccttttgccgaaattgtattaggaaaatccgattatgtccatcaaaggagctttgcatttacaaaaatcccatgcaaatattctttgcacaccgtgatttccaaaagtattccatctttttgaaacgaaaaataaaagaacgatagaaatgaaagtactgatggctggggatttttatcggcctgagacagcctgaaggcatattgttcgttgcagattcagtataaatgaaggctttcactttagcaaggtgttttcttttttcccattaaaaaggcagaaaacaaaaatacaccacggtatctgccttctgcctttggtatcgttaagcaaaacaaaaggctacggacaaaacattgtccatagcctcgtacacattatcactacatggaaagccaattttaaaaagggtataaaatccctttggctttccgatgaaatctgattacgttctttatacactatactctgcacaatgtttcatcggaatggattgtacagagttaattttctgtttgcgttgatcagttaaatgaaaattcatgttcatacgttatctccttataaagaagcgcaactttcgcttttcataatacaatgaaggaaaggatttgtcaatctccgtccctttttaaggcaatcaagatattctatatcctaatacaagaaaatccaaaattgcatattatacctttaaaaaaattctctgtttatctcaacaacaacgattacattttcttctgtaataagaaaattccaaggatcgtgccgacaaggaaaagcggcgctactctcacaaacagccattcaaatgaatgaaatgccactccgagaacagcggtttcaggatcattatagttccatcccaagtaaggactttctaatgctaataagatcgcaaaaattgctgttattactacactcaatgaaatcaaaagccaatacagaatccttttcctcgtagtttttttctgtgagagttgcaggttgattagttccaactttgcggaaattgtctttaagtcatcgatttccggttcaatgatcctttctccaagtaacttacttacaggtgtttcaaacacttctgatatagagatcagcatatcggaatcgggaactgacaatccttgttcccatttcgaaattgtttggcgcacgacattcagtttcacagcaagttcttgttgtgaaagtccttttgcttttctgattgtcttaatattttcactcagcactaagaacacttcctttctataattgttacctctattctatgaaaaattgcccgttgctacaagcaatacatattaacattgctgcttctcgtgactatttaagcttttaaatatgtctcaaaaaatatttaaacttttaaaaggcctccattttacaaaaacgaattaaatagatggcatctcgtcttcttagtaatttttctcaaaatcttttcagaaacacttgcttatgacgtaacgtaatgagatatactatcggtaggaggtatgatatgaataaatataaagcgataccagatggctatatgactgtaggagaagtcgcaaagaaaatggacattactgtacgaacattgcagcattatgataaagaaggtttgctttccccatcagctatgagcgaaggaggacgcaggttatatacagacaaagacatcgttaaacttcatcagattttgtctctcaaacacttaggcttttctctgggtgatataaaaaaccgtcttattccacttgatacacctgccgaaattgctgccattttagcaaagcaagctgcctctgtcaaacaaaaaatagattttttgtcagaatcattaagggaactggaagtgctgcgggaagaagtacttcaaatgcagtcggttgactttaaaaaatacgccgatattattgttaatttgaaaatgaaaaatgactattattggctgattaaacattttgatgaccaaactctcgatcacatccgcagtcattttgataaagacagtggaaaggcatttataagccgattcatacagcttcaagatgaagcaatcagactacaaaatgcaagtgttcctgcggacagtgatgaagggcagaaatttgcgaaagcctattggaatatgataacagattttaccggcggagatatgagtatgcttcccaaacttattgaattgggacaatttcaaaatacagaccttatttggaaggagaagcaagatatcgctaacaggtatgttgaacaagtattgggagtttatttttcccgtttaggaatcgacccgtttcaggaggaaacaaaatgactgaagctataaaaatcaaaaacttaaaaaaacattatggatcccatctagtattaaaagggttgaatttttgcgtacagcaaggggaaatttttgctttgctcggtgtaaatggcgcggggaaaaccacatgtatggaatgtttggaaggtttaagaaaacctgacagcggagagattaccatcaacggaaaaatgggaattcaattacaatcgtcttccttgtctgcgcatctcaagcctttagaggctgtcaaattgtttgccaaatggaataagacgcccattgataatacgatgcttgacgctctcggtatttatgaacttgcgaagaaacggtattatcaattatcaaccggacagaaacggcggcttcatttggcgcttgccctaacgcgaaatcccgatatactttttttggatgagccaacggccggacttgacatcgaaggacgtctatccctgcataaacaaatccgccacttaaaggccatgaaaaaaacaatcatattagcaagccatgatatgaccgaagtagagagcttgtgcgatcggattgccattttatccaaaggcagaattgcttttataggaaccgtcgatcagctcaataaaacggtaggaaagcattataacatcacgattcaaacacaagacaaaatcaaaaaatatgagtgtgatgatatcgaagcagcgttgtttccgctgcttatgcagtataaaaaaaacaatgagacaattttagatatacagataaatcgcggttctctggaacagcattttatgaaaatcgcaaagggggattactaaatgggcgcatttttatatgcaatttccttacaatggaaattagacatacggagcaaaacaatactcataacctgctacattgttcctctccttttttttgcgatcatgggcgaaatattcacttctgttatgccggagtcaaaatacacacttattcaatcgatgacggttttcggtgtaacaatgggttcattcattggtttacctccctctcttgttgaaatttatagtagtgatattaacaaagtttataaagctaatggtgtaccattatatcttggtcttgttttgacaaacatttcggcatatattcatttgtttattatgagcatacttctctatattactgcaccgtttttttccatgctgagattccagaacatccaggaatatactttgcaagccttaccatttttattgctgtatcactttgtattgccagcataatagggttagctataaaagatcaggcgaaaacttctatgatttccattattgtttttttgccatctgtcatgctatctggtatcatgttccctattgaactgttgcctaaagcatttgaaagaatcggaaaggtttttcctgcttcgtgggggtacaaactaatggcagatcatacgatccggtttgaaaatctactgccactgatcatcgttctaacattagctatttgcatatgtcgtatgttggttcacaaaattgataaatagcaatgtcaacaggatgttataatagatgaaatatatcaaaatcgtattctgtctctattagttggcacaccatcttttacctccttccaaagaccatctataaagatctcatattctctgaaagcgcaaggtaaaccgtttgcctttgttatatccctactgtccataagctgaaaatgtaaatgtggggcaaatgaatttccagagtgtcccacatttcccacataatccccggcctttacatactgtccaacagtgacctgaacagaatctttttgaagatgacacaatgctgcatatacattctttgcatattgtatgatcatataattaccagcaatacattgaatattatctttgtacggatcaaaataatttgcatttttatagtccttaaatacatctgtcaataaatttgtttttttattttctgcatacccgtcctctgcgactacaaccattccgtcacacggggcatatactctttctccccaacaataatagtcctctaaggcagctccctttattagatactgcatcatactgacccgataggcaggccacccttttctcgtccagtcaacttgtataaaatcataagcataacgcgttccatatctattcgtgccatgacttgggatttttgacccaggagtattaggggaataccactccccttttaatggaaattgcattaaaatcggcttactcatatcttttactttcctctcagcacagcacataataacaactcaaattatcgcatcgtttttggctttcaagctctctgcttatttcagtataatagatttgcatacaacgtgtctacaataatactgccgcacaccggaatcgacccgttttaaattattaaaagcactgaaagaaaggggctttgaagacttcatcaagtctgcggtgttcaaaaagtgttcaaatgtttcattgttaattaactttcaaaaaagcactcatagggcacatctaatatttcttttataagtttcaaatcatatgctttgatatttcttcgtcctgcttctatattcgccaatgtgctgcgtgacatattgcttccctttatctgcattttcgcaataagctggtcttgtgtcaatccgcttcttaatcttatattttgaatattactccctaatgacacatcacgtataacccactgcattacaatctccatttgtgactattcagaaactttttcttgagtatacgccacatatatgttaaaattgtcactagttagaaacaatcgtatttacaacctttagtccttgaaaaattcagaataatcaacattaagaacttctcgtaatgctcttaaatcactggcttttatatttctacgcccagtttctatgttggcataagtgcttcttgaaatgctactgcctattaattgcattttttcaacaacctgcatttgtgtcatatttcttgacattctaactgtttgaatgtttctccctaaaggtatatcttgtaaaatccattgcattatgctctctccatttgtgactaatcggtgttatatcttgagtatatgcaacgcttcgaattttcttgtcacccattagaaacattcgtatataaggacaatttatttataatgctattgtgtctaatcatattgagaggggataacactaatgacaagtaacagtttctatgatacattcaaaacttcactcgaagctatgaaagaaaattctgtattaccattacttacaaccgataaagactaccagaattacacaaatcaagaaagtatggcagaagcacaatatatgcaattagatttatctgcaaaacagaaagaaattgtagagcaactgttagacgctcgtgacagacaggacatagaatattctaatctatcctatttagcaggtatcatagactatataaaatttttaaaatatttcaacataccgattgatggagtattagaagatgaataaggttgaagtacatgaaaaagaaacttattataacactttttgtcctatgcctgcttattggtatttcttactatattagtcttcctgattattcggatatttaatagtatttcttatagcaatcaagacacaagggataccactttaaaagttgttgtatataaatattgggaaataaatgatactatcaaaaaaatcgaagaagaacacaacaaaattaatggtacacctaccacacttaaaattaatcttaattattcaaaactgcttatccgatatggaaaaaagccttttaaaacagtcatgtttgaatataaccagaaaaagaggaagacaacactatactaattgcattgtcttcctcttgatttggttttttgcttcatcaatatttttgaagcaaaaaaataagagaaacgctataaaatcaacgtttctcccacttttaagtactgccgcagaccggaatcgaaccggtacgagagtataagtcccgcaggattttaagtcctgtgcgtctgcctgttccgccactgcggcaaaatggatggaggtggattcgaaccaccgaaagcgttgctaacagatttacagtctgccccctttggccactcgggaatccatccgtgtcacatagaatcgtttgaccctgacaataactatttatatcatattctaaagaaaaacgcaagggctaaattatcccttgcgcctctttctatcttcttttacgtcccatctgctgtttcagaaccgctgatggtctctcctgcctctactttgttgatggtctgtgcgatctcggcgaccgtatcttcgttcggcacggttacatacagatactgatttggagcagagtaacaaatattctcctccggtgttccgtctgccgccatggaataaatctgccagtcagaatggtccttaagctgctgcttaatcagcgcacggatctgcttcatagacatattggtctccacgctgtccgctgcctcatctaggatatccgccgcctttacgatcatagatggagataccatcttcttaatcatggcagtaattaatgcctgctggttctttccacgctgattatccccatcatcaagtgcgtgacgctcacgagcaaatgccagcgcctcctgcccgtttaagtggtttgttccctcctgaatttcaacaactgctcctgcatctgttccggtcgtaaagtcaaactcagattctacgtccaccccacctagaatatcaataatattgataaaggatgtaaagtttaaccgtgcgtagaatggaatcgatacctgatacagttcttccaaagtatcaatagacacatccactccgtagtttccggcatgtgtaagcttatccctcattcctccggaaataccaggaatctccacatagtaatcacgaggtgtggttacaagtaggatctggtgtgtcttcggattaaccgtggcaatgatattcacgtcgcttcggctcatatcctccacatttccataaatgtcaattccgctgatatatacggtaaatggctctgtctgtaccgggacgtccagtgacagatcctgagtctcttcaatctcacattcataaatcactttcgtaccggatttaaagtcctccacagctttttccatcgtgctctgataactggaatcatagacgatgatgtcgatctcctcacttatcagcgctttcgccatatcttccatattgtcaaacactttggtctcaatgctcttctttaacttcttattgatattggcaagtgctttatccgtgttctcgccgtctgtggcgtactggataccaaatatatagtcctccgcatcacccaactctttagcgctgtcatcctcccgtacaacggcgaccatcttgtggctctccgaactaccacccgcaatatggaaaagggctccgcccgtcttatagagataaaatgatcctatgacgaggacaactgtcatcataaaactgaataccttgccgatgatcttgccttttccccgcaccgcaagttgggaaatcagcgtgataccgagcaggacaagcaggacaccggcgattccaagaagatattccataatgagaatatccatccagcacaaaagccacaaaaaagctaccgacgcaacaagctgcaaagcaaagaacgccattcctctggccgctcctgcccgctctgcctttctttcctttcgccttccgatctcctgttgatacctttcccgcttttcctctcccgtaatcctgttgtgaggtcttcttctggctccctccggcctttttcttcccgccgtcttacgatcctgtgcctcatctaaatgataatctaaatctgacttttgccgcccggtccggccgtcttttcgtttccggcgctgtactggaatatgatccggagctctgtcgcttccgttctttctctgggccataatcttttatcctttcgtaagtcttttctgcgattgcacgcactcttactattttataacttttactacatctctgcctgtttgtcaagttttacactaatattcacgtttttttaagatgattgcagagtgttttcccatattcagaacaatctctccgttttctacaatatactcctcaaattcggtcgtgtatccttcctcatatgtataaatcattctccgcatgaaaccctgcatcggaacctccgccggccataccggcacatgcagcgtaactgcctcgctccgattgttgacaatgatgacgaactgccttctgtcattaaaacgcgcataggcaagcacgccttcctgccacattagcattttgactgaaccggtccggaatgcccagtaccgcttatggatagcgatgacctccttatgaaattcgatcatctctttatcttcatgtccccacggataggtcctccggttgtccggatccgtaaatccgcaaacgccggcctcgtctccatagtagatggtcggagctccaggccaggtcatctgcatcacaaccgcttcccgcagaattgccgagttcgtatagctctccgctgcctcatgtccgaggtgttccacacgcccggtcatatgattggttcttgtcaggaatcgggaatgatcgtggttggacagctcgttcattgccgtctgcaaagacggcgtcgtcatcgctgccatatggtgcgtgatggcattgacaaagtaatccgcattattgcacagatctggtctgctgctgtcactgtgcttttccattcccgtcaaaaaccaggtaataggctccataaaagcgtcataattcattacggtatcccactcgtccccctggagccactcttttggatctccgtagtgttccgccaaaatgattgcctggggatttgcactcttgactgccattcggaaccgtttccaaaagtcgtgattatattctttcgttgttccaagatcggccgccacatccagtctccatccgtccacattgtacggagaggacacccatttctttccgatccccagaatatagttttccagttttacggagtcctcgtaattcagcttcggaagcgtctcatgcccccaccaaccgtcgtagtttccgttatccggccaagctcctggatcattattgaaaaaccggaaaaaatcccggtacggactgtcggccgaacaataggcccccggctcgtaattaccctctttctggtagattttctcccgatccatccatttattaaaagaaccgcaatgattgaacaccccatccaatatgaccttcatccctcttttgtggatctcctctactacatgggcgaaaaatgcgttgcttgcttccaggttcgcttttccggcagtacgaatctgatattttgtcgcctgactgttatccgtacagccctccggcagaatatctcctccgtcttccacgatcttcgccagatggggatcaatgtaatcatagtcctgaatatcgtatttgtgattggacggggacacaaacagcggattaaagtagatcacttccactccaagctcttccagataatccagtttatccagcaccccctgcagatcgcccccgtaaaactcccggatcgccatcgtcttcgccggcttctggttccagtcttcgatctgctcagatctggcgccgagataatagtattctcctgttaccacgtcgtttgaaaaatccccgttgcagaatcgatcagtgtaaatctgatacatcacagcgcctttcgcccactccggcgtggaaaaatttggaatcaacaaaaaatcataggcctcaagcggctcgcttacggctccgtaacgattataatatatggtctcgccatcagtccctttgatttcaaagtaataccgcagtgcctccgttccaatctgtactttcacgttataatagtcaaagacgtccgtcgtctgctctttttgcatgaaaatcgtctttcctttatctgacccctcttcatctgaataacaggtctctcttgtgacaactttggcttcctgtacgtcatcttttgccgttcggaatcgtagtattatcttctgatcttctaccggctccggtggaatgacgtatacacccgtcccgtcacaaaataatgcctgtttgttcataatcatactccctttcttcccgtatctactctggcagcatctgtccttcctgagagccctctgtaaataaaccttcaaattcttccctggaaatcttttctttttccaagagaagagctgcacacttgtgtaatacgttcatatggtcttcgatcatagtttttgctttttcataacattcatcaatgattcgtttcacttcctcatcaatcttacccgcgacagcctctccgtatcctctcgtatgggcaagatcccgtccgataaatacttcatcgctgtcattgtcataattgatcagtcccacttcccttgacattccaaactttgtcaccatcgctttggcaagattcgttgcctgtttgatatcctgtgacgctcctgttgtaatgtcatcgaagatgatctcttccgctacacggcctcccagagaaaccgtaatgtcctggagcattttcccttttgtatgaaacatctcatccttttccggaagcggcatcgtataacctgccgccccactgcccgtcggaataatggatacggtgtaaaccggtcctacatccgggagcagatgaaataagattgcatggcccgcttcatggtatgccgtgatccgtttctccttatcggaaatcacacggctcttcttttcagctccgataccgaccttgacaaaggcacggcggatgtccgcttgtgtaacaaacattcttgcctgcttggccgcatagatagcgctctcattgagcagattctccaggtccgcccctgtaaatccggctgtcgtctgcgcgatctggcgcagatctacatcgtccccaagcggtttggatttagcatgaacggtaagaatttcgagtctgccttgtacgtccggtctgccgacaagcaccttcctatcaaaccgtcccggacgcaggatcgcagggtcaaggatatccacgcggttggtcgccgccatcacgataatcccctcgttagctccaaagccgtccatctctacaaggagctggttcaatgtctgctctctctcatcgtggccgccgcccataccagtacctcttcgtctcgccactgcgtcgatctcatcgataaaaataatacatggagaatttttcttggcatcttcaaagagatctctcactctggatgcacctactccgacaaacatctctacaaaatccgaaccggaaatcgtgaaaaacgggacgtccgcctcccctgccactgcctttgcaagcaatgtcttaccggttccaggaggcccctcaagaagcactcccttcggtattctggctcccacctgaatatatctctgcgggtttttcaggaagtccacgatttcctccagctcttccttctcttctttcagcccagccacatcgtcaaatgtcactttcttatccttgtcagtgctcattcttgcgcggctcttcccaaaactcatggcttttgcgcccgctccaccgtcactaatgccgctctgtcttcgcataaacacaaagataaacaggatcgccgccaccatgatgatggtcggaaggatcgacgtcagaaacacattctcccccggtactttgtctaattcgcaccgcactcccgcatcctccaggtattcctgctcattctgaacattagaaacattgacataccggtattccccggaatccttcaacttaagttctacctgtccggtcggaaccgccttatcctgataaatcacggcgctttctacctgattactgtccactgactcatgatattcatccaaagtgaacatcctgcttctctgctgggactgatttgtgatccagaacacaaggaagatcagtacgatcaaaatcagcgctgatacaccgccaaagcttctgttctttttattgttcaatctctcttttctcctttctattttactccctcgaccactccgatatacggaaggttccggtatctctggtcgtagtccaggccgtaacccaccacgaattcatccggaatgttaaatcctacataatctacatggacatcctttacccgccgctctggtttgtccagaagggtacagatatgcatactcttcggccctctctcacccagaatcttcatcagatgatacagggtacggccggaatcgatgatatcctccacaataattacgtctttgtcctgcaacggctcatccagatcctttacaatcttcacaacgccgcttgactctgtgcctgatccatagctgctgacactcataaaatccatggaaaccggaacggtgattctctttgcaagttcacacataaaaaagaccccgcccttgagcacgcaaatcagatgtacgtgcctgccggcatagtcttcgctgatcttcctgcccagctcttcgatcctctgattgacctgctcctccggaaccagtaccttaattgtctctgccattttcttctcctccgtaaacctctatttctactatgtgttttgtcttctctgtgatctggtacgcctgattttgacggtacccgacgatccagacgatctcgtctccatccgcgatcagcggaaccgtgtctctttcctctgacggaatcttctgattaataaaaaatttcttgatcgtctgctttttgccgtccgcggtgatggtaagaaagtccccctcccgccgcgtccgcataataagactattttttattatatcataatcaaaccatttcgtgtagggggtattcggccacttttcttccccccggcgctcaaacacacgcatccgaaaccttggcatttcctgcttggcttcaggcttcccctgtctgtttcccttccttagcagcacaccctcgtaacctcgaaatgcccgaactccgtaaggaagagagagtctccttccgggttgcttttccatcagctctaagatgtcacggacatgaaccgccatcagatctttttcgctgccgcagacgtcctcaagtaccgcccggatgacttcctcccggaatacatacgggattttctgaaatgtttccttccggatgagagtcccgtttcctttttcttccacacactctcttatatatgttcccgtttcatcttccatatattcccacaactcggacattttttccgccattcggcaaatatgttcctcggctgccggattgattttgagaagttcccccataacttggtttcggacgcggtttcttgtgtagtcattctcgaaatttgtagcgtcaatccgccaggacacgccccgttccgaaagagcctcctcgatctctgactttcccacacacaagagtggatggataaactcacctgccacgggcagaatcccccgcatccctttcacctggcttccgcggcagagattcatcaacacggtctccgcattatcaccttggtgatgggcgaaggcaattttatctgcgtggacctcctcaagtaccgacttcatagattcccttcggatttcccttcctgcttcctccaaagaacagcttctcttcctggcctctgccgcagcgtggatacgaaaaacacgacatgggacatcatgccgcttacaaagctctgccacaaagctttcatccccgtccgccgcctttcctctaagcaaatggttcacatggacggctgttacctgaatcccctgcgtctctcgaagtcttaaaagtacaaaaagcaggcataccgaatcagctcctccggatatacctgcaactatatgctcccctcgttctatcatattccatcgcttcagataggattccacctttttttgcaatccttcccatttcttctctgccacacttctctctcccgtatcttttttcttcatcttactataatcatcccgcaaaaagcaagctatatccgccagattccgatgacaagcaccgtcatgtcatccatcggatcttccccggtccattccagcacttgctccagaatgtggtgcgccatctcttttggattattaagactggtcccccggatgatggtatccagcagaaattcctgctcgcccaccggaagggcatccatgatcccatccgtaatcataatgacgaagtcaccgttctgcaagtgcttatgtacgctttgaatctccagatcctgcactacgcccaagggcagattggttgaacagatccgctccaccccgttctgatgccggataaaagtcgttgacgctccggcttttaaaatatccactgtcccctcatacaggtcaaaaatgctgatatcaatggtggaaaaacggatctcctccctcccgatcaccagcgctgtattcatcatttccagcgccgtcctggcagggaaaccggcctccaaaagttcttccagcatatccaccaccatggcgctctcccggtatgcttcttccccggagcccatgccatcagaaagcaccgctccctgcttaccggccggcaactccatcatggaaaagctgtcaccggaaattccggcacacccttttccgattctggctacaccctgcaaagtatagtaatgctgcatctcaagaaagacaattgtcgcgtactccggccccagagaacgcctctcatcctttgccgtctccatgatctttccagtacatatcgaaagaattctcgccagctcctttgtactgatgcactcacctttggccgctcttccggtcagatgaatctcataccttccttgtggcgtcatcaaaaagaccatactgagaattcggatattctcgctttttagttttgctcggatttttttctccagccgttcatcagagaaaatactcgcgtccagttctctcgtggcatgtcggatcaaccttgcaaacgtatccagctccacggcacacccctccctgctctggacgatccggttattccagaacatcgcctgtttcgcattctggaaggtctccatcgtctcacgcagaaagcgcggcgccagaatacagtatctctggagccgttttttcagatccatattcagttccgcgccatactcatcggctgtctttaaaatttcatatacaagttgctttgtccgtacctgattttcaccaagacaccaggaacggttttcacagttcttacagactgccccagagactctggagaacatctcctccacctccccggatgtaaactgtccttttctctcttccatcctgaaaaaagtgtccgccaaatgctccaacgactttccaaatttttccatctgctccacatagggattcatcatataactattcttttccatcttatgccccttcttatatccgtgtagtgaaaagatctgtacgccatggcgtcgttcacctgacgtttttgtgtttaccgggaaggattttcccgcggaataaaaaacagctttggaaatggttcgttcccaaagctatcttctgtgtgtcatatcgtgctctattcctcggctttgaaaaggatctcattttcctttaccatgccaagtctgtctcttgcagtatcctcaacgtactcgtctgtgccaacatagtccttgtacttttcgatctcttctgtgcgctgctcctcctgctctttctccttctccaagtctgaaatctgcgctgtcttgtcccgcaactgggctccaagagaaatactgtgtacggtcgtcacggccgcaagcacaagtaaaatacaggatataaacatgatgcttcctctatatctggaaaaccgcggccccttccgagagccacgtgactttttcttaaaaatcttcatctttacctcgtcgaacattctggtgattttggattatacatataatagtaccctgtttccagagattaatcaactcttttcccgtgttttccagtttttttctcgaaaagttttccgcagaactttccggtttttgacaaaaggagtaagaaaaataccgcccctactgccacacccacaacaaagtaccaccggatctccccggaacttgtctgaaaaatctcaccaaagagaaagaaacccgcaaagagccagtaaataaaatcttctacagaaacaaacagcggatgatgccggatgagcctccggaaaattcgcagcgcctcatagattccacaaagaagcatccccgtaaaaaatgcccgtaaaaatgcctccgcctcaatccccaggccgctcatcgccgcctcctaatggaagaggcgcgccaggagcttgccgccctgcttcgccgtctgcttcatatccgaataggtaatgctgtcaatattgccagacaaatcgacctctcccttctctaagcttaaccggttgacatggagatcactcccctttaccatcatcattccctgctccgtttccagaagaatttcgttcagatcaaaagacaacacatcaagcactcctgtcacaagacttgtctttctgttgttgacgaccagtttgtgggatttcctgacctgtgtctcctctgttacgctcatcatgctgctgctcatcatcattttctatcaacctctctttcgttgtcagcctgtctgcttcttccaacgtgcttctgagatatcttatgagccgcatcctgtctttatgccacttccttttatgatcctatctttgcttaaagataacggaaaagattcttcgcttcttctttcttcgtcgtatcctgaatgtccagtacttccgcctcaacggtcttcataccgaactgaatttcaatcacatcaccctttttgacattggtggacgccttggcctgcttaccgttaatcagcacacggcctgcgtcacaggcctcattcgctacgctgcgtctcttgatcaaacgggatacctttaaaaacttgtccaatctcatcgctctttcgcctccctgctgttctttcgtcaatcacccgaagttccaaaccggatattcccgggtaataaacgctctccaaagtctctgacaaacccatactttggcttacaccatcgcaaaaaatagagggcttaaaagccctctatttcgtgtcgtagatatcttatgcgttgatcgcgtcttttaaagcttttccggctttgaatttcggagccttgcaagcttcgattttcatcgtcttacctgtctgaggatttcttccttctcttgctgctctttcacttacttcaaaagtaccaaatcctactaactgaatcttttcaccgttctttaactcgtctgtcacaacgtcgataaatgcttttaatgctttctcagaatcttttttggaaatttctgccttctctgccactgctgcgattaattctgttttgttcataaatacttatcctcctatttgccgttataaagtatttccctgatctattagatcttattaccaaaacccctgatttcccttgggttcgcttcactaaaagttataacggtttcttgtatgtttgtcaagtgaattatactcctaaagccccattttccgcaggtttcacaaacttcaaaggttttttaaagcatcttgtcgatcatttcaagaacggctttgccaagtgcctctgatttcgcatccgcatcccccagagaaacgcctttgattccatagtagaacttcactttcggctcggttccggatggtcttacgcaaagccatgcatcgtctgtcaaatcatagtaaaggacgttggacttcggaagtcctgtcgtcgtcacttcgcctgtcgccagatctttgatcgtctctgcttcgtagtcgcgggcttttaatacctcatattctcccactttgaccggaggattattcctcaatgtctcaagaatagactggatcttctttataccttcaattcctttcattgtgacagactgaatgctgtctttgtagtatccgtatttattgtacatatcaatcatagcatcccacaatgtctttccctgtgtcttataataagctgcagcttcgcacaatgccattgtcgctacgatcgcatccttatctcttgcatgtgttccgatcaggcaaccatagctctcttcaaatccgaaaacatactcgccttttcctgtcgtctcaaatcccagaatttgctgccctatatacttaaatcccgtcaaaacttcaatcagtctgaggttgtaagcctttgcaatggcgtcagccatattgcttgtaacaatcgttttgatcaggcagccgtcatccggcagtcccttaagggcctgtctctggctgatctcatactctgccaaaagacaccctgacatattccctgtaagcaccttgtactctccggattttgtatcttttacataaactccaagccggtccgcatccgggtctgttgcaagtacgagatccgcgtccacttctttcgcaagtttcaaaccaagctcaaaagcctcctcagcttcagggttcgggtaggatactgtcggaaattcaccatcaggaagctcctgctcttttactacatatacgttctcaaatccgagttccctcaatactcttctggccgggatatttccggtaccatgaagcggagagtatacgattttaagatctttttgtacctggtcaatggcgtcttggtgaagcacctgctttttgagctcggcaatgtaagcgtcgtcaacgtcagctccgatcacttcgtagagaccagcctctttggcggcctctttggccattgtcttgactgtcgcaaaatcggtcactgcctttacttcgtccataatgcctttatcgtgcggaggtgtgatttgtgctccgtcctcccagtataccttgtatccgttgtattccggcggattgtggctcgctgtaatattgattccggcaatacatccaagctttctgactgcaaaagaaagctccggagtcggcctcaggctctcaaatacataagccttgattccattcgccgctagacaaagcgcagcctcgtccgcaaattccggagacatccgtctggagtcgtaagcgatagcaacaccctgcgcttttgcctctttcttggcaatataattagcaagcccctgcgtcgccttgcggactgtataaatattcatgcggttagtaccggctccaatcacacctcggagtcctgcggtaccaaattccagatccttataaaagcggtcttcgatttccttttcgttggattcaatctcttttaattctgcttttgtgtcagcatcaaagtatgtacttgttaaccattcatcgtatttttcacgatatcccatatcttagtacctcctgattggtcttctatgttgtttattatacaccactcttttctaaatggaaagcaaatatctgctctaaaaagcgtttcctgatctcattttgttcaatagaaatccgcagtttttcaacacttttcgatgaaatccatgctttgttggagttgtaatatgtattggcgcacttccagaacttttccggataggaaaggcggagtgcaatgtactccttttcctcttctgacagcggattgacggcgcagtacgctctgaggatttctgctcccagcttttcattccactggtgcttttccataacctttcttaaaaaataagcgagatccgcagcctgtaaatctcttcctacatgctcaaaattgaccgctgtcatgccctccggcgtaattaggatattatgataattgtattcaccatggatgaagcttcctcgctcttttgcctctctctgaagtctacggtaggacgaattgcccagacgctcctccacggccgccgccacccgatacatgtcttcaaagcactccaaaaaccgactttcaaactctcctttgattggttttttacgtatgaaggaccagacctttttcatttcccggttgtgtctgcggtattcatccagaagatcagaactacgaaacccttcccgcgcccccggcaattccattagtctgtgaattttggcaagtagtcttaccgcctcaagaatttcaccgtgtttgcggacatcacattctctccctggataccatgctttcaggtaataggtcgtcccgtcctccgtagctgtcagaaattccccctccctattcggaatcagttcatcacacctcagatgttcctgctttttcatcgctttatggatttcattcataaccaacatgcgcggcttagacaaagccgcctgctttaacagcatcagaccccgatccgtctcgcacaggaaagcaccccttactttgcggacattgtccacttgtatcggatattgttccagtatctccaaatcataatcgcccataactgccccctgccttctgaattcaatcgtctttctagcttatgagattttaaaaacaaatagaaccgggcagaagactttctccaatattaaaataagattgcgctttcgcacaatcttatttttcttcatatacgtttaatgcacgctcaagcaaatatgctttttgatttttctttgggtcttccaacacttcttccagaagggtattcaaaatttcccccatctgtggacccggctttatacctgcgccgatcagatctttgcctgtcaccgccatctcttttagggaaacacattcgccatccctcagaatcttgtaaaagcactgttctaccccccggatatcagctatcttttcttccctacgataggcgctctgagccagagtatccgccatccggatttccaggtagtatggaaagagctcctttccgatccggtttactgcccgccgcaccgatcttttgtccggcggcatccggtaatcgtgatagtagacaagcctggtcacactgcggaccgtatcattatcaaacttcaatctccgcaaaatctctttggtaatccgctcgcttccaatggcatgcttcttaaaatgtgccgtcccgtccgggtccatcgtcttatactctggctttcccatatcatgaaacagcatcgtaagcctgagaatccggtcagcgcggatgtgtttgagcgcctccaccgtatgaacacctacattgtacatatggtgcggtgtttcctgggttgtctccatcatccggtcaaattccggaagaatcactttggtaataccaagctcccaggcagtcagcagctcctccgggtgaggtgaaaccaacaatttcacgagctcgttttgaattctctcggcactgatcttcttcagcgtcccggcaagcgctcccgccgcctcttttgtcttttcctccatggaaaatccaagctgagctccaaaacgaacagctcgcagaatccgcagcgcatcctctgtgaaacgctccctggcctcccctacgcaccggataaccccctgtttcagatcttcctgcccgccaaagagatcgcaaagtccgtcttcatcattataagccatggcgttgatagtaaaatcccgccttttcaggtcttccgcaagcattcctgtaaaccagacctccttcgggtgtctcccatcttcgtattctccgtcgatccggtatgtcgttacttcaaacccctctttttctgccagtacagtgaccgtgccatgggcaatcccggtatccaccgtccgccggaagatttctttgatctcttccggtttcgcggacgttgtgatatcccagtcctccggctctcttccgagaatagaatcccggacgcagcctcccacggcatacgcttcaaacccttgctctttgagcttttgaatgatccactgtacttgccttggcagtctgattgttatctgtcccattttaatatgctttaccccagaaaactttatacttagccggttttccgcaacatacgcagcgatcggaaatcggctcttcatcctcgatcagacatctggatccggccccgcctgtctctgtcttgatcatctcttcgcagctttcgtctccacaccacattgccttgatgaaccctctgttgtctgtaaacttcgctttcatttcatccatggtctgtgcttcatcaatgtggctgtcgagaaatgctttcgccctgtcatacatatcctgctgcactgtctccaaaagctccttcaatacagatggtacgtcatcaatggataccactgtcttctctctcgtatcacgtcttacaagaactgcctgaccgttttcgatatcctttggtccaagctccacacgaaccggaattccgagcatttcctgctcgctgaatttccatcccgggctcttctcggattcgtcaatatccgctcgtaatccttctgcccgaatcgccgcaagcagctcctcagagcgatccagtacgccctccttgtgctgtgctaccggaatgacacgaacctgcttcggagcaattcttggcggaagcacaagcccactgtcgtccccatgtaccatgataatcgctccgataatacgtgtagacagtccccaggacgtctcgtacacactatgaagttcattattcttatccaaatatttgatatcatatgcatccggaaatccgtttccgaagaagtgacttgttgcggcctggagagctttcccgtcgtgcatcagcgcttccacggtgtaggtgtcctgtgcgcctgcaaacttctcgctctctgtctttcttcccgctacaaacggaatcgcaagagattcactgatgaaatcgcggtatactttccacatcatcagcgtcctttcctccgcttcttcatatgtggcgtgaatcgtatgcccttcctgccataaaaactccctggagcgcaggaacggacgggtcgttttctcccatctcaaaacagagttccactggttccatacctttggcagatccctgtaggactgtactgtacggctccacagctcgcagaacaaggtctccgacgtcgggcggatacaaagtctctcctgtaatctctccatacctccatgtgtcacccaagcaacctccggggcgaatccttccacgtgatccgcctctttctgaagcagattctccggaatcagcattggcagatagacgttctccactcccgtctctttaaaccttttatccagatccgcctggatattctcccagatcgcatagccattcggcagatagttcagacatcccttcacactggaataatcgcagagctccgcctctctcaccacatccgtataccactgagcaaaatcttcctctctggatgtgatggactgtacaagtttcttgttgtcctttgccatatcacattctcctctcaatcaatatatttttcacatcttcttaggacttccgttctctcaaacagttgatcccccctaaagatcaggtaagatctgttgtattgaatacaaaaacgccgaacatccgtcccatcagggaccggatgtccggcggtaccaccctcattaaccgcaaaaccccgcggctcacttcattgatcattaacgctgataaaacgctgcacttttcatacagaagctccgggcccggttcggtcgggatctgtcaaaggctcgcaccatccgcctcttctctgagacttctccagaacttactatctcccatcatcacccatctcttcggctctcgccatgaaattattcgtattttaaccgaaatcagcggggctgtcaaggcaggacaaatattttactcatttttctgttccccgcctccatttgaacgatttgtgtcacaaaaataaccatagaaccggatctcttttgctaaccggatgccaatatggtatgataagggaacaaatgaaaacaataaaaaggagtacatgatgaaaccacagattttatttgaggatgcagaaatccttgtctgccataaacctgccggaaccgctgtccaaaccgcttctttttctgcccaggacatggtgagtatcctgaaaaatcatcttgcattggaaatgcgaaaaaaagaaacagtaaagggcccaaaaaccagtgcgccttatcttgctgtgatccatcgtcttgatcagccggtagaggggattctggtgtttggaaagacgaaaaatgccgccgcctctttaacacgccagcttacgaggaacggttttaaaaaatattatgaggccatggccgagggtactcctcctgccgcctccggcacgctgacagattacctcattcgggacggccgcacgaattgctctgccgtctgctccccggacaccttgggatcgaaaaaagcagtgctggaataccaagttctggcacagtatgagacgaacgggacgtgtctttctcacttacgaatccagcttcagaccggacggcaccaccagatccgggttcagttctcccatgccggatgcccgcttttcggagaccgcaaatataacccggatggaatcccggtcagcaggctttatctctgtgcctgtcagcttgactttctccatccgtctaccgggaaactactccactttgagattcaccctttcttttacgaagaatttgataagtcatcgccctcataaccatatgaatctttaattgtacggttgttttctcaaaaatgactgattcgaccgtgcccttttcggcattgtacggtcgaatttttgaaaataaccgttatgaccgtaatgtccaactatttcccacaaaccagtccaaaaacggacagatgcccagccaatcgagtaggggagattttctctcccctctcacaccaccgtacatgccgttcggcatacggcggttcaacataacttaaacgcaggcagtattatgagactttggaattggcggcatagttagtgatatccttgaggaaaatgtgtcaactaatattgacaatatcacctggagctctcatcctatgttgaaatggatacggtacattcctccagggaatccaaaaaaactctgttgaccctgttctttacaaaagaaaaactgtttcttgcctttctcatgaaccggtgtacggaaggctctgtgcgccttgtttttgaccgcttagaaaaacgcttgggaacctatgagttctcctctgtattcgagtatatcctgacagaccgtggctcagaattcggagcccctgtcgcattggaaactggtgtaaatggaatacagcgttccagcatttattattgtgacccaatgcagagcggacagaaaggcggactggaacaagcgcacacgatgctgcggatgatccttcccaaaggaaccagctttgaatttcttactcagtgggatataaacacgattgtaaaccatatcaattcaaccccaagagaaatccttggtggaagaacaccgtacagcatggcactggaaacatttggggaagagattctaaaagcatttcagcttaggccgatagaacctgaccaggtcaatctaacacctaagctgatccgctttaatcactaagcaactatctcaaaaatctgctgtcggactggaagtaaacttttcacattttttaatgtggccggtggaattcagtccagcacactgattctcagtggcccgtttgccatgcccaaaaacaaagatttttttgagaagttggcataattatagcagatatcgatgttttttgctttattaaaacgcgtaaaaactgaaaaatttaaacccttgtggaatttaatcatgcactggaatttaaaatttcaagtcagcttgaaaaaatactttatcagcctatgatttctaaagtggactatttagcattgcttaggcaataaatctttgacaaaacatagtctaatacgaaatcattgaatatttccggtaacttgaggagcagaattttgtaggtggctcaaaaactttaactctatgaagatttttacatttacaactatatttttaatgattgacattatattatgcttttattattgacatttcttttctatttttatattattatttaaagatactattatttttttctgtattacaggagcataagattattatgaagacaaatttaccatttaactttcctatgataacacatgtaccatttgataattgcatattaggaattttacaaaattatcccgatacttttgattggatctactcaaactttataaatgtctatattaataaaaagaatggggcagattactttttccccaaatttctttggaatatttgtccttttattgatacttatactcttccatttatatttgtcaaagataattttatcaattataccgattttttagagttctgtcttaaagacggtttttatgtctattctctcttgaataggcgtcctattcataaatataaaacgcagatagatgatgaccataatcccatcattactaatatagatactttatcacagactgtacaaatgtatgatttttttaataacgggatttatactatatatgagtgttcgtatgctgaaatgaatgaagcttttcgctctcttccccaatgtaaaggttttaatgtagatgattatttaaataattattcagaaattattcttttaaaatatcatgcacaacaggaatacatgtttaaccctgataatttaaagaaaactattaatgattttttgaattgcactaatctattatcaaaatgcgattcttatttgtttttagaaaataattataaggactcgtttttctggggaatagaatgttggaaaagtatatttcaatccccaatggttagacggcattttagcctactgcgtgctcacagtaaaatgtggagttatcgatatcaatacttttcggagaagaagtatttaaatgcttctgattatattgaatctataatttttgaattaattaatacagcaacaattgcgttaaatttttatttaagggaatctttgaggaagaacaaggctggaggttgtaattttgaaataattttgccattattagaaaaatgcgaagcattagaatataaaatttgtgaatactttatatctaatttaaataattaatagtaccatatatctaacgcatcttcaaaaattagccttcatccctaaataatattgttccttgattatcgttaccctatttataaaagagtttatattaaaaaagggttaacaagactaggatgtgtacaaaaagttagactgactgcgattaacaaagggatgaaatatgaataaagacatcaaacaggcaaaaaagtatcgaaagtctataatccatggcttcattacagagaataaagtatttgtcagaaaattgaagctgggtatggatgagcttctttttgtcgttttacaaagaaaatttttctgatcgtaaagaatctgtcaatcgtacataattaatggaaatagatttatgagtagattgtaagacaaagtacattaaatttaaataagacagtttacccgaacgatggtgtgctacccgtcaagtagacaatgaaaaaatataaagtttttatgttgcccggtttattccgggcaatatttttatgcagctaataaccgttcatgaaattcaaacggtgttaatacatcaaggcacctttgcgggcggtcatttatgtaatagataacgtataattaatttcgcaaaatcaattttataaaaatagacatggtctatagccgtttggtaaaattaagtcaccacaaccaaatctatcaaaggcgtctaaaaaccatatctgataagattatacagctaaatgaggacttaataaagcgatcttgttcgtaacagtgtcgaagaagctttaaacgccctgcacgataaggaagccgccgaattagtcaatgctgaaaagtatgagcgctcctctgatcgccagggatatcgttccggtcattataaacggaatctccacgcatccgcaggggaagtggagctaaaggttcctaaactgaaaggggtgcccttcaagactgcctttatcgaaagatatcgtctcagggaatcttccgtggaagaagcattaatcgagatgtatcttggagatgtttctgtccgccgtgtggaagatattatcgaagccttatggggaacgaaagtatctcctggaacgatcagtgacctgaacaaaaaggtttatgagcatatcgaaacctggcatacccgcctgctttccggggactatcctatgtttatgtagatgttgtctacctgaagcgtagttgggtcagtgggatctaaagtctttctgtccttgttgctattggcgtcagtcagggcggctgcaagaagatcattggcgctgaggaaggtatgaaagaggatcgtgaaagctggcgttctttctttgtgtggttgaaagaaggcgagctgaccggagtacgtttgattattggagataataatctcggcatgcttgaaaccatcccggaagtctttccggataccagatatcaacgctgtaccgttcatttttacagaaatatattttctgttacaccccataataagatgaaagcggtagctcttatgttcaaggggatccatgcataggtgagcaaggaagctgaccgtaaaaaagcactccatgtatcggaaaaactccagtttatgaagctttccaaagccgccaaaaaggtggaggacggaatcgaagaaaccttgacctatatggatattcctacgcagtattggacccgcatccagaccaataaaactattgagcgcctcaaccgtgagattaaacgtcggacaaaagcaatcggcgcttttcccgacgggcagaaagccttgatgctcgtatgtgccagactgcgtcatgtagcagcaaccagttggggaatcagacgctacatgaatatggatcatctttttaaaccagaagaggatcctctgtctgatatcatagctggttgaccactgctgacaaacggctaggttttgatttcgtgaaaaacaattgacactatcctccactgatatcaaaaccgaatggccacctaataccaatagcaaaatttcaatttttccaaactcctcttgatactatcacgtcctgtaaacttccaaattatatataccattctaattgtcctaaataaagttttgaataatatgatgtagtattctgtattaatgcatcatgtgttccctcttctacaattctgcctttgtcaaaaacaattaccctatccgcatcttttgaaaatcctagcctatgcgaaataaaaataacagttctatcaccagcgagatttttcactaaattgtaaacttctatttctgataaagggtcaagatgtgctgtcggctcatccaaaatccaaatactcgcatccttctttgcaagcaagcgagccatagcaattttctgccactgtccttttgataactgaataccattttctaaatgtcccagaaatgtatttaacttatctggcaatccataaatataatcatataagccaactttttttaagatttcccatatttctggatcactaatatttttattattgagcaaaatgttatcgcgtacagttccctgatattctaaaaattcttgcgtgatgacagatatctttttcaaagaaggtgtcattaatataccttcataattttgaattaagcttaaaattaaattagtaaatgttgtctttccactgccattagttcctactataaaaattttctcccctttttttattgttaagtttatattcttcagagcaaagacattcgattgtggataagaatatgtaatatttcgaaacacaatgtctgtattctctacctttattctatcttctaaagtgataaatcctaatatttcgttatatatacggacaaagtaagaatttactatatcgtcctgaatattctcttggatttgcataatcatatttgtaatactagtcaatacggaattaatagcaattattattcctacatcatgttttcccacggctacttcatacattgtaactaacagaattaatattcgtggaatattgtacaaaacactagctaatttattcaaaatctctgtttttctatatattccagaagtaatcttgtattcgttttcaaattcttgatcccatttatttgaaatataatgatacatcctatagaatttatattcttgatgttccgtcatatctccagttagcttaaataaatattcttgcttttgacttttctctttcgtattttcccaaagctctccgagtattttatatagtgattgcgcttttttattgaacaaaaaaaacaagataaaatatactaacacaaatatccaatagattcggaatagataatacaagtaaataaaaattagtggtataatactaatataatataaagaattttttaaaatacttttcatactatccaaacctttagttctggtttcatggatttttaaatttatatcatgcgtttcaaaatattcccaggaaattttgcttaactgttcatctaaattgtattctatgttatatgaaaattttaaaatcaatttgttttcaacatatttctttattgtatctagtattgaaaaacatatcataccaatagtgaaaccagctattcctattgctgaattagcaaatgtaattttacgatttaataaatcgtatgctaaattcatgttatattcgctataatacaaattcagaaatacatttcctgacattaacaaatatagcaatatacatataatatattccttttttgcagccgtaaatgccagtctatttacttgaaaaattttaatgtttaatttctccatgggtcttaccttttattaatatcactagattttaagaatctgtattaattttctacaatgtgctttactatattatttaaaagaacaaataaagtttataatccacttcatgacaagtatacttttcttttattgtgcttcataaatcattttttggttttcatacaattcataatatcttcctttcgtttgcaataattgctcatgtgaaccagactcaatgatttctccattttccataaaatagattctatctgctaatttagcaaatcctattctgtgtgatataaggattgctgtcttattttctatattatttctaaaatttgccagcagttccatttcttgaatcggatcaacagaagcagtcggttcatctagaattaagatttctgaatttcccatatacgcccttgataacacaattttttgccattcgcctcgcgaaagttctgttccattactatcatattcttttcctaaaatactatccaatccatttggcaatttatcaattattgtatcagcacctccttttttgcacgcctgtaaaatcttatctgaattagaaatatattcaattttccccactcctacgttttctttcattgttaaactatatcgagtgaactcttgaaaccctaccccaaataaccgaaatacatcttcctggttcaggtctttcaaatttttcccgtttaatataatttctcctttgtaatcttctagtaatccacataatactttcgagagggtagtcttaccgcttccgttgtatcccaaaatacttattacttctcccttccttagagaaaaattagcactttttaaagcatatcctttttgatttggatacttataagaaacactttttaattttatttcatcaaattcactaacaccttctctcgcatcatttgtattttttctcgtattttttataaattcatcaaatctctctatatattcaatgttttcaggtaaatctccggtaattatttgaataattttgttactctctgccataagtgtcatcatcattccaaataaaaaagtaaaatcgcctatcgacattttatttaaacttacaagtcttaaaaaatatactgttaatattcctgataaaactttctgaataatatcaggaatcaaagataagaagagagatttattttcaaaacgaattttctcatccatgaactgcaaaaagtaagattcccattttcccaaaaaaaacaagctcaaattatatactcttaattcttttgcatattttttctcccccaatagcattgtataataatctgattttctttccttgtttacagtttttttattaatttcaacacgttctctaacaatatagccattaacgaaatacattattactgcgataaaaactataaagacaagaacacttaagttaaaaactgttatcgccgtaatagtcagtagcaattgaatgcctgcagcaaataatttattaaatattgtaaatgcaattttagacgtattattcaaatttttcttgacaaattcatagttatcataaaattcctttttgtaaaatgtgtcttgcttttcttgataactatttttttgaaaaatctttgtatagatttttttcgagctacttgtgcacaataattccaaataattatttatatttgctgtatttgaaccaatacaaagcatacaaaataaaaaagcaacaggaatgactatattgatattaattttccctccttcgaaggcccacaatgctgtatcagtcatccatttaaatgagtatgtaattccaaatcgtgcaaacgcaataataattatgattgcaaaattaattccccaataaattggatttaactttatcgaattaaagcaatatttaattagcattttcattgtattctctagccacctctattccattttcccttatcttgtctagttcctcaacctcaaaaaccccataacaaaataattttaaatattcatcagacacactttgcccaaaaatcagcggatcatctgaagcaatggtaacaagtatattattatcatacaattttctaataggatgttccttatatgtatttactcgttttaaccgtatattacttgtaggacaaatatttaatggaatttgttgtcttcgaataagactcatagcattcgtatcatctacactcgaaataccgtgattaatttcatctaatcctaacagatctattgcttttatgatttcattcggacctccaaattcccctatatgtattctttttcttaaattatattcttccgcctttctatataaagggataaattcttcaactggtaaagctaattctggtcctgataaatcaatagcttttatccatcccgcactaaatatctcgtctaaacagtgttcaattttcttaaatggagttctccaatcaaatgaaacctccggcaataatactaaatctttggcaacagagtcctttactttttttatccacttcaaaaactgactcatggatttaaaacttaaaatttcctgtaaagaaaaactcattacacataaaacaattccattatccttacattctttaaatgacgcttggatttttttataatatcctattgcaccgttaaattcatgaaaattgtcttcataccattgctccatctcctcaatagaatcaaaataatttgtttcatttcggaaccttaaatcccaacattttcctcctgttgtagaatgtttgtgtaaatcacttttttcaatctctcttattttttctatttcacgatttagtaaagcttcagtaaatttagacatttcctgtatcaaccttataataataaatcttcgaacgtatttacagcctgttccctttcttttttatagtttattcgttcatgcaaagcacttatgttatctttatatttatgattgctaataagttccagtaatagggtttcaatcttttctatgtcatcaaatgattttgcttttttggatattctttccataatagttctttttaataatgtactacgctttcctatagataacgcttcaactcttgcagcatttccatgctgatcgtagctacaaggtaatgctaaaattgggacttcatagataatgcaatcttttatggttccataacccgcatgacaaatcactacatctgctaatggcataacctcttctggattaataaaatcatatatatatacattcgtagggatcttatcatatcctatctccttacccttttcacctaaacttacaattatatcccaatccaaatgtttttgcacaatctgaaagaattttacaaaaaaactttgtagtttcaaatatctatgacttaaagttccgaatgtacagtaaatcacttttttattatcgaaatttagtcgagagacatatccctttctatttattttctttaaaccagtataaatatttacattagaatttagattttggagatctaagtattcgaattctccactgcctaaaataagtgtagggtattcgatatacaatccatctaagccgtattttaatttgctcgtcattttgtaacttttttttaataaacttatagtatattttagaccagaatatgttcttttcgataactctaatctcaatattcgtctaagccagtgtatgacaacaataattagtgatctcaatcttaaatcaggtatatagctgctagtattgggtggaaattttgtgttaaaaaaatattgcccacaatttgttgtatatagaaatatctttttttcacattggtaagcagaatcaaaaaataaatagaatcttgaaacatgaaataagactgcatctatgtcatgttcttctaagatttgtctacattcatctgaaattttatttaacatatttctatatttaatacgatcagttcccttttttgatatcagttcttgaaatgtacagctttgcaaaatcaaaaaatctacccctgatttttcaagaaggattctgctttcctcaaatcccacgtatatcaactcgtatttttccgctatatctttagtaaaatcatatattgcccaataatgactaatatgattattaacataaataactattcttttcttattcattcgtagctataaaaactcctgcatctttttgaatatgaaacacattatgggtggaaaaatactcttcaatatcgtcgataaaccttactttttcttctccaacaagttgctcctttgctctgcttcctgacagtatataatttatcaaatcactgcccgaagtaacttctagactatcttcatgccgtcttatctcaaccttgtcaaacacgcttaaaattttttcttctccattgttaagagtaaatctatcggatgttcgatttaatggcatatctacatattttctagttaaagaatctaactcttttaaatgatttactccaaaagtagatgcataaaattttccgttctttcttaatactctttttaactcacttatacctttaataatatcttcaacatgatacagcatatgatttgcaattacgatgtcaaattcttgatcagcaaacggaagattttgcacgttcccttcatagtatgcaaattctatgttatcaagttttccaatattttgttttgctgtttgtaacattccaggcgatctatctaatagggtaatttttaaaaatggaggaattttatttttatttttataccataaagctcctggtccacaaccacattctaaaattttcatgtcactaactaaattcatttgtctgaatacccactcatgaaatccttcgctattaacactatacttctcatgtaatataatccttgcatttaaattagacgctgttttatattgatcaatttctcgtttactcatattttacctcctttttagcacttaacgtattgtttcataccaatacttttgctttcaagtataatttttgtaaatattcccacttatataagaagcattgcttgttgatatatagagagtcttttaccgaatgagaatctgaacctagagatattacaaatccgtttttatccgcacaaaattctatctctttccctgtagatttccagttatttgcatttatttcatatccccaaatacctgttcctaaaaaaggaatatcatttaaaagaagccccaatctttcgacatctggatgtgctaatatatatataccttctcctaccatctccctaatatttaactgtccatatttcccaacagacaaacttcccctttgctcttcattaggataatccgcatcatcaattccaactggtgcaagtagtggcattaataatctagaacacaaatttatgtcttcatttcgatgccgactctgatattcttctagcttaaatttcattttttcttttcgttcattacattgatcataaataagtagctcacttaatttttctttcacatcactaattgttatatttttctcttttaattttaaataaatataatcaattaaagatttatactctggatatagctctccttctcttttaagataattgaaatattcctcttccgaaaagtgaatatcatattttaatcgatagtaattcaaagctggattataatttaaacgttcaaactgaatcttgcatcttttccaataagcatctatatttactttttctttttcgatactttctaaagatttaggattacagaaatactctagtacatgacacaaaccattgtacttttcataatatactgaaaattcgataccaggaataataattgggacatcatcaatacaaatttcatgcctaattattaaatcatacaattcatcatacgcagcaaatgtatcatgatctgtaattgaaataatatcaaatttctcctctttcgcccgctttattttctgtaaaaaagtgtcacttccatctgatgaagctgctgtatgaatatgtaaatccactaaataatgttttctatgttgactcagcagattttcaagtttaattatcatatattttaaatatgtattccaaaataatttatcattcatatttttaatttatatcactaccatacttattgttcaaattatcaacgcctattaattcatacatattatttacaatatccgcattggataaatgattagacgataatttttctaatgtgtttcctgaaatgtcgctcctattttcaaagcctaaaattcggactttttcattatcaatctttccgaaaatcatcgacttaatagtagttttgtacccatgatatacaaaaataaccggattcaagctgaataatttctttactaatttttcatcatcaaaaactttaaagcttataacacttattaattttacactaatatttaccattgttttcttaaatatttttattgcttttttcccctccgctaatgagctttctcctatagtacaaatcactaaattcggataactattctgtgtattccaatcatagtatcccaattcaaccgcttcttttgcttcatggaaattcaagaaaaaattattctcgtttttagagcatacaactatattgactttattatagcttttaaaactttcttctgaacataataacaacgtagctttatcaataggaaaataacattgtacaaaatcccatgactgcatcagtagattatcaacaaatcctggattttgatgtgaataaacattggtccaccataaactagtcaaaaaaaaatttaacgaactttttttccctctccaattaatttttttgctttgatatagaaatttacaatattggctaaccatactatctactataggagcaaaagcctcataagatattagaattccattacctcccgactgaatgtgtccttgcaaccagctcatacagatattttcatttaatatttctttaattctatcactagattcttttaatttatccagcctaaaaaatctattagaacctaattcgtccggagaaaataccataaaattatcatcttcataaaggagcttttcaatatacttgtctaaacattccacattatatgtactattttcgcacagtatattcatatcttcttccgctaatgtataattatcttttctgtcatctttgacatcatacagaatgtttttccctaaacacgactcttttgtaaaattcaacacttcatctgatatttttctgtcttcaaaaatatctcccggcttatacgaaatcaaccaacgttctagtatatctatattttcctgttttgctaaagcttcttttagcgggactttatgagaatattgccccattatatccgaagctccatcaaatccctgtacttgtcccttcaaactgcaaaaaacaatcaccggattcctctgcttttttacacattcaaaagcccagtccagggcagaaatcatttccttatgatcataatgtataatttttacatcatatctgagtgcttgaaaaaaattaagtatttccatatctgtcatactcgaaaaaagagagggatttcccattttgaatccatttaaatttaaaataggaataacctgaccgtcatatgacaaatttaataatttttgggcttgccacgctgctgatatagtaccggtttctgcctccccatctccaactatacaaaatacgattttttccttgtctcccataacgctaccttgagcaaatgataaagaatatcccaattcacccccatcatataaggtgccaggaaactgtggattgatttccgagcgtattttaaaccgttcttgtatactaattaaagattcaattccagatctgtttcgctttaaaccataatataattcaagtgttccgtccaaaaacaaattggatagtagtgcttctgccgcatgccccgtaccgacaacaagagaacatttcgcctcgtgcttttttgaaaaattaattagatgtgcgtaaataaaatttacgcctgggcttgttccccaatgtccttttaaattttttttcaaatcaccatacttcaacttccgttccaagaaaaaattatcttttaaaaaaatttgagctacagtcaaataatcagctgcatttatatatttttgaattacgtctatatccttatacatttcaattcatcttctccatacttaaaataccataatggtctatagcattcccaggactgtggatatttatttagtttcttaaaaattttttccatcttttttcttattttcaaataatattctaattcaagtgctgactccgctaaaagtttatagtgttcatcaatgtgtggttgaaaaatattaattaaaggcatttcagtcattaccccagaaaaatattgcatatttttctcaattatgtctatgttatctattcctaatacatatattatattagttttaaatccatacatcttacctttctttaacatttcgtaatatttttctaaagtaatactactcttgttcttttttaaaataacatctcttttgctaaagcactctactgtaaaggtatacataaagctctgaacttctttctttatagcatcaaaagctttgtatgattgaatttcagaccctatgtaatgcagtgtcccattaaaccgaaaatttttggctacttgatttacaaggagtatgtgacttaatgcagcttcttcgcttccaaaacagccagtacatattgttaatctttcaatatcaggcatatcttttccgcctaatatttttctaaaatgtacttctactttttcatatgtatccaaattttgatcctcgctatttaattccaaattattaggacaaaatttacatccatgacatgtgcttcttttgttcgaatttaatgtaattacttttccttgtttcctaaaataactagaagcacagtcatcattttcaagattgtttatggttccaatctctatatttttttctatatatattacgttatctcttaaaacaaaaggggaattattattattagataaaccaaaatagaaaaattcttctggatgtgtctttaatgccattcgcattctaattcttggtgttaatccaattgcatttactccatttttgttcaaagaaattagtatgatatcttctataggtatactatatttttcacttaatatttcaaatccatctaatgttttatcaaatttgtccaaaacatttttgataaattcactttttccatccgtatactttgctcgatcatccggataacgactacacaatttttcttttaattttacatattctttcctatcttcttcatgacttctcatataatttctaaaaaaaatttgtttataccagcttgggctatccgaaaaatgtacatgtaaataatgtgtccgtttttcttctggtccttttgcaaaaaaccttctttcatcatccccactattttccctataagtataccccaacttttctattagatttctcaggatttcaaaatcctccttcgactctatcattacagctatatccaaaataggtttagacttaatgtgtaatgaagtactaccaacatgttctatctttctaatgattctccctgcgtttttcaataatacttctttttcatgtaagtattctttatcccataattcataatctgttttcaaagttacttttttacgttctagacctaaaccactatacattattcttcatccctttactttcctaatttccaattgcaatataaacctactttttcggcttaagttagattttattccacaatcctctctcttttagttgttatggtaatactccccctctttctcataattcactcaactgcgattcaaatacaaatcaaatgttatattttctactccatctgattatataaagaaccccctttcgtaatttatacccctattatgtaagatggactcatataaaaaattttttatagcaaccctacattcaatcttccacttgtaattaaatactataaattaatttgcttcatattctacttgcggttatcgcaaatatttatcgaatcacgtatatcgtttaagattttcattatactgtcatattctggaattcgattaaaatgagttttaatcattattacattagctaatttcccccataaatttaataactgatagactttttcatcttggtttttccctattctttgcttataaaacggaattattttaaaagagatacaaaatcttatcccaagcaaactgtaaatttgtatatttttgtctttatcttcataaattatttgaaaaagccgtatcaaatcaagtatatattttgtatttttttttattgaaatttcctcaaccacaaaattattttgctcttctatacatttcgagaagtcaattagttgacaatacatgtgcctatagcagcttttaaaaaaggcctgctccaattccgttactgttatttcttgctttgatgacttttcagaatctcctattacaattttgctttcatttatgccttcaattaataccgaatgtttattatgcttcttttcaaaaaattgactatatgaaatataatattcatcaacattaattatagctcccaaattatcatttacttttttttctatcaattcgtataagtcatcaatttcttctcgaacacatattttttttattatgtgatgtttttggaaataagcagatatttcatctccgaaaataaatcttttccctttttttcttaaaaaaataggttgaaacccccatggattccagtttcgtaaatattgttcttttattttttcattctcaatgacctgacatactatttcactatcgctgaaaatatccattaagctgtggcttaaattatgtttagctaatagtttgtaatagtaggaaccttcacaattccaaaaaggcactatcctctgattgtctaaattggtcatatatcctctccttaaatgctatacttatcctttccgactcataatctgttatttctctgcatcctaataaaatattcttcttatttgtaccatgataatcacttcctgctgttataatcattttatttttagcagcaatgtttacatacaaatcttgctcttctttgttatgctctggatgaaaacattcgatcccgtctaatccccatcgtttccattcatttataaggctatttaattgtcttgcctttaagctcagcctcttaggatgagccaaaactgctatcccgcctgaagaatgaattaaggctattgcttcttctaaattcattctttcttcccgaaatctatcaccgctctttaaaaaatcaatatattttctcatattagcttttttcaaatagtctattttttttactagtacggattccatggaaaaattgtaacctaagacatgaatttcttttccagcagtttcaaccgataactcaacgccatttattatttcagtaaatgaactaacctttttcttttttattgctctaataccatcaaccgtatcatgatctgttatagaaaccatatttaattttaacaggtcaaactgatttagaagttcttctattgtatctgagccatctgaaaatatgctatgaatatgcaaatcaatcatgacttttttcattatccaccaattctacaattttttttatactacttaattctttaatagataatttttcaaccggaatctcaattccgtatttttcttctatatcgactataatgccaacaaattcaaacgaattaatgcccatctgttctaaatcatcaatttctccaatagatgaatctatcaatggacaatttgataagataatactttttatttcctctacattaacgtctttcataagtgcctccttttcaaatatttttaaaataaaggtttttttgattttacgcacattttttctattgtttaatatgttttccgaaatggaatcttttctatattatactttatcattaatcattattcaagttttttatctttctttttgccttaccatatattatatttatatatagtttctttatataattttacacttaataatttaactaatatttaaattgtaaattaagtagtctctataaactcaaatcagagatttccaactagatagaaataatgattttctaaaaatgtaataaggtagatctctttacaacaatatacattaagctatgagtacttactcagttcttttctagcttttcagtgatcaaatttacaaattgttttttgaaggtatttcgataaatctcttaaactgatctaacatataaagaagttcttcaaggttaaatcctttgtattatgaacgtcaaatacaacagtacataaataaccgtcaacctttctctacttaaaggcaacggctattggcgcaggtcttttaccattggatttcaggacagataaccatccagatatccaagatgtttaaagatgactgtttccgacatatcgcatacggcgccccatcaatactggttcatattttgacaaccatttttcgacagtcaaatttgcacattaattgttttagcccttctacagtacccttcttttgtacgagaccatctaaagcccataagttagttccatcttttacagagaatacattattcttattctaagataatatctattaattaaagcagacttattatttcgagatgatttttctcctatctataaaagatttttcaaaaatctcctcgaataacaatgccctactatcaaacttttaaaaaatcaagaatatttctcttttcctgaacaactttattcgtaatatattgtttaagaaaaatccttcttgttccacccatatacatgcttaccgactgtttcatgcggactttctgcataaatttaagttgactgaagtgaggtgtgactgaaaaatgccttgatcacaatgaaggagaacctacttctaacacatatccccctctgtataccacatgctgcggggcaagtatttatcttctttaaatacttcagggttgtattcctttgcaatccgtacgtactttttatgaatgtcttcaacacataatattgtcatatgttcatccgtctggctttagaaaatgtgtctttcaggatcttcatcgatcctgcggtgcctgggatactcttttcaccatagccacataataatccaaaatgtgcatacatcatgcttatgcatctttccaactatctcgtccgtagtgccgatcactctgaaatttacagctcttagtataaaatcaaatattttccccaccacgtgctccggttacatactataagctcaacaggccagtatcacataggtccatttctctttgatagccagtaatactaaaaaattttaactgcctccaagatttagatcgcgtacctgtaacttcatcgtcccatctgagaccacagcagcgtaaaaagcgaggaagaaattctatagatatacgtttataaatgcatttagaaagtttttaattatatgaagtatcaaatagtacgaaatgagttctcttaataataatatagtatattgaacttgactttactattttatcctatagagaaaatttaatgtgttttccttacttagtcttgactttttatttatatgcctcataatatgtatatgaattatagaaggcaggcgtctcttttgaatggactattattatttcatcacattaggcaaatggtgatacgatttccttttatttaacttatgaaccatacctcaccataacatttttataattgaatgtaacctaatataatacattacaatataagtagattttagataaggaaaatacatcatgattaaagttgtatgcttcgacattggcggcactcttatccctttatcttcaccttcttttatagattctcttgcttcactaatcaaccatccttccatggaatttgaagcgaaactaatccaatatttcggaatccagaacggggatattgagtctttctgcaaagatttaagtatattaaacaaaaaatcaataattgaaaattttataaatagctacaaaccactgcaaaaactatttgatgatgtactacctacacttcaatatttatacaagcaaaattacattttagccacattaagtaacgctatttccatcgaaccttctagtttggaattttgcgagcttaataattatttttcatataaaatttattcatatgactgtggtttcagtaaaccctctaaagaaatctattgtttactggagaacatgctacatatttcttctgatcagattttatatgttagcaattctctattagatatactgggagcctaccgcagaggatggtattgcattcttataacccgggaaaacaaaatgcctttttcatacgatccaaataaacccaggctattttttattaacaacttaaaaatggtactagagataattgaaaacatctaaccgaaaacgtttttcagaattttattgttagcaaatactatatttctaactgattcagactaactcattagcttttttactaattagagctatttagaagtttactcaaaaattttttggtaaaatggaaaactagatgatttagaccgttcatggaaagatactataattgagcggaataagactatatagaatataggcaggataagagggtggtcgtttagtccaaagaaacgccccgcttaactttgtaaaggacagtcaatctaaattcaactgtcctgtatcttaaaaaattcagtttttccatgtgagattgatacactttatctcgcacccttaaagacgtaaatacaccacataaatacgggatatttttactttcaggttattgtttccagtttcttatgccctcacttgttagataatgggtgctttgaacggctcgctaaagctcttcgaaccgtcgaagtgcccccccccttaccagcaagctggcgcggcgatatgtcttgcgaccgccaccgtgggcggatcactccgtcggtttatgagtttttaagcctatctttcgcattaactagaattatcttatccaaaatgaaaagaaataattacatcaagcaaaaattcatgaaatatcacaaatgctcccatcaacagagtatcctccagcgtgttccgtttcaaaacgataaatccaataaggaagactagcaaattctaaaatagaacgtgtttcaaaatatccccattcatatacaaaagtcatattaaacaatactgctaaaataaccgctgataatgcaaatgctatattgcttacccctttttcataccaactgataaatgccagaaacagagatatagctgtaaatccaaaccaaattatagcgtagtttttggaaaaatcctgcaatataatttgaatacaaatagtagcttgtaaccataccgacaaagaaagcagagacattgatacctgctcttacggaagaattactgtaaacagaaatacacaatgcaataaatacccaaattgcaaaacgcctgagaaaatttacaatgtccaaataggaaaacacaaatcgcaacctatttataggtatcatatctaaaaattttgaaaaagtccccaaagctgttccaaagcacagtataactatggtatttatattttttctattaacagggagtttattttccataccccttatatcattcaagaacttactcatagtacatcttcaaattcaattttccctatcaaatattaaatatcttgttccttggaatgtcagttttccttcatctccctctgcaagcattccgtactctgagccagatacagacatctccattctgtcaccactttctacttgaaaagtgacataataagtagtactggatgtagtgtgaccatgtactcctgatgtatctccagcgtttggatgattgtaatgcgtgatattctggcgttttgctactattcttgtcgacacagttaaacggggagaataattgtttttatgccaagtagcaatcccctttgcaaaagtgaatataatcattataaaatattagtataaatatcgctgggaataacattccgattatattcaacattttcttgttcctctcttatgtaactttcaatttatcatttaccatacagtcgagtagatagagccttgcaactctagcccctcacagatccgtacgtacgactttcccgtatacggctcctcataataacattcactctgaatataagcagtagtacgtctttggttttgcaagtggataatattttaacatctcccagtaaccactccatgtataggctcctctacaaccacggtggcttactgctttgaataggaattgctttactcggtgtaggaacgcacttagccttctataattccatgttactccatagtagcgatagtgctctacaaactttacattcagctcttttatgatttctctaaccggtcgatttcgattatcatatatccaaagtttgtattctttcatcttgcgttcaaacttctttcgtgatgtctgcaactttaatgcgaaagttccctttctcgttttcccacaatagaatgtaaagccaagaaaatcaaatgtttctggcttacctaatcctctggaaaatctatttgctactgcaaatctcccaaattcaattattctgcttttactgctttccaattcaaggttaaatttctccattctctctttcagttccgaatagtaccattctgcttctgacttgtattggaatccagctacaaaatcatccgcaaagtttaccagaaaacagtcgccttttaaagtctttttcaccacaaatttgaacaacagcgtcaatacattatgcatataaatatttgctagcataggactcatcactgaaccttgtgcggaaccttcctctgttgattcaaatgttccatcttccattattccagcctttaaatacttctttatcagccagagttaggggcttgaatgtgccattccagagatttcatcacccagtcatggtttatgtggtcgaataatcctttaatatcaacgtccactatgtagattgttttcccataacagattctttggtatacttcttttacttctttgtggcaacctctgtttgatttaactccatacatgcagttcggaaatcttggttcatagattgcttccagcaccttcttcactgccatttgtacaatcttgtcctcataggaggcaatcccaacggtccatttttccatttccctttgatatgtataccctcaatgatggaagtggtttaaaagttttttcgacctctgtactaaatcttcgatatttctatcaaggttctttccaaattcttcctttgtcactttgtcaacgccaactgtctttttaccgtctaattcgtggtgacattttttcagcaagtcgacatttatcaagtgatatatggatgtgaatacaggtttctttgactctgctgttatttcagctattctttctaatttggttctctttatttccccgtccccgagaacagataatatgtcctcagaaaggccgttactatacagtccccttccttccatcggagttacccgatttcatcagtactatgagactgcccgactacctgtcatccgtttgaagttctccgttttcaattaaaacttcatactcctatccgaaagacagcaggttctccccagttgatgtatacccataatgtcaagcataattggccctttgcccccacagcgccacacaattctcgccataatgacttgtgtgatgttgccttccgcaccagttaagacgtcgacctactgaagttaacttttcgacgctcaatagcattgcaactctacttttttgctgactatgcttgtcagttgctgttaccagcaacatcccaagacttgctattatccggctggctagaccttagataaatcggattcccaccgacttggttacacacccttagctgggcacacaactgggatttatcggttgctatcaatactgggacttaccaaattttaatatatactgttaaatcttataaaactatcccacaattcatcataattcttgaactcataatacatatcttctatcttaaaatattgtcctggactgattgtcagtttctcactgtctgtgaagcagagtgtgtaataagaaaccgccccatttgataatgccttgctttcatctactgcattgctgagttccacttgattcagcaaatctataaaaccacttatttcactgtctgaaaaagaatacgaatacctgttgtctttccctcctgtagttcctgtatgttcaattttatcgacatcagatacaccgatactcgccaagtcgatgttcggctcttgcttttcacagcctaataaaacacttacattcaagaatgatgtgaacaaaactattccgatttgtctcatttaaaaatgcctacctttaatggttcaattctacaaatccaaatttgtctttatctgtattatatcatgctgttataagaattgtcattttgcttttgaaaagctactaattagcctatgttttgtaaaggggtgctgttcatgcaacaagtccttgacaaagcatagactaataggttttaaggtaattaagtagaaatgaaatagtctgctgtttcaaggcaacaaaaaagacactctatttaaaatgccattttcttataactctgtaattttccttattttcctttaactgtattgctgatagatactgtatttatgcgaatatttccgatttcttatctcacgacaaacgcatgagtaaataaattgtaaacaaaccttctttttctgatatgataaaagaaaaaggggattaggtatcatggaagaattacttgagtggttggaatatatagaggatgtacatcagagcaagattaaaatgaggcgtgacaaaagaatttttttaaatcgactcatttaccacagaatcgtcattctgtggtaagaaagaaaagggaaatgcaggtgagtgggatgaaaagtacagaaaagagagagaagattttccgaccagaaaagatggatttagggcacaatgaactgttgctctggaaagataaaaaagacgaaacaccgtgtgcagcacttccttatcgggagatgctgtttgtctacctggaaagaaagacggaagtgaagggagtggttcagattccgccggtggaggaaattacaggagagatggaaggaaatttggtgatatggaacagaacgcatcggtgcatccgtctggatctgtccagtcagaaggagacggccggagcgttgttcatccggcttgccgagcacatcccttttgcgtttctgggggcgacgccgtggatgcaggtggagaatgagaaggattttcaggagatggtaagaatggtggatctgtatcaagaaatccatgggggaacctgtttgtaatgtggagaagaaaaagccgcctgccttttgatgtggaaagaaaatgacagaagcggcgtttggtggtacaatagacaggacagatttgcatgattgataaaggaggatcgggatgaagaccatttattttgcaggcggttgcttttgggggatggaggcatttataaaaaagcttccgggtgtaaaggagacggctgtgggatatgcaaacggaacgaaggcgaatccgacttatgaggaggtttgtagccatacgatcggacatgcagagaccgtgcgtgtggtttatgacccgtcgcagattaccctggaaatgctgttgaaagcattttttaaggtcgtggatccgacagaactcaaccgtcagggaggagatgtcggtgaacagtaccgaaacggtatttattatacggatgaggaagaccggaagacgatcgaggctgcgatcagggccgtccgtgagaaatatgatcagccagtagtgaccgagtgccggaaactggtatgtttttacgatgcagaggagtatcatcaggattatctcgataaaaatccgactggatattgccacattaatctacttgatgcggaggagtttattgaggaggagatgggagagagaacaagatgttaatgcatccagagctttaaaaggcccggtaaatggccttgtgtgtatgagaaatccactttcttagaggataaagaaaggccgtgtctgcaactggcatctcattgttattgagttgctgtacgcagatacggctttccttatttctggaattctttccggagtatttcttttggcggctctatctcattggcgatggtatgttccgtcagttctgagagtgatttgagtttcttgttgatcagtggacgcatacagtttggcacatgctcctgatgagcccggtggatagccacacattccttgcagttgccgtgataacggcaggctttctggcaggggcagtgatctttctcccgatactcccggcggaatgtggcggcgaattcttcctgaagtcttagcccctcggttcggtcgcctttgtgaaacgcatccatagcttctttctgtattggattcccttcgatgatcatcggtattcctccctttgtttccctttgtacggccttattctaccatacttttctctgataaaaaagaagaaagaagcgggcttaacggctgagcggtcatcacataaagttcatggagcgcacgggtaatggcgacatagagaagcttggcgtctttcggatgatccgaatagcgtgtttcatccggttcccaaagaattacgcagtcaaactccagaccttttgtcagggagactgggagaaccatgacgccgttgtggaagctggtatcatctctggccggggacatatgaagtttcgattttaacttggtggcttcatcttctgtacgacagatgacagcgatcgtctcaaatccttttttttgaacggactggagcgtcatttccagatggtgcagcagatcctgggaagaaacgtgaatcacttccaccggttttccgtggcggataaccggatcgatttgataaccgccttgggaagcttttttcaggacttccccggcaaaatttgagatctcgatcgtgttgcggtagcttttttgcagcagatagaagctgtctttcggggaatcgaacatggcttcttttagctgatcccagtcattcataccggtttcatagcggatattctgggagacgtcgcccatgatggtaaaataacagtcgttgaggacttgcttaagtacataatatacggtctctccaaaatcctgagcctcatcaataaagatctgactgaatacttcctgatcctgcttctgaaagatcctgcgctgaatcaggccaaatgcggcggcatcgtacacatccagacggttcttagcgaccccctctctggtaatggaaaaatccagctccggatgtccctcctccagatcctgcaaaaaccggaggtagagtccgggaatggtccatttgcgggcggaagagtcaaagtgctttcgaaaggcctgccgtttcgctttccggaaatcggctgtcttttccgtgcagagaaatttcagtctcgagagaatccgttcattgagatggcgctccatctggtaaagagagtcattaggatgataactccatgtttccgccatgctcttttgggaaaggatcacgccgagatccggatcggtgatatccgaaagatgcagtgtatcttcgatcgttctgcttaaaaactcgtccagcgcacgaataaacagcaggtggcttttgacgcttgcatccggataatcggcgacaatctggtattgctttttccaggcttttcccatcagatacggaaatacagcgtccatccgcatttcatggatatggtggacgtccagttccggtagaccacttcggatatagtgcagaagcatatcactgcttccgatgatacaaaattctgacggcttataaagctcttcataattgtacagaagataagagatccgatgcaaggcgaccgttgtctttccactgcctgccacgccctgtacaataatgttcttattcggcagatcccggatgatggtattttgctccttctggatggtagcgatgatatcaccgagaaccgcatccttattctgggacagatatttgaccaggaggtcatcattggcggcaatatcgtcatcgtaatagccgtgaagctgaccattggaaatatcataggtacgcttctgatgaagatcaatctccacatcatctgatccagggaccgcatagcaccccttaccaagcccgttttcataatagacattggctaccggggcacgccagtctacgatcgccacgtcggtctgattgcgggaaatcccgtttttcccgatatagcagcactcggaagtatcatacgtcagatcgtcgtagacgatccggccaaaatacggctgatccagcgccgcacggttttttctgagggaattttgcagatgttccaaaatgttctgacttgcgatcaactggccgtaagaatctccctcccccttacggacagcctgaaataatgctgtaacctcttttctcgaagcctgttcacgggcttcgtacagccggatgttttcctgaatcaaagaaagacagctttccagatgcaggagttcttcttgataatcttgattcattttgatggctcctttctttccggccatcccaaacactgtcctttcattataccaaacccgaaaaagaaagaaaatcaaaaaaatgggatttttccactttttttcaggtatgataagtgaaaagcttttcagagaaacggacttcggaggatgaacgtggaagaagaaagatatatagaaatcgtaacaacatacagtcccatggtataccgggttgccttgcacgactgtaggaatcatgccgatgcggaagacattatgcagaatgtattcctgcggctttaccggttcgggccacggtttgacagcgaagaacacctgcggcgatggctgattcaggtgacggtgcgggaatcgagacggctttttgccaagccgttccggaaacgggaggaacttttcgaagagatagatccgaatgtcatggcggcagggcggcgggaggaaacttcagacagcggggcggacgggacgatcctggcagatgtattttgcctcccgagaaaataccgtgtagtgatttacctttattattatgaagaatattccgtccgggagattgcggacattcttgggaaaaaggaatcgactgtccagaccgaactttggcgggcgcgtcagaaattgaaacaaaaatggaaaggggagacaaaacatgagacagcagggaagaaggcaggaaacaaaacaagatccgatgattgtacagtataaaagagcctgtgtcaagcttttgccgggacagcaggcagtaaacgaggtgatacagatgaaaccagtcagacaggcaagaaggcggctgatgcataaaaaggcagttgctcttgcggcggcatgtatggggatctttgcctgctctattgtaggaaccgcggcagcccgacatttccaggtggaattttttgtggacggcaaggtcctgcagattggagcaacgatggaacaggattcagacggctatgtgattcatatggatgagaaagaacaggggcagagggatatgacactggcagagctgcttggtatttccgtagtgcatcatgctgacaaaaataccgtgggtctcgttcttggagaagaagagcgggatattacagaagaactccggacacatgggagctatcagaccgcctgggaacaggacggaaagacttatgttatccgggtgacgggaggggagacgtctccggcggtcactgtgactgaacagtagcaaacgcttctttcggagtcatgtgatactttttcttaaatatccggtaaaaataagacagattatgaaatccgctggaaaaggccgcgtcaatgacggaaacctgtccgttttgcagtagtttccaggccctttccagacggagcgtattgatatactcggtacaggtcatccctacatgcagcttaaaaaagcgcatgaaatgagattcactgaaacaacagatacgagccagatctgccaccgggatcatatcttccagatgtgcgtctatataatccagcacctgtttgagcttcttactctgatctctggaggatggcgccgggttcttcagaagacggtacggccagatacgggaaaataattccagaaataatgctttcatccgaagctcatatccatctccacgggatatatactcgtcagataactgcctcatcatgtccctaagcagcggatttgccgggtgatccgcctgaaatacataagggaatacaatttcacgggaagcaaacgggcgcagatatttcacactacaaacatctgatccgcccattccaagaaagtccagatgaaacacaaaggactccgacatcatgtggtccctcgggaaaaaaccggacgaatgaagtatccttgggggaagcaaaatcatatcaccttcttgtaccggataatcgcacaaatcgatatggtacacacaggcaccggagcggatccatgtaaattctgcctcctcatgccagtgtgccggtaccaacggaaaggactccgacaacaccacgtcatatttcttaagtggaaacaaatgatccccatgacttaccccctcacgtttcatcataaatgaacggtcctgttgctctgttactacatacattcctcacacctcccacatcatcttttacagccctcagcgcttcacgcccgaaatatattctgacaatcatcgtaaaacagcagaaaagtacaaaatagtgacataataatacaagaaataaaaagaaaatgcaagtataatacagttgagacgggatcggaatcttacagtgaagatcgattcaaattcagaggaggttttaaggtatggcaaaaaagtggtggcaggataaggtcgtatatcagatttatccgagaagttttcaggacagcaatggggatggaatcggagatcttccggggatcatttcgaggctggattatctgtcggatttgggaattgacgcaatctggctttcgccggtataccgttccccgcaggatgataatggatacgacatttcggactatcaggacattgatccgatgtttgggagtctggaggatatggaacgcctgattgcggaagcagataagaaaggaatcaagatcatcatggatctggtattgaatcattcttccgatgagcatcggtggttccgggaggcgaaaaagagcaaggacaatccgtaccatgattactatgtttggcgtgacggagaggaagggattcttccgaatgagatgagagcatcttttggcgggacggcatgggaatgggtgccagagcttgagcagtattattttcatcagttttctgtgaagcagccggatttaaactgggaaaatccgaaagtcagacaggaaatttatgatatgattttgtggtggatggacaaaggagtgggaggattccgactggatgtgattgatcagatcgcgaaagagccggacagaggaattacagcgaatggtccgaagcttcacaaatggattcaggaattaagccgcgagacattccaaaaagcggacttgattacagtgggggaaacttggggtgctactccggagattgcaaagctttacagtaatccggacggcagcgagttttctatggtgtttcagtttgagcatgtgatgctggatcaggagccgggaaaagaaaaatgggatctgagcccgttgccattcgtggaattgaagaaaaattttgcaaagtggcagaaagagttgtatggctgtggttggaacagtctgttttggaataatcacgacctgccgcggattgtttccagatggggcaatgacaaggaataccggaaagaatccgcaaaaatgctggcgacagttttacatgggatgcaaggaacaccatacatctaccagggagaggagctgggaatgacgaatgtcagatttccggatatcactcattaccgggacattgaaacgctccatatgtatgaagagagactggaagccgggtacaaaaaagaggagattcttcgttccgtttatgcgaaaggacgggacaacgcccgcacgccgatgcaatgggatgacagtaaaaatggaggctttaccgatggaaccccatggatagaagtcaatcctaattatttagagatcaacgcaaaaaaagaaatttcggatgcggattctatttacaactactataaaaagctgataaaattacggaaggagaacatggtcttcacacaaggggagtttcagctcttactcgaagaagatccacagatttttgcttatacacggacaacgggcgaggagatgatgtgtgtcattgcaaattttaccgataaaccggcgccgtgtaggctgcctgagacatggcaaaagaaagagctgttgatacataactacaacacagaaaatataggcggagttttacgcccgtacgaagcaatgatctatattgatagataatatgtccgtatatgagggacgtgttccgatgcatcgggacacgtccctccctatcacgatgaaacaaaaaggagaagctatggtggagttgagttattttgagattgatggcgcgatcggcggaaaccaggactggttttctaatgtagtaatgcatatcggcggatgtgcggcagcggcagcatgtgattcgtgtatttattttgcgaagcattttggtaatacagggtggtatccatttgatgtggagcatttgacgcaggaggattatgtacgattcagtcagatgatgaagccatatatcaagccccgggttggcggtgtgaaaaatcccgagtggtttgtggaaggcttttaccgatatctgaaggatcacttttatccgggcaggcctgtgctgaggatggaggtcgtgcgtggggaagcgtcgcaagatcaggcatgggaggcattgaagtcccggattgaccaaggtctcccggttccgtttttgcttcttcgccatcagaaccgggaagtgttcgaggactatatctggcactggtttatggtgatcggatatgaggaatcaaaggaggatctcctggtacagacggcaacgtatggagaaaagaaaacgttttctttcgcagagctttggaataccggctttgaggaacggggcggtatggttttgtacgatctggattttgagaatccggatttttgagagaaacccacacaagcatagctttagaatttcttgcctgccacgctttcgtgtgatacaatcgttttagtgaaaattcgtatatagaaaaggagaagacagacatggcaaatccagttgttacttttgagatggagaatggggatatcatcaaggcggaattatacccggagatcgccccgaacacagtcagcaattttgtttctcttgtcagcaagggattctatgatgggctcatttttcacagagtgatccgtggatttatgattcagggcggatgcccggacgggacaggtatgggaggccctggttattcgattaaaggagaattcgcgcagaatggcgtagccaatgacttaaagcacacaccaggcgttctttccatggcccgctccatgcatccggattccgcaggcagtcagtttttcatcatgcatgaggcggctccgcatctggatggtgcgtatgcggcatttggtaaggtcatcgaaggacaggaacatgttaataagattgccgagacagccacagattacagtgaccgtcctctggaaactcagagaatgaaaaaggtgacggtcgatacatttggagaagactatccggctccggaaactttatagagagcagaacaggcgcccacaggcggggagaagtctcccgtcctgtgggaatttattttactattgagccggaatgtggtacactatacgaaatacggaaaagtataagaaataagaggttgattgcagatgagtatggtgaaaaccgacaagcttgtatttgaatatgaaaaacgagacgaggaagggaatgtcatcggaacgcagcgtgctatcgacgaggtggatatacagattgagaaaggccggtttatcgcgattctcggacataatggttcggggaaatctacgtttgccaagcacatcaatgcacttctcgttccgggaggcggtacgatgtgggtcggaggacgggatacgaaggacgaagatgagctgtggaatatccgccagagtgcaggtatggtgtttcagaatccggacaatcagatcattgcaacggtggtagaagaggatgtcgggttcggcccggagaatctgggcgtgccgacgaaagagatctggcagcgggtggacgatgctctggagaaggtaggaatgacggagtaccgttaccgctctccgaataagctctccggcggtcaaaaacagcgggtggcgattgcgggagtagttgccatgcggccggaatgtattgtgctggatgagccgacggccatgctggacccaaatggccgcaaggaggtcattcggacagtgcgggatctccagaagcaagagaaagtgacggttattttgattacccactatatggaagaagtcacggatgcggactatatttatgtgatggacaagggaaaggttgtgatggagggaaagccggagcagatcttttccaaggtggatttgttaaagcattaccgtctggacgtcccgcaggcgacagcggtggcggacgagctgatcagaaagggatttccggtttcagccggaacccttacaagagaggcgctttgccgggaagtggtttcccttgccagggagcggggaaggattcaggatccgctcgggaaggaagtatacagggacgaggtgaaaagccgtccggacggggatccggttttgtgtctgaagaatctgaattatatctacaatccggggacagcctatgagaagcacgctatgaaaggcgtggatctggatatttggcagggcgaatttatcggaattatcgggcataccggttccggaaaatcgacgctgatccagcatctggacggactcatccgggctaccggcggagaattgtttttccagggagaaaatatttaccaggaaggatattctatgaagaccctccggcagcaggtggggttggtatttcagtatccggagcaccaactgtttgaagcggatgttttgagcgacgtatgctttggaccgaagaatcagggactttccgatgaggagtgcaggcagagagcaaaagaggcgcttcagatggtaggttttccggaaacgctgtacaatgcctctccgtttgatctttctggcggacaaaaacggcgggtggcgattgcgggcgtccttgccatgagacccaaggttttggtgctggatgaaccgaccgcaggcttggatccgaaagggcgggacgatatcctggatcagatcgctctgcttcagaagacgacccacatgacggtcatcctggtctcccacagcatggaggacgtggcacggtatgtagaccggatcatcgttatgaaccgcggggaaaagatttttgacgatacaccgaaacgggttttccgacattataaacggctggaagaagtgggacttgccgcaccggaagtgacatatcttatgcatgaactgagagcgcagggcatcccggtctccacagatatcacccttgtggaagaggcagccgatgagatagaaagggtattaaaacaatgatacgagatattaccataggccagtattatccggcacaaagtccgatccataaactggacccacgtgtaaagattgtcagtacactgttgtatttgatttcactatttttatttcggagcgttcctggttacctggttgccacgatttttttgtttggctgcatcgggttgtccaaagttccggttaagtttatcctgaaaggattaaagccgatttttattctgcttttgataacgattttatttaacctgtttctgacaaccggaggcaggacacttctgcatgtctgggtgttccgggtgacagaagaagggctgcggacggcggtctatatggcgatccggctgatttacctgattatgggagcgtcacttatgacctttacgacaacaccgacagcgctgacagacgccatcgaaagtctcttaaaacctctgaaccgggttcatgttccggtccatgaaattgctatgatgatgtctattgccctgcggtttatcccgattcttctggaggagacagacaagattatgaaagctcagatcgcgagaggtgcagatctggacagcggaaatataatccagaaggcaaaggcgatgatcccgatactggtgccgctttttgtgtcggcattccggcgggcaaacgaccttgccatggctatggagtcccggtgttaccggggcggcgagggacgcacgaaaatgaagccgctcgtgtacagtgggcgggatatcagggcgtatgtgattgtgatcgtgtacgtcgtggtggcggtggcagcgggcagattgctaccgttccatgtttggattttttaaaagaaagaatcgaaaaagaatcttttgataatacagcgtcaagagattctttttttgttataataaacatgacagacaggtgtcatgtttgttgtgttatagtaagtgcaaaaggaggaactatgaaaatcgacaggctgatcggaattttatccgttctcttacaaaaagaaaaggtgacagcgccggagcttgccagccggtttgaagtgtccagacggacgatcaaccgggatatcgaagatctgtgtatggcaggaattccggtggtgaccgagcaagggagggacggtggtatctcgattctggaaaatttccgcctggaccggaccgttttgacccgcgcggagatgcaggacattctggcggggttgcggagtctggacagtgtcaacggtacgaatcgctacggtcagttgatggaaaagctatccacaggatcctctgatttcctgaccgggaaccagtcggtgctgattgacttgtcatcctggtacaaaacgacattggcgcccaaaattgagcagatccgatatgccattgaaggtcggcggttactgatgtttcgttattttgcgccgtccggggaaagcctccgcagaatcgagccgtattatctggtatttcgctggtccagttggtatgtctggggatggtgtgaaagtcgggaagattttcggatgtttaagctgaaccggatggaggagctgtgcgtgtccgaagagatttttacgggacggaaggtacctatgccggatttgagtaatgaacggattttcccgggtgggatccaggtagaggctctttttgaagcttcgtgcaaatggcggctggtggaagagttcggtcagaactgttttgaagagcaagaagatggaaggctattgtttcacgcagattatacgagtgcggaaaatctcctctcctggcttttgacgttcggtggtcaggtggagctaaaaagtccgaaagagctgcgtggggaaatgaaagagcggattcgccggatggcaaaacggtatgaagaaatttcagacagcgatgagaggaggaaagaacatgaaatatgactggatggatgcttatgtattgaaaaagcgaggagtaacaaaagattttcagccggcctggaactggattcgttaccatgtgggtgggaaaatgtttgcggccatctgtctggatcagaaaaagaatccttattacattaccctgaagctggatccggtccggggagtgtttttgcggacacaatatgaggacattgtgccgggatattattcggataaggtgcactggaattcgatccgcccggatggggcggtgccggatacactgatgcaaaatatgctggatgaggcgtatcaccttgtcttgaatggtttcagtcggaaacgccagagagaaattctggggattacctgttgcggcgcggattgtaaagcatgtgattgctatgggactatctgcctgggatgtaacgaatgtaatggcaaggtctttcatgctccggaggggaaagcgtgtccgatttatggatgcgcggtcaacaaaaggcgatggacaagctgtgcttcctgccgggagatgccatgttccatctggcgggagacaagggaccccgcactggatgacgcggcctttgagttggatcttaaaaagcgtgtggaacatctgaaaggagtgtacaaagatggcatttgattataagaaggagtacaaagaattttatcttccgcctcaaaagccggggcttatcatggtgccggagatgcagtatgtagctgtccggggcaggggcaatccaaacgagccggagggagactataagaaagctatggggactttgtacagcattgcatttacgatcaaaatgagttacaaaggttcccacaaaatagaggggtatttctcttatgtagtgcctcccctggaagggttatggcagcaggaggggatggaaggaatcgattacacaagaaagaacgaactggaatggatttccatgatccggctcccggaatttgtcacaccggacgagttcacatgggcgaagagagaagtggaacaaaagaaagggatagacgtttccgaggcagagtattttcgctatgaggaaggactctgtgtccaatgtatgcacatcggaagctacgatgaggagtcggaaacaatccggaagatggaagaatatgtgaaggaagcgggatatcgggtagatttgtcagaggggagaaagcaccatgaaatctatctgagtgatccgaggcgaacagcgccggaaaggctgaaaactgtaatccggcagccggtatgtagaaaagacgggtagtttgtaagtcagaatttgatttatcaccgaagagaaaacgagcgttttcagaaaaaactggaaacgctcgcggcggttattcctcaagaggagtcatatttttatttgtcacaggaattccgttgacctccacactgtcgctgagctggatcatcagatatggaatcccgtcgatcagccgggtttctaccagatcggtccggtcgggatggaccttgatcattacatccggagtcttgacctcaaaggtccgggtgttggctacattggaggcaagcagtgaggaggtctcccccgcggcggcctcaaactcccggtcaaactgctccagatgctcttcttttgccccactccgctccagaagcttcttcacatctgttttctccagacgcagcggctccggctcctctttgtgctcttcgatcagttccgtgagctggtcgtgcagcgttttgaccgtgtcaaaattgcatgcgtctcccaatgtatcacttaccagatactgaaatgcagacttctggtgtcctgcaggcatcggcacatggcatccgagaacattgtcgatcagatcatcctgaaattcctttgcgtttttcgagtagtacaacaggctgtgaatatcagtagaacgatccgtaaacgccgggaacaaaaatccgatatccggcatctccacgatccagtcccggatccggtcttcaatatggtttgtctccgagttgtagcagagcccagccttggaaagcttcactgggcagatactgcaaaggaggaactcgtacacctcgtccgaggcatcaaacatctcttccccgtcagaagattttcccggaatgtcgtaattggcgtggatcagaataatgtaataattttccccataattataaaagtcaatgatcttttggtaaaattcatctaaaagcgcatcatcctgaagcttactgtcccgaagccgcagaaggaattcctgggtgccgccggatgcctcctgctccagaggaaattccatgtctatcagattcttcccgatacttccggaaagcgtctttttcaacagatcgaaatatttaaacatctcttcttcgggaagagagagaaacgcatctttggacttggttttcacagtcttttctgcgtctacatagcagccgcagatccgggtaatcgcacagttggcaggagaaaactgccttttgatttcagctaattctttcttgttcatctttatccacctcgcagattatcttatcacggatccggaaaatgtacaagaaataaggaagaaaccatgtcttcttttccgggggtatggtaaaatgaaaagaacaaaaaagtcaagtaaggagacggaacattgagacgaatcaaactgacggttgcctacgacggcaccaactactgtggctggcagatccagcccaatggcattaccattgaagaggtactgaatcagcaactaagcaggcttaccggagaggagatccacgtcatcggggcaagccggacggactccggagttcatgcactgggaaacatagcagtttttgatacaaatagcacaattccgccggggcgtttcgcatgtgcagtcaatcagaagcttccggaagacattgtcgtgatccactccgaagaagtaccacagggatggcatccgagataccaggactgcacgaagtattatgaataccacattttaaacagtccgataccaaatcccctttgccgactgaccacaagccacgtctccttcccactggatgaagagaagatgcaggcagccgcaaattatctgaccggcacccatgacttcaagagcttttgcaacatccggacaaacacagacgacacgatccgcacgatttacagccttgacgtcattcgggacggagaggaaatcaagatccgcgtcagtggaaacggcttcctatacaacatggtacgtatcatcgccggtacactcatccgggttggccgtggcttctatcagccggaacagatcaaagagatccttgacgcaaaagaacgtaccgaggccggagtgacagcaccacctcaaggactcacgctggttggtatcgaatattcgggtcatgtagaaaggggacaaaacattttgcgtcggaatacgtccccggaaagggaaaagaatggaaagaatctattttgataatgggagtacggcgtttccgaaagcacctggagtgggggacgctatggctcatctgttacatgagggtgcttttaatatcaatcgtggtggctacgagggggcatacgaggtagcaggacgtgtactggacaccagagatctgcttgcaaaattatttcatgcggaaagttccagacaagtgatttttacaccgggcgtgacatggtcgttaaatatgttattgcaaggacttctttgccccggagatcatgtagtagtctccggactggagcacaacggagtgatgcgtcccctttttcatctttgtgaaacaggtgggatttcctacgctgttgcaaggacgtctgtgacgggcgaggtgacggcaaaggccgtggaggagcagatccgcccgtccaccaagctggtgctggtgcttcatgcgtccaatgtgtgcgggaccattcttccgattgaagagatcggtgcggtgtgccggaaacatggcgtcttttttgcggtggataccgcccagagcgcgggaacgattccgatcgatatgcagacgtgcgggattgattttcttgcattcaccggtcacaagggtctgaaagggccgcaggggatcgggggattcctgatttcgcccaagctgaatgccagtgtccgtccggtgatcatgggcggtaccgggagttattcggatctgctttctcagccggaagagctgccggacaagtacgagagcggcacgatcaatcttccaggcattatcggacttcatacggctctttcctatctggaagagacaggcatcgacgccatccgacaaaagaaggatgcgctcacacgccagtttcttgcgggggtggatggactggacggcgttcggattatcggggagcggacaatggaaaatcggacggcggtcgtatctgtggattttccgaaccaggacaatgcgctggcagcatttcgattagagcaggagtttgggattatgacacgggtgggactgcattgtgcgccgttggcgcaccagagtcttgggacattcccaaaaggcaccgtgcggttttcctttagtgaagtgaatacagaagcagaaatcgaaattgggatagcggcggtaaaggaaatcgcaaaaaaggattgttgaatagatcgtatctataaatgagcgcgtatatgcgaaaaaacgatgatggaatctgctcgtcaaaatggaagagcctcaggaaatatgttacccttataaataaggaatatgatgaaagacagggccaggatatcaggcagccgtgtctttctttcgtgacaaaggaggaaaaaagaaatggcagattatcacaaaatgtgggaagagcttgggatggatgtagagacacatgaccagctctgtgaagtgcttccgcaggcgtttggcgatgtatacctttctcaggagaacagaccggagggcatggattactataattttgttgtagcggaaattcatggagtccgtccggcagagttgatagagcatcaaaaaaaaggtggaaaggtttttggaactttctgtgtgtatgttccggatgaagttgtatttgcggcggatgctatcgcaacgggactttgcggcggttctcagttctgggttccaggtggtgagaaagtacttccaaccaatacctgcccgttgatcaaggcgtctgttggggcgagacttgaccggacctgtccgtttttccggatcgcggatatgtatgtcggagagacaacctgtgacggtaagaagaaagcatgggagatcctggcggaggatgtgccggttcatgtcatggatcttccacagatgaagcggaaaaaggacgtcaaagcatgggcggatgagatccgtactttccggaaagttgtggaagagatgacaggaaatcaggtgactgctgattccctgcacagtgcgattgtcctcatcaacaacaagagacgcgctctttccagactttatgatttaagaaagaatgaaaagcttccgatcagtggaaaggacgtgcttctgatttctcagatcgcattttatgatgatcctgcacgatttactgagatgacgaataagctctgcgatgagcttgagcagagagtgaaagacggggtcagcgttttcccggcgggaacaaagagaattatgctgaccggtacgccgcttgccattccgaactggaaactacataacctggtggagaccagcggcggtgcggtagtctgcgaagaaatgtgtaccggaacgagatatttcgagcgtcttgtagacgaggcggagggaaccgtggacgagcaaatcgatcacctggctgaacgctacatgggaatcaactgtgcatgttttacgccgaattctgcccggattgacgacattctcagattggcaaaggaatataaggtggacggagtgatcgacgtcaatctgaagttctgcagcctttacgataccgagggataccatgtagagcgggcgctgaaagaggccgggattccggtgctcggcattgagacggactacacggacagtgacgcacagcagcttcggactagaatcagtgcgtttattgagatgttaaacagttaaggggagttggtggcggcatgatttcgtattatgtgcttttcccgaaccacgacaatgggatgcggctttatcgggaaatgaaagaacgcaggcttccatgcacaattgccccgacgccgcgtgaggcaagcaaatgctgcggtatttcccttctggtacagaaggaagatctggaggcggtccgcatgattgtagcggcaaaacagatcgagattctccggattgcggaaatcagaagagatataaatccgaaccgtgatcggtattgttaaataataggaggattcggctacagagtttcggttcgcggatagatgattcgttataaaataaggtggggacgcacacattgcgtccccaaatcatggcggaggaaaggaacatgaattacgtaggaattgatattggatctacggcatccaaggtggttgtaagaggagatgccaatgcacattttgtcctgccgacgggatggagcagtaaagagacaacgaagaaaatcagggaacagttaaaacaactgggggcagacgtggagcaggatgacacaagagtcgtggccaccggatacggccgtgtagccgtagattttgcggattatgttatcacggaaatcacctgtcacgcaagaggcggccgggagctggcaaagggtgactgtgcggtgatcgacgtgggaggacaggatacaaaagtgatcctcgtggaacggggtatggttgtggacttcctgatgaatgataaatgttccgccggaaccgggaaattcctggagattatggcaaaccgtctgggcgttaccatcgacgaactctttgagatggcggctgcaggaacggtgcttccgattagctctctttgtacggtctttgcagagtctgaagtgattaactacatcggagaaggacagaagagagaaaatattgcggcgggcgttgtggattctgtcgctgccaaggtagcgcagctcgcacagagaaaggagctcccggatcacattattctgaccggaggactcagccacagcgaatatttcacccaaatactcagtaagaaaatcggaaaacacgtggaaatgactgagaatggacgttacgcaggagcactcggcgcatctttcctcgcagaagaaaaaaagaaaagataacaatcgcgcacttgacggattcccgcccaaacaggtatgataacagaagaagattgggagggaatgacatgaaaatatcaacgaaaggcagatatgcgctcaggctgatgctggatctggctctgcatgaccagggaagaccggttcgcttaaaggatgtggccgcgcgccaggagatttccgtaaaatatctggaaagcatcgcctccattcttgccaaagcaggctatgtccgaagtctgcggggagcacagggcggctatcttctgaaatatcgcgcagaccagtataaggtaggcgacattctgagactgacagaagggagtatggttccggtggactgcctggagacagaggaaaatcattgtccacggtccggatcgtgtaccacactcaggctgtggaaggagcttgatactgcggttagaagtgtgattgacaattatacactcgctgatctcgttacatgggaaaagcaaaaaggaaacgaatacattatctaaacgaggattccatgagaatccgggatctataaagcccggattctcatggaatcctttttgcatcttacgcaaggaaatattcgcttatcgctaaatagtaatatcaagaaatcccttgacaaagcgctttgtttttcatataattcctataaagaaaataggaaatgagtgaattaaggccatatatcggtacatggcccgataaaaaaggaggactttgtatgagaatttttgacagtgtattggagctggttggtaatacgccgcttcttgaggcggggaatctggagaggggacttggcctggaagtgcggattttgttgaaacttgagtatctcaatccggcagggagtgtgaaagaccggattgcgaaagcgatgattctggatgccagggagcgtggtcttttacaggaaggggcggtattgattgagcccacttcgggcaatacaggtattgggcttgcttcgatggcggcggcgcttggataccggctgatcctgacgatgccggagacgatgagtgtggagcgcagaaatattctgaaggcgtatggagcagagatcgttctgactgatggagcgcttgggatgaccggggccattgataaggcaaaggagctggctcgggagattccaaatagttttattcccggtcagtttgaaaatccggtcaatccgaggactcatcttgagactacaggaccggagatctggagggatacagacggaatgatagatctgcttgtagcgggcgtcggtacaggcgggacgattaccggagtgggccgcttcctgaaagagaagaacccgaagattcaggttgtggcggtagaaccgtcggattctccggtgctttccggagggaaggcaggtccacataagcttcagggaattggtgcgggatttgtgccggaggtgctggatacggaatgctacgatgagatcctgacgattggatccgaggaggcttactccagtgcaaaagagcttgcgaaaaaagaaggaattttggtaggaatttctgctggggcggcccttgcggcagcagtaaagcttgcaaaaagatcggaaaatagaggaaagaccatcgttgtctttttaccggattcgggtgaccgttattattcaacaccgttatttactgagtaaataaacactgcatggcaagtagtgatggccctgataatggaaggtgatgatggaaataaaattatgaaacccaagcagcacaaggtatgacaggaaaggaaaacagagtatggaaaaaacacagacacgagacgagagaaacttaagatttgaaacattacagcttcatgtgggacaggagcaggcagacccggcaacagacgcacgggcggttccgatttaccagacgtcctcgtatgtatttcacgactgccaggacgcacaagacaggttcggtcttaaggcagcaggcaacatttacgggcgtctgacaaacccgacccaggctgtctttgagcagaggatcgcggctctggagaaaggaacggcagctttggcggtagcctccggtgcagcggcgatctgttatacgttccagggacttgccggccagggagaccacattgtggcggcaaacaatatttacggcgggacctacaatctgttggctcacactttgccggaatatgggattacgacgacctttattgatcctgccagaccgggggcttacgaggaggcaattcaggaaaatacgaaggcagtatttattgagacacttggaaatcccaattccgatatcactgatattgaggcggcggccaggtcagctcacgcccatgggattccgcttgtcattgacaatacttttgcaactccgtatctgatccggccgattgagcacggagcggacattgttgtccactcggcgacaaaatttatcgggggacatgggacaaccatgggcggcattattgtggaaggcggctcctttgactgggcggcatccggcagattcccgtcccttaccgagcctaacgcaagctaccatggcgtcgtattttcagaggcggcgccgggagcggcatttgtgacaaaattaagagctattacgcttcgggatatgggagcaacgctctccccgtttcatgcctttttgcttttgcagggattggagaccctttccctccgggtggagcgccatgtagaaaatgcgctgaaggtggtgcattaccttcacaatcatccgcaggtagcccgcgtacatcatccttcgatatccgaggacgcagagcaaaagcgtctctatgattcctactttccgaaaggaggggcttccatctttacgtttgagattcaaggcggagccgaggaggcgaaaacgtttattgattcgctggagatcttttccctcctggccaatgtggcggatgtaaaatccctggcgattcatccggcctcaacgacccatgcccaacttactcaaaaagagcaggaggagcagggcatccgtccaaatacgattcggctttccattggaaccgagcacattgatgatatcctggaagacctggatactgcttttcgccgcgttgcacagcaagtaaaaagcaatgtataaaacagcacatatacagaaccggaagtttttggcctgtctctggccggagatttccggttttttgtgttacagaaaaaagggttgtcttaattgtgtccgaaagccacttcaagcagtaaacgctttgtgtaataatggaaaagacagaaccaggaagtgctgtgttttgccggacacgatcacccatcagccggaaaagacctgaaagctcagtgacagaatgaaaaagtaccgggataatggaaaccagagcagataacagcacgcaatacagggaaggagggcagatataaggtcagtcctgagcgagcaaaagccgattcagacaggagagaaatacgatcggaactatcgcaaaagagaaaggaaaaggacatggcaagaaaaggagaaaatatttacagaaggaaagacggacgctgggaaggcagatacattgcggacagagccaaggacggcagggccagataccgctcggtatacgcaaaatcttactcccaagtcaaacagaaattgcaggaagcaaaagaaatggtacaaaaagaacacagaatccagaatctgcctgaggcggaaaaaccattttccgaattcctctacaggtggctcgattacatacgaccgcgaattaaagaatcttcctatgttaaatatgtcaatcttattgaactgcatatcgatcaggagatcggggcagtgccactaggaaggctcaatacggagatgattgacgagtttatcaacacaatgttgacgggaaaagagggaatggaacctctggctgccaaaaccgtgactgatattctgggcgtcgtccgaaacgtgatccgctacatcaatacccgctatcaaagactggactgcgatctttcccaaatcacgattaaaaaggaagaatcccggatgcggattttaagccgggaagaagaggaacagcttatccgttatctgatggaatatccctccccgatgaactgcggcatttttctcactctctttacaggacttcgtatcggagaactctgcgccttgacctggggggatatccatctccgggaaaaagaagtctatatccaaaaaactatgcagcggattcaaaacaaacagccgacaagtacaagaccatcccaaaagcggatgcaggatcaggaaaaagaaaaacggacccggattattatcactccgccaaaaagcaggaaatctatccgccacattcctattccagacggcgtcgcccagattctggaggggtatcagcgctatggaaatgaatatttgttgacgggaaaaacaaacagctttgtggaaccccgaaccttacagtaccatttcaaaaagattttacagaaatcgcgtattcaggaggcaaattatcatgctctgcgtcatacatttgcgaccaggtgcattgaactggggtttgacatcaaaagcctcagcgagatcttggggcacgcaagcgttaatatcaccctgaaccggtacgtccacccatccatggaaatgaaacgggataacatggaaaagctctccgagctaatcgccggataatggtcgcttggcatttgataaaggagagaacaggaaacaaacagtgaatggaaagaaaatcgcagagtgtaatactctcggaaataggaaaaccaggaaagaaatgatcgggatacaggcttgttttttgaggaacagctatgatcagagatagaaaatactgatattctgccgtatttttacctgttaccacagaatcgtcattctgtggtattttatacaatcagcctcatctttttcaaaatccgttcatgtgtcctgaccccctctgccacataaatccgtgtcgtctcaatcgaagagtgcccgagtatatctgccagaagagccagatttttctctaccgcataaaaacaccttgcgaacaggtggcgcagattgtgtggaaagaccttttccctgtccacttttgcctcctcgcagatctgcttcatctcgtggcaaatattactgcggtccagtggttttccgcttcttgtctggaaaaccggccccttacggatggactgaatactcacatactgattcagttttccacgtagtttttggggaagcaaaatagtacggtctttcccctttaagtggatctgtacttttccacttttcagcgcatccaccgttataaacttcaattcacttacccggattccagttccgcaaatcgtgagaatcacataataaagccgcagattaggtcttttttttgccacctcaagcagacggcggtattcctcttctgtcagctctttttcctcatctacaaacgcctgccgctgaatcttcagtaacttcaccacgcaggaggaaagcccagagaattcaagatacgaattaattgctgaaagcttcgtattgaccgtcttaggctgatatgtctcgatcagccgttcccggtactccagaatctttggctttgaaatttttgcgcccttcataaataccgaaagtacccggatctcacgtagatacttttcaaccgtggcctgactcttctcttcctgtctcaagaaagattcataattttccagtgacttctttgtaatgctttttctttccataaacaaccagcctttctttcatgggtttctctttcatattccatgatattcttttaccagtcgctttttggaaaatcaaatacattttccgagctttccggttcctttacgccacagctccatataacatcctcatttaacgataatatttcaaaaccttgtctcgcttcctggcgattgtcatccgctttttcaaaagcttccttttctcacgtcctgttccatattctccaaatagctcccaccatcttctaaggatgtagcagggatagagaaacggcttctcacgaagcttcggataacggctccccaaccgaatacgggacggaaacagaatccgtttccatttgctttccccggaatctattgctaccgcagaaaacccggcaagttttcggtcattgttttcaccaaagccgtaaattcctccggtaaacatatcttccatcaaaatttccggacgcacacttttattcacgagtcccttaggcaccatggaaagattcagatggagataatccgttcctgcattcaaaatggccgcaaagagttttctcatatgactctcctcgagaaacttttcgaactgtttccagtctatccgcccggaaagcttttgtatccccagaatcagatctatcatctgacggacgcccaccccggaaccataaaaatgcttgtagaaatgggacatgagctggatcatctgtgtcgtcggctccaaaacaaaaaatcgatgcccttcaaacataatttcctccgtctgatccaagctatcataaaatcgtgaattcagatgctgttgcatctgattttcctttccaatgacattcagatgaacttccacatacagggaattatcctgtgcaaggtagctgatctcctgctcgtctttcacgtcgggtacatggatgctctcttcatttataaaatgaagtgttttcaaaatctcatccactttttgcaaatctccaggatcgatcaatatatcttcgtctccagaaggccgcaactctgacttgggataccagattttgcaggaaatccctttcagaaccacatagcgaattccatgttcctgaagtgtttcgcaaagcttggcgaaacgctcagtctgcacaatctgacggccggcagccgctactgtctcactcatccactgattccgaatatccggcgcaacaaccgtataaagagccagacgatagatctgttcatagatcatgggccataagttttgatggacactgattttataaagacacttccattcttcctctgtccgatatcccgtaaattctgccgtctgtccggtcagcgccgctgaaattatttttaaaaaatctcgttcctgtgtattcataactcattctccccgcaccgtttttttctccacactttgtatccttttcgaaacaccagatacaccaaaccgcccaccgttcctccaatcgagttgtagcaaagatcggataactgaaacgtcccaagacaaaacagaagctgaaggctctcgattccaagtgaaacaataaagctgatcaccagagcccttccggtcatccgcaccgtacttctgtgattcacaaatttttccggaaaggtccagtacaacagcgcggtaaacgggagaaataacgctatattttcaatggcttctgtcgtcagctcgccatcgtccccataaagtccccagccgcccaaaatattcgatagaggattactccagatacttctatttaaaagtgtccggaacagcatcagcgccacataaaaagacaacaaaaacagatgacggaatctccttgatttccgaaacatttcccaccagattttcaccgctttcgtccagctcgttgcttttgcaaacaggtaaaagaacatgaaaaaaacggcgagaagaagtgcaaaaccaaacggctcatagatggctttgaggatgttcgtgaggatggattgtataatggaaataaggatcacctcttaaatttgttcaaaactcttgttatttcatacatgacaaaaatggttcagatttattatgcattttaagatatttttcaatccacagactttgtataacgcagtaaggcgctaatgcacaacaatgtgaaacaagtataatccaataattcctgcttatatgtgtaagcaaaacgctaacgccaaataataaaaccactccaatgctcataagaactgtctgaattttcaattcactaagtccatttgcgatagaaccatttagattggaccataccataaaaaactgttccaaggcaaagcaaaacataagtggtatgctgactgcaaatgttttactgcctaaccaaacatcaaaaactatctgcataatgggaaatactgcaacctgccctactgaaaataagaccgcaactaattgtaagcctcttaatgccttttttatccagacaaaatcttttccagccatcgcctttgttacagcggaccatattggaattgtaattagtgcataaaacgtattaaccagggaaaatactttaaaatatacattatactctactactctatctgctccacataatttagtaattaaaatagcattactattattaagtaacattgtttctaattgtataatcaaaaataaacttcctaactttaatgtttctttggcatatttaattttacagtaccttatacttggtacggcaaacttcatttttccagaaaacagtacgattgttatacatataagcggtatatttaccgcaagcatatatgcaatagccaatataacgatattattgttatatcctgagaaatttgcccctaaaacatagattagaatcattgtattcgttacaagtacaagaagattggcgatataagacttttgtaatgcatattcaatggaggtcgatagtcgaagcaccaactgtagaaatatgctaaaaatcacaattcgcatcgctgtatttaattctgcattagaaacagtgtttgtattaattccaaaaaattctgtccaatcaatgaaattagtacaatacaacacgattgtgccaactaagacggaaatgcttaataaaaaaccatatgcagaagatattaagcatttgattgttttttgatcattactacatgcaaattcctctaccagacggtttctgagaccattacctatacctaaatcgaaatttaacatccaagtaaccaccgacaaaatcgtaaaccaaatacctaatatttcgtttttactgaaataatccatgtaggcaggcgttgttagtaacccgacaataataccaccgcccttgattactacggcatttgctatgttttttagcacatttacggtgttttcattcccattggaagtcagttttgaaagaattgtcataatttaatactcctcattttcaaataaggttattttctctctaagattattgatatgaaaaataatattttttacataaacgatgttttttcttctttaatatcatctatatcccctctttcactaccaatttcataacttaattcttccttaaaaggactgtaaaaattagtattcaaaacccccattaagaacccccagatcagaaatgctccttcttgcacaggtccccttatcgtatatgtgtacaaaattcctccaaaagaaataataattaataggatatatacgttcatttctctatttcttcttttgattcctgctattcctttttttaaggagctgaggaatatcgtcaagagagccagcactcctaatattcctattttaattaatactgtatagtagccattgtgtaatagtggaatttggttgttttcaaccatttctgaccaggaatatgggatataatcgatgtgaattcctcttcctaatccacttcctattattttttcaaaaaagttactgctaatccattgctttatagcagcttgcatttcgtaagctctccaattattcattgcactttccgtagaatcaataatctgagagttgtccagttcattgagggattctccgactttccctgaaaaaaaattcaaaacatctttaggaataatagtcacagtaactacggccaaaagtattaataatactagtaaaataaatacttgcaagaagcttcttttacgattttttttatatattagcactaaaaacgcaactaaaagtatggatgctaacggcacaaatatggatatacgtccaagcgaaagaaatacatgtgcggaaactataataataattaatgtatctaatttttttgaaaacacaaaatgcctattaaaaaatgaattaaggatcataataggtaaaataaacccaatatcatacacacccgttacaaaattcagccgtatgccgttaaaatcaaaatttccatttatcaaaaaaatataaaagcaataaattgaaactataaatgcgtatacatataaggtctttaaaagagaggctccccttttgttttttataaagttagcacctatcaaaatccataataatgtagatgtaaaataaaaaatatctcttgccacattcctaataggatagagataataaccgagaacacctccccatacgaccaagaaaatatataattttaatcctcctattttaggtaatagtattttaaaatgatttttctgtatcaatatgagaaggtaaacggtagaaaccaggaaaaaaactgtctggctaaaaataatggttcctgaaagtaaaataaccaataaatcccaatatacattagtgggtttttttatgtattccatatttttctttcaccttccaaatgataagctgtaaatttcttataaatatagccagtatacattctaaagaattatagccactataatttttaatataatatttacggcttttcaaaaacgcaatcattcttgccgcattactactaggtttctgcgaagatatatgttgatgatatgcggttacttcatctacgtaaagtgctttataacctttattttgcaaagttttagctaaaataggctcttcacaatacataaatacattttcatcaagcagattccctttttttataaaagatttggataaaaaaaagcagcagccggagaatttttcacaatagcctgtcctttcctccgttttataacttccccctatttttagcttctgcttcatgtattctataggataaagtatttcttctaatgctgttaattctctcatagggttctggttttctccatctggtaataaaactctcgacgccatcgcccctatattattccatttacaactttcgtttaccataaagtcaatgtatccagggtctcttatctccacatccggattaataatcaaaacccacgatgcattcagttgcattgctttttttattccaatattattgccgtaagaaaatccaccatttttatcagatggaagaaagataatctgctgttcatcacagaacttttttaagttttcaacttgcgtcctgttggatgaaaaattatctacaacaatgatcataaagttttcatacttttgctgaagtaaaaagttaatacatttttttgtatctgctgttgtattataattcaggattaccccaaccaccaagttttcattatctatcgtttccataaaattattgctcctcttctaatctcttttctagttccattactcctaaaaggatcctagctctaaaacctgctatttccaaatctccactacctcctctcattaaatagaaacttattatataaagtaaatataaaatcaaatttctaatcttttcctctttagaagcagttacggaaaataaattttttatgtagttgacaatcttatcataagataattttttctcatatataagagtctgcaaaacaaaatgccaataatcgaaatcagaaggtgcatttttaagagaatactcaaaatcaaagacaaaaaaaatattttcatttatacaggtattccacggcgtaaaatctccgtgtacacatccccaatcaactaattggttcgaatacacgtccataatacttttcaccgcttttaatatgcttttacggtagattacatccaatttacccgtatttttattaagaaactcaatatatttgtacagtctcgtgttttcaaatttacatttttcgtgagtttttgtgtaaagctcttgaataaacattctatgatgctttccaaaactatgtagagttctggcacctttttgcttttgcgtagactgcaaaaaaacgttttctttcccaactctgccttcaaatgttttctctggaatatttttgactccctttttattcaaaaactcaagcatggaagcttcatattcaaataacttctgtactttcattgattgtccaattttacagtaacctaatatgctgtttcctctatagatttgaatcgtaatcttctggtctacagaaggagtcccataaaaaattgagtattcgaaattctcaccataatatctttgtaggatattcataagtgaatcagttagctcaattctttctaattctattttaaaaaacagtctaaaaactgagctctttaaaagacaattatatttttttaatagtatccctttcttccccgatggttcataaatttcaaaaccaatggatgtgtttttgtaggggatactccacatttttccttcacgatttgtaaaagtaaaaaataatggcatcgacgctgtatcaatattattttttagtatatacctattttgaacattcatatcactctttcatcactacctcgtctaatacagtaagtatccgctctataaatatgcttttgtctttccatctgaaattatcccatattcttttacggcctttttctcccatcattctccgaatatcaggatggtctatcaaatactgaattgcttttgccatatcttgtacaaacttttttgacccatgtggtttaattctaatggcacattggtcatttgtaattgtgtgcatccctgtgcaatccagacatattacaggcagccccagtgccatggcttccataagagcccaggaaccaccttcatgcaaacttggaaataaataaatatctgcttgagatagcaattccagtaccttggttctgggaacttcatccagtattgtcacttttttctgaagaccattttcgtttataaaagaaataagatgatctttttcatttcctctcccaactaatgtgagatgaatattacaatctggcaataattttacagttttcacaagagacattacatttttaatcgggatcagacgtcctgtgtatattaattctgtaacatctgattttttacattgattgtgcaggctaaatatttcttcctctattgctgtctcaagtacaatatgaactttatctttatatttgtccggaatagtttccgctgaatcaaaggttcttactaatattgccgccgcttttttggaaggatatgccactaatggatttataaatgcgctttttttcaaaaaataccggaatgattggaccaagtgatcctttaaaggtaatgtagttaaaaaacttttagggacacaatccccaccgcctaacggtccccatataaatggagttttaaaaaaaggcaaaaatgtaggcatccagaaacttccgaaacttaaatgcatggtatagtcaatatcatttgtttctataatttttcttataattttaattatattgaattgccatattgtataatacaaataaagtcccttttctctgcgctttagttttctaatatataccggagcatcataataatagaatttaatattttttcttaagttcactggtaaatttatttcaattttttctctattattttctcttgtaatcacatgcagccgattatttttcgccatttgtaatacccagttccatcctactccagcttcggaaccaacaaagggctcacatccatatgcactcactaatatattatgcatttcctctatccttcttttatgctatataatcattcgttttattagtatagtaatcaattataacagatagggcctgatccgtaatttcttctggtgtcttatttgcatctaactttacatatccttttgctatatcctttaatttattaaattctatcatctgacgctttatttcatttaatgttaactcttgcttcctagaaaagacgacaataggatcagcatttaacacaaaagtaatttgaggctgtggaacaattctgcaaaaaaaccttcttatttgaaatggtaagtttatttttgatcttttcggatctactaaaaaatcataggcgtatctatcaaaaactgtaaatttatcaaactgaacatcttttcgtatatttacaaatccacccaaaatataatcaaccgtatagtatatgattcttattaatgaactaactgtatttgtttttttccctctatgcggttttgtaaattctttatcctgttccattatgcctgctctctcacctaattcgcccaaattgggaataagcgtaggtctaaaatgatagatatgtacttttgagatatccgtaacaaaacattctgctaactttactgctaatagatcgataaatgttgtctttcctgttccatccggtgcctccacagctatcatttttcttatcttacggggacaaacagcaatacgatataccttttctttaaaaaaactgataacatttctggttgtgtatatcggtcttttcttaaacgcattgatcttcgagtgtttggaaaggcatcgtgcattttgaatgatccattcaaaatcagactggtctaaatgagcacatattatatctgccatatttttatcaaacactttttctaagattttaaggatatgtaatcgattttgcaaaaatctttccgatattttatctctatatttcttttttagttctctgcatcctatcactttatatagcaaaagcattactatatcataagatgggctcaatactgtatagccgtgatattcaatcgtatttttgtaaagttcgtgaaagtcaaaaatttcaaatcctttatttagatatccggctataagatctacatgaatataaaaagcagaagaaagatctaacccaatccaacaatgtgctctttcaaattgaacaacataataatttggaacattgttttcttttaatactttaataaacaactctgccgcacttctatacttattaggatgtattattatatcaacatcttttgattcgtttttttcaggtaatccttcataatttctcaaaataaagtactctatttgcctatcttttaatatagataaatattcatgtaatatctttgaatgtcttttatcccatttatattggatttgcataaaaaaacctctcttttaatcttatggtttattttattttgtcgcgcagttttgcctcgaatagctttgtacgttcttccccaatcacattttctaaaaaatttcttgcatttcttagaaacgggcggcagatatttctccatattaaactattcccacgttttctttctctttcagtaagccaactagcatcaaaatgatgaatagtgacactatctttggaaataagaaactcattttcattcttttttttgggacaaaaaacacttctgtcataaatatggattcccgagactatttgcttactgtttcgtggagtgaggcctttttcgactaatagtttatttaatatctttacatttgttgtagtatctgccactccatttttattaataaaatcgtgagaattataatatcttagcaatttcaaaaaaagaggattatttttttgtgttccaattatccctgtcccgaccatcgttcgattttcaaaacccagaaaagtgttatgatctaaaaatggtgagaaatcttttaaaacttctacgtccgtatctaaataaattccaccatatttatttaatgcataaatccttacataatcagaaacaaaggcatactttccctgatcatatgcctgttttacatatcttacactttgcacatcaaaactttcttcattccagaacacaaaccgatattccggtagtttcactttccagttttctatatatatcttctcatttttaggaatggggtttggtccaaaccaacagtagtgtattattttgggaatactcatttcaaattctccttatatatttttgtaacatcttgcaatagaagtttcatggataatattcgcatattttcatatatcaaaatttgtctatccattataatatctttaagacttgttttgagatccgaatatataaattctgaatctaataaatctttggcccctacattttcactgacaagaaccggcactccataactcaatgcttctaaaacagtaaacccaaaagtctcataacatcggcttggtacgaccagtaaatctgtatcaccaaatatttcctctagctggccatatagatacccctcctgtctcaccgtaatatagggacgagtaaccgaagttgaagagtaaatatgtaattcaaaatttttaacatcatctgcccataattcatccaatgtcttaatcaaatatgggaaccccttaaatggttttgcagggccaagataggttagtctaagagtttcatggtcaaacttttttttcttccgatgatctttaatatccctatgagtaatcgaaatcaccgcactatctttcggagtcatatatctacgatatatctgttctgctaccgtactgttaaaatgaataaagcttatcttttcgagcatagaaatataatattcccgcagtttccgatactctgcggcatttccatcggtaactctacatccccgatctgacgattcttcaaaaaattccttccggtgtttttgacgtatctttattagtaaatgggtgtttttcaatcgacgatatagaggagattgcatgagtgtaatctttttcaaactaagtgcagtttgattacatcgcacacagtccgcacagttgtgatcctcgtcacaggtcatccctccatgaaataacgtgaccttgggacaaaggccatagtagtcatggctggtaaacacagtacgaatccccatctcttctgttacctctaaaaactctctatgtaaccccatccacgtatgaatatgaatggtatcaggccgaaaatcttctaaaaaccgagcgtaaaccttcaaatcaaccgcagacatatacgcagaacagtttaaaataccctcatctaaagctatcggcaacggatttaccaattcgtaacttccaatttctttccaattttctctctttcgaatacgcactcttttatctattaatcctatccgcccgggccataatagtgcgacttcatatccctgttctttttgtgtcagcataagatcaacacaatattttgtcaggccacctgtccgccatggtggaaagcctaatgcataatgtaaaattctcattttattctttccttttgtgttagaaatatctcttcatactgatccacgatatcttgccagctataattttgtgctatgcgttcttttgccttgcggccaaactcttcgatcttttcaaatgtcatttcatctgcattttcaattaatccggacaaatttccattttctttggtccaataaagagcattaccctctgcaacctcacgattaaatccaacatccaacaataaattcagcttcgtactaccaagtgcttctaaaaggcttggattcgttcccccaacctcatgcccatggaaatacccgtatgcgttttctctgattttcattagtaattcctggttatatactgttccgacaaacttgattcgcttatcgttcttaaaatgaagtttttgttccaattcatctaaaaactttttattcacattggtgacaatagcaaaattttttttactgtggctgtgcataaattcccgaatcattatttcgtagttgttttccggtacgaatcgtccaactaccaaatagtattcgaatggtttcactcccttttcagaacaccagtctttgaaaacggggtcggcatctgacagcttactttttctggtttccgcgccataagcgataaatattgtcctcggatcccttccttttattccttttccgtcgtaacatatatggatatatttctcaatggttttgctgtcacagatgactaaatccgaccactttaccatcatgctttctgataccttccagtattttcgtacaaacgcaggccacttcgctcttttccactcatgtccatctggatttaagtatatctttccacccagtttatgaatttcccgataaaaatgttctgcaaaaggtccaatgcgacacgccataatatagacgatcggattttgaatatgatctcgtctgatgatcttacaacactcctttaatgcagctacatcgtaatatatcgcttgagccggtcccagcttttccgggatttttattctgaagcaacgggcattatggtatttaaattcttgactgttaattatctgtgcattctctgttttatgaggattcatgcaaccatcgccatttgctttacatgctacatgatattggatcctttcattgttctgatgatattcagtcaatttattaatgaaagtctcgtaaccgccatatgcacctaatgactttgccccgaccagaaagatatgctgtattctattttcctgcatggattccttttctcttttccccatcacatcgacccttcttttttcaccaccgccagcactgtcttgaaaaggatcctgaaatccatccccacgctccattccgtgatgtagttcgtatccagccggacgacttcctcgaagtccgtgatctcgcttcttccgcttacctgccacattccggtgattccgggtttgatggcaagtcttgcccggtggtgtagttcgtatttttcccattcatccagcgtcggcggtcgtgttcccacaagagacatatcccctttcagcacgttgaaaaactgtgggaactcgtcaatcgacgtcacccggatgaaatttccgattccggtctttttcctgccgtcgggcagaattttgtttccaatgattcttgtatcaaaatccactttaaacatcatgccgtctttgacacggttttctttcatcagttcctgttttcgttcctcagcatcaagatacatacttcggaatttatacatcttaaatctttttccgttttttcctaccctgatctgggagaagaaaacgggtcccggtgactgaatgtagatcatcggcgcaatgatcagaaacagaattcctgtcagaacacacccggtcaatcctcccaggatatccagacaccgttttagaaatgcctgcttatctgtcgtataattgatgctggttgtaagtaccagatattctcctactttctcgaccaacggccgttttcccaccttattttctgcctgggaaatgtggaaatgtactgtgactccagtttccaccagcttgtccaccagactttggggcagcgtttcgtcatcccccggaatcagaagcacttcatcgatccaggcacggcacacgtactccggcgcagtatctacgtttgccaccacgggaatcccacccacctcctgacctacgatattccggtctgcaatgaccagtcccgccaggttatacatttcgtaattgtggttccggatactcagtacgacgtcgagagaagcccggtctgttgtcacaatcaggagcgaccggtcgccgccctctttcattttctttcgtagtcgtctcttccaaagcagccgcaccgcatacgtcaggaacagatagatgcttcctgtcagataaagtacgatacgggagaaattgccgctttcctgtatggtgaataaatagagaaccgccaacagcgtcaccagtacaacgtgtttcagcgtcttggcaaattccatataatatcctcttttcaggacacttttgaatgtttcaaagaaaaaaagtaccacaatatccgccagctccagaaagatcgccatattcagatacagttgtgtttcgtatggatttccagacttatgcctcagcagataggcaatgataaatgctgcctgcatacagatcaggtccagcaggacaaaatcgctgtgttttaaccatcccttagaatgtttcttgtacatggtctctatcctttcttgttacagccggatcacggcttttcccctcagtatccttcctggattttctcttaacaacagctccggacattcgctaccatagtgtcttcccagaaaatcccgcagagccgccagctccattgtacggtaatccgcccgatgagcgtcggaggccgccagatgagcgagtcttctctgcaaaagatattctgcggtaatcatagccgcttccccaaacctgccgaagatgctccctttgtcgatctggagggtgcatcccatatccgcccactctttcgtgtgagctggtgtcttttgtacgcagcggtaacgctccggatgcgccagaacaggatagtattcttcttccagcaggtgatccatcatccggtatacctgccaagccggggcgtctggcaaaacttctacaagcacatatctggtctggttgattgtcagcagatcaccccgcttcaatttccggatcagctcgggtccgtccatgatttccatcccctccaccagctccaatggagtccgatactttttgagtaattcttttagtttctcaaggcgttttcggtattctcttaccagacctgacgtctctcttcctggaagattcgcgtgacaggtggctgcggcaacactgattccagactctgccgcagtctgtgccatttccgacgcctcctcccaagatcttgcgccgtcgtccagaccgggaagcagatgagtgtgcagatcaatcatgtgctcccctcttttttcggtcttcgtaactgtaagagccgtagccataataaccgtagccgtaccttccatatccataatatccgtagccgccacggtgaaccgggataccgttaaacgcataaccaaggagcggcgcttttgcgtcttcgagtccctggatacaatccagtatccggcgtttctgcaccatgtcataacgaatgatatacaaaatgccgtccgcacgctccgctaaaatactggcgtcctcaaacatttccgcaggaggggcgtccagaataatcaaatcccatctctctttcatctcctgcaacactgcctcaaaacgactgtgattgaggatctgctggacctttttgatcgggcggctgccccccaggaagtcaatcccggtttcttcctcgtttcgtaccgcttcttctaatgtacattttctagtcaccacggaggccagccctcttccgatttcccctgtcaaatgtttccggtcttcctgttttctgagatctgcgtccacaaagagaactttcaccccatgggaagccgccgctgccgccagattataggccagcgtggatttcccttcttccggcatggtactggtaatcagaagaagctttccgccccgttcctccagttccctggaaatccggatctgcagactttgaatattttccttaaatgcctggggcgtgcggtcgtctttcatccttatccatctctgatctttctgcttccgaagcttccttggcgcctctggaatattggcgatacaggtcaggctcatagcgctttttaattcctccggcttctgcaccgttttcttaaaaaaagcatacagacagatcagaagaattcctgctcccgcaccgtagagtccgccctttttgatctgtgcccggtagctcggtttgttgtacggctcatccggcattgtaggctcgtcgatgatgttgaatctcgtatctccgatgacaaacctggcaatatccgggtacaccttgatggcagactccagaatggctttggcatcttccggactctgacttatcacgctcatggtaatcatgttggactcggagatagcctgggcggaaatgctgccgttgaccgcctcgactcccagatcttccttgatagcatccgtcagaaggctgctgctcagaatgtaaggaaaggtcctggcaagctgccccgccgttgtcgtgtcataataaaagttgtacgtgccgttaccggaatccgccgtggacgctccacccgtcagcacggtgaaagtggcggacgattggtacatcggcataaaaaagatccgggacgctttcagataaaatgcacctgctccgatggccataagcagaatcacgagccaccagaatttcagaaacccctggatgatgttccaaaacaaggtccccaaatcgataacgtcatccccatcgagtttccggtatgagcccgagtccgccttttgatatccatttttctctgccatccttacacctccccgctgtcatcgtttctcctgtagccgtaataagagtgctcccgaaacgaattccacaaattttctctaaaaaaagcgtttagaataaagcctgtgaaatcaacgcccgtctgacggatggtgtcggaagcatcgtttgttgcccgtacatcagtccagtcctgacgtacaatcagcaccgcattgtcagccattttcagcatcagctccgcatcgctggagacggacatgggcggtgtgtccaaaatcacgtaatccatttttttccggcctgcgtcaatgagcgcacccatctctggtgaatccagatactttgccgcattgtgaataccctttttctgaaacacggtgtaaatccgttctttcttctcgtagaagagcacgtccttgacacccgcctttttctccaggtaatcggaaagatatttccggttttcctgctgtttttcaaacaccttataaagagcaggtttcttcagatccacgtcgatcagaagcacttttctgcctttctccgccaaagcaagcgccagatttgctgccactgaagatttcccctcgttctcggacacgctcgtgacaatcagaactttctgctctctacgttgcatatgatgatccagacgtgtcgccgttttgcggaccgcctcacaaaaagacatgctgaccagtgcggacgaaatgagaatggatttgttcagctttttcagtactccccggaccgtcttattcttccgctcgtaaggaatcacctccagaatccggccgtccaggctacgcttgccgccttctcttgtcttgactgtaaaccgcagaacagataacagaacaatggctccggcaactgctgccgccccaaacagtccggcgatcttctgtatccgggaaatattcatcgtattggacggtgcgtaaggaaccgccggctcctgcacaattcgaagggttgcattggaaaacagataatccgatacctccccgtaattctcaatggccgactggatcaccatgtatgcctgtcgtggattttcactcgtcacctgcaaggtaatgaggttcgtttcctcgatgacgcttgcccggatggattcgtcaatcgacttctctccaagatccttggcaatcttttttttcagaacattgctgtcaaagacttcgctgaatacacccgccatctggtttgtcagggagagagaggagtaggcgctgctgctaccttttgcgttgaccgccatggtcgcctgggccgtatattccggtacataccggaaactcatcatgcccgtcaccgcaagccacgctgccgctgccgccagaagaatcacccatagattcttcagcaggtctcttatgatacaaaagacgctgatctcatcaaacttgaattctcttgcttcattcatctggtgtctctccttctatcccctaacgatgacggtcagccaggtctcccctctgcctgcatctccttctgtctgataatgcacctcataagtgcctccctccgcggtgttgaccccggaggcaatggaaaccgtgtccgtatccagacgatttccatcaatatcttcgatataatcaatgtaatcttccgggcggaattcgtctcctttctttatgtaggcaattccctgtatcagatggatttccgtactgatccgagatgcctccacaatgtgaaccggaagtgttgcttccacggtatctcccaagctgtttgtcacctgtacatggacttcataatctccggcggtccggtaattgatactgctgtccagaagttttacaagacttgaaatatccccgtcaatctggtcgcccgcccgaatataatccatagcgttatcctccctgctctccgcaaatacaagtgggcttgagagggaaaattccggcgactgatagtcggtaaattttacccttctcgtcaatgtggccgcctgattagaagaatcaaagaccacataggacagattacacactccaggttcgatgaactgggaaaaattgccgaccatgatctgatctgtcagatcaccgtccttttcatcctgggccttcagcccctccagcaggtcgctttcttcgtaggatgtggaaatctcaagctccccgttctcgtttgttatcactggtttcgtaggatcttccccggcacgttcccggatttttgcggctccgcagagtccaaggcttgccataaataggatcacaaccagtattcgtatatatctcatcttgctttctcctgtcttgtggatttgtcagaatgtgtcgaggaattcgcggattccttcttcgtctacctgaatcatggtccggttctcaatcttatacacccggctgcacatggaaaatacgcttggccggtgagccgccaccagaatggttctatttggttcttttttgataatatttctcagtacccgccgttccgtcgccacatcgagagcacttgtggcttcatccaagatcatcaccggtgcgtccgcaagcaacgctctcgcaatcgaaagtctctgcttttgtccctcagaaaatctgctccctctctcccggacctgggtattcataccgtcctccaacttttcaacaaattcccaggcacaggccgtttccagagcttgccggatctccttgtcatccgcccccggcttgaccattcttaaattatccgcaatcgttccggtaaaaagagtgttattctgcggaatatagctgaacagacaacgtgtggcggaggaggcttctatagaaggccaccctggatttccaagaagaatccggcctttctgtggatgatacagtcccagaagaagattgagtgtcgtcgtctttccctgaccggatggcccgatcagagccacaatctctcccgggttggcggagaattctacattttggtaaatccattgattcccttcgtacgcaaaatctacatgctccattttgagagtaattccttcttcccggcttcgtcgcttggtctcgtccgcctcttctttttgttccatagaatctcttggaagacttgtcacctccatgatgcgctctgcactgattcccgcccggatcaccgtcggcatgagactgataatcccgctgaatgacccacgcaaagagcctgccatggaaacgaacattgtcatggtaccgtagctgatgtctcctttccagagccggtacgccgcaaatccgtaacatgcataccctaccgcctgtcctacgagagatgtgataatcgtcgtccactgctggaaatgattctgcgtcagcgccacggccaccgtttctttctggatgctgtggaatttttccataacccggtctaccataccaaaagctttaataaactgaagattctgaaaggtttcctggtcaaacaccgtccggttgctggcaacttcctgattatctttttggaaatcctgcatcttcctcatagaataccgggatgtcaaaaaggaaaccggcgctcccatcagcgcaatcgcagccataaccggatcatgtctcaccacaataacaaatgcccccccaaagctaatgagtgtcgtcaccacattcgggagaaaggtgaggatcgtattcgccaccacactcgcatccccgttaacccggtataaaagatcaccagaccggtatttcgccagggattcccaattcgtctgaaggatctgctgatagatgtcgctccggatctcgtttgtgaccttcagccggactctcagtgataaacttgttttcacagcattgataaaaatctgtgatacgccgacgcccacatagacaaccgcaacctgtataatctcagcagaattcactccggtcactgcatctaccagatcccggctgacaacggatgttcccaaggacagtaccgacccggacgctcccagaaggatatacacgccgatcaacagccagtacttccgcacataggcatacatccagagcagttccgtaatcaggcgctttaacttcccctccctgaccttttgaaggactcgtctaatctcactcatggtatcttcagaatctctccccgccaaaaacggttttctccgccaactccactgccgcctcgtccggccggcaggacagctcgtaaaccggaagcgcacacaacaaatgattcaacgtctccaagcacagctccattccattttccagccagcgagggtagaagatactgccggaaaccgcagagaccttttcaaaaccttccagtttccgaatctggttcttgggagcctgctttaaaatgatgagagcatccaccggaacactggcattttcacagtaaggagaggaaccatgccatggcgtgccccatccaaggaagttcccttctgtctcctgcacaaacacaatatcgccgttgataataacagcgtcacgatatgtatgccacagctctgcctgggtagtcttcccgatcccggaaggaccaagaaacatcaggccatgtccatcaaagtcgataagagagctgtggaattggatcatatgtcgctggacagcgtggattcgaaatatttgaagtaataacagttcaaattctgggagtatcccaagatttgtgtaaaccttcaaactgatgtaagatagacttaccagtttggaggtttattttatggcaaacgcaggcagtattatgagactttggaattggcggcatagttagtgatatccttgaggaaaatgtgtcaactaatcttgacaatatcagagtatactctctcctgtacagaagaaaagattttatatgaaacacttcattttgtcaggggagacatgagcgactttatggcccgaagtacacagcctcgtgtcctgtatgcggatcaggaggttccggcaaggaataccagggacatgaaacgtggcgatgtggtcattgtcaacgatgagtacaaccggtacaagggagaacttcagatcgtacttatggatatggaaaatgacggccggaaaaatgtgatcgggcaccttccggcaaatgagcggatgcttcttgactacttggaaccatggaggaagtttggcttcataaaatcttaagcgacaggaagggtgagaagattggccgcaccaatatacttgaaaataaaagaacgcctgatggaggatatcagggacaagtcagtcagtacgccgattgattcggaacgcgagctggcagtaaaattcgacgtgagcaggatgacagtccgcagggcggttaatgagctggtagcggagggctatctctaccggaataaaaaccggggaacctttgtctcagatcaggctctgcacaggaagaatacgacggtggacagttttgtaaagcaggagaatgcaaattaccgtctgatttacttcaatgtgcggccggagccggaatatgcggcgttgttttcgattacgcaggaagacttgatgatctgtgcggttcgactgatgatggaagatgatcggccggttacgatcgaggagatttattatccgtattctcatgttcactccatggggatgaaagatctggatgagatgctggatatgaccggatatattgtggacgggacggtgacacagcgtttttatccaattctggtgccgccggaatacagtaatcttctgaatttggagatgaatacgccgattattatggtggaatgtaagattcataatcaggtgggcgagcttgttgcgattgtgaaaatgtaccataatccgaacgaaaaagtcatcgagatgacattataataagaggaaaaatttctgatgccgtaagaggcggaggaatttttcctctttttttgttttgtttggctctttttcttctcttgattcgttatataatatgtaagacgttttacgataaaaatacgaggccacgattatgacagacagagaacgaatacaacgcatcttctccggtgagcccgagcagatgagtgagctgattgaagaatattatcaggacatctttcaatattgttattcccaaacaaggcgggagagtgcggcatatgattgtacccaggagacctttcttcgagtcatccgttatctgaaccgatatgtggaacagaagaaattccgggcctatctttttggaatcgcaagaagtgtatgcattgactttttccggaagaaatcagagagtgaggttggatacgaggaagggtacgaagagacactgagagaagaggattttgcggacagggtgtcggagcaggtgatgatcaaaaaggcgatggaaaagttgaaggaagaacaacgggaagtgctggatctttcgtattaccatggactgacagcaaaagaaattgcatatgtgacgggagaaagggtcacggctgtgaaaagcaggattcgtcaaagcctgaaaaagctgagacagattttggaagaggagggattcagatggaacggataaaagaaatggaacagctactaaaagaacaaaagaagccggtgccggatccaaagagggtagcggcatgcaaggaacgtatgatggaagaaatcagtcatcaggtgatccttccgtcacgtccgcttttagtgcggatgtgggagagtgcggggtatatttccaggtggacctggggagggcttctctttttttgtgcggtgggtgttctgatggcgcttcataattcctatcagaatactttggcactatgttcaatacttgccccgcttcctggtatctttcttgtaccggaactagccaggagtttttcagagggcatgtgggagatggagcagtcctgctactataatctgagggagcttctgctgctgaagatgattgtgcttggtcttgcctttggcgtccttcttggattgggtgcggtgatgacaagagtggagagcggaagttttgtagattttgaactgtggatttgtctgccgtttttggcagtgagttcactgtccttcttcttattgagaaaaatccgcagtcgtcaggcggaatatgggatcatcgggattgatctgatgggagtctgtgttgtcattggtatgtggaatgtcaaagatgaccttcaaagaatgttggagagtgatcagacagcggtgctgctttttgtacttctggcggtgcttttggggagcctcgtgatgaatggaaagaagtttttccagtgtgtacagaatggcgaactggtatgggaagaactgatggaatagaaaggagaacacatggaactgaaactgacgcatgtgacaaaacaatatggaacaaagactgcggtagatcatattaatatgacgttgcgtgaggggatttacggacttttgggagcaaatggagcagggaaaacttcgctgatgagacttgtctgtctcattcaaaaaagaagcggcggagaaattactctggatggccgggaaatccaggaaatgggggaagaataccgaagccttcttggatatctgccgcagaatttcggttactatccggaatttactgcacagaagtttttactgtatatgtctgccttaaaagggctgaacaagcatgcggcgaagcggcggattgaggaacttctggatgtgacggggcttactgatgacagaaacagaaagatcaaaactttttccggagggatgaaacgtagactgggaattgcccaggcgatgctgaataatccgaagactcttattttggatgagccgacggccggactggatccaaaggaacgggtgcattttcgcaacctgatcagctccttttctaaggataaaatcgtgctcttgtccacccatattgtgtcggatatcgagtacattgctgatgagattctggtgatgaagcagggaaagctgatccggtgcgggaagccgcagacacttttgaaagatttggaagggaaagtatgggaatgtctggtgccgtttgaggcggttgcagagatggaacgccactttacagttggcaatttgaaaaatgaagagcaaggatgtcttctgcggattgtttcggatatttgtcctgtaaaaggggcaaaggaggcacagccgtctctggaagatatttacctgtatgattttcaaagagaggaggacaaacgatgatttcgcttgttagactggagatacagaaattgtttcggcgtaaatttgtattagttttgcttttgatttacggtgtggtattgctttttatgatttacgcaggaaatccgaaccggttttcttcgattctgacttccgagggagatgtgctaaaaggcagggaagcagttcagtatgaaaaggagctggcagaaagctacggtacgctttccgatcaggatgtccaggaaattctggaggagaacgcaagaatccttggggagtttacggatgagaaccagatgaaagatgacgtgcattatcggtacgccaatggcttttatgctgccgtggcaaaggtgtttaccgatgcggatggaaattacaaccatcttccggcggatcaggtttatcctgggcaagagggattgatgcagggaggctttacaagcggtatggacatgatgcttagctatgtcaccacgtttttactgtttgcggcggttcttctgatcgtgatgatcgccccggttttttcagatgaatacacgtccggtatggactcactgattttgtcatcccgttatgggaagacgcggtgtgcgcgggccaagattctggcctcctttctgactgcggctaccattctgagcggaacgattgcgttcatcgtactggttacgatcggatatttcgggacagatggatttgcagtggatgcccatttgtgtgccacagggatgatcggtatggcgccgtttgcattaccatactggaaagcacttttgattctgatcagcctgggactgggggccattatgatgctgaccggttttgctctggctgcttcggcacttggaacgtcctcctttatcagtgttctggttacattggcattttttgttctgccgatctttttgtggggagtgtgggatattccgtggctcaatcatctcctggaactatgtccggggaatctcgtttcacctgccaaagtatttgcgcttccggcatatcagatcggaggtcacactgttcaggtctatcagatggaaatcgtggctgcagtttgtttcacaccggtctgtgctgtctgttcttattttggattcaaaaaccatcaggtgcgctcataaaagggtgcgcctgatggtttttatttcataggaaactgcgttcctatgaaataaaaaacgcgctgcggcggagtggaagctaccactgaatcgacccgccgcaggcggagaatcctgccaaaaaggattctttttatgataaaaactgtatgtcaatcatacagatctcacttttggtacctactctcatatttggtccgaagacgcccactccagaggtgacaatattatgcatggaacctttctttaagtagccgcaggcgttttcccacaccatgtcggtaatcagggtgagaggaaagacctgtccatcatgggtatgtccgcaaagatccagatccactcctacctcggagagttcatttagctcccgtggctcatggtcgatgacgatgagaggcttcgtcagatccagctcttcggtgagctctttcggtgttttgcgggtgtcaatgccccggcctggtcgttcataatccggtctgccgcacaggtaaaaggcatgatcgatctcgatcgtctcatcccgtaacagggtgatcccggcctgcttaagaaaggtatccatccggggatcgctcatcttttttccatcctggtggaaggtgaatccagcaaggatcggctcttggatatcgtggtttccatagcaggcgtaggtaccgtatgtgctccccaaatcagcgagtgtggaagccagttcttgtggatcgtccagcgcttcgtattcattgtcaaaaatatctcctgcaatgacgacaagatcgggattctgtgcgttgattttatccaccatctgccgcatctgtgcggttcccacgctgtaaccaaggtgaagatccgctaccagtgcgatttttaaggagtccagatccccggcctgtttttccacctttacctgataaggcgttatgcggatccaccgggcattcaccatcccgtagatgctgaccgctgtgatgaggatcaggcagagtgccccggcaagagccggacgcagccgggtgaaagttttttttcgaatttttgtatgaacaagccggatgagatcggcggcaacgacaacgagcaccatgtagagcattattcccatccagtagtagccaagaccttttaaaaaccgctgtgcctctcccggaggcgtgagaaagccgatgccgggagaaaaggccacaaacaggtagacaattccgaggacaatccgcaccgcctttttatgaaatacagggtggacggcggaaagccaggtaaaaatccggtgcagcagatatccattgacaagcaggtataccggaagtaaataaactgcaatcataacaaattctccaatcttttgtaacagtgacacattacagacgcacgaacgtcggatgatgtccggtatgttttaaaaagacgtccagaatgtctttggtgcggattttgagcgtagaactgttgatacaagggtggcatccgatatattcatctgtaaggagatcctcatcaatcaaaagagtcacatccagaccggggtcattcatcagccccaaaacacttgcggaccccggtgtaagattcaaatactgttccataaattccggttccgcgaaggaaaggcgggagattcccagttgcccggagagatcctttgtcacgaattttttgtctcccggcattaaaaggagataaaaggtggtcttctgacggttacgaagaaacagattcttgcagatcttgacgccgagttcttgttctacagcttcacagtcttcgatggtatttgcggtatcgtgatccactccttcataggaaattcccaggcggtccagaagctcgtagacatgagcctctttctccagacggtctccacagtctggacgtgcgttaaaatgggttgtatgtacagtgatactcatcgtaaaacctcctgataaaaatgattttcttttacagtataaaaagaaacagaaaaaaagacaagactgtaccaaaagaattaagattataggcttgcggaggcatgggacaccccttataataaagaaagtatgaatttaggagaaaaaaggaaatgagaaaattactgaagtatctgaaggattataagaaggaaagtatgatcggtcctctgtttaaacttctggaagcctgctttgagctggtggttcctttgattatggcgaacatgattgatatcggaatccggaacggggatacgggatatattttaagaatgggcagtatcctcattttatttgcggtgctggggctgtcctgttccctgactgcccagtattttgcggcgaaagcatcggtggggtttggaacggcgctgcggcatgacatgtttcggcacattcagagtctttcctatgcggagattgaccgcgcgggaagttctaccttggtgacgagaatcaccagtgatattaatcaggtgcagtcgggcgttaatctggtgctccggctttttctgcgatctccgtttatcgtggtgggagcaatgctgatggcttttacgatcagtgtaaagctggcgctgatttttgttgtggcagtgccgcttttatcccttgtgatttacgggatcatggtagtgtccattccgctgtaccgccaggtgcagaaacggctggaccggatcctgctttccaccagagaaaatctggaggggatccgggttatccgggcatttggaatgcaggcaagggagcgggaggaatttaaggccaagaacacaaaatttctggcagcgcagatgctggtaggaaagatttctgccctcttaaatcctgccacttatatcattgtcaatgtggcgaccattgcgatcgtctggtttggaggccgggagacctatgccgggggcgtcacccagggagaggtcattgccctggtcaattatatgacccagattcttaccgcattagtggcattgtccaacctgattgtcagctttacgaaagcactggcctgcgccaaccgtgtcaatgaagtctttgatcttgagccatccatccaggatccgtctgtggaagagttagctggccgggagacgtccgtacaggaaatgatgaaagaaaaagaggttacaaaggtcaaggaggccgtggcttttcatcaggtgtcttttgcgtatccaaagagcaaggtctatgcagttacaggactgaatttctctgtgaaacaaggggaaatgattggaattatcggaggaaccggttccggtaaatccacccttgtccagatgataccgaggttttatgatgtgacggaaggtagtgtgactgtagatggacgggatgtccgagactataaaatagaagaattaagacagaaaattggaatggtaccgcagcgggcagtgctgttccgtggaactattcgggataatatgagagttggtaacgaacttgcggacgatgtggagatcatggaggccgtgaaaagagctcaggcgctggaagtggtagaagggaaaccggatggtttagataccatgattaacgagggaggcaagaatctttcgggcggacaaaggcagcggcttacaatcgcccgtgcccttgtaaggaagccacaaattttgatcctggatgacagtgcgtctgctcttgattttgccacagatgcaaggctgcgtaaagcagtcagggatttgaaagatatgaccgtctttgtagtatcccagagggcggcgtccgttatgcaggcggatagaatcatggtcatggatgatggaaagctggtcggaatcggtacacatgaagagctgatggaaacgtgcgaggtctatcgggaaatctgcctctctcagctctcagaaaaggaggtgggacgtcatgcataaaacaaacagtacgtggaagaaagtactctgctatatcagaccctattcgttctatgtgatcctttccctcctgttcgcggttctgacaggggtgctgacgttgtatgctccgatcctggtaggagacgcaattgattatattatcggaagagatcaggtgcttttcggggaaattgccggtattttaaggaatcttgccattattattgtaattacgggagtgggacagtggctgatgaatctttgcaacaaccagatcacttaccgggtagtgctggatgtgcggctgaaagcctttaagaagctggaaaagctgcccctttcttatatagacagtcacgcaaatggtgatacgatcagccggatcattacggatgtggagcagttctcagacggacttttgatgggattttcccagtttttctccggcgtggtgacgattgtgacgactttgattttcatgctcaccatcgatattaaaattacgctgattgtcgtactgctcacaccgttatctttctttgtggctggatttatagccaagcggacgtatcagatgttccggaaacagtctgagacgagagcggatatgacgtctcttgtcaatgagatggtgggaaatcagaagattgtccaggcgtttggctatggaagtacggcttgcggacggtttgatgagataaacgggaagcttaagacgtacagtctgaaagccattttcttttcttcgattacgaacccaagtaccaggtttgtgaataacctggtctacatgggcgtggggatcggaggcgcgttaagcgctattacaggagccatcagtgtaggacagctctcctgctttctgacctatgcgaaccagtatacgaagccgttcaacgagatttccggcgtcgtgaccgaacttcagaacgcgcttgcctgtgcaaagcgggtatttgattttatcgaggaggagccggagacaaaagacgatcaggacgccgtggttctgacggatgccaaaggaaatctgaaactggaacatgtcggattttcttataaaaaggaagtgccgcttttgaaagggctgaatctggaggtgaagccgggacagaagattgccattgtcgggccgacagggtgcggaaagacgacattgattaatctgctgatgcgtttttatgatgtggatgagggtgtgatccgtatggaaggagaggatatccgccacatcacccgggatagcctgagagaaaattacgggatggtgctccaggaaacctggctgaaatccgccacgattgcggagaatattgcatatggaaatccgcaggccacaagagaggagatcattcatgcggcaaaagaggctcacgcccacagctttatcaccaggatgccggacgggtatgacactgtaatctccgaagaaggcggcaatctttcccagggacaaaagcagcttctttgtatcgcacgagtcatgctgcgcctgccgcctgtcctgatcttggacgaggcgacgtcctctattgataccaggacggagattcaggttcagaaagcgtttgaaaagctgatggaaggaaggaccagctttattgtggcgcatcgcctttcgaccatccgcacggtggatcggatccttgtaatgaaagatggaaatataatcgagcaaggtacgcacgaagagctgctctcgcagaatggattttacagacaattatatgaaagtcagtttgcatagataatacgggatgggaatcgttacgtcggagacagaatctcatgtgcggagcattgcaattttgcgttgaaagtgttaacataatatttgtaggaactgacaaacgctttccggaggagactccggcacgacacaaaagaacagatgatgacggggagcttgcgtaggaagcaggctgagagtaagctggaggctttgacccgagacctgatttgggtaatgccaacgtagggaaggaagagaaattgtttatgcgggtataccctgattgggatacccgctttttgtatgagcgataagccacagtccgggtttcctctgacttgtgccgtgatccataccagagcaaaggagtgtgcgacgatgaaagaatgtatggacaatgtgagaaagaatgtacctttagtacacaatatcacgaattatgttacagtcaatgacgtggccaatagtctattggcctgtggcggaagcccgatcatgtcagacgagccggaagatgtggaagacatcacgtcagtctgcggcgggctgaatatcaatatcggaactttgcatcagtcaagtatagaggggatgttacttgccgggaagaaagcaaatgaactgggacatccggtactgctggatccggtcggagcgggggcgagcagacttcgtaccgacacggcgcttcggattatgaaggaaattaaattgacagttattcgtggaaatatttctgagatcaaaacacttgcttatggtagtgggacgacaaagggtgtggacgcagatgtggcggacgcggtgacagaggaaacgctgaatgacgcgattgcttttgtgaaaaattttgccagaaaaacaagttgtatcattgcggttactggcgctattgatctcgtttctgatggggaaatctgttatgtgatccgcaacggcagaccagagatgggtaagattacagggacagggtgtcagctatcaggaatgatgacggcttatgtgacagcaaatcaggagaaaccgcttgaggcagccgcgtcagccgtgtgtatcatggggctggcaggtgagatcggatggagccgaatgcaggagggagacgggaacgctacttacaggaaccggattattgatgcagtctatcagatgacaggagaagatctggagagaggagcaaaatatgaagtacgctgataaacttttgctttatgcggtgacagacagaagctggttgggcggcaaaacgctgtatgaggaggttgaatatgcgattcagggaggagtgacctttgtccagctacgggagaagagactggaggaaaccgcatttttaaaagaggcgcaggaaatccagaagctttgtaaaaaataccatgtaccgtttgtcattaacgataatgtagagattgccgcccggatccatgcggacggcgttcatataggacaaagcgatatggaggtcaaaaaggcgagggagaggcttggaaatgagcggatcatcggggtttcggctcaaacggtggagcaggcggtccgggcagagagggacggcgccgactatcttggtgtgggggcggtattcccgacaggttccaaggcggatgccgtggaagtggatcaccagacgctacgggagatctgcagggcagttcagattccggttattgccatcggaggcattacaaaagataatgtaaaagagctgaatgacagtggaatttgtgggattgcggtcatcagcgcgatttttgccgagaaagatacgaaagaagcggcaaggagtttaaaagagaagaccatggaagcgctcggtatcatataaagggaatccgctcaatggtgaaaggaggcagtgcatatgataaaaggggtcatctttgatgtggatggggttcttctggactcgatgtccgcatgggaaaatctggggcagatgtatctgaaacacctgggaatttctgcagaagcagatcttggggagattttgtctccgatgagcctggaggaggcagcaaggtatctgattgaccattatggactaaagtggaagccggaagaagtggtgagaggaatcaaccaggagttgaaagaattttacgagcatcaggttttactcaaaccaggcgtggagatttatgtcaacgaattttgcaggagaaacatcccgatggcgatcgctacatccggtgaccgggaaaacgcggaagcggcgttggacagattgggcgttctttcatactttgagggaatctgcacctgctcggaaaccggatgggggaaaagccgtccggacgtctactttgcggcggagcatcttcttcatacgaatccaaaagaaacatggatttttgaggatgcgctccatgccctacggacagcaaaaagggctggatttcagacagtcgggatgtacgacaggtcgaatgaaaaagatcagggaaagatccggaaggaggcgaatctttacctgacaggctgggaacgttttgaatggttttgggaaagagcgtcgacggtcttctaagaggaacggcatgtgtttccagcggcagaccgggggcaccactttctgtcgcgatagaaaagaatgctgaggaagtaaaaaagaaaggatgttgaaagatgagaacagcattgacaatcgccggaagcgattccagcggaggcgccgggattcaggcagatatcaagacaatgaccgcaaatggtgtgtttgccatgagtgcgattaccgcactgactgcacagaatacgaccggcgtgacagggattatggaggtatctcctgaatttttaaaacagcagatagacagtattttcacagatatccggccggacgcggtgaaaatcggcatggtctcttcaggggagctgattatggcaactgctgaaaaactggaacaataccgcgctgaaaagatcgtgattgatccggtgatggtggcgacaagtggagcaaagttgatcagcgacgatgcgattgacacattgaaaggcaggctcctgccgatggcggacatgatcactccgaatatcccggaggcggaagtactgtcaggaatgaagatccacacagaggaggatatggtgcaagctgccggaaatatcagcaacagatatcagtgcgcggttctggtaaagggcggacaccagctgaatgacgccaatgatctgctctgcagggatgaatactgccgttggttttatggaaaacggattgacaatcccaacactcacggaacaggctgtaccctgtcaagcgcgattgcggctaatctggcgaaagggtttgatatggaggagtcgataagacgggcgaaagattatctcttcggagccctgggtgccatgctcgacctggggaaaggaagcgggccaatggaccatgcctttgccattacaggagagtaccggaaagaatccatggattgtggaagtatggaggcgtgagtatatgaatgggaaacgtagagattccactcggaaatactctgcctgatatgatgatcgtaatcgtattgtgtgtacttgtagatacgataagacgcggaataaagaagtagaacgtattccttcataaaagtaaatgaaagtacttgacaaaaatttccggggggggggggtaaaattgttataagattttgcttgacagaagagaaaagaaatgcaattatggtaaagagttaagaaaaatcattacaattttaggcatatggaggaaaaggctatgaatgggagtgttcagattgagatccgtgatctcaccaaaatttataagctgaacaaaaagcagatgcaggaatctcacaccaagaatccgaagaagactgcggtagatcacctgacgctgacggcaagagcaggagagatctacggacttctggggccgaacggggcagggaagacgacgacacttcgatgtatcgcgacgattatcaagccgacgtcgggagagatctttgtgaatgacaatgaggtacagaaacattcagaagcagtcagaaagagtatcggatttctgaccagcgatattaagctggacccacagttttccgtggattatctgtttgatttctttggagaacttcgagggatcgcgccggcgcagattaaacgcaggaaggaagagctctttacatattttggaatcagtgatttcgcccacaaaaagatcaaggagctttccaccggtatgaaacagaaggcagcaatcgctgtcagcctggttcacgatccggaagtggtaatctttgacgagccgactaacggacttgatattattactgcaagaggtgtcacagactatttaaggaagctcaaagaagaaggaaagcttgttattgtttccacacatatcatgtccgaggcagagaagctttgcgaccggatcggcattattatcgatgggaagaagagagcagagggaacccttcaggagctgcttgacgagacgcggacacaggatctggaagatgctttcttccaatactttaaaagcgtaaagggggaagcataggatgagaacgatttataagaaagagcttgcaagaatatttaaagataaaaagatggtcttttctgttttcctgcttcctgtcctgatcatggtcgggattatggcgctggtaggcaatcttaccagccgtcagatggaagacatcgaaaaccatgagtccattgtatacatgatgaacgagccggagagctttacggctttcttggatgcttcggacctgcacatggatgtgaaatccgttgagacggaagcagagcgcgacgatgtgatgtctatgctcaaggaaggagacgcggatctctttattgaattcccggaaaatttcgattccctgattcaaggatatcggcagggagacgaggtgccgcagattaagacttattacaatccgtccgaagattattcttccagtgcttatgagctgatctccaatcagtcgctggaagcgtatcgtcaggtactgctctcccagagagtgacggacatgaacgagcttcaggtatttacagtcaacagtgataataaagacatggttgttcaggacgatcagaaagcgagcggcaaggctcttggaatgatgctgccgtatttcatcaccatcctgctctttgcaggcgcgatggggatcggaaccgatatgatcgcaggagaaaaagagagaggcacgatggcgagccttcttgtgactccggtcaagagaaaatccattgtactcggcaaagtctttgcattgatgacgatttcagggatctcctcggtgatctacatcgtggtgatgggagctacattcccgaagatactgggaggagacagtggtcttgaccttgagattacaccggaacagatcgtaatgattggcgtgctgttggtagcgatagcatttctttattcagccattgtcattctgctctccgtctttgcgagagatttaaaagaggcaagtacctatattaccccagcctacatggtggtactggtgatcggtatgatgaccatgtttacgacaagagaggctggtatgaaagattacctgattccgttttataacacagcgctggcgctcaaaggcatcctcacatcggaagtgacgatggcacagtatggtgtgacccttgctatgaccctcgttcttggaggaatactgaccgcagtcattgcaaaagcatttgaaagtgaaaaggttatgaatctctaaacatggaaactcagaaatccgaatgcagaagggaaacaaaagacaatatggcgcatatgctggtgataagaccggcatatgcgcttttgcattggctacgatctaacgtcagggtttatcaggaaccctggcggccgatttgctacggccggggcgataggagggaagacggatgagactttgcgatctgagagaaaaagaagtcatcaacacagggaactgcaggagacttggctgtgtggtagatctcgtagtggatatgaagaaagggtgcgtgcaggcgattgttgtgccggggcctgggagactctgtggtctgttcggatatgacagtgaatatgtgatcccgtttgagtgtatctgtaaggtaggaccggatatcatccttgtagatatctgcgaagaaaaatttctctgtgagtgcaggtaattctgggtacgatctgttgaccgtcattaccggaagatggtatactgataccagattttggagaaaggatggtacttcagatgaaatgtccatactgcggcaatccggacacaagagtgattgactcccgtccagcagaggacggatcttcgatccgcagaaggcggtcgtgcgatacatgtggcaagcgctttacgacctatgaaaaagtagaaacaattcccctgattgtgattaaaaaggataacaatagggagcagtacgaccggggaaagatcgaaaagggcatcctccaggcatgttataagagaccggtgccggccgaggtgatccgaaagacagtggagcagatcgagacagagatcttcaatcgggaagaaaaagagatcccaagcaaagtgatcggtgagatcgtcatgcacaagctcaaagatctggacgaagtggcatatgtgcgctttgcgtctgtctatcgtgaatttaaggatgtcaatacgtttatggaagaattaaagagtatactggataagaaataggtgaagggagatactttgtaaggaagtgtctcccttgatttatatctcataaaactattgacgaagcagaaaaatacccttataataactaatgttatataacaatagatatttaaaggaggaagtaagatgccgcctaaaaagaggatcacaagagaactgattttgaaaaaagcatttgatatggttcacgaggaggggattgacagcttaaatgcgagagctctggcgaagaagctgaactgttctacaatgcctattttccagtccttccaggacatgagagacttgaaaatggaggttaagcgctggattgacgagtactacagtgcgtttcttaaccggtatgtgcaaaaagaggattacctgtttacgatcagctttgcttatattaattttgcaaggatggagcatcattttttcggagcactgtttgtgaatccccttcttgattccaggacagtccgggaagtaattgattcgccctggaacagagagacgattgaatgtaccgctgaacagttcgggatttctatacgggagagtgaggagctttacagggatatccggttttatgcccatggaattgccacgcagctttatggagggaacatgacgctcggcgaggaggagattcagggacttttacatcatgcgttagaaaggtttttacaatgaaaaatttacaaattatccgacgttattttcaggtgacaaaggcagacaggaaaatttcggtttttcttgtgctgtcttctataatggcaaatgggccgtatctgtttgtgagcctgttgttcagtatggcgattgacagcttgtccaagggagatgcgaaccgggtcatgctgatgatggtgatctatttccttttgaagatttgttcgaaggtgttcaagattataagtcttatggtagagcggagactttataatgatgtgtacagaaaacttcaggatcagatggtggagaagctggaccggattgaaatgacggcctttgctgtctgtaataagggagaacttttgaatctggtcaatggggatgtgagagttctggcagaattcggaacctggctttcagaggcccttttgttggtgttctcctttgcagtttctatcgtcgttctggcgaaaattagtctggggctgatggctgtcggatttttggtcaatgccctggtgatctggattttgaatatttataatgaaaaatatgagaagctgaccaaggaagggaaacagaaaggagacgatgaaactcgcttttatggagaacttctttccggaatgagagaaattaaaatcttccagatgctggctcccctgcacacaaagtaccgcagacttaacgaggcatatatcgatgtacataacaagcagattcggaaccgagtcatcagcaatattttaaatccgagcattacgatgtgtatggagatcattttgatgatctatgcatgctggcagtgtttgcacggagtctttgggatcgatacggtgctcatcatccagtcctattttggtacgatgtttacatctttaagcgaccttgtcaccgcccttggagaactgcggatcaaacatgtttccattgaccggtacgatggttttatgcggaaaaaggaggacaagatgacagagacagaggtagtggtggagagtaaagactatgacatccagatggatcatctgggattttcttatggagaggaaccgatcttttccgattacagcgtcaggattttgcccaataccctgacagcgctttctggaccaagcggatgtggaaaaagtacgttctttcatttgctgttgcggtttgagaaaccggattctggaacgattcgcgtcggaggaaacgagatctggtgttatccgaaggagacgtacgcaggactggtgacttgtgtttcacaacagccgtatctgttccatatgtcaatctatgacaattttgccctggtaaatccggatatggatcagattcgaaaggcgtgccgggacgcagagatagatgattatatcatgtccctgccgcaagggtatgagacgattttgaaggagggaggaagtaacctttccggtggacagaggcagcggatagcgatagcaagggcacttttgaaaaatgcgaaggtccttctgttggatgagattacgagcgcattagacgaggcgacggcggcagatgtgatgaggacagtgaccaaacttgcggaaaatcatacgattttaatgatctcacacaaagctgtagagcagaatttatgcggtcaggtgattcgcctgggcgaatagaacaatataaccaatggttcattttctgtaatagaaatgagagagctgctcagttgtaaaacctgccttggagaggatataataaaattatggacaggaggtacggaaaatgaatataagtgagcagatcagaaattatagaaaaagtgtggggcttacacaagagcaggttgcaaacgccctgggagtttctgcctcggccgttaataagtgggaaaaaggaaattcttatccagatatctctacactaccggcacttgccagattattacagatggatatgaacgatctgttttctttccgggaagaattgacagacagggagattggacagtttgttaatgagctttctgaagcagtattggaagagagtatcgatacggtgtttgaaatggcatcaaagaaaatacatgaatatccacggtgcgagctgttgatttatacggtttccacagtcctgaatagtgcgttgatactttctgagacagacagcaaaaggaggcgggaatacgacgccagtattcttggctggcttgagcggacggcagaaagcacgaatgaaaagatcagaatgtccagtgagtatatgttggctgtgaaatacacacaaatggaagaatatgagaaagcagatgcttatcttgccaaaattccggatgttaccattgatacaacgattatgaaaacgaatgttttgatccggaaggaaggggaagacgccgcggctctctttttagaagggaaactgatgcagacagcgacaacgcttcaaaactatctgtataagctgattgaaatagaagagacgacgggaaatcgtcaagaggcagaacagattgcggatcttgcggagcaaataatatccttgtgcggaatgtggaagtatggcagagttgtcccgcatctgttgcttgctttatatcggaaagacagcgaagggagtatcaggttgatacgagaggcgctggatgaagcaagaaaaccgtgggacatggaagcaagcccattatattacagatatgccggtaccagacaggagaaagcgggatctgctgctggagagagttttgtccgggcattcatttctgaaattgaaacgaaaaaagagtatgattttttgaaagagaatccggaactcgaaaagattcttgcagaatacaggaagtgacagaatgctgaaggatcctgaaaacaaaaaacaaatgaaaacgccgtaaattttcgagttgaattttgcggcgtttctgcctatactaaatcatagtaatggcatcggagatgagaaaagatgagaacatataagctgacaatctcctacgacggcactcgatatcaggggtggcagagacaacggggagtagaacagacaattcaacatgtgatagaacagtccattgcgtccatcaccgggtatgaggtgaagatacagggatccggaaggaccgatggcggtgttcacgcgctgggacaggtggcaagtctcagactgtccgggaaagtcgaggaaagggaatttcttcggaagttgaatgagaggcttccggaggatatccgtatccgggaaatcgagctggtaccgaatacctttcatggacgcagaagcgcaaagggaaagtgttatgaatatcatattgatttacgggaaaagccgtgtgtcttttcaagaaaatatacataccactacccggagaagctggatatcgaggcaatgagagaagcgtctggatatttgattggacgccacgatttttccagctttacagaccgcaaggatgaggaaagctgtatgcggcggatcgacgaaatccgagtcgaggtagaaccagataagctttatctggtttttcgggggaacggatttctgtaccacatggtgcgcattttaagcggaactcttctggaagtggggagtgggaaacgtcgggcagatgaattgcctcggattctgaatgaaaagaaaagagcagaagcaggatttttagctccggctcaggggttattcttaaaagaagtattttacagagatgaaggatagaaaatatgcagggggaatcatgggaaaaagatcgcatgggttccccctgttcagggagtatcccaagatttgtgtaaaccttcaaactgatgtaagatagacttaccagtttggaggtttattttatggcgccataaaataaacctccaaactggtaagtctatcttacatcagtttgaaggtttacacaaatcttgggatactcccttggtatatgcaaaaaccttttcttgatatgtttgaattagatttttgcaagttatgataaaatcatcgcattcattaagataattatttaaagataaatattcttgtgtataatcatttagtatcataataaatctcctaaaattttgctcttaattcaacaactcgtccaataattcgaaccggtttctcctcaatttttttattgctgaaatacattgtagttgcacgaaaaaagtacatcttcggagtacactggacgtcttagtgttggccgcaccggggcggtttttatttatatatgcatttcttgactatatccataagaaacaattccacgctctttttgatcgtcatagcaccctttcattaaaaaaatcattagtattatccatataagtacaaaacaaaaaataaatttgagaaatttctttatcggtcttaatgagttgcctgttccagtcaaccagctgtgcccgcaattatgacacaagtgtcgtgtgaatatcccgccgttctcatgcaaaattacggactctacattactgcttttgcattttggacacttcatatgtaccacctcaattcattatttttttaggatgtcagaagtagaagaaaagaagtattcaaataaagagctatcgtatttacttccaatcatttcatttaccttatccgctatggcagttcccatttcttctccaaactcagaatccgctacctttgttcttttgtattccgtaaatatttttccccattcttcttgtgttccctcataataaatcttgattttttctccatcttttgggtgtaagtacgataacgaattatcagaaacattgctcatcgttttcgggaaatacacagattttacatgggatgagttaaaaacggattcatatatttgagtaattccatcgcaaaatattatagattccacatacttgtttccaattcctacttggaaatcggataaatcagtattatatgttttcccgtcaatttcatatgacggctttatttcaaggactttacattttccatcatatccatgtaaaacaacagtatcacctgaaatattgtaatcaaaatcatttattactccatatttttcagatttatctttctgtacttcaactcctgttacacctttagcattttcttttgtttcattcttttctacctgttctgtgttcgagttatttttctcagactttccacatgccgcaaaggtcagtgacatagacacggctaacatcattgcaacaattttcttcttcattttctattcctctctttctcttttccgagaaaacccaaacctattatataatcgcttatgcggttatactttttccatgactgccagcttcggaataaaataaattatgtaattatctatttcggtacaaataccgtacttatcacgatagcagtcgatgcattcttgtaaatattctactgttacttctaaaaattcagcagtctcatatgctgactggcatcccgattcaaaagcgttgacgatcccagtcagcccgatcagcttgttatatccccacagacgagcctgtcgttcctgcttccgatttgaaacattttccatatcaatgatgttcccaacagatgtatgatggtgtccaagctcctcggcgagcgtacaggttttttcgaccgatgtttccaatctttcatttattcctatgattccatcattatatagacctttgattctttcactttggaatttccataagaaaacatctataccgtccttgcaggcttcgtcttccagacgctcaaatgagttcatagtaaacacctcccgctgtagtatatcagttatacagtccaataatcaggactctctctttcgattctttacaaactctgcaaattgcttgatttctttcagctcttcctctgtatattcctcgccatcgaagtgagcggcgagagtagtaggtggtgcagacacacttttacatatttcgccatcaactagtttttcggcatccaatccaagttcacgtgttatttttagaacatttgtaatatttgaattggcaacgccgcggttaagtatgctgttgagcgtggtccaaggcatgtcaattatttcagtgaatttcttcaaacttccatattcttgtatgataagcgctttcaaatttgactcaagttcattcatcaggtgtcgccctccttcctatttgtctatgattcgataatatcattaaaatctcgaaaaatcaatataaaataatttatttaaaaaaataattctcgaaaaatagagaaacagtattgacaatcacgaaaaatcgtatatactttaaaatataatcacgaaaaatcgagagaggaagtgaggaagtgtttccaaatttagaagcagaaatggcaagatcgaaaataactcaaacaaagttggcagatatgttaggtattacacctaccacattatcattcaaattgaatgggaaaagcacattgtcattgaaagaatgcgtggaaatcaagaaaaaagcttttcccgataagacattggattatctgttccaaacggatgatccagacaagaaggaggtggtatagatggaggagaaaactcaaaaaagtataaaaaagacgcttgaattagaagaaggaacgctatcggttgaaatatctgccgagaacgtccctgtatcgagaactaatagttcttatgaaatgtttttagaaacattagtcgaaagaacaaaagaagaatttaaaaatttataaggtcggtctgtattaaatgaaaaattaattgttgaaccttaatataccctttcatcatttgataggaagagtatacaaaaaaatcacagaaagggaagaaggaggagaaaggcaagggaacaggaatacaaaactaaaagacaagttgctggattatttattacaaacaaatgaggggggtgaaaaaatggtatgtactggaaaagtccccattcctatagtggcttatgtctacggaaaagatgcctgttgggtccgggccggattaataagcggatatcttccaattggttttgcaacaagaaaaggaaagcagataactcaaatatctgaaatggattctaggaaaggaagaataagctacttcgtttcaccgaaaaagctatatgaggagactggatttgagtggaatggagaaaagacggtagaggagatcatatgccgtgaaagaaaaaagaaatagggaggtgatagagatgcatcgaagaaaactgcggaaataccggatcttaaaagacatctgtgcagtggtcgggggagttgccgtactggtgatggctggatctgctgacagttacagccagaacattatttcaacggcagagtttttgctgtcgttcgggatcgccctggacatgatgatagtagcgtacatgttgcatggctgtgtgaaagacagggagaagcattatcttcagatccgggaactacgtcggagacatcggcgacaagatataaaagagtgtacaagcgatacgatagcgcagaaaggagaaacatgaaacaaccgaaaaagttgacgagggaccagaagaagctggtgaaggaagtcggattgaatcctgatgaatggatgtgccactacgaaaataatgagtatttacatatcgtagaaaaggcggagccggccgagatgaaaattatcgacagaaaaagaaaagccctctgctaagagaggactaatctaaaaacccaatttcattataaagaagaacgtggaggatgtaaatgaaaaacattaaattgttgaaaatgcatatacagaatttcaagggctgtaaggatagagaaataagttttggagagaaaactgcgattggcggtgtaaatgcttctggaaaaacaaccgtatttgatgcattcacatggcttctcttcggaaaagattcccttggaaaatcgagttttgatatccgaccaagggataaagcaggaaacatgattaacaacgtggaaattagcgtagaggccactatttgcttcggcgaagatgaatacgtgctgaaaaaggtacagaagcagatctggagaaagaagcgtggaacgaatattacggagttccagggcaacgtcaatgaatttgaaatcaatgggtatccgaagagtgagaaagagtttaaagaatttgttcacgcagaaattgatgaaaacatctttaatctcattacaaactcgaatgcttttaatgctcttccgtggaaagaacagagagaagtattgatgaaatttgttggtaatttctcaaatgtggagattgcacagcagttcggtgagagatttcagaagctggttccggaactaaaaatcgcaagcacggatgatatcttcaagaagtacaccaaagcaaaaaacacgctgaacaaagacatggttgaaattccagcgagaatcgatgaaatatcaaaacagcttgtgaccgcagacgttggagctttagaagttgagaaagcggcgaaagaagtcgcactcaaaaaggtggaagatgaaataaccggcggtgcagataaacttgagacaatcaatgagcttcgcaaacaggtgatggataagaaaatcgcactgagtgagatccagaacacggcaaacgaacaactggcaaaagaacgcatggattccagagtgaagtttgacgaagtgcagaaagtgttcttcgcagtacaagatcagatgaaacagttggagcgagaacgcacagaatacatctatgagagagaccggagtgaacgggaaaaggacagattgcttgaagaatggaaaaaagtgaagaagtgtgaattcgctgaatatgttgcaccggcaccatatgttgaaccggaaccgttaaaagaatctgatctgatttgcccaacttgcggacaggatttaccagaagaagtaaaacagaaacggattgctgattatgaagcgaaatgcagacgtgaaagggacgcatatgaagcaggttgcgaggctctcaagaagaagtacgaaaaagataaagaagatttccaaacaaagaaagatcaggatctcaaacgaatcactgaagcaggacagaaagcggctgacgctgtgagagccaatcagaaactgattgatgaaagaactaatgtattggaatctctgagaagcaagttcgatgcttccaaagcggagtacgattccatgaaacaggcttttgatacaatccctgctgttgctgatgtttctgaaaatccggcatatgtgaaaaccaaggaagagattgtggctattgaaaagcagattgaagaactgagcaaggaatcttctggaaaagcagagctggaagccaagaaggcagtactgaaagatgagattacagagattgaagcgaagatcaaggcagcagacaacaccaaagtaaatggccgtatcgctgaactggaagaagaacagaaagctgtcggacagaagatagcagagcaggaacagatgattgacctgacagaagatttcatccgggtgaagatggatcaaatctctaatgcgatcaacgacaagttccagattgtatccttccgtttgtttgaggatcagatcaacggtggattgaaagagacgtgtgaatgtacggtaaacggcgtgccgttttcttcactgaacaatggtcaccgtatcattgctggacttgatatcatccgatcattgtctgaactgtacggtgtaagtgctccggtatttattgataacagcgaagctgttaatacagagaacttccctgaaatggatgctcagatgattcatctggtagtaactgacgacaaagaattaaaagtagaaagcgaggataaataaatgattcgtgcaaaagaaggagaaattgattttaaaggaactctcgatacattactcagtgagtatgcagttattacgagagaatttcgtttgatgatggctgaagcttttgagtcggaagaagaggctcagagaataatcaaaagagcgtatgatctcggatgcatgtctaatgaggaaattgataaagagattgaattggacaaagaggagtttgaaaagagcgaaggtgctaaaattattggaatcttgttttcaggaggtatgaaacatgatgctgattaaggcaagatacattaaagccgacaagccggctggtcgtgaatacacatttgaaagcgatgtgatggtaaagctgggcgatgtcataatgatcggtaaagcacaggccgtagtaaccaatacaaatgtcccggaggaagaagttcttccattccgggacaagctcaaaaagattgatgggaaagcggaggaagattagatggcagaagaaaagaaagaggtagctcagaatcaggaattcactacagctttaagtacttggacaaatacgattacaggacttgttactcgtgattttgagaagtgcggagttgaatttgacgaatattcaaagaaatgtgctatgtcagcaatgagcagtatttttcagcttgttcagaacacggataaagcaacaatgaacgacctgaatacatcaaacctgagagagattgttgagcagtgcgcaagcctgaaactgaacgcacatgctgttccgagagaggtttatttccagttgcgcaacaaacagatcaatggcgaatggaaaaaagtcgttgaaatggggattgagggcgacggaaacgatgctcttctccgtcagttcgggaacgatgtaaaaagggttcatccggtatggctggtaaaagagggcgatgatttcacctatccgaaacgaaagggacttgatgtggagcatccgtcatgggaagaaaaaggattgtctcagaaagttgtgagagttgtgtatccagtcgaattaatgaacggaaacgtagagtacctgatctcagaaagagacagtgtgaaagttaatctgattgctcatatccgtaacaacatgatgaatgagacattcgatatctgcaaagacagatataaagccacaccggagcagaaaaagaagatcaagcagaagaaagaagaaattctggatgcggtccgcaagtgtgaaactctggaagatatgctgaattgcgaggtggcaagaccgtttatttccgcagcatggcttgatacgccggaggcaatgtttacccgtaagatgcggaataatgcaatcaagaaatttccgaaaaaccttaatagtattgcaagttcttctctgcttcagatggatgatacatataaaaatgcacaggaagaaatcagagagaatgagaactcacagccgtttgacgttgaggaaaatgtggtggcagagtgtgaggctgtggaagtaccagattttgcaaaggaggatacgcagaatgagagtcattagtcagacatttatggattttccgtatgaacatatcgttgtttttgtagatgataacaaagtatgctgccgtcctgtcaatgatatgagcggaagatattacctgttgggcgaatacgaaaccaatgagcgggcgcaggaagtatttaatattattcacgaagagtacgaagagattccattaatggaagacggggaacatctttataacacgccatgcttcattatgccggagaaatgatatggagctaaaagtaattaattccggatcttccggaaacggatatgtgctgatttcaggggcgggagaaatcctgcttctggaatgcggagtaaaaggaatcgaaatgaaacgggcaatagattttcaggtaggtaatgtagccggatgcttattgtcacatatccatcaagatcattccggcagaatcaaggattatctaaattccggcatcaaggtttatgcaagcgatgaagtgtcgagtgacgttcttgctgttactggagagaaaacggttccattaccaaggatgcgaaagaagaagctgggaggatttacggtgataccttttcatgttccgcacagtgaaacagaatgtgatggatggctgataaatcacgaagaattagaaaccctgctgtttatcaccgatgcagaatattgtccttataatttttcaaacatgaatatcactcatgccatgatcgagtgtaactacagcgaagattatttaagcagggctgaagactacggaaaatttgaacacgttcttcacggacacatggaattgcaaacgtgtaaacggctcatacagacgattaacaacccaaatcttataagtataggcctgttgcatttaagtggcggaaacagccacccagagcgattcaggcaggaaataagaaatctcgttgattgtgatgtgaatgtatgggtagcagaaaaaggatttcagacagagctcggtctgtatccgttctgagggggttatatgtggattataaaaattttaaatgaagttgataggtttttaacatcaattgcggaatggttttatgaataaacaacaattttgaccggtcaaatttacatatatcaaaattcagagaaaggaaatgtgattatggaaacattgaaattgcaggaagtagcaggaggagcattacaggagaaagccaatcaggcattgcagaaggtatttgctaatatgcaggatccgaatactccttggaagaataagcgtgttgtgacaatcaaactgtcattcacgcagaatgaggacagggatgattctgcttgtgagatttccgtggatacaaaacttgccccggttaaaccggtagaaacaaagttctctcttggaaagaatctcaagacaggcgaagtggaagctgtggaatacggtccgggaatcaaaggtcagatgtcatttgcagatatgcagccgcaggaagcagtgattgacggaaaaaccgttgatacagaaacgggagaaatcaaagataacaatgtcatcagaatggcaagataataggaggaaaacattatgtcaggagttattaaagaagcgattgagtatttattggggctgaatgatccatatataacgagtattgatgaaattacgtattcagacaaaaaattagagccggttattcacaatccgaaagcatcaacaattcggatgaatactctgacaagccttgtggattatatcaaagcacaggttgataagatggatgaaaagatgattgtgcatgtgcagagtccgactaaagtatcactttattcagctcttgacggtgaacggattagagaaaatatggttgaggtggttgccagagtaccagagtttgaatacggaagattcatcgatcatgaacgcttctgcattggcttacaggcaaaattccttgatgatccagagagtgaccgcgcattggtattaaagtttgccggaactgtggaagatggaacggtgtcacagtacagtgatgacggcatttcgcagaaagcgacaattaaaacgggaattgcatctaagggagatgctctcgtaccgaatccagtgaaattacgtccgtatcgtacattccatgaggttcagcagccaatgagtgaatttatttttcgtatgaaatcagatgatagtgtgaaatgcgctctttttgaagcggatggcggcgcctgggagaatgtggcaatgagaaacatcaaggactacttagaagtagagctggcggattatccgaattttacaatcctttcataataggcaaaacgtgagccgcctgcctagtgggtgggcggcagacaggagaaaatatgaacaaagtaattttaatgggacgactcacgagagacccggaaattagatattcgcaaggagaaaaagcgacagcgattgcaagatatacgcttgctgtagatcgcagattcaaaagagatggggatcagactgctgatttcattaactgtattgctttcgggaaactgggagaatttgcggaaaagtatttacgacagggtacgaaaataactgtctgcggacggatccagactggaagctatacgaatagagatggagtgaaggtttacacaactgatgttgttgtggaagaacaggaatttgcggagagtaagagtaagcagcagagcaatactcaggcaggaccatcaccatacggaccagctccggagtctggagatggatttatgaacattccggatggaattgatgaagaactgccatttaattagagtggcgatttggtgaacgaaatcaaaggttctggcagaaagaaggtgaaaaaacttggatgggcaatacagaaaaccatctgacgtaacacaggagtttgtagatttcttggaagagtcaaaagccgtatatgagaacgcaaggaaaaaatgtgaggaatacgattcgatggaacgtcacatttactgggcgcataagtttgaatttgcaaaggatcggaacgagagaaatcgccttgctacgaaataccagaacgagcgaaaagaacggagacgatacaaaaatatttgcgatgaatacaagattcttgcaggatttataaacagcgataataacaaaggagcgttgaaaagactcaagggcttgatcgaagttcaaaggcgtgaagaagaatacatctcaaataagcgggtgtataaaggcggtgattgaaaatgacttacaacaatatcgcaagggcaaagatggttgagaaacgtaataagcagtttgttctttctattaattcaacacttaatgatgacagtggaatttacttccttacacgaactgatgaagatggaatcaaatatgcgtatataggacaggcaaaacacattctgacaaggcttgcacaacatctggttggatatcagcatattgatttatccatcaaaaaacacgggtggtatacagatgataatctgtgtgggtggaagatcggattcatgaattgtccagaaagtgaactggataaaaaagaacagcattatatcaagatgtatgctaagcacggttaccagcttcggaataagaccgctggcgggcaaggacagggaaagacccagattgatgcataccggcccgcaaagggatacagagacggtattgcacagggaaagaaaacactggcaagggaattatcccacatcatagataagcacttgacggtaacgcttcaagacggaaaagaatacaataaagtatctcaaaaggcaatggagaaatttaatgctctgttagacgaaaaaaattattaggaggaaacggcatgatacataactttgatataaacatagcggaaaaatacgggatcaatgctgcgatcatcctgcaaaatatgtattactggatcgagaaaaacagagcaaatgaaaagcatttccatgatggatactactggacttacaacagtctgaaagcttttgaagaactgttcccttatatgagcaataaacagatcagaggcgcattagaaaagctggaagaagaaggggttattgtctgtggaaactacaataattccacttatgatcggacgaaatggtatgccattactgaggctgggtatgaacttctccaagagggcaaatgcattgtgccaaaagggcaaatggaaagttccgaaaaggcaaatggaatgtcccaaaagggcgaaccaataccaaataataaaccatataataaaccaaataataatatatgtgcagcagagccgcacgacgacgaatcggaaaatgaggatcaggaaaaacaggcttctcgtgatgaacagcttcgtagtgattttgagattatatacggcatttaccctaaaaagcgtggaaagacggttgcatttgccaattacaagttgtgggttggtaaaggcaaggatgtcggcggcaagaagtacaagctgaccaaccggcagatctacaaggcggtgcaaaagtatgtaagacagcaggaagaagccggacaggatgattaccagtactggaagaattttgacactctgatgggtcggcagcttcttgactatgtggattgggaggattcgtgatggggtatgtggaagagcaaaatatcatcggcgccctgttgatggacaataacagtgtctctgaaatttattctatgatttcgccggaaatgtttacttcggagttgctggggcggatgtatctggaatttcttcgtggatatgataaccaccgggaagtaacgattgcagtcctgctacagagacttactggtggatcctacccagaatatgccatccaagatactataaaagcatgtgtttctaacactttgacgagtgcgacgatcaaaagctatgcgaatgtacttttgagagattataagacacggaaactcagggaaacggtacaaagagtggttccgaacgctgggaatattgatgttcagatcgcagatctgatccgggacttagaagcgttgcaggaaggagagcaggttttatcaaagtcattgccggagatcgtcaaggaaaacagggataaatatttttgcgacagagaagacgagaggatgtacattggtttttctaagctggatgatcttctaggaggcctggaaggtggagacatgattgtgatcggagcacgtcccggagtggggaagtctgctttggttacgcagattacctcgaacatggcggcacgtgggaaacgaatcggattttacaatctggaaatgcaggaaaaacaggtgtatgagcgctttattgtggcgcagagtggaattaggctgacgagattacggagggcgaagaaattccttggtgacgagaaagagcggtttgacagggcaaatgaggagcttatgaagcgtgacagtatcgtgattaccacaggtagtaaggcgatgagtgagatccgatctgaaagcagacacatgggatatgacattatcataatcgattatctgcaacttttgaaagcggacaagtcttaccggggaaatcggtatgcggaggttggatccatttctaaggcaatcaaggctctggcaatggagctaaatattccgatcattgcactatcacagcttaaccgtgtatctgaggcccgtgagacgaaagagccgacaatggcagaacttagggaggctggagacattgagcaggatgcgagtgtaattatgcttctctggaatatatcccaagacgataattcaaaaaagggatgtaaggtagaaaagaatcggcagggaagaccaggaaaagagatattaaggtttgacggtgatttgatgcaatttgttgaatccgaagaatctgtaaaggaggcgcaggagtgggcaagagtcaatgatgatgattgtccgtttaagtaatatggcaggaaagaagattgtaaaaggatctgaagaatggcagatgtttcaagatttctggaaacttgcgcaggagatatgggagccggaagatacggatgagtattggcaagaggttatcggtaagacagatgaattttacagaaaatacaaaacaccgtatgcccgtgaatttgccattggaatcacaaatgcattagacagagttcacaaggataggaggcgaagtgagaaatgataccgagaaaaggaatgaatccggcgttagcgaggttaacacagcagagaaaagaaaatatgctgattagtgcggcaggtaaagcgaatctgattatatcgcttatggtgcttgcggataagttcgattttacaccggaacaactagagaaattcatagatgagtctcaaaagcagttggaagcgtataacagtggttatgtagagagtgtgaatgattttatcggtgtgctgaaagaagagtatgggattgaggtgaattaaatgttaatcagaagtcagaataaagtacagttgattccagtgggagagtttgcgttcagtgttatgcttaatggttctatttctgccaataagaatatttttgcaactgtacatgaagcgactcaatcaatagtcggcagatattcaaccagagagaaagcgattaaggtgctggatatgatctgtgatgcatatgaggtgacaatatgacaacagagcagaaaatacaatacatagctgatcattacggatacgaaccgcagagtcgacagcttatcgaagaaatggcggagttgacagtggcgattaacaaaggatggagaaagagtcacccacttgaatactcggctggatcagaatatgagcatattattgaagagatggcagacacggtgattatgatctggcagataaaatatcttcttggcgtgggggaaggagagttgtcgaaaatcattgaacagaaattggatagacagattgaaagaatcaaaaaagagtagaaaggagccgcctccggccggggaaagggtatatcgggcttcttagaaaaatggataaagagaaaaaatcaatagagagaataaagatggcaagcgaaatgagcctacatcactatggaaaaccgcttgtttgcacgtatagcggagggaaagacagtgatgtgatgctagagttgttcaaacgatccggaataccgtttgaggtacataatagccataccacagcagacgcaccccaaacagttcagcatattcggaaggtattccgggctttggaaatgcagggtatcccgtgcgaaattgagaaaccaacctacaaaggaaaaagaacaagcatgtgggaactgatacctcagaaacttatgccaccgacacggcttgtgagatactgttgttctgtcttaaaggaaacgggatgtaaaaatagatatattggaacaggagtaagatgggacgaaagtatagcaagatcagatcgcggagaatttgagagacttggaaagacaaaaaaagaaactgagaaatttgatgcagtcatgctgatgaacgacaatacagcatcccgccgaatgacagagttatgtatgcgaaagaataaaatggtagtcaacccgattattgattggacgcataccgatgtatgggagtatatccattcagaacatattgaaacatgcgaattgtataaaatgggatacgaccgtgtgggctgtattggatgccctatgatgggcaagaaacgctggaaagaatttgcggactttccaaaatacaaaagcctatatatacatgcgtttgaacggatgcttaaagagcgaaacaaaagagggaaagaaagcaaatgggaaacaggggaagaggtttttagctggtggatggaaaatgatgatataccaggtcaaatgttcttagatgaaatttgtggtgatgagaattaaaacacaacaaacgaaaggagatcagagatggagagattaacaataccagataagaagatagacggcggattaagaagagccatcattgacgcccgagaagtacggaaagaagcaatgactatttactgggcgttaaagaaatacgaggacaccgaacttacaccggaacagatcatggagttgaaagaagcagttcagaaactcgaaaatatattcggagatgaaattacagttaatcaggttattgattttttcgttgatttctatattgcacagggtgatccagacagagtggaaaaagcagaactgttgacaaacgaagaagctgcgaagtggcaggggctgaaagagcgggatacggcgaataaacccgtgcaaacggaagatggaatggtatgcccgatatgtggtagcaaggcagttccgtggaaccggttctgcgatgaatgcggacagagatggtgggaagaggaggactgacatgcagatattagagaaatttgctttaactgtggaaaagattatgaggtggactatgatgactatgatttctgcccgaaatgtgagcagaagatagacagatttggattggaggattagaaatgatatctaaaaaatatactagagaaatgttaagaggaagaaaagcacgagttcttgtagatattgctaataaaggtggatgcggtgtaagtgcagggggtacagtgacaatcgcaaatgttgtccgaggtaaaggcttatacataaaaaccgaaaaatgccctcactgtggacaatatgcatatattataggcgtatcaagggaagatcttgaattaatagaggaggactgatatgcaggaattagagaagattctggaagaaataaatgacagatttgaaaatctgactattgctgatgatgaatgtagaaaaacagcactttcaaaacacaattatgaacaagtaaaatattttcaaaatgcaatgttttatacagaaagggcaaaaggcattgtagaagaaatcatccacaagcacatgggaaatgacggctggattccggtggaggaacggctgccggaaatgccaaaagaaaatccggagtttgaaggaaagaaaccggaattgtatcttgtgactgttcgtggaacgaaatacccgtttcgtgcattttggaacggatcagattttacagacggatggacaagatgtaatgttacagcctggtgcccacttccagagccataccgaccggaaaggaatgatggttgcagtagttgcaaccatctttatggtattatcaatttggtatggtatctgttaatgtagctgaaatttagtcaagaatcattaagattatgcaataaagaaaatatatctcttcgagagatatattttcaaattatataaaagaatcattttttgggagtatcccaagatttgtgtaaaccttcaaactgatgtaagatagacttaccagtttggaggtttattttatggcgccataaaataaacctccaaactggtaagtctatcttacatcagtttgaaggtttacacaaatcttgggatactcccgaatgcgtatatcttaatttccttgctaccgtgcgtgtatcccgttataaaaccacttgtcctcttagaggctcaatattatacttccggggactttccagaattgactgcttactactccttaagtcctgtggccttgatctctggaaaagttttttacaggatttagctagtaggtcgcatatcctgtttagtgggaaaatgggaggactggactcgaaccagtatcttctgcacatagttacatccggctttcagtgctctgccaatttagctacctccccaattatccaccccaaccatagaccgcctgtaaacagacagcgtaattgtaagcggaaacatatttgcacacgccctcatacaaggtgacacgccggtatggtatttagtgacgtgtgcggtacttgctacttgatgcacccttttcacaagcattttcttttccggcatatttattccaactcttcatgccaacgctatgcaatggcatatgagaccaacttcatactacacaagaaagatgaaagcctcgttcaaagcgattataactccaacgatcccacacacaattgcggttgccgtatctttcttctttgcccgtattaccgaataaacagcaattccaaagaaaatcatcatcaaaattacatcaaatgtaatcaaaactccttttaacatttccataatgctgatcctccttaacaattacttcttgcaagccatgtataacgtgttgctctccacacttctcgcttatcatatccaagattctccatacatttcacaaatttatatctgcgacatataggatatttgcatgtgccgtgaatagtctcaagcgcaagccgaatatcatccaaaacatctgttatcacttgcaccgcaaacttgaagtctttcacaaccatgtctatcagctcaggaaaagtgtatctgaaaaagtgacgaacctttttcgctacattcttgaactgaatcactgatatgccgcatttacggatttcctgtgcctgttcctcagttaatgtcatgtacatttctattcctccccggctattctccgaacaatcttttctgccagttcattcgtccatatctcaacatttgctggtatttctttaagtgccgtctggacacttaccacaaacgccttgtagaaatctttgtgtttttgcagttcctcggaaacgatcaggcaggcatcggataaattctctggtgaaaaatcgaaagtgaccatcccaaatgtctcaatatctggcctacccaccactttaaacttaaactccggaacttcatcaactgaagcatggaaatctgctgatataaccatcggaatctccacattgttcacaaagcaccttgtcttatcaattttgacactctttccagcttttattaattcttcttcatcactaattatcctcactttgttcatctcatcacgctcccggataaaatcctattcccatttgcctgtaaaaatctttttctaattgacgcttcaactcttccaaatcaatcgtaattgttgcgtccttgtcaatcttaatatcccggtaattatgttttaccgccattggctgaaccatttccgcagcacttggtattgcggccgacatagcaaagtttggttctatgtatccttttgcttccagacgtttcctagaacactttgaaacgaatggacattttcgacatttttcggacagtctagttatgctcgtcatcgtcttctccttcccagtcttcgcatgtatgaccatattcgacaaaatcagccacatactcgctatctccattcacgcaaacatagccctgcatctcattgtagatgccatatttacatgtcccataacattttccactcatcacaattcctccaactgcctttgtaatcgttcaatctcacaatcatagaactgcaaaatcgcatctgttagtccattatgaaacccttcatgcctaccgcaacagtcaatctcggatttacatggagcaacagtcatatacataactcctcgacttatatgatatttatccaactttaatctatcgatgcaactctgaatgtcagagtatttcttaaccttttcttttgcttccttaaactgttcttctgtcataagatcctctcctctgatgtggcctttttattttttatgtggttgacccactcacctaacccctccggggcttcgcccctcagacccccaccccggagcgatccactttctaaaaatgcgctctgatcctgagtgattgatgtatcgattcagagtttagcggataaataaatatttgtccgaataacttcgatctatatattgtgtcctatcgtttacgcatacaatatattgttgttttaatgttcctggcgtctatatgagtttaattatcaatcactttaatcaattatctgtctctttagcctctgggaacttcgggatctgccgttgatccgcttgatctatgccatatttgcgggccatatctggtattgatggggctgtctgcctctgttcctgccctcttggctgtcccatattccacccataatgcctgtttaagatgcccaatataccaactggatttccctttccagacactaaacggacgcttaaagactcctccctttctgcgttcaactttttcgctacctcggacgaaccacgctcaaccgtaccctcatttaaccattcataaatagtatctacactaatccctgtcagtttactaaaacccatgatagacacttctttactgtattcataacagagattaatatatatatcgcagatattatttaataactccttgttactgtaatctatattagatttaccattatatctataattagggttattatctggtgtaggtttaaatacctgtttatatacatacagtaaaacactattccatctactctgatctattttatataaatcctcagttttaagattgtgatctatacaataattagatatagattcctctatgctgtcgctatatacctccagtttattcgctgttgtatccatcgtctgtatatctgtattttgcatctatcacacctcgctttcttctggatctggaataaaaaaagaggccctgcatcactgcaagacctcccgagtccattctcacaccgccgggaattgggcggatttaatcgtattaatttattttatctgttaatcacaacaatacaccgctatatatagatttgtcaatacttttttaccatatttggtattatatatagtgctagacataaaaatccccggattgctccggggttattttttatgccgcttttgtgtaatcgatgattgaaatttcctgcattacttttttagctgtatcaataatcttttcgagtcgttccacaacatcaccagtataaaaaatttcatcacattcagaacatttatagcaaggcacatttcgaacgataacaaggcaattccctaaatcagttacacttgttgttgtgcttttctccattcccgcaccacatttaaaacatttcatattaacgcccctttctggtcttataatccggttcccattgttccaaattaggataatacgccgttattaaatgtataaaactattatccatactaaccactatatgcaaatatctattgtttatagatatgcctaatatcaaacaactagggaatggtttatcatcttcatattgctttattatttcccctgtttctatacattttataacgtcctgcattgttatatttctttcaatcagcctaattcttgcgtgttctgttactgctatattttccggcttgtttatctttcttaattcgtcaatgtcaatcacttctcaccctcctttctccctttcggggtattgtcctctgttcccttgggacaattatataatatcactattttttgtgattttcaataaagttttcactgatttttgagatatatttttctctatcctcgtccgtttctacatattttaatatatcccgcggctgcatttccagaacggcgcaaaggcggttcagattgtctaatgatatagtagtatcattttcccggaattttttcattgtcgcttgcccaaaaatccctgtatttttcgccgttgtggtcgttatccctacattttttaattcttttatcacatctattttatattgtagcatccgttttccccctgtctgatttctatatattatatagtaacatttgtgcagaaaaagtcaataaaattttctcaaatatttgtgattttagcattgacattcactaatattagtgatatgataatatcaacaaaggaaaacaaaaagccgattccgcaaagcctaccaagcaaccacggaaccggcaccaatcaaaaaaatgaaaggatgcctttattatagcagggcaaaaggtaaaaaacaatgtctgaaatgtatattacaacaattgaaaacgtcgatccggagcgacacagaagccctattatcattcatgatggctggcaatggtattttgcagaatttagcaattgggaacaactagaaagattccttgactttgcagggctggaaattgaactggaagaagaaaatcaatggttttttaatccgaagtgcggaacatggagaaaatacagagtaaacaggaaattagataatccatgcgacggcgggttctggagtctttcagaaatcccagaaagtgcaaagaaaatcaagggtcattcaaacggcagcatagttgattgttatatcctgaacgatggcgaaacattgcatatatacagaccaaacccaaatgctaaagaggtatataaaccattaccattagacgaacacataaaatatatacgagaacacgggggattttaagccgaaacgcccttccgagggcgtccgggaaagatggcaacttttccgctgacgatggcaagccaaacaaccaaatagagaggcgataacacaatgaaaaaagattatacaaaaacaatgaactacgcagtagttagcatgatcgacaggattacgcaagatgacaagaaaagcaagatccggattttcgggctcttcccaaatccgacagttgcagaagattctttcttgccgtatctacctaatcaggagataaagcggtatcttcttcgagtagaggatctggaaagattcgaggaattttataactttatccaagatctgaatgagaagcacggagaaaaagctatctttcatcttgcagatgggaacttttccacggacgaggaaaaccgcttccgtcagattctgaacatctggacagatacaaaaattgcatagccgaaacggccagaaatggccgtcagccgtgggatgatctcccggctctgaagatggcagatcagaaagaatatttcccagcccccagggaaaaagggagaaaggtacgtcatgtcgctatatacacaaataccaacagataaggaccgcagaatctttgcgcagacgctggaagcgtataaggctgctttaagtggatcaccggagacgcaaaaagaaattataacataggcagggtaacacctgcctttttcggattgcttaccaagctattgacgattcgcagttttaatgctattctttgtgtgtaacacgatttgagccacttttactgcatacattaacagacatagaccgatctatataaatagcctagaatcgtcccacggagcgtcacagcggtatcatacgagattaaatgatatataggaattgtcagaaaaaggacgtcggaatgaataattgttccagcgtccagatttttgcccttttcaaaatagggtgtgatctttttttcgaaaagttttcctgggaatctgaaaaaagtgatctaaaaagacgcgattttcacatcaaaaaacatgccttttaaaattatttaatcaactttttcttatggattcccttcttcttaaaccattcttccgtatcatcttcttccaagtcattaacttctacgcaacaaccgcacttttcacattgaactccttatcggctatagtcgtttattgtatatcctgttgttgctttacccccgcaaaacgcacacgtttttaattctttgtttaatgggtttttttcactctccatactccaatctctgaccactttctaatgtatttaacattaacatgatgtgttttacaatattcggctgatgatgatatggttgactctcttttaaaaaaagtatagtataaaatatattacgatgtcttaaaggaatgagaattatgaaaaaattatcttttattttcttatctttctttttgctgttatttaccagttcatgtcagcctaaagaagtagatattaccggaagctggtattgtgctgaaaataatgtattgttgacattttacgaggatcagtcctttgaccggaaactagtcggttttaatagtttttatgatgggacatacaaatggacgattgatagtgataatatgttaaagctctctaatttaacaggagaaacccttgagaccttaaattggaatatggacaacaatacacactccacctggcatatgcaggctgatcttgtcatcggaggacatgtatacaataatacaaacggagaagaaataactgaagatgatatcagccccgaatttcttgaaaataataccaattattgttgcactgcctttttcaaagatacttctggcgaagatatagaagtaaagatacagaatttgtatgacacacttgcctccagagcagaagtgaaagatattaagtacatttcttctgacgatgcttgggaagaatttcaaaacgattattttgcgggaaatgaggatgcggcagaagggtttgcggatgataatccgcttatcaactcgaaacatttggagatttatacacataatcaagatgaattagacattattgttgattatctgcaaaatattgattttgtaggaaacgtgaatgtatcctcgaaaaccataaaaaatggagaccgtttcaagttttgtgtaaactcgaaaaaactgatataagatatgtcattagttactccgggcagagctgatagacagaaatcacctttggtatctgggatgaaaaccagagacctgctatggagcagatggtagaagcttatgaaaaagagcatgatgatgtaactatcaaaatccagttgacgccatacaaagattactttacaaaactggaaacttctgcaactggaggaaaggctcctgacgtattctgggtaaatgtacttcaccttgatgcatatgtagagggcggtatccttgcggatctgacagacgcagtagcggattccgatattccggacagttattccgaaactttacttaacaactatgtacgtgatggcaagaactatggtgtaccgaaagatttcgatacaaacgcattatggtacaacaaggaaatgttcgacgaagctgatgttgcttacccgacagacgatatgtcctacgatgatctggtagctcttgcgacagaactgaaagacaaacttccggatggcgtatatccgtttgcctgtccggtagatttccagacatggtactatcagactgtatatgcaaatgacggatggatcttaaatgaagacgcaacagagaccggatacacagatgaaaagacaatggcaggtatccagtgctggatcgatatgatcaacgcaggattatctccaagttcctccgcacttgctgaaacaactccggatgcaatgtttgaaggcgagcagattgcgatgaatttcgctggttcctatatggtcccggaatatgcagccaatgatacaatcaaagataagattgactgtgtagagatcccgacattcaatggcaaagaagataatgttatcaatggtcttgcatattgtgtatttgaaggttctaagaacaaagacgcagctacagattttgcgatttggcttggaagctctgaagctcaggaaatccagggcaaaacaggtgtggttatttccgccagaacagatgttcagcactgcttcgcagaagcaaacgacaaatacaatctggcagcttatacgaatcatgcagatgaagcttatccacttccggtttgcaacaaagcagccgaactgtatgatttagaggcacagtatatcaaacaggcttatgatggaacgatgaccctgaaagaggcatgcacacagttaaaacaagaagctgatgcattactcgcagaataagtgtaggtgataataaaaatgtctgaaaagaaagcagtaacgaaaggctctaaaaagggcctttcgtggaagaagaaggactggattgcggcctatatttttatcgcgccagttacaataggtcttctggtattttatatctggccatttatccagaacgtatggtttagctttaacgatgtaaacaagtttaatgtagcgacgtttaacggaattgaaaattataaacaattggtaagcgataaagaagtctgggcatcgctcggaacaaccttgaaatatgttgtatttaccgtcccagttggattatttctttccattttgatcgcttcgcttttgaatgcgaagatcaaagggaaatccatttatcgaacattatatttcctgccttctgtaacgatggcggcagccgtagcgatggtatggaaatggatatacaatgagcagatgggtattcttaacagtggaattcgcgcagttggcggcgaaggtcatggatggctgacggatccgcatacagcgctgttctgcattatgttagtcggactatggatgaaggtcggctatgatatgattatccttttggcgggtatgcagggcatttccaatacatattatgaagcggcggcacttgatggagccggaccgattcagcaatttttcaagatcacaattccaatgctgacgccaacgattttctttgtaatgattacaggaattatcagtggtttccaggtattcgatgttatctttatgatgattggaaaaacaaatcctgcgtacgagagtaccaaaacggttgttatgttgttctaccgaaccgcattcgattatggttataagggatatgcagcggcaatctccattctgatttttgcagccattatgttagtgaccgctgttcagatgtggggtcagaagaaatgggttaattacgattaaggaggaaagataagatgagaggtaaagcaaaattaaatcatctgattgtgcatctgatccttctggcaggtacaataatcgttgtattcccattcctctggatgattttaacatcctttaagacaaatggagaagcactgcagattccaccgactattatcccgacagcatgggtaacagatgcatattcagaaattgtaacagcaattccgttcgctactgtttatatgaacacgattatttccgcagtagtaacaacggccgtacaggttgctttttgtgcaatggcagcttatgcttttgcaagaattgagtttccatttaaaaacatcattttcctgattattctttcagtgctgatggtgccaggacagatcttcctgattccgcagtatttgattgttcagaaattgggattgctcgataccttgccggcgttgatgcttccaaacctgtttagtgcgtttggtacgttccttttgaggcagttctttatgtctcttccgaaggaattagaggaagcagccgtattagacggatgcagtcgtttccagatttttggaaagatcatgctcccactggtaaaaccaggtatcgtggctcttgtaatttttacggcaaaatttgcatggaatgactttatgtggccaatgattgtcaatacgtccacagataagatgatccttggaccagctcttgcaaccttgcagggtcagtatacaacggagtatccgatgcagatggccggagcggttatggcggtaattccgctggtagtactgttcttcatctttcagaagcaattcattgagggtgtcgcacagtctggtattaaaggataaaatagcgcatttagggcatggttttataatgccgattcctaaacactaacatacaagaaagagacaatcctacgaaattcgggctttccccaaacctgatttttcgattggatcgtctctttctttttataatcctttagaacaaaaagtttcaggggaaggtgtgaccgaactgagtcacgccttcccctgtttaggactgttcatatctcgacagccttttcattttaaacaactacattttcaagtttagcccttgataccggactgtgcaacaccttcgatgaactgtctctggaaaataataaaaacaattacaagtgggagtactgccataaccgctccggccatttgaaccggatagtttgtcagatactgtcctttcaaaagtgacaatgccggagcaagcgtcatcttctgagaatctgtgttgacaattaacggccacatgaagtcattccacgcaaaccttgccgtgaagatcacaagcgccacgatacctggttttaccagtgggagcatgatctttccgaaaatctggaaacggttacatccatctaataaagccgcctcttcaagttcttttggtaaagacataaagaactgtctcagcaggaatgtaccaaacgcactgaataagtttggcaggaacagacccggcaacgtatttaccagtcccaggttctgaataatcaaatactgtggaatcaggaaaatctgtcccggtaccattaagattgcgagtaatacaataaagattgcattcttaaatggaaattcaattcttgcaaatccataagctgccattgtacagaacgccacctggaacaataccgtcaatactgtaatgataatcgtattcacataaatctgagcaaacggaagcacctcaaacacgtacttataggaatcccagataattttttccggcagaatcgtcggaggaatctgcatagattccggcaatgtcttaaatgatgtaaatatcatccataggaatgggaatacagtaaccgcaataccagcaatgagcacaatatgtatcagcagattttttctgttttttgttgttttcacgatttttctccccctctcctaatcataatttacccattttttctgtccccacaactgaattgcggtaataatcataatgattacgaacatgaaaatagaaattgccgccgcataccctttatatccatacgtgaacgcattttgatagaacaatacgtttgtagttttcacagcgttaaatgcagggttcttgtcaatatctatcatcatatagagtgtatcgaacacctggaatgctccgataagccctgtgattgttacgaaaaagatcgtcggagacacaagcgggatcgtaatcttgaaaaacttctgtaccggtcctgccccatcaatctcagccgcttcatagtaagaattggataccccctgcattcctgccagaagaataatcatattatatccggcaccactccagatacctaccatcataacacagaaaagtgctgtgctcggatctgtgagccatctttttccttctactccaaaaaattcaagtaccgtatttaagataccgtaatctccgttgaagatcaatttccatacaagggcaaccgctgccgccattgtgatagacggcaggaaatagattgtcctgtaaattcctttccctttgattttggaattcaaaagcgtagccagaagtaaggatataaacaatccaatcggaactgtgataaccgcatacaaaattgtattttttaaggctagcattaaatccggttcctcaaagagctttttgtagttgtccaggccacaaaaagttgccatattaaacttatttacgtcgttaaagctgaaccagaagttttggatgaacggccacacgtaaaatattaacaacccgattgttaccggagcaatgaagatataagctgcaatccagtcctttttctgacggcgtgacgcttttttctttatcgcttttgttttttctttgctcatacaataccgcccctattattttgcgttcatttcttcaagaagcttgttctgttcctctgcaacagacttacaagcgtcctcaagtttaacttcgcctttccatgcaggctcaaggtatttcttttctacctgtccaagctgggaagtaatcttgcagtgtggaagtaattccgcgtttgctacattgtcaaggaagatctggcagtttaagccttcatgtgcgtctacaaagtactgctgacagtcatttctcgcggaaatacatacgcctgcttctccgttaatcttctgagcttcttcacttccaagccataatgcaaaatcagttgcttcttccggatgttttgtgtttgctgatacagagaacgcaaggccgttgatgatatccgtatcttttccgttgtatgtcggtctcttagcgattccgtatttgccttccaatgtcttgtcataggaagcaatcatatagttaccggataagtacattgcaagctgtccgccctggaacattgcatccggatctgtgtctgccatctggtcaagtgtcggtgaaagtccttctgatacaagatcaagccaggactgaactgcttcgattgtcttcggatcatcccatcctgatttttcatttccttcgcttaagaaatatccaccgtttgcaaatacagaagcatcatatgttgtctgtccagagtttctgtttacagccgtcgggtatgttccttccggaagccctgcatttttcagctcttcacattttgctttgaaatcttcaaatgtcatattgtctgacgggtattccactcccgctttatcaaagatttccttgttgtagaatactgcgtttgtatcaaagtcctttggaataccataaagctttccatctactgtgtatccttctaccagcggagccgggaagttttcatttactttcaggtcagattccttttccgcatctgttaaatcaagcagaattcctgcgtcagcatattcttccacatgaagaacgttcattgtgatgatgtccggtgcgcttccgcctgttgcagatgcctcaagctttgtccagtactcagaccatgtagtaagctgagttgtaacatgcacattcgggtgttccttgttgtaggcttcagccattttttccataaccggctgctgatctgaatcccacacactcattaccagttccacttttccgtctttgcataatacttcctcttttctctgtaagatgattatatcttattagccacttctgttacaactttattatagcacttcatctattcttaatggatgctgaatactgttccgtcttctccagttttgccttcttgcagacatccttccagtaacttctttcttcatttagttcaatatccgtagcatattcctgtaatgtatccacccatgccttataggaatgtgttttactggcgaatgacagttcctcacctttgcttcgtttgaggtagccataagtgaaatcctccagaataattctccatgaaaaaccatccgtaagcagatggtgcattgtaataaggagatggtcaccttccttggtatgaaagcagccaagacgaataagcggtccatttacaatatctaaatgagcttgcaaagcattgacctgctccataatctgcttccttgccaattcttcgtcttgctcaaggaaatcatattcattcaatttataaaatgaatccatattttcaggtggcaatataatctgctcgacagtaccatcttccagtcgatatctagctcttaacatgtcatgatggtggattatcccatttagcacttctttgacaattgatatgtcaaacctatctttacgatagagaaaaagtgactggttgtagtgtgagtaatggaaacctttgctttcgaagaaatgtttctgaatcggtgacaatgataccgctcctgtaaaagtttcctggctaatcacatcattcgattctttcataacactctccagttgtgcaatggtaggatatgtatagatgtcctttacggtaaatttatattttaaaagaattgccagtaaacgaattgctttaatggagtcgcctcctaattcgaaaaaattgtcatgcctgcctatattggattttcctagtacctcttcccatgcccttgcaatctctatctccttttctgttactggtgcttcatatccatgcacttcctcttcctttgccaatgtagtttcctgcctgcgcatcctatctctcttctctttccactgggaaaagaactcttttgtcaatacatctatttctcctatctttaaatcataattagaaagaacctgagacatataggaattcatatcccttccaatctgtcttatcgtctgctctgcatagcgagaagagtcaaagattgtcttcatgcttatagttccattttctaacttaaatctaaaaatgcaacttgcaccactcatttcttcatatcctgtctcatgcaattcttccatttccactataacagggaacatcgcttcctctttatataagggaatattaagtttcttaaaaacatagtagagtggaaacatctgatttacaaacgctttattcacaatctgcttgccattcactaggtattgcttaaaagtataattattgtccactttctgacagtatgccagcatatcattcatcagggtattcgaagcattttccttcaggattggcatccccatcaacacagtctcttcacctgtatacctactaagaagataggatactcccgtgcaaaaaaagactaacaggcctaagggagaattattgcaaagcttaactgctttacttgatacctcttccccaaagacatattctacttcagaatctgtcttgatattttttcttgcgtcgttatctgtaggcagaatcgaagcttccttacattctttcaaattctccatccagtattcatattctttctggtgtttattacttgatataataacattctttgtataccgattgacacgattcaacgacatcacctcttattcaatatcaaaatcattaagtaccatgtcttgattgcttgccattgcctggtcaagaatcttaagatatctatttagcagtttacgaatagtctcttccttaaatagttccttactgtagataaaacatacattcaaatgtttttcatctgaattaaatatattaacctgcaaatcaaaccgtccatttatcgctatgtaatcatgataaggctttacttttaacgcaccaaggtctaaatcagtataatctacattctgcataataaacaaggtattgattaaggatttttccatctgattatactttgatcttagtttctgtgtcaacacatcaaatggatattcctgattttcatacgcgccaaagaaaatctcctttatctggtttaaaaaatcatagaatgatgtctgctcatttggatggcttcgtatcgttaaagtattgacgaacattccaatcatttcattgacttcctttttcgttcttccctgactggtagcccctgtaacaacatcattcgtaccgagccacttccatagtaagatatggaatgcggaaagcattagcatatttaacgtaattccatgacctttgcagaattcaatcagtctatccctgtaatcatcagaaaactcataatcatttgttttttctgtatactttaacacaccattttttggatagtctaacgctaactccatggttggaattccgtcttcaaattgatttagccaatattcctcttgctgctgtcctatttccgattccataaactgctgataccaatttacatagtcctcatactgataaggaacatctggcaactgtttattattgtataattcctgaaactccttcataagtatgacaattgattttctgtcagaaataatatggtgcatatcaagcaacagcacatgccttgtctcggaatatgaaaccagctttgccctaaataatggtgccttgtcaagctggaatggacgcaggaatttttgaatagtttcttccatagtatcctgtccaccatctgcatattctacagaaaatgcggtctcttcattcactctttgcatatactctccatgatataggtgaaaggaaatacggagtgcgtgatgtctttgtatgatggtacgaaaaatactgtctagcttctctttatctaccttcccttccaagtaaagaatacgaggaatgttgtatgcggtatcctgtttcataaactgatggatcagaatcatcttttgtgccggaagaagcgggtagtactctttaggggccaccttacagaattcaggcattgaatcctcttttcccttttgatcacttacatagcttaccagtttccgaatggaatctcgcttcaagtaatctgacagcccccatttaagatgataacgttctgtaatctggttaaatatatgtaagcaggactctgcaccttttagatgggtaaaatagttctcatcaatatccagattttcttctccaatctccttttccacaatagcacatagttctttaagttctttcagagatggtttcgattgttccttgttctggttaatctcccgttctaatagcttgttactttcttcactctccgttttcgtagataatgagtattcttctaatataatatgcccatccaccccatcttgagttaagatgtcgatcccacatttttgtaaagtactttcctctgtgtttcctgacatcaccttatcccccaatgaatgtacagcatttatcactcttaaaacatccattatacctgacactttactcttatcatctaccgtttctgtcagagagtaggcttgttctttcatttttccatatgcctggttgattgcttcgatttcacaaagcgtatagaaatgttcattacttctacaaacatcaatataagacagttcgtcgcctgctataccagccttcttccacacatcacaaataatcgatttatgctgatcaatatctggaaggtaaaactgcccctgctttccattgacgcaaagactcatggaacttaacttcgcataaataaaatctccatctttttcggcctcttctaacgattttaaaacgataacacaaatctcaccttttcctgaaagaattgcaacaattgcttgcgtaaataccttatgttctattccttgtacagcacagtatagtacaggatacgaagaagaatctgtaatatcgctctccaagtaaattcctttcaatctatagcgttctgcaattatctttgcatagtttacggaatttgctttctcatgatagcattcacaatcatacccggtaaagacacctgtcttgctttctgttcttccattttgcagattcacagtactaagtgcattgtttaccttcgtaagcaagctttcctgaatggatgctccactttctttttcaccatctaaatcagacattccgacgatggtaacttcactttttgactcagtcaatgtatgcatttcacgttcaacaaaaaattctgctgccttttccttgtccagttttccatctactacctgctttaataaatatctatttaattcactcatacatctcccccaatcggaacaacttgatatctatccttgaatttctagaaatcaaagtcaaaattatcactcacggtaacctcaatatcatctacatttgtgctcaaattaatgtctttcaattttatactgtcattttctgttattatcttcataatctgcagataatcagaaatcagtttctttattgttgcttcatcgaaataatcaactgcatattttacttttatttttgttctttctggaagtacggtgataaccattctaattttatgtgtttccactgttgttttatcttctttaaaagtgaataccacatccctgtcttcattgtcctcgtcttctatcatgaacattgtaaataccatatcgaacagataggattcttcatatgttttaccatttgtcagttcttttacgatttccccaattgtacattgctgattttcaatcccgtgaactagaacttcctttacttcactcatatattctgaaaatgatttttccgcagctggataacttcttatgccaacccctactgcaaatgttcctggcatctggctaagttccccggatattctaccatgcattggagttccaatcgtaacatcttctgtagcagcatatttcgaataaagaaccttcaatgcagtcatatatacaataaacagtgttgttttattcttcaaggcaacttggtttatggcatttaataattctctatctgtgatttcctcatctacgtcactacccttataaaccccactttcgttgatacccgattgggttattcttcctttgtttggctcaaaatccctaaagcattctatccaatacttcttcttgctctccaaatcaaggctttttctatacttttcctcccaacaggcataatctttatactgtaattcaggtaattccagtgtttctccaaaatagaatgccactatttcgcgaatcaaaatttgaacagaaagtccatctgacacaatatgatgtaaatctagtaaaagtttcgcatttgcactctcatttgtttcaaataatgttgcacggattaagacatcatttttcaaattaaatggctttatataatctgaaatctggtatgattcactcttcacgatgtttaaatgaacagcaacattctctttaataatctgaacgggcttatctcctacaatatcaaaatttgttctcagaatttcatatcgagatactaattggttcagtgctaattctagtcgctttggattgacttctcctgtgatgtcaattattgagagaccgtttcaagttttgtgtaaactcgaaaaaactgatataagatatgtcattagttactccgggcagagctgatctttggttatgccctcgacctattagtaacagtcagctccatgtgttgccacacttccacctctgccctatctacctcgtcgtcttcaaggggtcttaccgctttcgcatgggatatctcatcttgaggggggcttcacgcttagatgccttcagcgtttatcccttcccggcttggctactctgccatgcgcctggtgacgcaacagatccaccagcggccggtccatcccggtcctctcgtactaaggacagctcctctcaaatatcctacgcccacgccggatagggaccgaactgtctcacgacgttctgaacccagctcgcgtaccgctttaatgggcgaacagcccaacccttgggacctacttcagccccaggatgcgatgagccgacatcgaggtgccaaaccactccgtcgatgtgaactcttgggagtgataagcctgttatccccagggtagcttttatccgttgagcgatggcaatcccactttataccaccggatcactaagtcctactttcgtacctgctccacccgtcggtgtcgcagtcaagctcccttctgcctttgcactctccgaatggtttccgtccattctgagggaacctttgagcgcctccgataccctttcggaggcgaccgccccagtcaaactccccacctgacattgtcccacagccggatcacggctgctggttagaaacccaataccgcaagggtggtatcccaacaacggctccataaggactggcgtccttacttccttgcctcccacctatcctgtacatgcagtaccgaatcccagtatcaagctggagtaaagctccatggggtctttccgtcctggcgcaggtaaccagcatcttcactggtacttcaatttcaccgggtgcattgtcgagacagtgcccaaatcattacgcctttcgtgcgggtcggaacttacccgacaaggaatttcgctaccttaggaccgttatagttacggccgccgtttactggggcttaagttcaaagcttcgcgtttccgctaacctctccccttaaccttccagcaccgggcaggcgtcagcccatatacctcacctttcggtttcgcatagacctgtgtttttgctaaacagttgcttgggcctattctctgcggccatatctctatggcaccccttctcccgaagttacggggtcattttgccgagttccttaacaatgcttctcccgtcggccttaggattctctcctcatccacctgtgtcggtttacggtacgggtactctacaaacaatagcggcttttcttggcagccagctcacgcgcttcgctactatgctttcgctccgcatcacgtcttcggattgtgtgccgggttttcctaacacactcctaccccgcttgcaccggtctctccattcccggctcgcgctctctttctgcgtccccacaattctgttgtacagcagtacaggaatttctacctgttatccatcgactacgtctttcgacctcgccttaggccccgacttacccagggcagatcagctttaccctggaaaccttggatattcggccggaaggattcccaccttcctctcgctactcattccggcattctctcttccatacagtccacagctccttccggtactgcttcttcctgtatgcaatgctcctctaccgatctgctcttgcagatccctgagcttcggtggtgtgtttcagccccggacattttcggcgcaggacctctcgactagtgagctattacgcactctttcaatggatggctgcttctaagccaacatcctagttgtcttcgaaatcccacatccttttccacttaacacacactttgggaccttagctgcaggtctgggctctttcccttttgactgcccaacttatctcgtgcagtctgactcccgataagcatcagcatggcattcggagtttgatattcttcggtaagctttgacgccccctaggaaattcagtgctctacctccacctgactctatcgaggctagccctaaagctatttcgaggagaaccagctatctccgggttcgattggaatttctcccctatccacacctcatccccacccttttcaacggatgtgggttcggtcctccattgccttttacggcagcttcaacctggacatggatagatcacccggtttcgggtctgctccagctgactccccgccctattcagacttggtttcccttcggctccgggccttctagcccttaacctcgccagccagcgcaactcgccggaccgttctacaaaaagtacgcggtccctctttctatagaggttccacagcttgtaaacacagggtttcaggttctctttcactcccctcccggggtccttttcacctttccttcacagtactatgcgctatcggtcactaaggagtatttagccttacggggtggtccccgctccttcccacaaggttccacgtgtctcgtggtactctggatcctgccgctctcccttgactttcatgtacggggctttcaccctctctggccggctttcccaaaaccgttccattactctcaggagtcgcttccgcagtccgaaccccagtgtgctcgcacactggtttgggctcttcccatttcgctcgccgctactttggaaatcgatgtttctttcttctcctccggctacttagatgtttcagttcaccgggttcccctccatacgttatggattggcgtatggatacatgaggtcttctcatgtgggtttccccattcagaaatctccggatctttggatatttgctcctccccgaagcttttcgcagcttatcacgtctttcatcggctcttagtgccaaggcatccaccctgcgctctttccagcataaccagttttataaaaacgcgtgttacaaagacgggataacaaaaggctctgccttacgttatgttttctttgaccggcgtttttatccacatgcctagcgtgacatgtgctggtcgatagttctttttacttctttctcaataatgtgttcacattacctcggatgtcttgatatttctttgtgttcttatatgcggttttcaaggtacagtcttctatcttacggatctcaaaagatccgagtggagaatacgagattcgaactcgtgacctcctgcttgcaaggcaggcgctctcccaactgagctaatcccccttattgttcttatttgtgatgggcttaagtggactcgaaccaccgacctcacgcttatcaggcgtgcgctctaaccggctgagctataagcccacactatattggaaaacggctttcaccggtttcttctttttaaagttggcggccacctaccctcccacaccgtctccagtgcagtactctcggccgtcttgggcttaaccgtcgtgttcgggatgggtacgggtgtttccccaaaacgcgtcaccaccaactgcttctgagctcctcttcgggtctcccctcttcgatcgctcaacaatagacaacgtcccttacttcttcccttagaaaggaggtgatccagccgcaccttccgatacggctaccttgttacgacttcaccccagttatccgtcccgccttcgacagctccctcctcaaaggttgggtcactggcttcgggcgttactgactcccatggtgtgacgggcggtgtgtacaagacccgggaacgtattcaccgcggcatgctgatccgcgattactagcgattccagcttcatgtagtcgagttgcagactacaatccgaactgagacgttatttttgggattcgcttcaggtcaccctctcgcttccctttgtttacgccattgtagcacgtgtgtagccctggccataaggggcatgatgatttgacgtcatccccaccttcctccaggttctccctggcagtctctccagagtgcccaccttatatgctggctactgaagataagggttgcgctcgttgcgggacttaacccaacatctcacgacacgagctgacgacaaccatgcaccacctgtctcggatgccccgaagggacagcgacattactcgcccgtcatccggatgtcaagaccaggtaaggttcttcgcgttgcttcgaattaaaccacatgctccaccgcttgtgcgggtccccgtcaattcctttgagtttcattcttgcgaacgtactccccaggtggactacttattgcgtttgctgcggcaccgatgtgctttgcacaccgacacctagtagtcatcgtttacggcgtggactaccagggtatctaatcctgtttgctccccacgctttcgagcctcaacgtcagtcaccgtccagtaagccgccttcgccactggtgttcctcctaatatctacgcatttcaccgctacactaggaattccgcttacctctccggcactccagatctgcagtttccaaagcagtcccagggttgagccctgggttttcactccagacttgcctatccgtctacgctccctttacacccagtaaatccggataacgcttgcaccatacgtattaccgcggctgctggcacgtatttagccggtgcttcttactcaggtaccgtcatcttcttccctgctgatagaagtttacataccgaaatacttcttccttcacgcggcgtcgctgcatcagggtttcccccattgtgcaatattccccactgctgcctcccgtaggagtttgggccgtgtctcagtcccaatgtggccggtcaccctctcaggtcggctactgatcgtcggcttggtaggcctttaccccaccaactacctaatcagacgcgggtccatctcataccaccggagtttttcacactacaccatgcggtcctgtgcgcttatgcggtattagcagtcatttctaactgttatccccctgtatgaggcaggttgcccacgcgttactcacccgtccgccgctcagtcactgtcctcttcctccgaagattctgaaaacagcgcttcgctcgacttgcatgtgttaggcacgccgccagcgttcatcctgagccaggatcaaactctcgtaataagaacttgataatacttcctcttttctctgtaagatgattatatcttattagccacttctgttacaactttattatagcacttcagtctccttcctagaagtggaaaaacgctttgtgaactctgtcccattgtctgtctggacacattcaacaggcataggaaaacgttccaggaaatggcgcagaaataccgtggaagaataggtgctgtgttcttcaaaggcttccacataccgccagcgggaatattcatcaatagcggtatactgataaaaacatttgcctttggcttcattgaccaggcagcaggcgggaacgaactttacgtcaatctggactctctgtccggggtaggacatctgctcataaggtttagggatatacttgggattcggtagtttttgagcagttaatccctgttttttaaggagacggtaaagaccggggatagagcgtttatagccgcgctgcataagcttcacccagaagacgaccagatcgatatgaggattgcacctgcgcatatcttggatgagtttgatctcatcaggggtatagctggttcggatgggaatgtggacgtctggaacggtctctaaaagagtcccaggaaccgtcataacggttcttccatcggtaaacatactggcggttggtcttgtattttctggcagcgttggaaacgccgtggctttcggaatatgtaataagtgatagacgatatttcatattttgtgttatacttgacatgcgaggagactcctttgtttgtattttgggtttggcgattcaaatataatacaaaagagtctatcctcgctttttaaatattcagttgtaacacatgtattgtaatcctacagtttgtcatggcaagaaggttattaaatcttgacaaatatccgttaatcaagttataataaaaataattttatatttataaaaaattctaatgaaaatttgagaaaggaaatgggtggaaagatttaataatacggctcagttattgacatgactaaagaagtttttacgcagttaaataatattttgatagaatattgttccgaatcaatccacgatatgcttcatgtatatcgtgttttatcatttgttttagatattgcccagaatgaaaaagaaattgttgatatggatattttaattacagcaacacttttacatgatattgcacgtgaagaggaaagattagatccatctgtttgtcatgctaagcgaggtgctgagctttcagaaaaaattttaagtgaattttcatatacatctgtacaaatctctcatgttcaagaatgcatccgaacacatcgcttccgaggggtggagcgaccagaaagtattgaggctaaaatattatttgatgcagataaattagatgcgacgggatgcataggaattgcacgaacacttatgtataacggtattataggagagcctttgtattcttttgatatggattctttggcaatagattatgattctccttcatttattcgagaatacaattgtaaactttcaaaaattggtcaacaattatatacaaaacgggcgctggaattatggaaaatgcgaaatagtcatgcgcataagttttatgaagaattgctttttgaaatacaagagatatctgtgttaaaaaatttccgtgaaaaattggactaatgcaaaagaacatattggtaaaagaactgtatataaaatagactgccaatcattaaatggcagtgtgttttgcaaattgacaaaattttagggagtattccaaaatggatctgttgacaaattaaagagaaatggctttctgtatggtatacttattatatccattgcaggaggctattttcccaacaaactcactttttcagtgtttatttcgggagtatcccaaagtttgtgtaaaccttcaaactgatgtaagatagacttacaagtttggaggtttattttatggcgtatgacgggcatgccgtcagtctgtggtgaaagtccacaaggggcgtagttgccgacgaaccccatagcgactcccaaggtctacatcgtgaggtgcaagcgagaagaagggatagcgaaatcgtagcctgacgaacagaaatctgatataaggcacacatggcggataagctggcgcgagacagtgaagtccgaaaggcaaccgtaccccatgtgtgtaaatcaggcaggtagacgaggaaagattggcaggcttatcccgtgaggtctcacaggcggggaaataccgtagtaacaacgaactgtgagaagtcagcagaagccatagtaggtaaagccctgaaatgggagttgctgaagggctgaacaatgtaaccgtgtaatcaaatgtatgccccatggaatacctgacagcaggaagggcaaaacgtaaatgagcaggtactgcacaacttagggcgaatccatgggaacggaaaggagaaagcacacaaggcaatgtcagaactgttggaaaagatactgtccaaagacaatatgaacactgcatacaagagagtctgtgccaataaaggcgcaggaggagtagacggtgtatcagtcgaagaacttggcgatcatatcaaagagaattgggaaagtatcaggaatcagatcaggaacagggagtacaagccccagccagtcaagagggtggagatacctaagtcaaacggcggaatgagaaaactcggaatccctacggtaatggacagggtaatacaacaaggcatcgtacaggtgataagtccaatgtgtgagcctttgttttcagagtggagttatggtttcagaccgagcaagagctgtgaaatggcaatcaggcaactgctcgtatatctaaacgagggatatgaatggattgtggacatcgacttggagaaatttttcgataatgtaccgcaggacaagttgatgagtctggttcatgacattatcaacgatggcgatacagaatccttaatccgtaagtatctgaaagcaggagtcatgacaacgcaaggatatgaagaaacaaaacgcggaaccccgcagggaggaaatctgtcgccattgctgtcaaacatcatgttaaatgaattggataaagaactggaagcaagaggactgcggttcacaagatacgcagatgattgtgtgatagcggtcaaaagcgaatcgagtgcaaaaagagtcatggggacggtaccggactggatacagaggaaactggggttaaaggtcaacatgaccaagacccacatcacaagaccgatgaagctaaagtatctaggttttgggttctacaaaaacagcaagatgaaggaatggaagtgcagaccccatcaggaatctgtgaagaagttcaaagacagattgaaaggattgacctgtaggaaaatgccgggaacagtcacgagtaagattgagaaaatcaatcaggtgacaagagggtggattaactactatgcccttggctctatgaaaacagcaatgacagagatagacgcacatttaagaacaagattcagagtcatcatctggaaacagtggaaagtgcggaagaaacgccaatggggattgcagaagctgggaatcggaaaagacctagcaaggctgacggcgtattgtggagaccgctattactggatcgcgacaaagacatgcgttgccagggcaatctcaaaagacgtattaaccagagcagggcttataagctgtcttgactattacaatgagcgtcatgctttgaagttatgttgaaccgccgtatgccgaacggcatgtacggtggtgtgagaggggagagaaaatctcccctactcgatcggtcggtgagctgtactctgacttccgcatgatatcccggtttattgacaagctttacctggattccgtcgataacgtgtccatagattcctgcgtaatcattcggagtctttccggatgcgtccgtcacccaaggcagccacttgcctcccctcaggtgtacccggtactgtaaatttccagctgcggactgggagccaactgtatacgctttcagtccggtgaccgccctgcacggaatccctgcgtagccgtcggaactgacattattatagtttgtcacccacggcagccattgcccattcacatatgcctgataccggacattgattccggatgcggacacagatcctccagtggacggagcagacggcttgccggatgtactggaacttcccgtatccggcggcagatctttgtccccggctaccatgctcttgaaagagctccatgttaccgggtcgtcgttcagtacaaacggattcggacagtatttcccgaccacatcatagtgccgaaccacacgggacaggggaacattgtacttcttcatcagcccctgcaccagcttcactgtgctgttgatcgtggcgttttcaaagtaccagtccttggacgtatcactccggctcccggacgtccttacacacatctcaatattgatgctgttgtagttggtgcatttcccatagacgcttcctccctttgtgcctgggtatttgttgccgcctaccgaccaggccgccagactgtcagacacactctgccagacctctccggagtacccgacaaaatagtgggcggacgccccacggtatccagttgaaaaataggtcgcattgtttgcggcacttcccggagccccggtataatgcactacgatgtacttgatcccgttcccgtaccggctggacgcattgatggtctgaagcttctggttgatcggcaatccgttgatggacgccgcctccgcccggatcggcggcaccacgaccattgtcccaaaaattagggtacagaaaaggacggctgccaacgcaaccgcccttcctcgtttcagtaatttattcttcttcgtccgcatctgcttcatcccccttgtgctggaatctccagaacagatctgccacataggtccagccttttgttgccaccagcgccaggacaaatccgatcacgatcatggcaatgacaaagtaccatgtcaccgggaagcccgtcatatccacataggcaaagtaccccaccagggtaaacgccacagacagcaccagaacctgtaaatcggtcgggatgctgcgcagtcccggcagtccttttgtcacctgggtaatcacaacggtcaggaaacagatgacccctgccacaaaaatcaggagattgagattctccatcaccattttaaaaatatccaactgcatcgcttctaccataaatcactcctccttttatttacttttttccaacttatcaattctgtgatgtgctgatttaacggactgctccacagccgtgatccggcttccatgttcaacgatttcctccctcagtctgtcaacattttttgatgtttcccgtacatcagaggcaatattatccagctttgtactgattttagtattcagttccgctcgtttcactgcatcatctatatctgtttttttgctgtttttattgctgtaatatactgatgccaaaaatcccaacagcgatattaaagcctgcaaataaaaagtcaaggctaaattgaaagaactttgaaaattttatacaggttgcaaaagggtatcaaaataagaccaccacattgtgctggtctatcagaaagatatgtataaattattctgattgaggaagtgatgcaagatattctttcactcgcccatagtagattctcaaaaatttattagctccggcagtcatgtaaacgtagtaaggcttaccttgggaacgtttcttgtctaaaaactgatatacaggatcgtcctgtggcattgttttgataagaacatccattacaagaaacagtgttttccgtaaatcagcagagccacgttttgatgtaggcacacttttctgtgagaaggctccggattcattcacaccagggtcaacaccagcaaatgctgtaatagcacctttgtgagtaaagcgagtaacatctccgatttccgcaataagctgtggaccaagagatggaccgacgccgttcattgccataacaatggggtattcaggaagctttgaggctgtatcattcatcaaggtgcgcagttcctcaacagtagaggaagcgctgttgagttgatcaactgcttgtctgataattcgtttggttatttcatccttgggaagtacaggaacaagttccttcgcttttccatagatttcttcagcttttgatttgctgaagttgtacttcttgcgtttgcaccagctctcatagcggtcagtaaaggcgtttaaagacattttacgaacacagtccacatgccagtatgtagatgcaaaatcaacccatttctggctgccgtcacttcgtgcaggactgtcgaagtaagtatttacgccaggataagtctgatcaaggatgccaataaggttatttttcatagcagttttgtgcttcatatagaaaccaaactgacggttcatggttttaagttgattgcgtaattcatccataagactatactgtttcagattcagccacttgtcaagagcatagcgagcaatcttcactgcatctgctttgtcggatttgactttacgaagagaatcattatcaaagtctttgattagtttgggattgattgtgctgacgaaaatgtccgcctcggaaagctgatgagcaaggacttcgtaataacgtccagtatgctccatcacgacacgggattcgccattaacggaatggatgagatcaacaagagaattaatatcatgggatgtgtgcttgatttcaaaaggactgtaaacaatctcgccgaaagggcgtaaaattgccaccatgcttttaccttttgaaacatcgatacctactgcgttcataaattagtcactccttaagatttattgcaatggataagaaccagttttactcattgcctattcaatctactgtggtgtgacacgaacgtacctattggcagttcaacctgcataaaacgaacgctgcgaatgaggagctggttatcagtcttcgttgcggacgcgaagtccaagaaaggtagatgatataccgattgctccatcattatacagcttaagcaacaagatggataaatctttactggctgtaagggatattaaccatatttatattgtagtagaaaggagagaccgtttcaagttttgtgtaaactcgaaaaaactgatataagatatgtcattagttactccgggcagagctgattttttgacgctctgcccttgcttttattataatgcagtttccggacatgtcaagcagagctggctcggccagccctgcttgaccagaaacggcttataatcaagataatcgttcctcaaaaaatatttccagctgcgaatggatctgtccccagtcctgccggtgacctgtccattttttcgtgatatccatcatggccagatacagcattttcaggagactctcatccgaagggaatacggtcttagatttcgtgaccttccgcaactgccggttaaatccctcaatggcattcgtggtatagattaagcgacggaccgcttccggatacttgaaatacgttgaaagattcgcccagttatctttccatgattttgcgattttgggatatttcccgctccatttctcatcaaagctatccagttcagccagtgcgatttcttctgttggagctgcatatacacgcttcagatcagccatcagcggtttgagttccttgtaggaaacaaactttgtcgtattccggatctgatggatgatacactgctggatctccgtatccgggaaaatagcttcgatcgcctggggaaaaccggtcagaccgtctacgcatgcgatcaggatatcttccacgccgcggttcttcaggccgttcaggatggaaagccagaactttgcactctcgttttgaccgacatacatgccgagcacgtctttgtgcccttccatgtcgatccctatggcgatataaaccgcacgttttacaatccggccttcgttgcggacatggtaatgaatggcatccataaaaacaaccgcatagatttcttctaaaggcctttcctgccattcttttacgatgggaaggatcttatcggtgatcctgctgatggtactgtcagaaatttcgatatcgtacagttcccgcatatggctttcaatatcattcgtggtcattcccttggcatacatggagatcattttttcctccatgtcctgcgtaatcgtattctgatattttttgatgatctgtggttcaaactcacctttccggtctcttgggatatcaatctccatatcgccatagctggtatgcatggtcttctgggaatggccgtttctggaattatccgtttctttgttccgataatcatacttggaatatcccagttcctcatccatttcctgatccagggcaccttccagaatgatggacatcatatcccgcataatggagttgacatcagttccatccttgatctttacattgttccctttcagatagttacccatcattttccgaagggctgctttttgtggggtatcttttttccttgccataaaataaacctccaaactggtaagtctatcttacatcagtttgaaggtttacacaaatcttgggatactccctttgtgtaaacgaaaaaaactgatataagatatgtcattagttactttgggcaggaccaattttttgaggttctgcccttgattgtattataatgcagtttccagacatgtcaagcagggccggcttatccagccctctcaaacaggaagctgtttataatccggatagtctttcttcaaagaaaatctccagctgcgaatggatctgcccccaatcctgtcggtggcctgtccatttttttgtgatatccatcatggccagatacagcatttttaagagactatcatcagaagggaacacggtcttggatttcgtaaccttccggagctggcggttaaatccctcaatggcattggtggtataaatcaaacggcggactgcttccggatacttgaaatacgttgaaagattcgcccagttatccttccacgattttgcgattttaggatatttcccgctccatttttcaccaaagctatccagttctgctaatgcgatctcttctgttggggccgcatatacacgtttcagatcagccatcaggggcttgatctccttataggaaacgaatttcgttgtgttccggatctgatggatgatgcattgctggatttctgtctgtgggaatattgcctcaattgcctgcggaaagcctgtcaggccgtctacgcatgcgatcaggatatcttctacgccacgattctttaatccgttcaaaatggaaagccagaactttgcactttcattttgcccaacatacatgccgagcacgtctttatgcccttccatgtcgattcctatagcgatataaaccgcacgtttaacaatcctgccttcattgcgaacatggtagtggatggcatccataaaaacgactgcatagatttcctccaaaggccgttcctgccattcttttacaatgggaaggatcttatctgtgatcctactgatggtgctgtcagaaatctcgatgtcgtagagttcccgcatgtggctttcgatatcattcgtggtcattcccttggcatacatggagatgatcttttcttccatatcctgagtgacggtattctgatactttttgacgatctgcggttcaaactcacctttccggtctcttgggatatcgatctccatatcgccgtaactggtatgcatggtcttctgggaatggccgtttctagaattatccgtttccttgttccgataatcatacttggaatatcccagttcctcatccatttcctgatccagggcgccttccaggatgatggacatcatatcccgcataatggaattgacatccgtcccatcttggacctttacattgtttcctttcagatagttgttcatcatttcccgaagggctgctttttgtggggtatcctttttccttgccataaaataaacctccaaacttgtaagtctatcttacatcagtttgaaggtttacacaaactttgggatactccctgttgtggtcaagcatttttgtaacacttatggctaataaaatcggtggattgcagtttggaatctatcggaactgtcagatttcatcaagggtgtttcacaccgctgtcgcagctttgcccttgacaaaagctaaccgttccgattttgagtaatcaagcaatctgctcgggcagcccttttttatcctgcggttcgtgcctgatatggcgtacggtaaccgttggagctatgcgggcgtacatgattgtagtggacataggaaaattcctccactgcttggtagagttcttcctctgttttgaactcatacagatttgtgcattcattcttcagtgtattgaagtaacgctccatcggtgcattgtcatagggataacctgctttgctcatactctgcgtcacattcactgacttgcaaaaatcagtaaatgccttagatgtatactgtgagccctgatcggaatgcaggatcaattctcctttgatagctggctgagaatccaatgctttctgtagagtgcggatggcaagatcactggtgatgtgccgatccgttatgctggcaatgacacttctatcatgaagatcaataatgctgcaattgtatctcacatcatggttcttcaaaaataagtatgtgaaatctgtgcaccatttttgattgattttatccgacataaaattctgctgaagtttgttttcaaacaccttgtgtggttttccctgttcataatctgttttttggggacgaacgatggatctcagtcccaactccgcattcatgtacttatgtatggttgcagggctgtagtgatatcccttacgtgccagatagactgtcatgctcctgtaaccatcgacaccattgtgttcatgatagatttcatgaatctgtgcctggacttctgttttatgggcgtgataatccgccttccggtgtttccggtagttatagtaagcgttcggataaattttcagccgtctaagcagccagcggataccgaatgtctcatgatattggtcaataaatcgataagcctctaatcgatttcctttgcgaagaatgccgctgctttttttaagaagagattctccttttttgcttcttccaattccttacggagacggaggttttctttcataagttccagatcattaggagcatctggattctgctgggcttttgtatggcattcttcgctaaattcagcacaccatttggagatactggcttttgatacaccatactctgcagtgatgcttttgtaagtacgtccctcttcgatatgaaggcgaacgattttctttttaaattcaggtgtgtaactttgtgacataatacttcctcttttctctgtaagatgattatatcttattagccacttctgttacaactttattatagcacttcaggtgtggtataaaaaaagttgacagcttattctcaaggatttcataataaaaccaagagaataaggaggtattcaaagtggcacgcaaatatgaccatgaatacaaagtacaggcagtaaaacttgccaaagaaatcggcggcgctaaggctgctaaagaattaggaatccctgaaggaaccatccatacatggctgaaagccgtaagggccggtaagttagatatcggggaaggttcccatacccctgccagtgcaatgagcctgtcagaagagattactatgctgcgtaagcgggttaaggagcaggataaagaaatccgtcgcttgaaggaagaaaacgaatttctggaggaagccagcgcttttttcgcctccagccgtcggaagtcagcaaaaaccagagaatgatctttctggctttgaaaacagaggacggcaggattaccgggaaaatctcattttattgccggatgcttggtgtcagccggcaaggtttctacaaatatctcgcgaataaagaccgtccctggaagtaccaggacttggcggatgccatgaatgaaatcgtcaatgaggacgaatgtaacgatacttacggacggatccggatgtatcaggcactgttgttgaaacagccggagggagtacatattcccagtgagaggactgtataccgggttatggatcagaccggcctgagccatcggccaaagagaacgccaaatgggattacaaaggcggatcgagaagccatgaaatcggatgatctgctgaagcgggatttccattccgatgccccattgaaaaagtgtattacagatatcacggagattccggcatccaatgggaaactgtatgtatccgcaatttttgactgctttgatcttagcgttctcggattggcaatggaaacaaacatgaaagcagatctttgtatccatacactggaaagcgccctgactgcttatcccgcgctggaaggcgctgtcatccacagtgaccgtgggacacagtataccagcgaggcttaccgtcagactatccgggaacatcacatccatcaaagcatgaacagtgccggagggcgctgccatgataatgcacgctgcgagagcatgtgggccaggatgaagacagaacttctttacgaccgctatgacacaaagcagatgacggtagaggaactaaaggtactcatttggagatacttcctaagctactggaacaaccggaggatctgctctgccaatggtgggcttcctcccatgataaaacgcaggcagtattatgagactttggaattggcggcatagttagtgatatccttgaggaaaatgtgtcaactaattcttcttcatagataatcccggctttagtaattctaccatttttaatatactaagactccatttccggataatattttgattctgcgcttcctgtttatccaacgttgtgtttgcatcctcacggaaggtcacgtccaaatgccaatgcatactctctatgctccaatgtccccttactcccatcccaaaagtctctatttccagtggcaggctgctgatgtagtaacggtattctttcctctcccctttttcatcctttattgtctttttctccattccgatactcttcacccctctccattctttcttctgggacagccatttgatgtcatccgtttggtaatattcccttccttccaattgcccgtgtgctttttctctcgtacataggtaattcttcttttcacggatttcacgctccacttcgggatcgctaaaatacagctttacatcttcataaagccctggctggttttctttttgcgcaagcacatagtccgcacgtttttttgtattttttccgcaatggctttctggacatcccctgcatcaatcgttataatctgtccttttatctggatgttgtccaacaattccggtatcgccgtgatctcattacttttttcatcaaccgctttctgtcccaggcagaatccatccttcctgctccatgcggatataatatgggatgcctttccatccttacttttgttggaacatatcgtctttccatctatacagatgagtttcctcagtgcctgcccctcattcctgtttaaaagctcctgccatttcccataaagctgctgcacaatctccggggagaccaggcccatgacccggttaatcgtattgtgagaaggaatcccattttttagttcgatatatttacgcagatagccctgtattcctttccaaacatttccatttctatccagtcatctgcattggccagggttgcgaacaacacaagtaccagaatgtctttcagtttatgccgcactttacgcgtctgatgtacatcctctatatattccaaccactcaagtaattcttccatgatacctaatcccctttttcttttatcat

SEQ ID NO: 31 - DNA, 2799102 bp, Clostridium sp. (residues 1-1,399,551 of 2,799,102)
aaaggcattgtatgataatctatatccttcaagaatcattgtaggaacagatatgaatgatgaaagacttgtagaagcagcacatacatttgcatcactcctacaagaaggagcatcaaagaagatatcgatacattgtttatgggatttacagaagcagaagcagtcaaactgttcgctaatacatatctagcacttagagtatcttatttcaatgaattagatacctatgcagaattaaaaggattggatacacaacaaatcatcaatggagtgtgtttagatccaagaataggatcacattacaataatccatcatttggatatggaggatattgtttaccaaaagatacaaaacagttattagctaattatgctgatgttccacaaaacttaatagaagcaatcgtagaaagtaatagaacaagaaaagattttattgctgatcaggtattagaaaaagcaaactattatggatatgatgataataacactttcaataaggaaaaagaaaatgaagtaattgttggagtatatagattaacaatgaaatcaaatagcgataacttcagacagtcatcaatccaaggagtcatgaaaagaatcaaagctaaaggagctaaggttattgtctatgaaccaacattagaagatggaacaacattctttggaagtgaagtagtcaatgacttaaataaatttaaagaaacaagtcaagcaatcatagcgaaccgctatgatagttgtctagatgatgtagaagataaagtatatacaagagatttatttagaagagattaaaagtttgttcttccttgaataatgctaaaaggaaataatttgttatgaagagtagcactagagtgttgctctttctttttatattataatgtaatcggttacaaaactataaaactacattaaaaatagggaggattttatggaattattatatatctggattggtgataatccaattgatacattacaacaagaattttgttttacacctgaatatgatattcattttgataatttaaacaatgagttgtttattgaaaagaaaaatatacctaatatttttaaaacagacaaaatattaaatattagtggtgtagttggtgaaaatgggacagggaaaactacattgttaaataaactagggggcatatctgatattaaattaaaatcacaaaaatcaaaagtaaaaaaagaatttattgctgttttttatgatgatgattttgttatttttaattcaacaaatcagaaaataaaagttgaaggagaggtgacagattatttaataaactattcaagttctaaaatagatgtcaatttagatcaactatccaaagtttaccttacaaatagtaatttttctggagaaaattattatctaaagttaggagaaattgactatattaatttatcaagtaaaacatttgaaatttttgaaaaagattttttttcttataaaggttcattgaatgaccaacgtggggtgaataatacaaagtttgatgttatgcaaagtatatttcctaattttatgggtaatcgttttcgaagtttgattgatattgattttttagtgtatgtaaaaggtttaaaagataaatttattggtaaagatatttcaaatattcaattcaaaatagataagattgatgattttattagtagtgatttaaaagatttaaactattatactaagaagtatcacgaaaaagatgtgaaagaatttgaaaagaaatttataaaactacttacaaatataaattcaaataatgatataacatcttctttaattatgaatctagcgggagaattaatttactgttatcctaattttaatgaacatattggggaatactatacaattgatgaattgtatgaaaaatgcaaaggatttattaaagaatatccatttacagatagtaaagataataaagaaaaggcatattttcaaaatgcaataaaagagataaatataataaaaagaaataactttgaaaaaaatggaaattgttatacagaaaatataaaaacattttggaacttcattaaaaattttatttctaatgaaacttccttcctattaaaatatattcatatattagacgagtacacttcatctggtgaaagagcaatccttaattttatgtcacgtatatattttttatcaaaaattagtaaatattttaaagataaaaactataagttaagggaaaatattttattattaattgacgagatagatctttatctacatccggcttggcagcaaaaaataataacgacattaataaatgaattaaatgaatgctttccagataacgtattccaaattgttttttcaacgcattcaccaattgttttatccgatatgcctacacaaaattgtgtttttttaaagaagggtcatacaggaataataatgaaaaaagcggttaaacaaacatttggatgtaatatttttaatttgtataaagatgcttttttcttagaaaatggaaatacttttggtgaatactcaaggacttttataaataatatagctaaagaaattaaaactggaaagtttgatgataaagaaaacattaatcgcttgattgatctcattggtgagcctattattcaaaatcatttaagaaaattaattaatgaacctaaaaaaataaattagattctagtcaaaatgaagaaatgattcgttttttagaaaaacaaaaaagagaaatcgaaaataaaataaatgaattaaagaatcaataatattgaaaaggttgtgaaaaaagatgattaaaatatcaaagatatgcgataaaaacaaaaatgaattttatgatgacgtaaaagaatcatatttaaaactattaaacaaaataaagaagaatgagaaaaaaatatataatattgaaaatagaaataaaataattgattacttttatgaggatgataagatatgtgaaaataaagtaatagaagtaattactggagatcataaagctctagaaaaagttataaaagaaattggtgttttagaaaaaaacaaagatgataaaaaattacatgatgaatttgaaagtatatataataattttacgaatagagagtttggaaggacttggggtaagaaaataggtgttgaaatatgtccttattgtaatagaagttttatttatacaacacccaagaagggaacatggccacaatatgatcattactatcctaaatctaaatatccatatttagccctatcaatgtataatcttattccatgttgtcctgtgtgcaataacgctaaaaatgcggaagatacttttgataataagagtttattatatcccttcgaagaggaatatggatatgatattttttttgaaattgaaacagatgagcagttatgttatttaggattatctaatgattttaatataaaaattaaatcaaaggagaatgtagaagaagatttaaaacaaaaagtacaaaatagttcaaaaatactgcatatagaagaattgtataatttacataatgattatgtatcaaagcttttaagaagcaagtatatttttacagatgaatattgtcaatctttattagatacttatccaggctggttttttgatatgaatgaggttaaaaatcaattatattttaattctttgcaaaaggaagaatggggagatcaaattctttcaaaattaacttatgatattttaaatagtgaataatttcatgcatttcataaaacataatcaataattttaaaattagtaggattgatagttcgttttgcaagaaataatcttattattaatatataatagatgccatgaggaattcattaaaaaatacaagaaaggatgcttatctatgaaatattcaaatgaaacgagtctaataggaaaagcagctaatagtttagatattaaaggtgctattataggaaaaaccttagactttataatacagtttattaataataaggtaaatgaaaaaaaatggaaaaatttatttttagaaactggagaacaagtagttaaaaatcttgatgatcaagatgggtttaaaaatgatttactagttatattttctaaagataatatgcaaaatatagctgaaaaaagttatgacaaaagaggatatgaattaatttcttatttagaaaatgaaattgttgaattatttattgaatacggagtatcggaaagaaatgcacatgaatatagttaccatttcattcaaattatattagatgaattaaaacaatatgatactgataaagccttggaatcttatttagaaatttggagaaaacaatcagtacaaaactatttttctctaaaaaaacaattagatgcaattgaaattgaagtaaaaaaacttggtaaagataatatacatgttttatcaatagaagatattgaatctgatattaaaaaaagtagttcttttgaaaaattaagtttagatttttttgaaattgatgatgaacaatttgaaatggattttgaagatcaattagataatgaaaaaattatcatagttggaaaatcaaaagaggaaagtttgtatcgcattttaaattatttaaaaagattttctaaagatagaatgattttaattgtgaaagacgaaaaatcttggttaagtcttattgagaatgatataagaaatgcaatccttgtaccttattttaatagtgaagaaatactagtgaaaaaagataatacaaatatcttcatttataatgaaggagatattttctatgaaactaatgaattacatcttagaaaaagaaccattcataacttacttagcgctttagaaaaaataggattagatcacgaagatgctagaaatcttgtaaataatacaagtggcatctatgcatttatgagaaaacatttatttaatcgtgtcagtaattttaagccgcaatgggtggaaaatagatcgaaagcagtaattgcggctttactatgtggatcatggacggaatgtgaaggagataaagaaattatttctaaacttgcggaaaaagagtacgacgatgttattcaagaacttaattcttattcaacagttgaaaaaccatttgttattaaaattgataaccatggatcaatacgttatatgatttcctcaattgaagatgcatggatggaattggatgcattgatttttcctgaaagttggaaacaatatatttctttgttaaaagaggtttttgaagaattggagccaatttttaagaaagattttaatgaacattatttagtgaatgttataaaagaaaagcctaaatgttcaaaagtattaaaagatggaatgttgcgaacattgattatgaaagtaatttataagaataatcaaaattatcaatatcaagttgataatatagttaaagcaatattagaaaacataagaggaatagaacaatgggcatgtatttctcaatattttataccactatgtgaggcatcaccaaattcatgtttggatagaatagaatctgaatttgttaaaccaacaggattaaaagaattatttgaaaagaattcaggagatatatttaaaagtaataattactatgtaaatatcatatttggtttagaacagttagttcatataagaaaatatgtttctagaacaataaattgtttttttagaatgaatgaatttgaaatagattacaaaatgggaaatagtcctaaaaatacattagaagtcattttttgtccatggtttaattcatgctccttaaattcaaatgaaaaaattaaacaagctcaaagtttaattgaaaaatataagacagcatggaatgttttagcaagtcagttacctgagtcgcatgctatggcgtcttctttattgcaacctaaatatagaattgttgatgaatctgaagaaattacttacggtgatttagataatgtatatattgaatacttaaatttatgtacgcaatatgctggtatggataaaaaacgttggaaaactctgattgagcatctagatagatattcaattgatcttcaaaaagatttttttaataaattgattaagaagacacaatcaatgtgtgacaatgataaagagtatttgaaaacaaaaatacgttatattgtttatagacatagattttataatcagagcgattgggcaatggaagaagataaacttatgatttatgaaaatacaataagtgctatttcttttaataatcctatttttgattatagatatttatttataaagcataatatgcctcttctgcatccaattccatataaaggtgatgattatagaaataaaaatcaacaattaaaaaatcaattgattgatgataaaataaatgaatttatcaaaaaagattattcaattgaggatttaatagatatcttagtaggtgatgatgactatgatattggaacagtttttgcacaatattattgtaaatgtaaatataataaagaaattttgaatcttttaataagcaaagattctcaaggaaagcaaactagatcatttatagaaactttttactgtaacaaagcaattgacttaagaagtgttattaatgatttaaaagaaatgacagataatacagaattaatatccgatatattttcattacaaagagtaaatggaaatgaggatgcttacattttcacggaagatgaacaggtaaagagtattttttggaaaagagaaagatgtttctttatatttgaaaatgctagtaaagaggtaattgaaaaagcattagccgaatgtttaaagtattcaaataaggaaaactatattttatttttagatgatatgaaagattacttttctttacaagaactatatgattatttcatcaaaatttccaatttgaaatatgaaggtcattactctgttatggattatccgttgcaagaattgttagaactattacaaaaagaatttattaatgatgatgaaaaatgtagtgaaattgcaaaaatagaatggatattcagtggtattttagactgggatgcaatgaaatgtattcaaaaagaaataaaaagaaatcctattttttatgctgatttaatttgttgtattttcaaagataaagatggaaataaaaaaatgggtattgatgaaaatgtacgaagtagtttaactagttgcttttataaaatgaaattttgcccttcagaaaaaaatggaaatgttgattatgaagagctttgtaagtggttagaggattttaaacatttattaaaagatcaaaatcaggaatatcttcatgagagactagttggttcattatttgcaaatgctccagtaggcaacgatggatatccaccacatgaaagtgtaagaaaaattattgaaaaatataatagtaatgatttaaataagtcatttattattgcagagtctaataaaagaggagtatattcacctgatgctggaaaatctgaaaaagaaatagcaaataaatattataaattttctaaagcattagaaattgattatccaataacagcagatatattctatgaattaggtaaatcttatgatgaagaatctttacaacaaaggatggctgccgaaaatgaataaaaaaaataaaatttatgagggagcaagatacaaatttgttataaagaaagaaataggttcgggtggcaatggaaaagtatatgatgtagatataataggacatccaaaattggattttgttgcaaagtttttttctgcagataaaagaaatctaaaaaagtgtaataagagatttgaacgttttaaaaaggaaatagaatatgcaaataagcttactgacattgaggggattatgttaattgaggattgtaatttatcttcaatggataattcttggtatttaatgaaaaaggccagggagtataaggttaatactagaaaaaaactcaatgagaagttagatgatataatgaaaattgctttagttataaaacaattgcattcccgagatatggaacatagagatattaaaccagataatattcttattttaaataacagagtatatttaacagattttggattaatattttgtgataacgatattgataatttgacagatttaaatgaaagaataggtccgggtaaaatcgcgccaccagaatttagtaatttgggagcgtttagttatattgattttaaagcttcggatgtttacttatttgctaaggtaatttggatgattttgaaagaagaaccgtttggcttttatggaccttataaatatggagaagattcaaaacagttgttacttgatgaaaaaaatattctgttgaaacatttatcccaataaataaattaattcatgaagcaacctatgatgattttacgaaaagaatcaatattgatgattgtataggttacattgaattacaacaaaaacttatttctaataatttaaatgacgatgaaaaagtaattattaataatttaaaaaatgaagagcttttaataaaatttaaagaagataaatgttcaaaacatataatatcaaataaagaatttatagccgagtttttacaaaaaaatcaatttccttcaaaaataaaaatttgtggaacaattagtgatgacaaagaagaagtaaaagaaaaagaattcttattagaaatttcaagagtgagaataaatcacaactattgtcaaggttattattttataaataaaagaaaaatatatgagtgtcattttattgtaaatgaaataattcttaatgaaaaaaaaacagcaatttgaattccaattaatagaagatgaaagattatggaaatataataatattattgaagcaagaggcaatattgttggaaaatattacgtaccctcaaataaaaaaatagtaattgattattgattaaaatttcaatggtcagcaggtacttcgaatagcctatttgtttagctgaattaaaatatatgagtagaaaaaaggtttaatttttaattatttatgtgtataatgatactatcatagaaataaaagggaaatgaattatggaaaatataaagaaaattatatcttggcctgtaatattaggaatacaggtcattacaacagtagtattattattttttatttttaagcttaatattttaccaacaacatatgctgttatggttgggatgatatttgttttattaggttttattaattatgcattaatgagacctaataaaaaagaacatcatcataaaacaaaaccaagagagattgttggtaaagtaataagtttattattaagtgttttaatgatctttggatcagtaatgatcaataaaggttattcaacattagatgatattacgaattctaatacgaaatctgcacattatgcaattgttgtattaaaaagtagtaaaataaatagtttatctgaattacaaaatgaatcgattgaatattgtttacaatatgataaagaaaaagatatgaatcaagttattgctgaagctaaaaagaaagaatcaagcttgaattttgatgttgctatgacatattcaaaactaggggatgatctttataataataccgttaatgctatattaattaatacagcatataatggtatgtttgaagaaaatcatccagattttcaaaatgaagttaaagaaatatggacaagtgatatagaaacaaaagtcaaagacttttcaacaagagtttctgtaacaaatacaccatttattatttatatcagtggtattgatacatatggaagtattacaacagtatctagatcagatgttaatatgatcgttactgttaatccaaatacaaagaagatcttattaacatctattccaagagattactacgtaactcttgcgaatatgcaaaaaaaggataagttaacccattcaggtattgctggtcctgaaaatacggttaaaacaatggctaagtttttaggaacagatatcaactactatgcaagggttaactttacatcattggttacaatggttgatgcattgggtggtattactgttaatgttgatcgagattttagtgcgggtggttatacctataaattaggtcttcaacaaatgaatggtgaagaagcattagcttattcaagggaaagatattcatttgctgatggagataatgtacgtgtaaaacatcaacaagatgttttaatgactatgcttaataaaatgatgtcacctgcagttattactaattatagtagtgttttaaaagctatatcaggatgttttgaaacaaatatggcatctagtgatattacagatttaataaaaatgcaaataaatgataatgcttcatggacatttaaacaaaaacaatttactggaacaggagttatgcaaacaggtggagcttacatgcctgatagcaaactttattatatgattccaaatgatgatagtgttaaagaaaatctacaagcaattaaagatgtcttaaatgggaaatagttattctagttgctaaaagtgatcgttgagtaataatagataacattgattatatagcgctctaaataatcgcgtgttttagaaaaatcactttaaattattaaggggatattgatgtgaaatcaatatcccctctaaaatatctaatgttttttaggaggaaaattaggctgatgattagtcttgattttcctcctttatttttattgttatcgtgatttttctactctagttttcctatatacttgatcaactaccactttccattagatttagataagctaaaaatcataactatgaaatattcaatatagatcaaattaaaaagtgaatttatattcattagtaaacatctctaaaatagtttataatatgtaaagaaagggtgatagaaatgaagaaaataccaataggaacgaaaagtttttcaagacttgtagaaggaaattattattttgtagataagaccttgatgatcaaagagttcttagatagaggaacagatgtaacattgattactcgtcctagaagatttggaaaaaccatcaatatgtcaatgatggcagaattctttgatattaccaaatactctaaagaaatctttaaaggtacaaaaatcatggaaacaccttatgtagctgaaatcaatcaatatccaacaatctttatctcttttgcgaatgccaaaagagataaagaaacagttgttccaacgataagaacacaaatacaaaatcaatgggataaatatgattttgtatttgaaaatcttaagggatttaagaaaacaaattatgaaagacttatgaagtattagctgataataacaagaataatcttaagggaatagatgatgcaatttcattcttgatggaaataatggaagattattatggaaaagaagttatggtattcatagatgaatatgatacaccatttgtagaagcacatacaggagggttctatgatgaagtaagaggaggacttgcaggattgcttcataattctcttaaaacatcaaccagcttaaaatatgcgatgcttacaggaattcaaagagtggctaaagaaaatattttcagtgatttaaataatttagatgtgtatacagtaattgataatgattatagtgaatattttggattcagtatagaagaaaccaaagaattacttgaatattatgatttagaattaaatgatgaagtcaaagaaatgtatgatggctataaaatgggagataaagaaatctataatccatggtctattttaaattatgcaagaagaaaagtacttgttccttattgggtcaatacgagtgctaatacaatgcttaaacaagctatataaaaagtagactaggactttaaaaaacaatatgaaaaacttataaagaataactatctagaaacaagagttgtccttcaaacaagcttttatgaagtggcaaatacacctaacttatgggggatgtttgtaagtgctggatatttaacagtagtaaaagcaattgattcaaaaaaagaaaagtttagaattgcgataccaaattatgaggtaagaagataatttataagattaacggaacatcaactaggaatgaacaatggataatatgatcgcattgttgacaatttgattgctgaaaacaaaaatgattttttcaaaaattatcaaaatgtattaatgattccaagctatcatgatttaaataatgaaaacagttatcatatgatgatgttaggaatgtgtttatgtctatcagataactataaagttatttataatcgagaagaaggtaaaggaagatgtgatctcattatccaggttcatgatgaaaagaaaacatcgtttattattgaatttaagtatttcaaagaagataaaaaagattttgaaaaagcattggataaattatcaaatgaagccatccaacaaatcaaagatagaagatatgattatgatttaaaaggaaaagtgatttatataggcttagcccatcatggtaaagatgtcatgatgaaatgggaagaaaaggtttatatttgatgtttgttattataataaaaaaatcaacgactgttgattttgataatggtgctggagatgggatttgaacccacagcctactggttacgagtcagttgctctaccgttggagctactccagcatagaaatagaagcaaagcttctattttttttcaacttttgtttcacaataaagacaacgataaatacgtttatctttatttgctaaatagaaaacatgatctaatccttgttctacagatgtaatacaacgaggatttttacatttttctacattaatgattttttgaggaagttgcaattttttcttttcaacaagtttaccatctttaataatacaaacagtaatattaggatctaaatatcctaaaacatcaaaatctaatgcaaattcttcatctatttttaaaatatctttcttacccattttattagatttaacgtttttaataatagcaacgctacaatctaatttatctaatcctagtgctttataaacttctaaagatttaccagcggtaatatggtctaaaacaatcccgtttttaatactatctatcttcattatctttctacctcattttccaatcctaacatttttaaaataagtgccatacgcataaaacgtccgttttgaacttgatcaaaatacttagctcttggatcatcatcaacctcaatagcaatttcattaacacgaggtaatgggtgcataacgattaaatcagattttgatttttctaatttctttaaatctaaaatatatgtatcttttaaacgaatatagtcttgttcattgaagaatctttctttttgcacacgtgtcatataaagaatatctaactcttcaacaacttcttcaatcgtttcaacttctttataatctaaattcttagcatctaataaatcatgttttaaatattcaggaattttaagttcaggtggtgcaataaacacgaatttaatatttttataacgtgacattgcttttgtaagagaatgaactgtacgtccgaattttaaatccccacaaaatccaattgttagattatctaatctacctttttctctataaatagtaagtaaatcagttaaagtttgcgttggatggttatgaccaccatctccagcattgattaaaggtactgtactttttcttgtagcaacaagaggtgctccttcttttggatgacgcattgcaataatatcacaatagcttgaaacaacactaatagtatcactaacactttcacctttagaagcgcttgtattgcttgcacttgaaaaacctaaaacacttccaccaagtgataacatagctgattcaaaagaaagtcttgtacgtgtacttggttcaaaaaagagtgtagctagaattttgtgacgacaaacatcttgatagcgtgtacgatctttaataatatcattcgcaatatcaattagttcatcaatttcttctacacttaaatccattgggtcaattaaatatttcataatagtctccttttttttcttcaatattatagcactccttagaaagctattaaatatattttaaaaaaatacggaaattttctttccgtattattttttaccattaaaacaataagtacagatcttatcactatcaagtccaatagcttgaagcatatcatccaaacgattaaaacgtaaagaagtaaaattaagttctttacggatttcttctaccattgcattatattcaggagtatctggatcactatatgtttctaacatattgatatcattttctccttcacgttttttaataacacgacgtgtaattaaatccatatcacttgtacttcttgaaaagtttaagtaaggacatccatacataattggaggacaagcaggtctgatatggactgctcttgctccagaattatataaatattcagttgtatctcttagttgtgttccacgaacaattgaatcatcaattaataataatgattttcctttaatcaagctcgcaattggaattaatttcatttttgcaattaaattacgatctgcttgaatttgtggcataaatgaacgtggccacgtaggtgtgtatttaataaaaggtcttccatattgaatatgtgattcatttgaataaccaatcgcatgggcaattccactatcaggaacacctgctacaagatcaatatctttaatatcatctctttgagccattaaacgaccacattcataacgcatttcttcaacattacgtccctcataacaacttgttggataaccatagtatacccataaaaatgaacaaattttcattttatcattggcttctacaagtgttttcacttcttcactggtcataaaacaaacttcaccaggtcctaattctttatataaagaatagcctaaattgatataagcatgactttcaaacgaagcacagaatccattttcacccttaccaatatttaatggagttcttcctaatttatcacgtactaaatacaaaccatcttttgtcatcaacataaaagaaatagaaccttttacttttcttaaaacattgataattccatcaacataagtatccttttgattaatcattgcagcaattaattcagtttgattgacttcgcccccagacatctctaaaaaatgagtatgcccattatcaaaagcatcttgaattaattcttccatatttgcaactctacctacagaaacaattgcataactacctaaacgacaatttattaaaagaggttgaggttcattgtctgaaatacaaccaatccccatttttccagacatttctttaatatcattttcaaacttagttctaaatggtgaatttgaaatattatgaattgcacggttaaaaccgttttctccataaactgcaatcccacctttttttgttcctaaatgagaatgataatcaataccaaaaaacaaatcagtgacacagtctttacgactgacaacgccaaacataccacccatatgtaattttctcctttttcatttgttctcaaaataccaaaaatatgataacataaaacaaaatgaagataaaggacataaaaaaatgaaattatatatagtaagacatggtcaaacagattataaccttgataataaagtttgtggcatttcggatgttgaattaacatctttaggaaagcaacaagctaaaatggccagtgaacaattaaaagatatttcattagatatgatttttgcttcaccacttcaaagagcacatgaaactgcaaaaatcataaatgaaaatcatcaattagaaattaaaatagattctagaattcaagaaatcaattttggcaaatttgaaggaattgttaataatgaagaatttcaatattataaacaaaatcatggactccattatccaggcggagaatctttatttcaagtagtccatcgtgtgtatagttttttagaagaacttgaaaataaatatcctgataaaaacattttagttgtttgtcatggaggtatcgtgcgtgtcattcatagttattttcatgatatgacaaatgaagaattaatgacatggttacccgaaaattgttgtattcaaagctatgaaaaatagtgactttgtattgactgaaaagtggaaagtgttatactaattataggaaaaaaggaaaaggagagttaaatatgaacgtagataaagatacttgcatcggatgtggagcatgtgctggtgtttgtccagtagaagctttagcttttgatgatgatggtaaaatggaatgtgacaaagatacatgcattggttgtcaagcatgtgttggaacttgtccagtagaagctatttcaccagctgaataataatgatgaagaagatagaaatatcttctttttatttttgctttatatgataaaataacggtggaggttttttatgaagacaacaatacatacattaaaaaatgaatataaagataatcaaacttatttaaatgaaaaacaaaaactttttcaaaatttaacttatcatatgatagaaaaagaactaaataataacaatattgatattcgatataaagaagttcttgatttttatcatcaatgttttaatacagatgaaacaattgcacattttgatgaaaaatatgatcaacaattagatcaattaggcgaaaaaaatgaagtatttgatgatgatgcccttgtttattatattgttaaagtaattgaacattttgaagatattcatcaagtagctgataaaaactatatagcgaatgatttattagaacttattcaaaaagatcatgattatttagatttgttaaataaaacaaaaaatattataaaaagacttattaaaatgaatcatgaaaaaaatcaagatttacaaaatacttttaatccttatggaatagatttagaacaattctttacacgtgtatttcaagatcttgcttatgttgaagttgattctaagttattaaaagaaatctatgatctaattaaagaattacaaaaagaatatggactttctttaagatatacggaaatacgtatggatttattaagtacacttattaaagatgatccagattgtttagatcaagaaatgaaaaatatttgtaaagagtatccgcaatttagatttatgctttattataaagtgatgactactttacaacaaataggaaataatgatttgttgaaaaaatattatcaagaaattaatacttgtataccaatgaatgaggaacaaaaggacttgttagaagttattaaagaaatttttggataaggagtatgaatatgaaaaaagatttatatttaatgagacatggacaaaccttatttaatgtaagaagaaaaatacaaggatggtgtgattcaccacttacagaacttggtaagcaacaagctttaaaggctaaagaaaatttgaagggtatttctttcgatcattattatagtagtacttctgaaagatgttgtgatacgattgaacttattattggtgatcaatattataaaagattaaaaggtttaaaagaaagaaactttggaatgtttgaaggagaaagtgaagatttaaaccctaattttgatgattttggttatgatgatttatttccacattatggtggagaaagaaaagaagatgtacaaaaaagattaaaagaaacacttacagatgtgatggataaagaagatcatcaaacagttcttgctctttcacatgctggtgcttgtatgtgttttctatccactgttattgatcctgaagaaatattaaaaagtggaggctttactaattgttgtatattacattttacatttgaaaatgatacttttaagtttgttgaaattattcgaccataataaaaaatattgataaaaagtagactttttaaatcaaaagaggtaaaataaatgtgaggaaaatagtagaggttggctacttcatataaacttactttccacttgtcataatataaaaagagaaccaaccaagaagaaacagggtgacctgttttttcttttaggaggagttatggttatttattttgatttagacgatacactttatcgtttatatgatcctttttataaagcttatcaaaaagtatttcatgaagatcttgatatatatgctttatggaaacaaagtagaatctatagtaatgaaatttacccaaaatatttaaataaattaatcacaaaagacgaattatctatttatcgtttaaagaatgcttttaaagattttcatcaattcattacaaatcaacaagcacttgattttcaaaaagtctatgaagatcaacaagcacatttaacattatcttctacaatgaaagaactttttaactacctaaaagaaaagaatatttcttatggtattattactaatggaaaagaaaaaacacaaatgaataaaattaattcattatttccaatcattgattttcctattataatttcagaaaaagtaggttatcaaaaaccacaaaaagaaatctttgaattaattcaaggaaatgatagttactatgtaggagatggttatgaaatagatatgatgggagcttatcaagcaggagtaaagacgatttggtataatcatcaaaaacaagaaaaggatacttcttttattgattttgttgtttatagtgatgaagaattattagaggtggttaagaagttaaataatgattgacacaggaaacaatgtcaagtagaataagcataaatacagtgagtagacatagtaacaaatgattaaaatatagagagtctttggttggtggaaaaagatttggcgtcatttgtgaatacagctatgagtagaatgttgaattgagtaggcatctccggtgatcaccgttacatgatgagagtatgattgtacttgatgaggcttaaagggtgacctttaggtgaaaaaaggtggtaccacgggaatagagctcgtcctttataggatgagtttttttgtttataaaggaggaaaaagaaaatgattattgtattaaaacaagaagctaaaactgaagatgtgacaagaattgaaaaaactattgaagaaaaaggactacaagttcatgtttcaaaaggagaaaatcaaacaataatgggactcattggagatacaacaaaagtagatccagaatcgattgaagttgatccagctgtagggtttacagtaatgacgacagatagtaaacaacctcttttaataacaacaatggtcgaagatgttaaagatagaggtggcagtggttatgttgttgaacatacaaaaacacctttaggtttatatctttctaagtaggtaaaaactatgaagaataagatagttttaagttatcgattcattatactagtttattatttattggcttttttgattattattatgaatattaatcatttagaaagggtattaatctattctttgattttaatcgttttgtttggtattgtgatgagtatttatataatgagtattcctaagttattattgaaaagtgaatatatagaaaagaatttatctacagtaaaagaagcgatcgataaaattcataataagtctattaatgacagtttaataacaatatatatttttcttttagaaatttctaattataaagaagaatatcaaaactttgtagaacaaaatagtaaaagaatttttgatgaaaagcaaaataaacattggtatactataaaattacagtattattataatttgaataaaaaagatgaatatttaaaactatatgatcctcaattggataataaagttaaaaacccactttttaaaattatgtatctcattttaaatgaagaatatgaagaagctcttgaattatcaaagaaggttacaagtcaacaaaaagacataggatatgttatgaggctatattatagaattatttgtttagaacatttagaaaaagaaaatgaattgaatgattgtattaatgagatggtagaattcaatgatcaaatacattatgttaaagaaattaaagataagtataaaaaataataatatggtatacttcttttcgtaactttatttagaaagaagtgaaatatgaatgttaataaagatagtagatgatgatcaagtttttgtaaaaaagataaaagatattgtttatgataattttaaagatatctttcttgattattcgatagaatgtataacgagtaattttgaagctcagtattttgaaaaaggggatattttctttttagatattgatttaaaagaaaaaaatggcataaaaattgctgaagaaattagagaaaataattctaatgcaatcattatatttgtttcagcaatgaatgatatgatttttgattccaacctttttactttattaggaaagataattttgatagagatatgaaaatcgcatatactctaattcaaaaatatattaataagaatcataaaattattacttttgattttaatggtaaaaaaacagctattcaattatcagatatcatttatttagaatcgtttttacatgaaattacgattcatacatcctctaatttttataaatattcgagcacttttaataaaatgatgtctcttataaattctactaatattgttagaattcataaatcatatgcagttaatttattttgggtcaaagaaatttataaagaaaagttattattgagaaatggagttactttaaagattggaaagaagtatcaacaagatgtacttgcatcgtataaggagtatttattaaaatgatgtatttatttttagattatttagaagtgctattggtagctttattaatttgtattttttgtgatgttgaacaaaaaaatagatattgtttgatttcatcagtaattagtttcttagttatggaatttatgcaaacttatgatttgtttggcaatgaaatggcatatgcaataacaattattaactttataattgtttctgttatgaaaaaagaaattaaattttataattttattccttgtatattttctcaatggatatctgtttttacttcaactatagttttatttttctttaaagtaataacaaattataatatagaaaatattataaagttgtatagaatacctatcatttttttagcaagaattcttttctttgcacttattgtggtattaaattatttcaaatctaaaataaaaaatacaattattgaaaaaaataaatatttattaacaattactatgatgttgatttttggaatatattttattctgttgaatgatataggtcatatgcatctaattatagatgatatctatttagttttacttttgttaacagttttattttttgtagtttgtattttgtttttacatatgacacgactttataatgaaaaaacagaatatatgttaaagaatcaagaattagaatatgtagaaaaaaatcaatctttagtacattatcttcatgataatattttaaaaatacaacatagtttaagatatggattaattttgatagaaaataacatagatgataaaaaatatgatgatgctaaacatcaaatagaacaattttatgatttattagataataaaataaatattatgacgaataattatatatttgatactttgttaaatgattatatttttctcataaaatctaaatataatgccaaagtaaaatcattgatcaatataggaaatgattccttttttaaagatgtaaataattgtacagaaataataactattatctccaatttctttgagcaatcagataaaacatatttagaaataaaattaattgaatatggaacatatattgaattagatttattcgtagaaagtaattttgataaaataaatgatgataccaacattgattactttgatgattatgcacatctaagaagaatttttgataaataataaaaaggacttatacaaacagcatggtataagttcttttatttctaatcaacttttaacctaaacttaacataatctcccctttgctatgttaagataatgtaaaggatgtggaaataatgaaagaatgtatatatgtagtagaagatgatgaaaatattagagaaattatagatttagctttaacaagtgcagggtataatgttaaacaattttctaatgctttagatgctttaaaaagtatggaaaatgatcaagtggatctagctgtttttgatttaatgttacctggcatttcaggaattgatgctatcaaaaagatacgtgaaactgatcaagaattacctattttgattttaagtgcgaaggaccgagaaattgataaagtcaatggtttagatagtggtagtgatgattatatgaccaaaccatttggtgttttagagttacaagctagagtacgttctttgcttagaagacatgctcctaaagcagcgccaattatcgaaagtcaaactttaaaaattgataaacaaacaagaacagtgatgcataatggacaagtcatggaacttaccaataaagagtaccaactacttttatatttggtagaaaatcatacacgtgtcgtagaaagagatgaaattttaaatcatatttgggggtatgattttattggtgaatcaagagttttagatgtgcatattcgtgctttaagagctaaattggatgatgatggaagtaagtatattaaaactattagaggtgtaggataccgctatgttgaggaagtgaaataagatgaataaagctctatttaaatattttgcaacagttttaattgtgacattactattttcttcaagtgtttcaatggtgattctttctgatcaaatgatgcaaacaacaagaaaagatatgtactatacggtaaaacttgtagaaaatcaaattgattatcaaaaacctttagataatcaagtagataaacttaatgatttagcttatacaaaagatacacgtttaacaattattgataaagaaggaaatgttttagcggatagtgataaagagggaattcaagaaaatcatagtggacgtagtgaatttaaagaagctttaagtgatcagtttggttatgcgacacgttattcttcaactgttaaaaagaatatgatgtatgtggcttattatcatcgtggttatgttgttcgtattgcgattccttataatggtatctttgataatataggaccacttttagaaccattatttattagtgttgctttatcattatgtgttgctttagctctttcttatcgtttttctagaacacttactaaaccattagaagaaattagtgaagaggtttctaaaattaatgataatcgttatttaagttttgatcattatcaatatgaagaatttaatgttattgcgacaaaacttaaagaacaagcagatacaataagaaaaacgctaaaaactttgaaaaatgaaagattaaaaataaatagtattcttgataaaatgaatgaagggttcattttattagatacaaattatgaaatacttatggtcaataaaaaagctaaacaactttttagtgataaaatggaagtgaatcaacctatccaagattttatcttcgatcatcaaattatagatcaattagaaaatatcggtgtagaacctaaaatcgttactctaaaaaaagatgaagaagtttatgattgccatcttgctaaagtagaatatggagtgactttgctctttgtaaatgttactgaatctgttaatgctacaaaaatgagacaagaatttttctcaaatgtttcccatgaacttaaaacacctatgacatccattagaggttatagtgaattattacaagcaggaatgattaatgatcctaaagtaagaaaacaatctcttgataaaatacaaaaagaagttgatcatatgtcacaattgataggtgatattttaatgatttcaagacttgaaaacaaagatattgaagtcattaaacatcctgttcatctccaaccaattgttgatgatattttagaatcattaaaagtagaaatagaaaaaagagaaattaaagttatatgtgatttgacatcacaaacttatctagcaaatcatcaacatgtccaacaattgatgaacaaccttattaataatgctgttaaatataataaacaaaaaggaaatttaaatattcactcttatcttgttgatcaagactacattattgaagtaagtgatacaggtcgtggaatttcacttattgatcaagggcgtgtctttgaacgtttctttagatgtgatgcagggcgtgataaggaaacaggtggtacaggtcttggacttgcaattgtaaaacacattgttcaatattataaaggaacaattcatttagaaagtgaattaggtaaaggaacaacatttaaggttgttttaccaatcattaaggactcattgtagtccttatttttttatgaaaaagtatctaacttgataaaatatgtaattttacatattttatcaagtaaaaaaatgtatttttgcgtattttatcaagttgaggataagaggtattcattttcaagatattttgaatatgataaaatgactttaaagagaggttgataaagatgcttcaacaagaaagacatgaacaaatacttgcaagattaaatactgatggaaaagtaaaagttaaagaattagctgttgattttgaagtcacagaggattgtattcgtaaagatttaacagctttagaaaaagaaggacttttaaaacgtattcatggcggggctatgcaagtaagaaagaatcttcatgcttatcatgtagatgaacgtatgagtgtgcgcttaactcaaaagaaaattattgctaaaaaagcagttgaattaatagaagaaaatacagtgatatttttaggaatttctaccgtgaatttagaacttgctaaatgtatttatcaaaaaaatataccactcactattgttactaatatgattgatattatgcaattatttagacaaggtgatcatcatgtaaatcttatttttattggaggacattttaatcgtgctaaagatggctttattggtgcattgacaattgaacaaattcacaattatcgttttgatcttgcttttattggaacagtaggcatgaatattcatgatgataaggtaacaacgtatgatgtagaagatggacttacaaaaaaagaagtcatggatgcaagtaaaaaatgttatcttgtggcagaaaatgaaaagttcaatttggatgggaattatgtttttgggcatttaagtgaatttaccggatatattggtgaacaagagttaggaagtccttttaaagaaaaaataatggagtatggattagaaatcatttaatgatttctttttttatgtaaaaacaataaaacgattattgaatattattgttttatagcttataatacccttgtaataataaaaagcaataaaaggaggcgtgttatgaattgtttatatcaaacaaaaagaatttctaagttaaaagaaaagatgttgagcagtaaacgttatgcttctattgaacaggcacgaatcattacacgtgtttatcaagaaaatgagaaattatctattgctaaaaaaagagcactttctttaaaagcagcgttagaagaattagagatttctgtagaagatgaagaattgattgtaggaaatcgtaccaaaggtgtacgttatggagtggtttttcctgaaagtggttgttcttggatcaatcaagaatttgaaatgttaccaacaagaccacaagatcagtttttagtaaaagaagaagatattaaagaatttagagaaaagatttatccttattggaaaggaaaatctttagaagatgcaattaaagggacttatggaaaagaaattaatgaaataagtaaagtagtaaaaattaatcaaaaagatcatgctcaaggtcatatttgtcctgatagtgctttatggttaaaacttggtcctcaaggtttaatggaaaaagcaaaagaaaaattaaagaattgtaaagatgaacaaaaagaattttatgaatgtacgattcttgtattagaaggagcagttcattttatgcaaagatatcatgatttgattgaaagggaaaaaatcgaatcattaaaagaagtgggaaagatttgtacgaatctttctaaaagacctccagaaacttttcatgaagcggtgcaatctttatggtttttatttgtgatattacatatggaatccaatgcttcttctttttcaccagggagaatggatcaatatctttatccttattatcaaagagatatagaaaaaggtagtcttactaaacaagaagctttagaaatattagaatgtttgtggttgaaatttaatcaagttgtttatttaagaaatcaaaatagtgctaaatattttgctggatttccaataggatttaatattgcgataggaggcgtggatgaaaagggaaatgatacatataatgatctttctttactttgtttaaaagcacaagagcatttaggattaccacaacctaatttatctgtaagacttaataaaaattctagccatgaattaatgcaagctgctatcaaagttgtttcacttggtagtggaatgccacaatttttcaatgatgaagctattattcaaccaatgattgaagatttaggaattgaagaaaaagatgcacgtaattatgctattgttggatgtgttgaactgacaacacatggcaacaatttaggatggtctgatgcagtcatgtttaatttaaataaagtattagaacttactttgaatcatggaaaatgtttactaacaaagcaacaaataggattagatttaggaagtttagaaacatatcaaacttatcaagatttagaaaatgcttttcaaaaacaaattgattattttattgataaaatgatggctgcagaaaagattgtagaaaaagcacatcaagattatttaccaacagcttttctatctactgttattgatgattgtttagaaaaaggattagatgttactaaaggtggagctaaatataatctatcaggtattcaaatgattcaagtagccaatcttgcagattctctagcagctattaaacaacttgtttatgatgataaaatgataagtcaacatgatttattaaatgctttacaagaagattttaaaggctatgaaatcatgcaaacaatgcttttaaataaagtgcctaaatatggaaacgatgtaaagtgggtcgatgagcttggaaatcaatgggcatgttactttagagaaaagatgaaacgttatacaaattatcgaggaggcccttatcatacaggaatgtatactgtttctgcacatgttccaatgggtgaaaatgtaggagcatcaccagatggtagaaatgctttaaaaccacttgctgatggaggcatgtcacctgtctatggtagagatctacaaggcccaacagctgttttaaaatctgtttcaaaacttaataattcatgtacgacgaatggtggccttttaaatatgaaattcttaccagaattttttaaaacagaaacaggctgtttgaaatttgaaaatttcttacgtgcttttgtggatttaaaagtacctcatatacaatttaatgttgttagaaaagaagatttgcttgatgctaaaattcatcctgaaaatcatcaagcgttgacaattcgtgttgctggttatacagcatactttgttgaacttgctggcaagctacaagatgaaattattgaaagaacaacttatgaaaatatctaaagcattggtttttgatattaaaagatttgcaatacatgatgggagtggtttaagaacaacaattttttttaaggggtgtccacttcgttgtctatggtgtcaaaatccagaaggattaaacactcaaagacaagtcatctattttaaaaataaatgtattcattgtagatgttgtcaacaattcaaagaacaaattaattatcaaaacgatcgaccatattttcaaaatcatcaagactttgatcaagttattaaaacatgtcctagtggtgctattcaatatgatagtcaagagtatactttagataaattaatgaataaaattaaagaggatgaagttttctttcaacatggaggaggtgttacattttccggtggagaaccctttatgcaaggtgaatttcttattgaaattttaaaaagatgtcagaaagaaaagattcatacagctattgaaacatcattttatacatcattagaacttataaaaaaggcattgccttatttagatttagtttatatagatttaaaaatatttgatgagcaaaaacatcaagcctgtacaaatgtatcaccacaacttattaaagaaaatattcgttatgttttacaaagtgaatataaagataaagtgatcattagaacaccactgattccaacaatgagtgcaacggatgaaaatattcatcaaatcgtaaaatttttaattcaaataaatccagaagtaaaatatgagatgctgaattataatcctttagcttcagctaaatatgaacttgtgaatttaaaatacggattagaatcatatcaaatgtttaccaagaaacaaatgcaacatttttatgatgttgctttacaagcaggaataaaaaacttaataaaagaataggagaaaagaaaatggaatttataattgatacagtaaacttagaagatataagaaaaaccaataaaaatggcggcacttatgggatttgaacccatgaccttacgctccggaggcgtatgctctatccaactgagctaaagcgccacatcttttttctgcccgttatagctcatttagactagatactgctctacgctccggagacgtacgctttatccagctaagctatagcaccaacaaatatattctatcatattagagataaataatgtattaaatatagtattttaaatcaacatttgttagaatgtcatccatggggtgaggttatgaaaaaaggaattattattacattattaggtggtacattttggggtatttctggaaccatgggacagtttctatttcaaacttatcatttaaatacaatgtggcttacaacattgcgtatgatctttgcgggaatcattctattaagtgtttgttttatcaaagatacaaaaaagacattaagtatttggaataataaaaatgatgtctttcaacttattttgtttgcactattaggattaatgttttgtcaatattcctatatgacagcaatctattattcaaacagttcaaccgcagctatactacaatacttgaatccaatctttattatgttctatacatgtcttgtttgtaaaagacttccttataaaaaagaacttctttgtgttattttagcttttggtggaaccttcatcctagcaacacatggaaatattcatgaaatgatcttatcttttgaaggattgttttggggagtgatggcaggattggctgcttcgttttattcattgcttcctcgacatatcatgaataaatacggcagtttgattcctacaggctatgccatgattataggtggcgtcgtattaggaataattggacgtgtttggaatatctctgtttctttagatatctatggctatttagcaatggcaggaattattgttatcggaactgttttagctttttcaatgtatcttataggagtcaatcttattggacctatgagagcttcattaattgctgcagttgaaccattaagtgcaacgatttgcatgtgtttatggttacattctccttttacattaatggatgtattaggttttattatggttatgtcaacaatcttcatattatcttataaaaagaaagcatcataaaaatagcataaagtatttaactttatgccattttttatgatttaaaatatttttctatttctaaaactttatctttagaaacttttaacaattcaaccgcttttgaaaatgaaatacttaagctattcatcaaatttgtaatcagttcaatatttttctttttttgtccttgtactaatcctttttctatattttctctggctatcatttctcctaaattacacatcttttttaccttcttctctatttcttcaaatccatattctctcatgatctctttctttttcaaaagatcatatgtattatttaaaaagataactaacggtgtctttatccaatcactatcttcatacttatctttgatatcatgatctttatttaagaatatcataatctgttcgcctttatcataactttctaacctttcaatagtacttccactgatattttctaatttagagtttatgcgattgacatgtccatctctttttttagctacctgtggcagtatccatatgacataggcctttttcattccatcataatttcgataatcatattctttaccattttgactggtaattattcttgaaagataatcatttcctcttgtaggcaaagcatagccaggattctctacattttgtatttctacatctagttagattcttttcattgttccatcaacttgtgacagattgatataacagaaataatcaaattctacttttccatgatgaggtatatcaataatattattgagttgttgaaaataataatttccttcctgatctttctttcctttaataatttcaatgatttcttctaaagagacatccttagcttctttaacaaagcctttggtgattcttcctaaagtttctggatgtcctaatattcttttacagagtttatcgagcatgataatatgatcatttgatgtaatttctagtacttggtccatttaatttatccctcctattattatatagacaattttttgacgtttttctttaaaaaaagaaaaactttcaaagcttttactttgaaagttaaatcaaatctaaatcttttaaaatatgaagtccttcttgaatagcaccatttccacctgttttagtaagtgtataggttgctgcttctttagcctccttacatccattagctggtgtaaaactataagggaatccttttaacatacatacatcatttaaaccatctccaaaagttgccacttcatcaagatttaagccttttaattttaaaacttcttttaacatgattcctttatcataatcatcacaagtaatttcaatattatcttcatatgatgaagaaatgtttaaatgaggtatacaatctaaacgttctcttatgccctttgcttcttcaggatttaaatgtctagcatctacttttaaaggaagtgctccttgttgataaatttcatcaattgattttaccgaggtacaatcatttaaataaccccatcttctaaagaatgtcgtatttggaaggtcttctaaagtaacgccctcacgacctttcattaataatttaacatgtagatcccaatagctttcaaaatccgttaaaatatattttccttttgttgtatgaatagaaatatgataattatgtttttgtaaaacaggaatcatctttctaaaagcatcttcatccattggatgcgcaatatttttagttccttcaatatttcgatattgtgtcccattattaataatcaaatcaccatctacatgagacttttcaatcatatcaagcatcatattcatatctctacctgaagcaaacataaactcgatacccttttctttataaaaatcaatttctttaatatcatcatcataaaaatgattatctctatcaatgcttgttccatccacatctaaaacaactaatttaatcatactctaccctctatcttccaaacttatcctttaatttatcaaataaactttgtgaaataccaaattttttacacatttctttaacatattgatcaacttcttcattagacatattcttaagtctttcttcatcaatacctaaactttccatcgttgatttcatttgatcatacattcctgtatcaccattttgataattactcatcatttcatcgacccaacgtttagctccctctaattgttggttttcttgactatcttgttgatcaaagaaactttgtgcttcatttaaagcatcaatttcatcactatccaatcctaaactttcaaagaaatctaaacaataacgacataaagaacgacattcatcttgataatctaaatctttaagttcttttgccatttctaattcatgttcaatatctttaatttgttggaagtgttgttcgttaagttctaaatcttcataaacatcttcttttaaatcatttaaaacaattggtacaaagtatcctactttttcataagctgacatttcataatgaacaggcatttctaaaatttcacttaaacattcaataaatccttttaaatttaaatatttatttttaaaaacaaaagtatttgcttttgttttgattttcgcataaaaatcaaaaccttcttcttttttaataagtactacttcttctatatcttcatataaaaatgaatgtggttctttaaaacaaaaataaattccttgatccgtaaagatcattcctttacttccatcaccacttgcatcaataaatcctaatacttgataatctgttgtacttccatataaataaagtgcttgtgatatctgtgaaggaatattttgttgactataaaaggttgcctcattaacaatactttcatctaaattttctaatatgatttctttttccatttttatcaccttataatactttactatatttttaaaagaatgcaaagaaaaaatccttaattgcttaaggattttgaatacatttttttacttgtaaaaaatgcgattactaatataacaaaagtgatatcaaaaggactgttataaaacacaattgaaatcaataatgaaatcacaatacttgatatttcaagtacaaaaggttgaattgatacttgatatcttttaatcaattttctttgattaagaagttgtttaatacttatacaaagcattattacagcaacaagtaaatcaatatagtaattgattaaataatgatttccaatcaattctttaacaaaaagaagtacaatatagatacacattgtaagtaaaataccagacatttcatatttatttaagtctttttgttttaactgattgattttttctttataatttatttttcgattaatttgatcaacaaatgattgactactttgtccaatcatttgtttaactgtttgtcctttttcctgacaaataagcatacaatctaaaatctcagatattaaaatatttgtttttaaaacatttttttgctttttaaacaatgttttttcaatttcttgataacatttaaaataatcatcatttaaactttttactttaacactattttcaaaataaatatcgtacttcttttctttcattctaatctacctttaatgaatgactgttaacttcactaatatgacaattaaagaattcagtcattacttgaatcatataataagtatctttaatacccgcagtttcataagttgaatgcattgctagttgtggtaaaccaatatcaacactattcatagaaacttgagccattgcaatattacctaaagtacttcctccagcttcatccgaacgattagcaaagaattgtacaggcacattagcttttttgcataagtctttaaataccgcaacacttaccgcatcacttgtatatttttgaccagcatgtgatttaacaacaattccttcattcatataaacacagtttgttgcatctgttttttgtggaatatgtggatgaacagcatgagcgttatccgctgaaagcataaagcttgaagcaatcgcacaatagaattgttcttctgtttttccaagagcactgtttgtacgttttaatacatcatataaaagtgttgaagcagccccttgttttgttccagaaccaacttcttcattatcaaagcaagctaaaacattgattgattgatcatttccacctgctaagaaaccttttaatgaagtaaatgcacattgtaaatcatctaaatgttgacttgaaataaattcatcattagctccccaaatagatggtgctgtacgattgtaaagatataaatcacttccataaatatcttcttcatttacacctgcttctttagcaactaatttcttaaagtcaccaggtttacaatcagctccaccaaataatggtaacatatcaatttgtttattatatgcataaccatcattaacagctctattcatatggatagctacattaggaattaatactaaatcacgatcaatattaattaattgtgtttttaattcatttccatctttaattaataaacgtccagcaatagataatggtttatcaaaccaagttgaacaaatcattcctccataaccttcagtatttaattgtgtgtatttacccttaacttctaattcagcattttcttttaatttaaaagttgggcaatcactatgtgaagcagcaacattaaaactataattttctaaattgcttccgacctttaaagcaataatacttgaattattacgagtcacataatatttaccacctggaaccattttccaaggttgaccttctaataattcaacaaaaccttgtttatttaattcttctttaatgttttcaacagcatggaatgctgtaggacttttttgtaaaaagtctaataattcttttgaaattcccctatacattttctaacacctcttctatattttatcacaattattctgtaatagcgttagctttttctcttttagcaatagctggtaaaattattcctaatgcagttaaaacaacaggagtaataatatttaaagccattgtaaataagtcagttgagtaaacacccatgatacaacatgcagctgttacaaaaagacaccatccaccaaagaataaagcaactggttgactcttaacaaaacgataatcagctgggatcttatcataggcttttcttaaaccaatataagctaagaatacccaaacataacgcattggcatacatactgaatttaatttatttaattgggctaatactccagcagccccttgtccaccaatgatttgaattaaaataatacttcctgataaagccacaaccattttaattccattaacataagcaccatatttgttttgttttaataatttagatggaataaattgtctagcatcttcattatctaataacattctaagtggtgcatcaatacttaatactaatgttgagaattgcccaatcatattacataatgcgtaaataattagtaatgcatctcccatatgatagtattgacctaatttttggaatgaccagtaagcaccatttgatacatatgaattgaatgattcaggtgatgcattgattacagttggatcaaacatcatacccatagcaaatgtacctaaaatagcacataccataaccatgattgcaagtgcaatcatcccttttgggaatccttttgaaggattttctactttatttacataaggtgaaattttttcacatccaccaactgcaaatactaaaatagaaagtgacgtaaaataattaacattaaattgtggaacaattttgtcaaaactaaaatctaatgataaatatcccccatttggattaattgctggtgcagcaaacatcattaagatatataaaattgacataacgaacatacttgttcctgcaagtgttgctaattgtttaagtggatttaaccctctactagcaaaccaacagaaaaataaaaataccgcaagtgttgcaagttgcacatataatgttggaagtgagtcataaaattcagcatttctaaaaattgcccagcttaatgcttttaaaccaccactacctttacttgcaatataagtaacgtgacatgcccaatatgtccatccagcatagtatgcaagtttaggaccaaatgtttcatgtacccaagaacttactcctccaccagaatttttaaacgcagaccctagttctcctaccattaaagcgtaaggaacaaaataaagtgcgaacattaatacccaactaaaaactacttggataccattgaagtagataaagccatttaaaacgtttccaaatccccaaacagtagaaaacgccatgaaagctaaaccataccacttgattttttttgaatcttccatgattttacctccatattttttgaataacttaggtcgtttattcttaaataaaatacaaatattgtacttcacgatacactattatatcgtattatgtcgataaatgctatatattttatttcattgtactcttttttagacatttatccgtaaattgtctaaaaaagcatacatttatcccaaaatataatattctatttttatcatcaataaacttttattattattcgtttctatttaacaccaaatatttgccttttaaacacctgtttagttcatcaaatacatgccatctttgttaatataaatcaaaagaggtgacaaatatggaaaatacattatattttaaagacatgattcattgtgatcaaaataactatcctaaaaaagtctacaaagtagaatattctaaaatgttgatagaaattttagatagtgatcacattcagggtagacccttctattttagcagtcctcattctagagacgatttcatcaaacaaattaaagatcatattttaagaatcaattatgaagagctcgaacaaatacagcactattggaaaaagaacataaaataattatgagaggttttgcctctctttttttatcactcaataattgcccattttttacttttctcccaaatgacatgctgttttgggaaaaagtaaaaaattgtgagaaaaaagttattggttgcccaataacttaaagtatctttttaaaatacaaaacatcgtccattggattatgataatacgcctcacattcaacaaaacctacttttttataaagatgaatagctacttgtaaaggaataagcgtatccaacaccatttctttataccctgcttttttagcatgccctaaaatttctaaaacaagctttttacctaatttattttctctatattttggttttacatacaaacgcttcatttcacagcgactctttgaatggcgatgataggcaaccattcctatcacctttttcttttctacagccactaaaagttctccttcaggagctgtatatttttttgctggattttataattcctcatcaatattttgaaaagataaatcacgtcccaaacgttttgtatattctataattaattcttttacttgatctagataatcaacaccattacatatttccataaaatcctctatgtacgaacctatttttttacatatatattttctataacctttgtatcgtcccatccatttgaactttcaaaagcgattactttttcttttccttttaaaataaaatcatgtttttggatatctacaaggtctttattttgataaaggaaaacaataacttccccataacatttctttttatcattttttgttttcttaatgcattcatttaattgttgtaaagaaatatcagttattcgatcaacatcaaaattattatactcttgatattgggtactttcttttgcttctatttcgtcataataagtatctttaaattcatttttcttaaaaatgaaaacactttgtttacttgcaggtaaacattttattttttgatcttttaatgatagatcaattggcttatttgatgtatttttcaaaatcaaaataacttgatcatctattttctttgtttcaaatgaatataatttattttgttgatgacatcctgtaaaaagtgttatcaaaatcatgaatgcacacatttttataatcaattttttcataacttttcttcctttttatataatccatgtcgaagtaaaacttctaaaataagatcaataaatgctgttacaagatatattggataacaattccaatatttatcttttactctattcatttcatgaattggattttgtataaaagctaatgcaatcaacagtattcctaaaacattagaaattctaataatgatcaatccatagttattttccttatttagcaattgtataatttgtcctacaatacgtataagaaaaataatttctatcgctatccaataaaacataaaatttcattcttccctttacatgcaggcaagagaaagccaaatcaatgaaagacaaaatacaactactgctattaaaaataaagtaacccataaagcatattttccaatatttcttttcatatttttctccttattataatttttaaaaggttttattatatatttacttacttttcaacaatacaatggttattaaaatattatttttctatcaaaaagtttattgcttctttggcgtttgaaataggataatagggtgtgcttttctttgtattatctttatattctatttctaaaccttttttatttcctttttttggtaaacttcgataataatatcctgaataatcttttgcattttgatcattaaactctaaaaacactcctttttcataataaaatacatagccttcaaattctggagatacatatcgaaacccctctaattgtccatcttttaaaaaacgtactgctacaaattcttgacaagcttttttattgtcatcttttgataaaaatatgtgatattcaaaataatcacctaaactacttctgcctcctatcaatcgatgatctcctatatattttttaacatcttcttctgtaaaattgctattcaaatccataaacattttttgataagggctatattttatgattgttttagtatcatctaataaaatatccttattagattttacactacatccacctaatattactcccataacaaacagtaataaaatcatttttgctttcattttatttcacccttccttgttaaaaccactcaaacatttaattattaattaaatacgtacgatattttaaatataaaaccatattaatgatcaaaccaacgcacataaaagttatggcacttgaataatgaaacattgtcataattgaaaaatgatacataaccaaatcaattacaagtaatccaaataaaagaaaagtatttcttttaagatcaatacattctttagaaacaacctttttaatcatcataaaaaaataaacaaatattataaaataaaacaaataatgtatgacaactgataaattataaagcaagcctacttccccataaatgggatttccatccgttcctattgtaatccaatgggtagaaatgtaattatcaaagtatttgaatgctaataaacctattatttcaaaaacatagcttaaataaataagacaaacatcatattgtttcttcatttccttttcctccatccataatattatgaatcaaggaagcgctttccttactttcattatacgtctttctaccattatgtcaattatacttttattataatagtatcttgtttataataattcatatgttataatcaatttgggtgataaaagatggcaaaatctaacagtttctttaatattgatatgcttgttttaagtttgttgaaagtaaaggattgttatggatatgaattagtaaaattaattaaagaaatttccaatggctcattagatattaaagaaggtactctttatcctgttgtacataatttattaaaaaaagaatatatttcaagtcgagatgagatcgttaataaaaaaatcagagtttattatcatattgaaccaattggaaaagaatatttagaacaaacaattattgaatttagaaagaatatgcaaggtgtatttgaaatcattgcatatggtgaaggcaaaaaagatgagtaacgatataaaaaaatatataaaatatgttaaaaaaattattccaatctattcaaaagataaaaaagaatttatacagttattaacacaaaaaatcattgaattttctaatgaacatgactcctgtagttatcaagatatcgtagatgaatttggtagtcctaatgaagttgctggttcttatattgaaactttaaatagtgacgaaattataaagaaacttaataaaaagaaaattataaatatttttatttctgtcataattattttatgcataagtgtttggggatttgaaagatatcgaatcaatcaattgattgatgaagcaaaacatacaaagatgaaaacatatacagctgaagaatataaagaaaaaatagcaaaagaaaaacaagaaaaataagtatttaaattaggagtaaaaaatgaataaagaaatcaaaaaatatataaaatatgttaaaaaaattattcctttttattctaaagataaaaaagaatttctaaagttactaacacaaaaaatcattgaattttcaaatactcatcctaattgtacttatcaaaatatcatagatgaatttggtagtcctaatgaagttgctggatcatatattgaaagtttagaaaacgatgacataataaagcaacttaataaaaaatatatttttaaaacattagtaaccactattatatttatatctattggtatttggtgtttagaaatttatcatttcaacaaactctaccaagatgcaagagatagtattcatggatattgggtagaagaaatcactgaagatagtcgcatagaaaatgaataaggctccttttagagccttatttttttattcaacattctttaatgcttcatccattggaattttcttgatttttctcatttgaatcatcataacaaataagtaagaaataaccgtcatgataaacatcttgatataaacactaccttctacatagaaaggtaaccatcctgcatattcttcaaaaactattttgaaagcataagataagatccatgttgttattccaaaagaaagtaatgttgaaatcaaaataacaattgttgtggcatgaacatacatcttttgtatttcttttgatgtataaccaagaattttaaccatggaaatcgatactttattattttcaataatcatctttgtaagaagataaataagcataataaacatcacaattgcaaatccttcaactaaatagaacatttctcccattgaaacatttaattgtcttgatacttttgttaaatcatcttgagtaatggttgaagcgatatagtcatcttttaaatctgttatttttctatttgaaaaataaccattgaagtatccatcttgacagttgaaaacttcattaaaataagatttagacatataaagtgccatactaccaggtgcatcataaatgcctttaatttcaaaagtataacgtaaatctttatagctttcttttaaagaaatacgatcgcctttttttaaattatatttatcagcaacatcttttgaaatataaacaccttttttgggtaatgattttatatgaatatattgactattattttgtaaaccataaaggctaatatcttcttctattgtactttctggaagtgtttttaatgagtaaagagaaaaagcttctgcccctgtggttttagttttatagttatcatacatttcatcatattgatcatcgatcaaacttaagaaactatccctaaattcttgaggaatcgtttggaaagcttgttcaatggctgtggtatcaattgattctggagtatttaaaatatattgatatttagcagtcatattattaacaacaacatcttgataatgatcgagaacaggatgcatatccattccaaacattaataagataattgcaaataaaacaccgacaaataatgtaacataccctgataagttatttaaaataacacttaatctaaattgagaaaagaaacctaaacgatgtaagacgagtgttttcttattctttttagcttttttaatatctcttttcataaatttaagaggtgataattttaaagatttcattaaaataccatagttaattaaaaccatcataataaatggaatgatcgttgtcttaataaacgcatctccagaccaaatagtaacataagttggtaaactataacttccataatacataccggccatgacatctttaaaatatgtataacctaaaatatttccgacaatacaagcccctaaagaaacaagaataggtaatgtcatgtattgaactaacatttctttttttgtatatcccatagcgcgaagagttccaatcattggtgcttcgctttcaatggtatttttagtagtgattgcaaagacaaaagcaaggattccaataatgatataaagtaaaactgtcatcattgcttcatctccacccatatcatcacctgtaaaatggatggcttggttggcgtattgaggaatataatcatcaattcctgaaacgtttttaacaagtacgtttaaaaaatcattgctggcattaacttcattatcaaccttttcattatatgtccacgcatagttatagtagattttagcatttttaaagctttcaaacccttcatcagaaacaatgcccacaccaaatttaacagaatcaaacattagatcactattttttgaaaaaagagcactataatctgataaagccacaagtccagtaatttttaacttctttttacctactttgatggtttggcctacttgataattattattatcggcatacatacgatcaatcgctatttcatttttactttgaggaagttttccatccataatacagacttgattgactttgtttcttggtttaaagagacgaattgtacttgaagattctactttttcttcaatgtaattaagattataaattgtgacaccttctttttctaaagcctttttattttcttttgaaagagaatcatttaaacgaaaatgtccatcttcaatattgtatttatcaaaactgtcattataagctttgatcattgagccatcagctactaaaaatcctgaaataagaccaatagatcctgccataaacaaaaatataattaaatattttgcaatttcatcttttaaaatatatggtaatcttttaaataatggattcttcattttaccaattcaaatcctttgctggaattttatgcgtatttttaatattttcacgaatacgtccatcatgcaaataaatcacacgatcagccatgtctttaatcgcatcattatgcgttacaataataattgtattaccatattttttattaacatcttcaatcaattgtaaaatatcttttgatgtatgataatctaaagctcctgttggttcatcacaaagtaataaatctggatttttgatgattgcacgtcctattgatgttctttgttgttgaccaccagataattgatttggttgtttataacgatgttcttttaacccaagtgtttgtaagagttcttctttatttaatggatttttacttaaatattttcctacatcaatattttgttcaacatttaaatgtgaaatcaaattatacatttgaaaaacatatcccaaatgattacgacgataatttgttagatctttttcttttaatgttgaaattgtttttccttgaatcgtaattgtcccactatctggttgatcaattcctccaataatatttagaagtgttgatttaccagaacctgaaggcccaagtaaaacacaaatttcacctttttctatttcaaaatcaataccttttaaaacttctgtcttatattcatcttcaccaaagctttttttaagatccttgattgataaaaacataatatttcctcccatggttagccttacctaaccacatatagaatactatcacttttctcttttttcaagtatctcaaagaaaaaaaacggatttctccgtttttataactcaatatgtttcataatagctttagcaataccatcattattatttgtatctgtaatttcattagctactgcttttaattcatctgaagcatttcccatagccacacctaagccaacatattccaccattgatttatcattttgagcatccccaaaagccatcatttcttcttttttataacccataggaattaaaacactatctaaagctttggctttatcaacaccttttgcagtaaattcaaaatagaaatcagatgtaaacatacaatttagacgatctttaaatggttccatcatttccttataatgtgcttgtaaatagtctggatcaccaaatgtaagaattttattgatttcaaaatcaacaaaggctgctaaatctcttttttcacataagatgtagttatttcctcttgattcatattgcataacattaaatggttttcctttataagtaattgtattatcaaaaacatcattgacatacatatattcatctttatcaaacattggtcttgctttaaaattctttagatgttctaagattgctttactatcttctacagaaattgcatggttataaagtgtttcatgactttgacaatcaactacttttgaaccattgaaacatacaaacaaaccatgatgattttccatatctaattcttcagcaagttttaataaaccacttgttggtcttcctgaagctaaaaccaaacgtacccctttatcttgtgcttttaataaggtttctttagtaagaggagtaatgactttttcatcattgactaaagtcccatcaatatccataattattactttaattgccataatctatctccttttctattagtataataaagcgcttttacaacttcaacatactttcataaaaagaaaaagaaacagaaaatatctgtttctaatgtaataatgaacgtgttgaacctgaagcaattaagaatgtacttccattatgaagcatggcgagcatttgtggtgtaagtaaacctaatgctcctaaaacaataaaggatgtatttaaaccaacaatcaaacgatattgactatgaatacgtttaaataagccttctgaaatcattcttaaagcaacaatatcatttaacgaatttgatacaagtgtaatatctgcaagttcacgcgcaatatctgagctatcttgaagtgaaatcgaaacatctgccatggataaggctggtgtatcattaataccatctcctaccatcacaacggtatttccttctttctttaaactttcaatataacttgctttatcttctggtaaaactcctgctctaaaatcatctaaatttaattgtttcgcaattgcttttgcacaattaggactatcccctgtaagcataatgactttatcaaaaccaatatcacgaagttcttgaacaacttctttagcttctggttttaaaggatcataaatactaataatacctgcaagctttttagcaatggctagataaataagtgaacttgaacctttactttcaagtgaagaaatcaaatctttaatttcttgtgtcatttctacaccttcatcttcaaagacaaaatgactgcttccaataataacatcttcaccatttaagcttgtcgaaataccatgagcaatcacatattttacttccgcatgttcttcacgatgttttaagttttcaacttctgcttgatgaacgatggcattagccacactatgtgggaaatgttcttctagacaagccgcaatttttaaaacttcttctcttgtataatcttgtaaaggaacgacatctagtacaacaggtttggcatgtgttaaagttcctgttttatcaaaaacaatcacatttgcatccttcatgctttctaaatgttttccacctttaactaaaacattatgcattgaagcttcttgcattgctgaaatcactgaaattgatgttgataaacgaatcgcacaagaataatccactaataaaagagcagtggctcttgtaagatttcttgtcaatgcccaaaccccaaagaatcctaagaaactataaggtacaatggcatccgccatatgttctgcttttgattgaatggatgcttttaatgattcatttgtatcaatcatatcaatgattttagcaatacggctatcatcttgtaagtttctgaccttaacaaaaatctttccttcttcaatcaatgttcctgcataaaccgtatcatttaatgtcacacgtttgcttaacggttcacctgtaaagcttgattcattgaccatcgcttcaccatcaacgatttctccatcaataggaaccatacttcctgtttgaacaataacagtttgtccttgttttaaatcagacatcgcaatttcttgttcttgcccatcttcataaatccaaactttatcaaacttactcatcaaactatcacctaattgtaaagtaactttttgacgtgtatagtcttctaataattcagatattttaagcatcaacataatattgcttgctgtattgaactctttacgcaataaagaaacaccaatacttgttgcatctaaaactggaacatcaatacgtttatttccaagtgaagcaatccccgctttaaaataagcaagtgctttatagatggcaattcctttaccaacaacatttggtaaaaagagcttaacagcatatcttctagcaaaaattttaattaattcatgcttaaaactttgatcaagtacttgtaaattttgagaacaattctcagggatttctctgttttgtaaagcacttaaatcataattatttaaataatcaaatacttcatttttataattttcatcaaaaaccaataaaagacttccatttttataatgagcttctacatatcttacatactcaagatttaaaaaatcgctttttaaaatagttgcttgtccacttgtaaaagcatattgtccaaaacgaacacgtaatcttccatcaatttcatgaactattttaaaattactcatcattattgtgccttacttttttctacagcttcagcatagacgtcttgagcatcttctttaatagaagtaacagttgcttctacgttatcttttacttgcattccactagctaatcctttaacagctaattctcttgctttattacttttagcgaactttgaagtgacaacagcagttactgctcctcctacaaatgtccataattctttacttttgaaaaattctttcatcttaaaatcctcctatcatttgtcattatacgacattttcttaaaaaataaataattttttatctcatctttaagtttttattataccttgttctatttcaataatttcatcacataaagcaagagatgactttcgatgactaacaataataatcaatttttcatctttaattcgttttaaactttctaacagggctgcttcatttaaactatcaatacgacttgttggttcatctaataaaagaatcggtgtttttcttaagaaagcacgtgcaagaccaattctttgtttttgaccacccgaaatattttcatcataaatcgtttgatatccttgtggtaaagacataataaaatcatgaatttgtgcttgtttacaagcttctattacatcttcttgactataagcaggatttaataaagtaatattatgatataacgtatctttaaataaaaatgtttcttgatcaacatagctgatattttcttttaaagtgtggctattgatattttcaatggattcatgatcaaataaaatctcaccttcaccttgataaatacgcattaataatttcaataatgttgatttaccacatccacttttaccaagaagaccataggttttaccaaattcaaatgtataattgatttgatgtaaaatttcagtagacgtatttggataatgaaatgaaagattttttatttcaattggtaaatttaaaattgtatttttatttgtaatttctttaagtaatggttcttcatctaatagatttaaaatacgtcttgcacaagggaatacttgattgagattgttggctagatttgctagagcaatcgttgggccaaaggatgaagaaagtgccatcattggaatcaacaattccttagaaacatgattcttgatcaataaaatagaaataacaatcgataaaataatcagcccatctgaaagtatttgttgaaaactttgatgcttgattaatttttgatgtgtttgggttaaattattttgatgctccatcatttgttcaaagcgtttttcttgttgactaaattgtaaaatttctcttttacctaaaactgtctctaaaacaaaagtattaaaattagcaagtaaaaaacgataattacttccctctttttggctcactttataagtaatatatggaatcaatatacccatgataccataacaaacaaaagcaagtatcccaaaaacaaaatgataagaacctataaaacaaatcataattatactataaataaaggcaatcatcactggcgaaatagtatgagcaaagaaaacttctaagagttcaacatcacttgtcaacattgcaataatatttcctttatcttcattttctaatttagctggtgccaattctcttaatttttcaaagactaaatgacgaatatgagccaatactttaaaggcaatataatgattacatgcttgttctatgtatcgtaagattcctcttgaaaatgcacaaagaataattaatttaacagcaagtgaaaaggaaattactttacaaaaagcaagaatgataaaaacggtaataaaggttgctgttaaatgccctaacacacctaaaataattgccaataacataatcattaaaaaaggacgtactaattttaataaagaaataattaattttatcttatctttcattttcaataatcctttctaaattcttttgattttccacaagctctctaaataaattagcttgattgaataattcatcataacttccttgttgaatcaatcttccctctttcatcacaaaagtaagttgactttctttacaatgagccatgcgatgtgtaataaaaataacaattttatctttagctaaacgtttcataatttttaaaataatctcttcactttcacgatcaacattattcgttgcttcatcaaaaatataaacatcactttcacgcaataacgctcttgcaagagctaatctttgtctttgtccacctgatagatttttagctccttcattgagttgaaactttaatcctccttgattttcaaagatctcaaatagttttacttcttttaaaacagccatcattttttcttcatcaatacttcctgacattgcaagatgatcaaagactgtcccttttaaaatataagtttcatctttgatcaacgttattttttgataaagtgtcatcgtttctgatattgtttcttgattataaagaattttacctttttgaagtggatataaattcattagcagtgaagcaatcgtacttttccctgaacccgattctcctacaatcgttaaaaatgttcctttggataaagaaaatgaaacatcttttaaaataattttttcatcatagccaaaagttacatgttcaaaagataaagttgaaatcgattcttgataactttcttgaatatcatccaagctatccaatagtttaaaaattttatctgctgccgcgtttccattttgtccgatatgaaaataacttcctaacattcttaaaggtaaaaagaattcaatagaaatcattacaataaaaacaaacatcataaaagtaatatgttgatttaaatattcttgtaaacctaaaacaactcctaaaccaaaaccaccataagccactagatccatcacactaatcgaattcagttgcataattaaaacacgcatggttttctttctaaagtcttctgcttccctatccattttatcttgataatataaatcagtttgataatattttaaagttgtaagtccttgtaaattttctaaaaaagaatccgctaatcctgtataactattccaatacttcgctaataaccttttagctattttttgtacaacaacaatagaaacaggaataagtggtacacataaaagtaagataagcgctacttttaaagacataaaaccaacaacgataaataaagtaagtggtgccaacatagcataaaagaattgtggtatatatttagaaaaataaatttctaattgatcaataccttcacttgtaagttgagtaagcgtcgattctttaaaaactattgtttgtttttgatgatatatcttatcaaaaacactttttcttagctttgtcttaatcatttcacttaaagataatgcttgtttattttgtgttgtttgtaaaaaacattttaaagcaaacaaacaaatcacacttaataaataaaaaacaagtgaaaaagattgttttaaataaagacaagataaaacataactatgtaaaaatgtcagtagaatatggcaaactaaaaccaaccattgaatcaagactaacccataaacatttttcatttccgctttaaaagtttttaataatcttttattaaacattttttcttctcctttctttaagtgaaagccatccatgtttgattgttagaagtggatggtaaaaaagcatatactttccagaaaagcgcatcacttttttaacttggcttcgatattctttttgatagcaatgaactttacatccactacaaaaagttttagtttccataaaaggacatttatcaatacgcaaacaagcgtacttataaagatcttcacacatcttactttcttgaggatgttttctttgataaatatcaatcattacctttaatattcttttttcattttctcttttttgatctattttattcattaataatctctactttctttaacataataaaatgatgaatactcattaccatcagtaaacatatctttccaatccatacaggtgtaatcattacagcaatcaaaaaaataagtgttactgtaaataatgactgattccttttctttttggttgtctttctttcaatgaccatttcattgatatatttttgataaagttttgtttgaattaaatattcatgaaatctatctgaactttttgaaaataaaaaagcacttaaaagtaaaaatggggtcgttggcaatattggtaaaaccacaccaatcgctcctaaaataaatgatataattccaaatataataaataatattttcatgtttcctcctgtagttagctatacctaactaccatcatcatatctgtttaaaataaaaaaaacaagcatttgatttgtttcattcatgaaacaaaatgctgtttttttcatgttttataatactttttcgtgtttcatcaatgaaacagtatttttaaaagggcaagattttctggcatatgtccttttaataaattaacctttaatttaaccgtaagcgatgtttgcatcaatctttcttcttttgtataaaagaaatttaaatctgtaataggtatatagaaacaatcatttttttcaaaacaatcatattccttatcctgaataaaatatttcatcgattttaatttagaagaaatcgtaattctttcttttaataattcttttttcatttcaattggttgaaacacaagaaacccttgatgttgttctattaaaagataggctggatgttcaaagcctcgattagccattgaatgaacatttgcatctttataatgaaataatgtaaaagaaaaattatatttacctggttctaaatgatgttctaaataatgtcctgaaaattctacaaggtctcctagttgatcaaaaactttattaaaatgaatacgactacaaatgcgctcaatggtttcatcattaagtgtcgtatagagtttgatagcttcttgacgagcctcttcttcatttaagtgacttgtttcttgtagccaataggttagattctttattttttcttgaattttttcaatatattcttgtcctttttttgaaagctgacatttacctttatctaaagttaatccttgttcataaaaagtattgatcattcttgacattgttgcttttgaaacattcatttttttagctagtaatgtgactgttatttttttattttcattcattaataataagctttttattttttctgttttcattttaatccctcatattgtaaattagcataagctaactaatatgtcaatgttaatgatattaacatttaaagctcttacatttttgggaatttgttaatgggatttaaagtgatatctaaatgctttatcttttttatcattcattctataatatacttgtattaagaaagagggaataaaatatgagtatcaatgaaattaatgaacaagcaaaagaatctttaagaaaatattttaaggacagtcaagacatccaacatgatgatgacactaaaaaacaattaacaattgaagaaatgtatcaatcagttgatggtgaaatcaaagaacaagaaaagaaattagaagaattacatcaaatgcgtcatgcattacaacataacgctaaagaagcttatgaagcggtttatgggaaaactgatgaagcagcagaagtaaaacatacgactgttgaagaaatggaaaaagaacttcatgaaaatgctgaacatcaaatggaatatgtcaatgaattaaaaaataaatctttaaaaaaataggtcaactcgacctatttttcatttatatattcatcttcactttgacgatcatcaacatatgaagcaactacaattttcgtttctagattctttttataatcatacgaaaagacacctgcatataaaatatcaaataaatattttaaagaggttgttgaagcaaaatcacctattttaatatgtaacatttctcttgaagaaagatacaaatgaacatccgccaatcttgaaatagaattttctgccatacaagtaattgaaataaatggaatatttcttttatgataaatttctgcaacttccaccatttctcttgtttgtcctgaataagaaataatgattgcacaatgactctcatcggcaagacaggcacttcttttttgacccgttacttgatcaatgacttgaacatctttaccaatatacatcattaatgttttaaaatgtttcgctagtaaaacatgattgagaacgccataaacatcaataacttgtgctttttgtaataagcgaaccgcttcttgtagatcatcatgatgattaagttgctgtgtatcttgaatggtttctttttctaataaagcaagattttttgtaattgtcatcaaatcatcacttaataaaaaaggaatagaagcatctacatctgtttcttctaacatataagaaagttcttttaaataagcacttttaaattcattaaaaccactatatcctaacttcttagcaattcttacaagcaaaggtgcacttgtaaaagtatttctagcgatttcattagccgacattttttcaatattcatcccttgatcaataatataatcaacaatttctctttctgtttttgaaaaatgcgtattttctatttgattgacaatgagcataaaaatctccttcctataattctattgtttctaaatcattaggaacataaatcttcccactaaaataagcttttccttcttttgtataaagttctttacgattttcaatattttgatcttcgctgtgatataaaaccacattttttacttttaatttttcagcaaactgacacgcatctttaactgttgaatgatatttttcataaggatgaaaaatatctgcttgattatataaacaaaaagcttcatgtaataaataatcactctttaaagcatatttttcatttgcttcgttataaggttcatccccacaacaagtaagttttctattttcatctaattccatcatataaccaaattgtttagctttggttgaatgaatatcaaagaaagtgacttttttaccaatgatttcttttgtttctccatcatttacagcaactaaatgtaaacgatcattgatatactttgtttgtttactttgtaaaagcatcttacaaattgtctctaacatctcaatgacttcctcatgaccataaatataagcttctccctcatattttccagctgccatattttgacaaatcagtcttatcatccaaatcattccaagtaaatgatcaatatgtttatgtgttacaaaaatatgttttacatctttccaattgattcctactttttcaagttgatttaaaactgtattacccccaccagcatcaaccataaaataatcattttcattttcaaaaatataacaagtattatagcactttgttactagggcattccctgttccaagcattgttagtttcaaatttaatccccctcatcctcttttattttagcgaaagtcttttcctttgtaaaataaaaaaatagagactaagctctattttcattaaagattttaccaaatacaaaacgtacgattggtcctgcaaaacataattgtaagaaaaatgccatagggaaattcataactgttgtttgtaaccaaactgcaatcatttgacttccagcatttttaaataaaagtgttgctgcaaatgacatacatggacacattaaaataatagataccactgaaatcgcaattactaaatgaaatggatgatcattttctaaatcaacaatttgaaatgctttctttttagcaagatgtcctacaataaagaaatctaaaatgaaagcaacaggtgccataataactaattcttgaaaagccattaagaacacttgatttgtcattcctccaatatttaatgaaatattataacaaatcataaaataaaccatcatgaataccatcataattgtaaaaataatttcttgaaattttgtttttggcataaaaaacctccttgaataataatgaatctgtgttgttcgttatcactcaaagagtgtgcgtttccaatataaaccaaatatttaagccgagtgttattttattaaataatgttaactaagtcaactattatttaataaaagattgactagggaaacgagtatgtctattatcaattcatagtcgtttagtatgattaaggagatttttatgttaaatcaattttcaagaactcaattattatatggaaaagaagccatggataaattaaaaaacagtcgagttgctatcttgggtttaggtggtgtcggcggttatgtaggcgaagcgcttgtaagaagtggaattggctcttttgatttaattgatgatgataaaatttgtctaacaaatctcaatcgtcaaatcatcgctacatttgatacagttggtcaatataaaacagatgtcatgaaagaaagaatgttaaaaatcaacccaaaagtcaacattcaaacacatcaatgtttctttttaccagaaaatgcatctgatttttcatttgaagattatgattatattatagatgcagttgatacagtttctgcaaaaatcgaacttgttttaaaagcacaagaatataatattcctattatttcaagtatgggagctggaaataaagttgatcctacccaatttaaaatcacagatatttataaaacaaaagtatgtcctctagcaaaagtcatgcgtagagaacttaaaaaaagacatgttaaaaattaaaagttgtttattctgaagaaaaaccaattcgcccaattgatgatttatccatcagttgccgaacacattgtatatgccctcctggtacaaaacgtaaatgtacaattagaagagatattcctggaagtaacgcctttgttccttccactgtaggattaattattgcaagtgaagttgttaaagatttaacaactatttaaaatggaagatacttaatctatcttccttttcttttacgtttattttcatacatcttataatctgcaatctcgatcattctttgtaaatcagtactttctgttccataacaaacaccatatgaaaatgctaaatttacactatgatcatctgctaataaaacgatttgatctcttatttcatttaattgattaatatcattatttaatttttccattgaatcataatgatgaaaaaaagcaataaattcatctccacccaagcgtcctaccaaacatttttctcccgaaatagtttttaaaacatttgtcatttgttttaaataaagatctccacaataatgtccatagacatcatttacttgttttaagtcatctaaatctataaatatcaaagcatattgagctatatttttatcttctaataacttattgatttttatttttaaaccatttcgattatatatttgtgttaattcatcgacatctctttctatttctattttctttctttttatataagaggttgtgatatctatcataacgcctaatgtaatatcttgatcttttcgatcatttatttgtatataacatttcatttgaggaagataataaatatctttttcaacttgatgtgtatttattttatttaaaaaatcaataaaatcattaatatcttctttaaattgtgtgcattgttgtgaatttaaagaaaatatttctttaaacccatctgataaatacaatgtatttaatttttgattatattcatagaacccgataagttgatttgtttgagttaaaatataatccatttttttattattaactaataagctttgtttcatttcattaatataatgacttaatttttgaaattctaaactattattaatcgatacttcctcatctaattgtcctttagaaatcttagataattgatgattaatttgatttatactatcaatcacataaacacgaatatacttaataataagtaatctaaataaaatagatataataattaaacaaacgatcatttctaaacaatttttaggtacttccttaaaaagaactcttacaggaataatacaataaatataattattttttattttctttgaaacacaataggataattgtccatcaatttcagtaaaaaaaccattttttgcttctttaatttgtgtatctttcaatccaatactagaagctacatctcctatatgatgatgtgttgtaccaacaatcttatgatttttagaattgattgcataatattgtgcttcattatttactctaaataatttaaataaataagataattgattctttttagttgctttagaggcattttcatgattcatgcctacttgtacaataaattctttattctcactccataaagcagaatattgcatttttatatgagaagcagtattttccataattttttgagtcagttgtaaattttgattagaaagtaatggtttaaaaaagcttagttgtttacctgaatcaaatgaataaccataatattcaggatgggtcccagaaataataacaccttgcttattaaaaatatgaatttcatcaacttcaacatactgtgctattttctttaattcatcaatattatataaagcatctggattttcttgaagactatatgcaacagcttgagcattatcaatacaggtttgtcgatattctttcttttgtttatttaaatctttttgattttcatttaaaatttgttcaatatgataaaaagtcgtttgtgctgtataatttgcttcttttttagctgttatacagttaaaaaaagtaacaataatcactaaaaaaaagataataagtaatgtgatttttttactttccttttgaatcaattcctttaaactttgcatattcatgacttcctttaactattaaaaagtatagcacaactcattcttttttacaaaatcaactctataaacaaaaaagagaattgcttttacaactctctttataattcttttccattagacttacatactttttgatccccatagaatgaatcttacggaggaagtatgttaaatcaattttcaagaacacaattattatatggaaaagaagccatggataaattaaaaaatagtcgagttgctatctttggtttaggtggtgttggcggatatgttggcgaagctttagtaagaagcagaattggctcatttgatctaattgacgatgataaaatctgtttaactaatccaaatcgtcaaattattgctacttatgatactgttggaaaatataaaactgatgtaatgaaagatggagtattgttaaattaatactccattttgattattattcatgaatcatcatctttataatttctttattcgtttccctcattccttctctacctaatcgtccaacactttgaattgttgcttcaacattttccatcactagtccgtcccctgatttaaattcctgtccatttttgtacatatgataacctaaaatagccgcatcaacactagaagcaatttttgctgcacaagaagcttttgctccatcacaaacaatacctgaaacattggcaagtgtattaacaattgtatgaatgacagcttgataatcttcatcgtataaataagcaattcctgcaccagctccagtagcggcacttactgccccacagtaagctgataaagttccaattccacttttttcatgaatcgccacaaggttagatagtgctaacgctctaaacattttttcttttgaaacctttaattcttgagcatagataataacaggtaaagaacatgtcatcccttgattaccactacccgaattaataacaaccggcaattcgcaaccattcattctcgcatcactaccagctgcagcataagccttcgctttattttttacatcattgccaaaagattttaaaagaacttttccaatattagctccataattatcatttaaacctgcacaagctattgcataattataatctatttgtctttctaaaatatcttgaatatctgtcaattcgacagtctttataaaatcataaatatcttttatatctaataatgaacgatctgctttttctttttttacaacacttttttcttcttgaaggatttgtccatttttttctatacaaacaacatgcatatgagaatcacttattctcacttttacatactcttttttattccaaaccgttattatgtaatcaaatacttttgaactatccaaaaaatgttcttcaaaatctactttttctatatattgatcaatttctttctttgttttttcatcaatttgacttaatacttctaaatatttatcatcattgcctcctatgattccagcacaaacagctgctttaattccttttaaatgatgtgtatgaggaacaatgacactctttacattttttataatacttccacttgcttctacaacaatttttgtaggtagatgatttaacacttttctagcaatacttgctccatacgctaatgaaatcggttctgtacatcccatagcaggtattaattcttcttttaatatttgaacaaatgcttgatatttttgctctgtctttttcatatgaatactccttgattaattgataactctagtttaatatgaatatgttatcaagtaaattaaacgtttttaataaagctgtttaatttttttaataggagactcttatggaaatacaagaacttatttcatttacaactattgttcaacaaggaagtttttcaaaagcttctaaaaaattagattattgtcaaggatctatcaccattcatatcaaaaatcttgaaagagaacttggtgtacaattatttgatcgcttaggtaaaaaagtaactcttacaaatcatggtaaaacattttatcagcactgtttgaagatacttgatgatatttcatgtgcgaaagaagccattaatccttcattagaacttaatggtcatcttacaattggaactattgattcattatgttcttccatagttcctcagcttatttgtaaatatcatcaataccaccctcatgtatctgtttcaattacaacagatacaatcgaaggacttttaaaaatgcttaaaaataacgatattgattttgcatacttagttgataaacaacttttagatacagattggctaaaaatatatcaatctaaagaagaagttacttttgtagcatcatgtcatcacccaatctgtaaaatcaaacagccaacaattcaagatatcctaacttatcccattattttaacagaaaaaaatgccagttatcgtcgccttctcgaagaaaagcttcatgaagacaatttagaaattaagccttttatccaatctaaaaatacagatttacttttagaactattgaaacttgatcaatatatcagttttttaccaaaatatattttagaaaatgatttaaaaaataaaacaatcactcaaatcaatcttcctgattaccaaattgatgtctatcgtcaacttctttgtcataaagataagtggctttctcatgaaatgaaagcattctttcaattaataaaagaaaaatattaaaaaagaattgcattttgcaattcttttataattcttctccattagacttacatactttttgataccagtagaaagagtctttacgtgcacgatgtaaatcaccgttgccatcatcatccatatcaacatagataaatccataacgttttctcatttcaccagttcctgctgaaaccacatcaatacatccccaaggcatatatcccattaaatcaacaccatcttcatcaactgcttttttcatttcaatgatatgttgtttcatataatcaatacgataaggatcatgaattgaaccatcttcttccactgtatcgatagctcctaaaccattttcaacgatccatagtggtttatgataacgatcccataattcatttaatacaatacgaagaccaactggatcaatttgccatccccaatcatttgcttttaaataagggtttttaacagcactttctaagttagaagctgtttttttagcatccgctttaacagttgcaacacttgttgaatagtaagaaaatccaatataatctactgtaccagcttttaatgtttctaaatctccatcttccatttttaattcaataccagcatttttatattcaataagtttccattctggatagaatcctttattttgaacatctgtatagaatgtacgtaatcttttttctgtaatacgtttccacatattttctggattacaatcttctggataaatttctgaataattgatcatcatcccaatttgaaattctggattgatttcatgaccacgaattactgtttttgctgcagcaacaagcatatgatgaacagcttgtgcaactttatctggtctagataaagcttctgtaattcctaagtttgtgtaatctttacagaaattgatttcattaaatgttaaccaatatttaactttatttttataacgattgaaaattgtttctacataatgcatatagaaatcaattgtttttctattataccaaccatcatattctgttgctagatgaagtggtaaatcaaaatgtacaattgttacttgtggttcaataccatattttaacatttcatcaaaaacatcatcatagaattttaaaccttcttcattaggttctttttcatccccatttgggaaaattcttgtccagttaatagacatacggaatgatttaaatcccatttgggcaaataatgcaatatcttctttataatgatgatagaaatcagttgccacatggcttggataatatgtatcttcatccacatatggtacagcaccatcaggtacttcagttccacgacgatcaataaattttgttgatccatcagcaagctttaaagccatacgtctaggaatattatttcttccatctccaccagtgattacatcttgaatagcaagtcctttaccaccacttaaatatccaccttcatattggtttgcagctgttgctcctccccaaaaaaatccttctttaaatcccattgatacttcctccttgttttcttataatattatattcatttttatgtattcggtttcattttttcactttatgaaaatctcattttcataataatacagaattcgttataataaatatatattcggagggataatatgaaattacatcaattacgttattttcaatgtctagctcattatttacattatcgtaaagcaagtgaagccctttatatttctcaacctacactttcatttgcaatcaaagaattagaaaaagaactagttgttgctttatttaaaaaagaaggaagaactattcaactttctcaagaaggaaaaatattcttagattatgtatcaaaaagtttacaaattttagatgaaggaattcatgctattcaaccaaaaaaagaaattaaaatttcatctattcctactgtcattaatagttttcttgtaccttttatcattcatttacaaaaagaacaacctcaaatcaacatacgatttcgtagtgaaaagacagaaacaattactcaaaaaatattagaaaatcaaagacaatcatttacaatatattcctcttattaaaagaaaacttgtcattgtactttcaaaagaaaatcctttatcaaaaaaagaaaaagtagaattaaaagatctattagattatcctttctatacttatcaaaaaaatatgacactttatagtacaattaaagatttatttataagtcaacatttaccctttaaacctactaactattttgatgatgaaaattcgatgattggtttagtaaatgctaatttagctgtttctattatggaagataatgatacgcttctttcttatcaaaatattataaaaaaagaaatttctcttccttataaagaaagagaaatctatattgtatatgatcctttaaatatttctaaattatctttagatattattcaagaaatgttaaattttaaaaatgtttgataaattttatctatcaaaccatagaaattatgatattgtttataattatctttttattttaaaattcttatataaaagtgagaattttttatggaaagaagtcaaataattgatataaaacaatttaatacattttatgatattaactatcattcaatttggttaaattaaacatatcaagaaaaatacactcattattgaagaaaaacaaaaaaatgaaaatatatttttcttacttcaaggtattgcttataattattgcctttttgaaaatgatagtaaaagaatactcaatattgaaaatcaagaacattttttaaacgaagacgctatctatcaagaatacgcttcttcaaatattaaagtcttaaaaaattctactattttagtaattcctatttctatcattaaatagttaatccatgataattttctattttcacaaaaaatacaatcatcgttagcttctaaatatacagaaaatcaaaatcttttaaaatttaattcttatcaaaatagtcaagcgcgtttaactatatatctttgttatttagctcataaacttggtatgccttatcaagatgacattgaaattccttttgatttttcagttgtttttctttctcaattaattggtgcaaaaagagaaacaacttctagaattttaaatcaacttattgatcaagattttatttactatcatcaaaaacacttagtcattaaaaatttaaatttatttaaccatttaaaaagtatcgctttttcgtgatacttttttaaaactctaaatttgaaatatctttgatatgttcaaccggcatttcttttccagtccataatttaaaagattctgctccttgataaagcatcataccttcgccattaatagcttttttaaccccaaattttctagcaactcttaataattcagtttctttaggagcataaacagtatctgctacataaaaatcttttcttaaataagtttcattcctactcctgttgcattaacaaataagtaagattcattcatttcttttcttaatgcttcatgatctgctcaatcaaaaactttagcttttgattgagtattttcattaatatttttacaattaaataaagcttgattataaaattcatcttttctattaaaaatagaaatctctgcgacaccatctaaagccgcttgtatttcaatagctgtaactgctccaccagccccaacaatcgttatttttttaccaataggatcaagattgctttcttttaacacttttataaaaccaacgccatcagtcgtagtaccagttaaaacaccatcatcattaataacagtattaactgcttggcccatcttagcaacaggtgttaagtgatctaaatactttacaattgttgttttattaggcatagagacattccatcctcttactttcattgcctttaaaccttctacagttttctctaaattttcatgattaacttcataacacatataacaataatctaatcctaacttagcaaatgcttcattatgcattgttggacttttagaatgtctaataggattagcaataagtcctattaattctgtattccagtcactctttcagtaatttctgccatttttattttcccctctacaataattctttttattttaataaatgaatactatttcttccctcttgtgttccttcaataatacgtctagctcttttacagtctccaatttctaaaacatcaccatttttatcttgataataatctttaagttgtaaataaagtggattataagctttcattcctaaacatacaaagccataatcaaatggaacttttatttcttgattttctttttctacaataaaatagttttcatgtacttcttttaattttgtttgtgtcatttgttttacatgatgtttttccatcatttcttttgtttgtgattttgtaacaggatcaagatctcttccaatttgattcatcatttcaataatagtaggtgatgcccctctattagcaaaatattcagcaacatctaatcctactgctcctccaccaacaataacaatctctttattggttgtatcagctggataaagatctagatgattcataaatttatcaatactactcaccttatgattatctaaatcaatattttcctttaatccactaattggtggaaggattggttttgaaccagttgcaacaacaatatcaagtttaaaattatcaacaaaattaacgtttgcttctactccttttaaaataaatcgtgtaacttttctgctcttttttctaaatacttaggaaaatgagctattcttgttttttcaggtatttgactaatttatctagctaagccacctaaagttttttctttttctattaaaaatgttgtacatcctacttcacttgcagtacaagctgcttcaagtcctgctgttcccccaccaataactactacattcgttttcttatttactttttgttttttataaaaatcatcatagaaagcatctggattaactgtacaacggattggtctatttaatccaatacgatgtcctgcacatccaatattacaagaaatacattgacgaatttcatctatttttcctgttttgactttatgaggccaacttggatctgcaattgtttgacgacccattccaattaaatcagcatcttggttttcaagaatttcacaagcactttgaggattgcgaatatttcctgatgtcatgactattttatcaggaaaaacttctttaatagcacgtgccatataacgacaccatccatcaggataatatgaagcatctatttgtttatgaattgaatcacttaatcctgcagaaacatcaatcatatcaacttcttttacaaagtatttaagtcattcaatgctatcttctaatgtattaccaccatctaaaaattcatctgcagaaattcttataataacaggaaaacgtggaccgactacttttcttactttttctacaatattttagcaaaacgtgcacgattttctatatttccaccaaattcatccgttctatcattcgtaagtggtgataaaaattgtgaaattagatatgaatgtcctgcatgtatttcaatggcatcaaaacctattgtttgagctcttttagctgaggttgcataatcatcagcgatactataaatttcctcaactgataattttcttggaatagcaccgcattctttatttggtaaattacttgcagaaacaggttgcataccaatacgactttccaaggcacttgctcctgcatgatttaattggatagcaattttagctccatattgatgaattgtctcacataatttataaagtcttggtatataattatcagcatctattctaagttgtgtagttccattacttccctctggatatttcacacaagcattttcaacaatcataagctcataacctccttgaactcttctttcataataatccatatgtagaaaactcatttctccattttgttcaccaaaattagttcccataggtgtcatgactaatctattttctaatgttaatccattaatttctattgattcaaataagtttttatattggttcattgatatccctccacatattattcaaacaaatagaaaaataataaaaaataacaaaaccgtgatatatatcacaaaaaaagaatatgtccttaaaacatactcttaatacttaatatctaacaattctttaaaacaatttaaatgataatctgcaaaagtgcaatgataagcacttgataaagctgctacattcatagaagcgcttttagcagcaaaacatcctgaaattgcatcttctacaactaaacattctttataaggaatattaagcaagtctgcagctttcatgaaaacctctggatgtggttttgaatactgaatagaatttccatcgctaattgcatcaaagaaagtatctaaacctagttgttttaaaataagcattgtatttttacttgaagatccaatagcaagttttaatcctttttttcttaattgttctagtgtttctttgacttctttagataaatcttttgtagacatttttaataaatattgttgataaagcttattttttctatcagcaaattgttctttttcttttaatgaatagttttcttttgatttttctaaaataatatctaaactttccattctagaaacacctcttaaacgttcattatctttttcatcaaaaggaatatttaaatcatctgctaaagatttccaagctaaataatgataatgatctgttgaacaaataacaccatctaaatcaaaaataatggctttcatctttttgtatcccaccttccacaatagacatcaactggactttttccaacaaatttttcttttccaagaagcttatccactaaaacttgtaatgtttgatcattgtttgtataacaattaatataagtttttatcattggtacatcaaaaagatgatatggattagcaagagagacaaaaatagttggcacatcttgcataaaccatggcgcatttgctgccattaattttatccattctactcttcttgtcgtttgattactcgctgtatcataattagctacataaatgactagatcacatttttctttgatatcttttataccaccttcaaatacctcttgaaaatctaaacgttttgtatcaaattcataaacattgaatccctctttttgtaataaattggttagtgatagttgtgttccttcttctttaaaaccaccattatcttgatcagttagattatatattctaatttttttgtatttatcacttgttaatggtaaaacacctttttgttctttaactaaagtaatagcttgtttagcgcattcttttgctaagctttgatgttcgatacaacctacaatcttttcagattcttctacctcactatgatcaaacaagccatttgccatctttgtaccaataattcttaaaacagcttcatctaatcttttttgagataaaagtccttcttttaaaccattttttataaacatgtagtcttcatcgatatttttattaaataaaatcatatcacaacctctttcaatacatagaggtaatgcttttgatctagacatagctacattaaacccaatcattgctgtagcatctgttacaactaatccattaaatcctaatttgtttcttaataacactgttaaaatctcttttgataaacttgctggcatatagtcttcttcattgcattcaggatttatttctttaatataatgaggtaataagatatgcccaaccatgattgaacctattccattattaataaaatgttgatatatttttccataactattattccacttatcaacggttaaatcatttacactacttaatagatgctgatctctcatatccacaccatctcctgggaagtgtttaatacaaggtaaaatatggttttctttaagtgcttcaatttgacaatcagcaaatttaataattgtttcttgatttgaaccataagttctaatatttgtaataggattcaaaaaattataatcaatatcaacaataggagcaaatgaccagttacatcctactgcgtgtgcctctttacctgcaatcattcctaaatcataagcaaatttttcttgattagtagcagcaacagacatttgtctagcaaaatatgtaccatcaaggcaaatgccatttcccccactttctaaattagcagccaataataatggtattttactttggctttgaagtctatgatgaattctttttatctcttttgaaggaagtgggcgatacatcattgctcctggtttatatttttgaatgaattcgtctatttctttttcatcttgaacattacctataggacaaaagatttgtcctattttttcgtctaatgtcatatcactacatatcttagtaactttttgaatttgttcatcatttaaattaaatggatttgttgataaatctatcatatattttctccatttctttcaataatttctttataccaataaaaagaatctttcttataacgtttacaatccataatatcttgatctgtgcgattgacataaactagaccatatctttttgaaaaaccttggtgtgaactaacaacatcaataaacgaccatggacaatatccaaaaacaggatatccttcttcttttgcacgtaatacttctttaatatgggctgaaagatattcaatacgataagtatcatgaactctattattttctaatacatcactataagccataccattttcagtaataataataggtaaagcataacgattataaattttatagataatacttctaattcctaatggatctattccattagacatccattttgttttctttaaatgttcattaggacaaacttcaaacatagaacttctaaaaaatggcggtaattgataattaatacgatgttctttgttttcttttacacaaatagatgaataatagtttattcctataaaatctggtttagaagatttgagaatttcatcatcccctttttcttgaactggataacaatccatattctttaaaatactttttactctaaatgaataatttcctttaacagacatatctaaaagcatatacatcattaattcctcagcatccattgctgctaaaacatcttcaggagatgaactatatggataaacattttgaacagcatttacgacaccaatttttgcatttacatcaatttctttaagtaatttcattactttcttttctgctaatgaagcatgatatgacatttgatacatattttttgtttgtaatactttatcattttcatgatttccatttagatcacttgctgccatagcaatcaattgttcattgattgtcacccaatgcttgatcgtaccttgccatttttgaaagcagattttagcatattcaacaaaagcatcgatacattttctacttttccaaccaccaaattcgtcaactaatgcttgaggcatttcaaaatgataaagtgttggaatcggttcaatatcattttctaaacataattgaataatttgatcataaaattcaagaccctcttgattgacatgatgtccatctggcataattcttgcccaacaaaaagagaaacgatatgcttttaatcccaattctttcatcaaaagaatatcttctttaaaatgatgataatgatcacttgctacttttgtatcagcaataccttctttaacatgacgtacatctgttgttgaaagtcccttaccacctaaattgtagcctccttctacttgaaagccactgattgaagcaccccataaaaatttattcatgttgatctcctttttcattcattaatgcttgattatcaagtgttttaaagaatggataataaataataatcgaaataacaacagcaactaattggaaaataccccaagataaactaccttgcataattcctgaaataagtggtggcattgaacccaatcctaaaattccaattggagcggtcacaattccaaattgaattaatgcatatcctaaacaaaccaaaacaattggacaaagaataaaaggaataagcataattggatttaaaataactggtaatccaaaaataacaggttcattaacactaaagattccacatggtaatgttagttttccaaatgatttatattgttcacttttagctttaaagaacattaaaataacaagaccaattgtagcacctgaaccacctaaattagctaaatcccataatccaatatttaatacatgaggaattgctttccctgcagccatggctgctgtgttatctccaatataactaagccaaattggaaataaaataggtaatactgtcattgatccatgaattccaaagaaccataataattgtgcaattaaaataataatgataaatgctggtaaatttcctgttaatgattgaagtggtgtttgaataattgtataaatgcaatcagttgcatttccataagctgtcattgcaaataacgctcttaatactaaaaatacaatggtaatgataactcctgctaataaagatgataaagattcactgaccatttctggtacagaatcaggtaatttaataacaatatttttttcagtaattaaagctaataatctagaaaccactagtcctgcaagtaatgctacgaaaactccttttgttcctaaataagctgtattaaagaaactaattccactatctgctaaagttgtactatctaatggaataagtaacatataagcaaataaagataaaaaacctgatgttaaagtatattttttatttccaaatacagttgctccacgatatcctactgcaaaagccatataaacagctaataaatttgtagtaacattttgaactcctgtaaataactgacctaaccctgttttagcaagtaaatctgtataaggttgccatgaaatattcgttaaaattgtaaaaactgcacctaacatgattattccaagagtagacatacatccaccactaattgcatttaaatatttgttttgtgataatttattagcaactggaacaagtgttttttctataatagatattaatttttccatttcctattctcctttatgtatctgacattggcctttgtctacattgagtataacaagaaaaagaaaaaaataagtcatcaaaaaaccagtgctattttcaaaaataaacactggttttcataatctgaaaattttattaataagtaaaataaatacaataatacatgatgattatttctagtgtataaagtaatgatatgcgagattcagtatttgtattatcttgactgcataaaataacttctcgatcaataaattcatttatcattttttgatgttcattcattgttaaaacaacaagtttaactttcttttcaagaagaatttgtataacttcattatgacgataaaaatagccaccttcaacacttaaaataataacagtactaccttcttttaaagcatgtgcactttctaactgttcttcattagaaatagctacagaaatatacttattcattaaagcaaaacgattttgtacatgttgagctagtaaagttgaaaactctaatccaagaattaaaacgtcatcactatcgtgtatataagaacaaatacgatctaattgttcaaaatcaagatgatcataagaaaattgaatattatttattacacgatttgtataatgctgaagaatttccttaacatcatttttatttgcttttatcactttaggagaataatcagtttttgaaatatccaatgtattcaaacaggcgtttttaaattcttgaaaagaatgaaatccaataagtttaacaaaacgtgaaattgatgctggtgaaacatagcataaatctgatatttcattaattgtttttttaggaatctcactataatgtgttaaaagagctagtgctatatcataatttgtatcttttttatattgaccattaacatatcttaataatattgataatactgaatttgtatccataactactcctctatatcatatgatgatattattttaacacatttttttatttttataaattttctgctaataattctactaaatgaatcgttctataccacctattttaagtcctttttcacaaccattacaataaactaatatattatttttataatgtttgacccattctttcattttcttttcttgaatattttgtggtaaaagttcaatatagtgttcttttaatctttgcattgtttgaggtgcaattttgaacaagtatatctccttcctttaaaaaatcatctttacttcgacaatacttatcaataatagcgccttgtccttgcatatattttgtaattttatgaatagcttgttcatgattttttcttacatcataacctccttcatattgattagcagcacttgttccaccctataaaaaatctttattcatcttttaacctcctcgtttttttattttatatattattttaatatattaaaaaatcggttataaactatggtataagatttcggtttttatttaaaataacaaaaaaagcgaaatttaagttcgcttttaatccaattcattaataatgaaagagtttcttcctgcatcctttgcttcatacatagacttatctcctaaacgaattaattctgtataatctgcatccttacctttcataatagcaatacatatactgcaagatactgagatagtttgttgactattattatcataaaaaccactttttaataattgaagaagtctattcatctctttttaccaacaaaacaaaaaataaattcatctccaccaacacgccctattttacctttaagttgttcttttaaaacagccgatacaaattgaagtaccttatctccaacttgatgtccaaaataagtattaaaatctttaaaatgatcaatatctaaaaaccctaaagtaatttgtccatctttttctgcttgagcttgcaatattttttgtttttcttgatctcgatttttttctttttctatgtaatctaataattcattaatacttatagcaagtttactaaattcatctttttgattggtttctaatctaattgaataatcttgtgtacgtttgatttgttcaaaagcttgtatttctttttgaaaaggaaaagttatctgttgagcaaagaaactttgaatcaatattgctcctataactaataaaataaagaccaataaataatatattctaaaagattgaatactttctttttgtcttgtatcaccttcttatcaagtataaagtttgctacttccttttgggaagttaataaatgtgttgtttctaatttttgaataattgacatgattttcaccccattttggtaattctttgacctatttttaagtagattagttcacctatcattcctatacctatccctgataaaataccaaataacattaaatagggtaaataataaataaatacagaagaattaaagaaacacatagcaacgagtagttgtccaatattatgaaatacaccacccataattgaaataataagatgtgaaaatagttttgttttattaaatataaacattatgaataatgataaaataccacctgctaaactataaagaaacatataaagatttgtaaaagccatagctacaatcataattctaagtaataaaacaattaaagcttctttaaaaccaaaacataaaagcaacgtaagggtaacaacattagcaagacctatcttagctcctggaattcctagataaaaaggaaatagtgtttcaatataacttaaaacaattgcaattgcacaaaacaaagaaagatagcataattttctaatagacttttccatcttgtacttcctcttttccttcttttatttctattattaaatgatgtggtaaacaaacaattgttgatccttttttatcaattgttccttgtttaatacataaatgatctggacaagtagcttgtatcatttttactttttgattttttatttgaatcgtatttttttgatctatttttatgatttgatcttcatttaaagaataataaccatatatttgattatcttttgttatttctattaattgaccttgttttcttgatttaaagaaaaataatcctccaatgattaaaaataaaataacaataacaaccaaatcatttcttaatgttttatttttcattttttcactccatgatataataagataaaggtggtctatatgaaaaaaatacttatttctatcattattttttcatttttattatgtggttgtcaaaaaacaacaccgctatctcataaagaattttgtttagatacaattgtacaaattactttgtatgattcatcctctaaaaatattttaaataactgtttcaatttatgcaagaagtatgaacttgtcttttcagcgaataataaagaaagtgaactctataaaatcaatcatgctcatcacaaattagatgaacaacctctttctaaagaactttttaaagtcattaaagaaggtctttattatagtcaactttctcaaggtgcttttgatataaccattggttctgtttcttcattatggaactttaaagaaaataaacttcctgatgatcaacaaattaaaactcatttaaatgatatatcttatcaaaatattatattagataatcaaaaaatacgctttttaaatgaacaaacaatgatagatttaggtgcgatagctaaaggatatatcgctgatcaaattaaaagttatctattaaaaaataaggttaacagtgctttaattaatttaggtggtaatattttatgtgttggtcaaaaaaataataatccattttctataggcattactgatcctcaaaatacaaatcattcaatacttagtttaaatattaataatttatcgattgtaacaagtggtacgtatcaaagatatattgaaattaattcaaaaaaatatcatcatattttaaatccctcaactggatattgttatgataatgatttatcttctgttactattgtatctaaaagttctttacaaggagatgctttaagtacggtttgttttgctttaggtaaagaaaaaggattagcattactcaattcaataaaaaacgtttcaggatgttttattgatgatcataatcaaataagctatagtaaaaattttaaaaaatatctttcaaattaaaaactccttttgggagtttttattcaataatctttctaggacatttttctttacattttccacaatgaatacattttgtataatcgatatgtgctaaaaaatcatctactgtaattgcttgagttggacatacctttgtacatagcatgcatccaaggcatcctgctttacaatttttattaacaatagctcctttatcatgactattgcatctaacatgactatttgcttcataaggtaccatttcaataagatgttgtgggcaaacatccatacatttttgacatgatttacatttatcctgatctacttgagcaataccatcaataatatgaatagcatcaaaagcacaagctttaacacaacttccatacccaatacaaccaaaacgacactttttatcaccactaccaggaacaatggcggcacttaaacaatcatgaataccatcatattgatattgtgtttgaatttgatcacaagtccctttacattttacataagctactaaatgtacatggttttctacttctagatgcatgatttcacctatttttttagcaacttcttcgcccccaacaggacattgattgatgggtgcttcttttttagcaatggcacaagcaagtccatcacatcctggatagccacaagccccacaattattacctggaagaactgcccttattttttcttcattttcatctactttcacttcaaattttatacttgctagcgaaagtaaaattccaatcagtaaacctattattcctacaacaagaatcgaaataatcatatgcattcctcctaaattaatcctgaaaagccaataaatgcaattgccataagaccggcagtaattaaaacaatgggtgaaccttgaagtacatgaggaatatcattatcagcaattctttctcttataccagctaatattgtaatagaaattgtaaatcctaaagctgttccaaatccagcaacaacgcttgtaataaaattataatgattttgtacatttgttaaagcaacacctaaaactgcacaattcgttgtaatcaatggtaagtaaacacctaatgcattatataaagctgttgagtatttttttaaaaacaattcaacaagttgtactaaagcagcaataataagaataaaagttactgtttctaagtattctacatgtaataaaacaagtaaacgatataaaacgtgagtaactgcagaagcaatcgtaataacaaaaataactgcaccacccatcgaaagagctgtttttgtttgtttagaaacgcctaaaaatggacataatcctaaaaattgtgataaaacaacattattaactaaagatacactaatgagtgttagtataagtgttttcattttttatgatcctcctttaacaaggatttattaatttggcattgactaccatgacaatgtaaacaatcccctccacattttaaagatgaattttgtacatttgttgcactaggtagctttaatttattttgaatagctgttaataaagctaagataaagaatgctcctggtgccattacaaaaatagtaattggttcaaaggaaataggtaaagtcattgaaaatgctgttccagaacctaaaatttctcttactaaacctattgaggttaatgcgagagtaaaacctaaccccattcctaatccatccattatagaaagaagcggattatttttagaagcaaaagcttctgctcttcctaaaataatacaattgacaacaattaaaggaatataaataccaagtgtatcatataaagatggaatatatccttgtaataataattgtacaactgtaacaagagaagcaacaatgacaatataagcaggaatacgcatacgactaggaataatatttctaagtgctgaaataacaaaattcgacataattaaaaccaccatcgtcgtaagtcccattcccattccattcattgctgaggttgtaaccgcaagagttgggcacataccaagcattaatacaaaggtaggattttctttaatgattccattatataaaggttttaaatacttcttcatattttcatcttcctttcaataaatcataaaaatctaaggctccattgattccatttgtcattgctttagaagtaatggttgctcctgataaagaatctacttcatcttcattttgtttaccatttttaacgacttggaaatgatctacttttttccctacatactgatttctaaactcttcatttttagcattcattccaagtcctactgtttcatcaattgataaaatttcaactcctgtaatttctttttgaagattgataccaacaattaactcaatatctccaccaaaaccatcatgatcaacaacttgaataatatagcctatactctctttttgtttaaaagattttaaagctttttcaattgttatcccatttttaccataattattttttaattgtttagctaatttattgatttcttttgaattaatttctttaaatgatgttgcttctttcatgacttctaaataagcatcttgttgactttgttgagcttgtttttcaatagggcttagagtaatttggtaaacataacctaaaacaccaccacatatgaccgtaataatacataaaataagaatatcttttattattttcttcattgataaacaccgccttttaaagtgaatttatcaattaacggaacaagtaaattagaaataataattgcataagaaacaccttctgtactagttccaaaaaaacgaaataatcccgttaaaacacctaataaaactccataaattatttgtcctttttgatccatcggacttgttacataatcagtagccataaagaatgcccctaaaataagtcctcctccacaaagctcacaagttaaatagtaaaaatcaaaagaacaaggtgaaaataataatgtaaaaatagaaaaagttatgatataagtcattggaattgttaatttaataactcctttaataagtaaataaacaactcctataagcaaagcaaccgtagaagtttcccctattgttccagcagtatttccaataaacatccttattaaatcaaagctttctccattttttaaaattgcaagtggcgttgatgaagtcatcccgtcaaatgcaaaatttgtcattcttccagtaaaggaaatcaataaaaaacatcttgctgctaaagctggattcataaaattttgtcctaagcctccataaaattgtttaaccacaataatagcaaagagaccaccaataacaggaagccataaaggaactgttgatggtaaatttaaagcaagaataagtcctgtgacaactgctgatagatctttgatggtaattgtttttttcataaaacgttcatataaatattctgctaaaacacatgttgttatcgttgttacaataatcaataaagcatttattttaaattgaataattccaaataaagtagctggtattaaagcaataatgacatctaacataatagaagatgttgtaacacgatctttaatatgcggtgaagcagaaacatgtagtaattgattcatgaataacacctactttcttttattaatagagactaaatatttcatcttcttaaatgcctgtgtcatatttctttttgctggacatgtatagctacaacaaccacattctatacattccattccaccatttaaaataaaggcctctgtatcattttttgttgctatttgataaagtttttgaggaactaataaactcggacacacgtctttacatcgaccacaacgaatacatgcagaaggttcaaaaagggatacttcatcttgtacaagtgcaagtaaagaacttgatgtcttagttacaggtatatctaaatgaataagggcacttcccatcattggacctccacaaataagtttttgaacttcagatttgaaacctcctaattgttcaacaatccatttaaaactcgttcctataggaacttcaatattgctaggtgttattccatcacccgaaatcgtcattactttagaaattaaaggttgattataacgaaccgcttggttaatagcaatcactgttgctacattatcaacaatacatcctacatctaaaggaagcattttagaatttaatgtctttcctgttaaaaccttaacaagcattctttctccaccttgaggatattttgtttttagttctttcacagcaattcttttttcatctttacacttttcttttaataaatgaatagcctcttttttattatcttcaatggcaatataacaaagagcttttggaaacatttctaatagaacatgaattcctgctattagttcatctgttttttcaagcatcaagcgataatcacttgtaagatagggttcacattccgcaccattaacaatataatattgaacttgatttgaatctttaacagataattttacatgtgtaggaaaccctgctcctcctagaccaactatacctgctgccttaattctttcaattttttcttcataagttaattcttgtttattattattattttcaactttttgatataatccatcattagcaataacaattgattcttgcattttcccactgacatccattctttcttctattttttttactacacctgaaactgaagaaataataggacttgatacaaattgatctgaagtagctattatttgtcctacttttacattatcttttatttttacaattggttgacaaggtgcaccaatatgttgttttaaaggaaatacaacttcatcacttgcttttattttaataataggtaaatcctttgtatattgtttttgatcttttggatgtatacctccaataaatgattttaaactcataacttccatcccctttaaccctattttagtcctattattttcaaattgaaagcgtttacaacaagttaaaaaattaacttgttttctttgaaatatatgaaaattatgtgattttaatcacatttaaatataaaaaaaagatagctttcgctatcttaaaaatactaattttgttcataaaattcttcgtcatctaacattggataagttgtaagttgttgtgcatctaaatttactttatgcatattaactgctgtaatttgtcttctattataagttgtgtaataatagattcctttttgactattccaacatgaagtataaattgtaatttcatatttaccatctgctacttcacaacatcctctttgttgttcaactgaacctaaaatatgaaaaaattgattaacactatctctttcattatcttttgattgtccgttcattttagtaaatgcaacacgtacaaaacgtgacattgaagataaatcaccaggtaaaccaagtgctcccatacctcttgaatatgtttgtaaatctaattctttagaaaaaagattttgcggttgttttggagaaagcgacatgtaattatttaagttgaataattgtttatcaaatgaaggattatttgcaagaactcctacaggattttcatagatttttaatccttcttcgactgattcaacagttatacatccactttgatctgcaataatccaatgtaatgaagctacaggtaattgttcattataaggagtattcactaaattcattgtttgaataagttgtttagcttctttaagcgttgcacattgacttaaaacccaaggaatgaattcatattgagcaacgttgactgctccttctttaacctcttgataacaagcatttccgacaaaatttaatcctgccattcctaaacctttttcattaacagcatcatagtataatggataatcttcaactacatgagccataccaatcatggcataatgttcaatattttttaatccatgtctatattgtaaaggatagtttctcggcataatagctattttttcaccataggaaaattcataatccaaagttctacccatataaaaatcttttgtttgataagttgctgctgtacacatataaaatctctccttcttttcattgttttgctattatatagtataacccatttatttcatctttatgaattagaaaagaaaaacactcctaagagtgtttttcgaatattatttaacttcaacaagttctaaatagcttgttgcacctttaactcctggtgttccaccagtaactaagattttttgaccaggttttacaccattttctctagcaataatacttgcataatcaatcattgaaatacgtgaatttaatggtttacaaggaacagctttaacaccccagtttaaagctaatgcttttactgtttttatagatggagttgctgctataatacgagattttgtacgataacgcgccattttacgagcagtaaatcctgattctgtaaaggctataatcgctgctacattaaatttataagcaatttcagcaactgacatacaaatagcttcacttgtatcatctggtgctgtacgaatagcttgtctttgtaagctttgataatccaaagttccttctgtttttaaagcaattttagacatcatcatgactgcttcttgaggataaagaccacttgctgattctccagataacatgattgcatctgtaccatcataaatcgcattagccacgtcagatacttccgcacgtgttggtcttggattttgttgcatactttctaacatttgagtggcagtaataacgattttaccacgttgtttacattttttaataattgatttttgaataagtgggacatcttcagcaggaacttctacacctaagtcaccacgagcaaccatgataccatcagcaatatcaagaatttcatcaacattttcaacaccttcttgattttcaatcttagctaaaatttgaatatcatttctaccattttcaattaataattttttgatatcaataatatcttgtgctcttcgacagaatgaagcagctacataatcaaaaggttgacctgctccaaatgttaaatctgaaatatctttaggtgataaataatcaaatcctaatttaatacctggaacattgattccacgtttattttttacttctccatcatttgctgcaacacaaacaatatcagttccttcaatatgatcaactaataattctacttgaccatcgtttactaagatataaccaccaggtttaacatctttatataaatctttataagtgattgtaaatctttcacttgtaccttcgatatcttctacacaaataatagaagtttgcccttttttaaaagtagttttaccaccaacaaaatcacctgtacgaatttcaggtccttttgtatctaataaaatagcaacatttgtagataattctttattaatttctaataatgtagtaattttttctgcatgttcttcatgtgttccatgtgagaaatttaatctcatgacattcattccagcttttactaattttgtaagcatttctttgctttcagatgctggccctacagtacatacaatttttgtttttgacataatctcgtttttcttcataacttttgccttcctttactctctacaattttaagtataaacctatttttttactttaacaatggacaaaagtaatgtaagcacatccacttgaaaatattttttttaatgtaaatttgttacatctatttatatgatttatcaaaaacaagaaaatatttttctattaaaaaaaccttttaaagtaagctctaaaaggtttaaatattattggtattcaaaataatctttactatgatgtactgcaatttctagaggtaaagtttctaataattctggtaatttttcttcaatgatcacttctaaatgatgccctggatctattaataaacaatcatgatctatcgcatatttagcatgacgatatttagtatcacctgtaatataacaatctacttgatcagcaagaatttctaagtcgtctgctgcacttcccccgcaaatagcaattgtatgtatcattttatttgtatttttactatattttaaatgttctatatgaaaaatgtcttttactttttcaatgaaatcttttccatttatagcttcatttaaaatagctttctttccaacttcataatgatcataacaagtaacatcatgaacacctaacttttgaatcaaccaatcattcattgaaataccattttgtcctcgatctaaacatgtgtgtaaactataaacaacaatatcatgtttcatggctgttgaaataaattttccttgatgtaaagaagtatctaaatttttaatcttttctaataaaaaaggatgatgtgtaattaacatttgacaattattttcaatacaggcttgtaatgtttcattatcagcgtttaaagcaatataaacttttttaacttccttttctctacttccaatttgtagaccacagcaatcaaaatccatttgaagatttaaaggaaaatatttctccaaatgattcataatttcataagctttcattaagttcaccttcaattaattgtttttgtttttctaattctaaatatcttggatgatttgatggcaaatctttcataatctttaaatatgtttgatattgtttttgccaataacgaataaataattcatctttattttttcttaaaactggaccaaacatcatatcttcttgattatattgaatatcttgatttgtattttctacaaccatcatttcataaatatgatgaccatctttaatcatcttttcatcaacaattttaaaatgatttttaaataaatattttcttagatgatccgtattagcgttaggttgtaaatagaattgtttaactttgtttaaatacgctttatttttttctaatatttctacaattagaaatgatcccattccagcaatcgttaccatatcaacttctttatcaagaataggatctaatccatctcctaataatgcttctacattttcttcaaaatgatattgcttaatagtagaaagtgacgccgcaaaaggaccttttgcgacatcacaggcataagctttatctataatatttttttcaattaaataacatggcaaataagcatgatctgttccaatatctgccaagatatttccttttttatgtttttctaccaaataagcaagtaattctaatctttttgatagtttcattaacgatctaagaaatcctttaatcttttagaacgagatggatgttttaattttcttaatgcttttgcttcaatttgacgaatacgttcacgtgtaacgttaaattcacgacctacttcttcaagagttcttgttctaccatcatctaatccaaaacgaagtcttaaaactttttcttcacgatcagtaagttctaataaaacatcatttaattcatcttttaataattcatttgctgcataatcatttggtgacatagcgccttcatcttcaataaaatcacctaaatgagaatcatcttcttcaccaattggtgtttctaatgaaacgggttctaaagagattttttgaatttcacgtactttttctggtgtcataccatccattttttcagcaatttcttcagcagatggttctctacctaattcttgaattaattgtctttgaatacgtgttaatttattgattgtttctaccatgtgtactggaatacgaattgtacgggcttgatcggcaattgcacgtgtaattgcttgtctaatccaccaagtcgcataagtagagaatttaaatccttttgtataatcaaatttttctactgctttaattaaccccatgtttccttcttggattaaatctaagaataacattccacgtccaacatatcttttagcgatggaaacaactaatcttaagtttgctgcagcaagttcttttttagcttgttcatctccttcaagaattcttttagctaattcaatttcttgatcatgatttaataattcaactcgcccaatttctttaagatacatttttacaggatcattaattttaacattacttccaagttgagtgctttcactttctttatcatcatcatgttcttgatacatatgtaatgtatcccctgtcatcatatcgaaatcaccatcaaaatctaaatcaggagtatcgtctgcatcatctatatcaaggtctaaatcatcatccattgtaggaacgcctgcaagtaacatatcatcatctacatctaatgaatctaaatcatcatcagaaatggtaatttgattttgttgaatatattcaagtaattcttctgcgagttcatcacttaaatcataattcattaaatattcatcaatttgttcttgggttaatacattgttattgttttttgcttcatttacaactaatttttttaaatcatcaaatgaaactgcttgtacttttttctttgccatagtttactccttatcttttgattctataatttcttgaagaatttttgcttgttgacgaggatcatatgtttgtgatagctcctgttcaagttgtttaattcgttcaattttaagtttttcttgtattattttgatataatcatcaattgcttgatttgattctaattgaggtaaatgtaaagatgatatctctaaaattcttttaacaatatcttgatcatcaatcatattaatcaaatcagcaacttctaaaatgacgtactgacgataataatcaataatataggaagcaattaagcgattaactttatcatacatatagcctgcttttgcttcatattccatcgcatactttttatcctgcatcatataatataacaaatctctttcagccttttgatacttatcaatcaatcttgaaacatgatcataagtcactggtctaaaaggtattggtttttttacaagagtttgttgactcattaaatgatgaattgtttctttagaaaatcctgattttttttcaagttgaccaatataataatcttgatcaacaatatcatccaattgcatgatgactttaaccatggattctaaataattttttcgatcttcataattatcaacattgatacgttcataataataatttaatttaaactcaacagcacttattggatttttaaaaagtgctattaattcatcttttcctttagcttctagaaattcatctggatccattgcatcaggaataaccacgattgatgtatgaaatccttcattatttaaagcatccacacattttatcatcgcattttttccagcttgatcaccatcaagacataaaacaatatcatttgataatcgttttaacatttttaaatgttgtgaagttaaagctgttcccataattgcgacagtatttttaatacccgctttatataatgctattacatccataaaaccttctagaataataactttaccttcatttctaacatcattttttatacgatggtaattgtataaggtctctcctttaataaaaattttagattcaggagagttcatatacttggattctttttgatttttttgatagatacgaccactaaagccaacaacacgtccttcactattatgtaaaggaaacataatacgattggaatagcgatcatatcccacttcagattctataacaagtcctgattcataagcttgcattcttgaaaaaccagatttttcaaaagcttttaataaaatattttgttccggtgcataaccaatttcaaaatagtcaataatatctttagataaatgtctttgacttaaataactatttgcttctaaagcaagcttcgtcgttaaataatgtttataaatacgattagcttcttcatgcattaaatagtatggttctaattcttgatttacatgtggtttttcttcataaaatgtaaaatcacctaaatcaacatttcccatttgagccaccattttgacagcttccataaaggaaatttttaagtaatcttgtaagaaagtaaacacatttccaccgtgtgaacatacaaaacatctatagatctgcttttcaggtgaaacagacattgatggatgatcatcattgtgaaatgggcaccttgctaaataattacgtcctcttctttctaaaggaagataattgccaataacatcaacgatatcaacgctttgtcttatttcattgattttttcatttgaaagtcttggcataataatctcctttattagaatgtaattttatcttgaatataacctactaattgatcaattggtaaacgtacttgttccatggtatctctatcacgaacagtaacagcattgtcttccattgtatcaaaatcaacagtcacacaatatggtgttccaatagcatcttgacgacgatatcttttaccaatttgacctgcaacatcaaattcaacagagaaatgtttagcaagtgttgcataaacttcttcagctttttcactttgttttttagtaagtggtaaaactgctactttatatggagcaatggcaggatgtaatttcatcactgttcttgtatctccattttctaatgtttcttcttgataactatcacagaaaatagataagaataaacggtctgcccctacagatggttcaataacatatggaatatatttttcatttgtttgaggatctaaatattctaaagattttttagaatgttccatatgacgagataaatcataatctgtacggtctgcaataccccataattcaccccatccaaatgggaatttatattcaacatcacatgtagccttagaatagaaagataattcttctttttcatgatctctgaattttaaattttcttcttttaatcctaagtctaataagaattttttacaataagctttccaataatcaaaccattctaaatcagtatctggtttacaaaagaattctaattccatttgttcaaattctcttgttctaaaaataaagttacctggtgtaatttcatttctgaatgatttaccaatttgaccaataccaaatggtacttttttacgagaagttctttgaatatttttaaagtttacaaagattccttgtgcagtttctggacgtaaataaacaacagatttatcatcttcaacaacacccatatgtgtttcaaacattaatttaaattgtctaacatcagtgaaattactttttccacagttaggacaaacaatattatgttctttaatataagacattgtttgttcattagaccaaccttcactatgtacagaaggatcatatgcttcaattaatttatctgcacgatgtcttgttttacattctttacagtcaattaacggatcagagaaaccaccaacatgtcctgaagcttcccatacctttggattcatgaaaatagctgaatctaaaccaacgttataaggagattcttgaatgaatcttttccaccataaacgtttaatattgtttttcatttcaacccctaatggtccataatcccaagtatttgctagtccatcatagatttctgaaccttgatatacaaaaccagttgattttgcatgatttactaatttatccatatctttagttgccataattttctccttttttacgatataaatgaataaagacttggctttccaagtcttctatcttcttttcgcgtacaaataaaatacccttatagtggatgtttgtcaaccaactataagggtactatatataggttctttcgtctaaccaatgcataatatcatgatagacatctcgataattattatcatgtaaaatatcttgtcttttattatcataaatcttatattggagatcttttagaccatttccttttaatatttgataaagttttatagtatcttttccatttttagtaagattatcaaaaccacctgataataaataaacaggtaaataatcaggtatatgttttagatgatcttcatcacttacatattttatgtattccaatatatcatgataggcttgatttgtataaacaaaatcacttaaaggatcttcttgataaagctgtacttctttttgattactcattttataacaaccatttaaatttttttgtaaaaataaatcaactgctttttttattactcttgaacgattcatttgtccatgtagtaaaatatttaaatcaacaatcgttttcatacgataataaaaattatttttcatacatgttccaagcataatcattccattaatataatctccatacgtcatggcatatttaagtaatacgagcgaaccaaaatcaacaccaatcataaaataaggaaggtcttcatatcttttagcgataatatgtcttaaacgttgcatatcttcaatcaaagtatcaagcgcatttccgcttccaaaatagccttgttcaaaatgataaagtgatgtaccatgcccaggaaaatcaggcacgactacaataaaaccttcatgacttaaatattccgcaaatttttgataacggtctgaatgttcacataatccatgatgaagttgaatgattcccttatatcttaataccacatttggttgataaatatcaaatttaatatgtgtttgtgttaaggaggtatacgtttctgtaagtttcatcatttatgcccccttgtataagatctgttatagttttgcctttttgtacgtggtttaatcaggcattttttaccaaatccaatcaaatcttttcgattagatttgatcaaggcttcatatacaaggtcatagtttttaggattcttatattgaatcaaggctctttgcatcgctttttctttaggatcttttggcacataaacaggtgtcatatcacgaggatccaaccctgtataatacatcgttgttgaaagtgttcctggtgttggataaaaatcttgtacttgttctggttgatgatgaatatctcttaaatattccgccagttcgatagcatcttctaaacggcatcctggatgagaggacattaaataaggcactaagaattgttttttattatatttttcattaatacgataatatttatcaacaaatttttcgtaaagcccacgtcttggtttgcccatcttatctaaagcatgattactgatatgttcaggggcaacttttaattgtcctgaaatatgatgttgaacaagctcttcaaagaaatgatcatttttatcatacatgagataatcgtaacgaattcctgaacgtacgaaaacttttttaacgtttggaagctgtcttaattttgtaagtaatgataaataatcttcatgatcaacttttaaatttttacaaggttctggccataagcattgttttgtaggacaagcccctttggttttttgtttatcacaagcagtatctctaaagttagctgttggtccaccaacatcatgaatgtatcctttaaaatcaggatcccaaaccattttatttgcttctgcaataattgattcatgacttcttgcttgaataattcttccttgatggaacgctaaagcacagaaattacatgatccaaaacaccctctatttgaaataagtgagaatttaacttcatcaatagctggaacgtgttgataacttggatgataatcacgattgtaatcataaccataagctctatcgaattctctttgggtaagtggtctattcggtttattttgaaccacataccatccttgataaggttcaactaagattttagcattataatgatcggtatttaaatattgtttttggaaagattcagcgtattttcttttagatgttgtaatttcttcgtaactaggaagcattatataatcagcttcatttaaatcatcgatattttttgttttataaactgttccatctaaatacgttaaatatttaatatctaacccactatctaatgcttctgcaacttcaataatactgttttctcccattccaaacattaataaatctgcattggcatcaataataatcgattttctaaccttatcactccaataatcataatgagctaaacgtctaagagaagcttcaattcctccaattaaaatattagcatcaggaaatgcttgtcttgccatttgactataaacaatcactgctctatcaggtcttttaaaaccttcgccacctggtgtataagaatctttatgtcttctttttttagaaacggtatagtgattgaccatcgaatcaatattacctgaagaaattaaaaaacctaaacgaggtttcccaaattgcctaaattcttctaccttatgccaatctggttgcgataaaaaagcaaccttaaaaccatttgcttctaatgtacgacaaataatagctgctccaaatgaagggtgatctacataagcatcaccacaaatatagacaaaatctacctcttgccatcctctttcttccatttcttttctatttgtcggtaaaaattgtcccatctataaatcctcccttactttttttctattatagtcaaaatatgtttataaaaaaagacaaaagtgtctacttttgtcatatttttgaaagactttgaatcattttctttgttttaaataaaatccccgtcatctcatcaacataataatccataatttccattaataaatcaatagattcagccggtactttaagttgatcaatagaatcaatcgataatttattaatatgacgaaaagcctttaatgtcaccttatctaattgtttatcatgaagtgataaacaatcgtgacagacaaagcccccatcttctaaactgattcctgctatatgatcttgtcttaaacatcttacacagccatcaacttgtaaagccatcccacacctttttaaaataaaagcattatataatagataaaccaatggatagggataaccatgatttaaagcatccaatgatttttttaaagtatcaaagatttctaaatccggttggttatcttcttcattttttaaaacaaattccataaaataacttgcatacgcttctaattcaagattttctttaatataacgataaaaatcaaccgaacttgctttaatcatcgttgataaaccatttctaggtataaaagtaaactctgaaagtgtaagactttgacaagccgaagcatttttactttttaatttttttacaccccgagcaatcaaagtcatttttccataatctttaaaatacacagtgactaaagaatcactttctttataaggatgcgtctttaaaacaatacctaaagaaacaacttcttcttttttaatagtcatcttcgttataaccaaattcttttaaatatttttgtttattacgccagttattttcaactttaacaaataattccaaatgcactgttgtttgtaaaaaacgtttcatttctctttgtgcattttgacgaatttttttgatcatacttccttgtttaccaatcaaaatacccttttgagatttacgatcaacaacaattgtcgcaataacttctacactgccatcctctaattctgccattctttcaacaacgattgcaacactatgaggaacttcttctcttgtaaaataaagaatcttttctctaataaattcagccatcacaaatctttctggatgatctgtcatttgatcttttggataatacatcattccttcatttaaatatgttttaattgtagaaatcaatgtatccacattttgatcttctaaagctgaaataggaatgatttctttaaaatcaaaaagttctttccattctgttaattttttaataacttcatctttagaaacaagatcacatttattaagtaaaaggaaaaccggtccatccgcttcttttaatctttcaataataaaacggtctcctctaccaatcgtttcatttgctggtgcaataaataaaaccatatccactccataaatactatttaaagccgtcgtattcataaagtttcctaaaccatcttgaggtttatggattcctggtgtatccataaaaatgatttgtgcttcatcatctgtataaataccttgaattgtattacgtgttgtttgagcaacatctgacatgatagcaagctttgtttttaatatttgatttaataaggtagactttccaacatttggacgtcctacaatactgacaaatcctgatttaaaactcataaactctctcctataaataccattggtaataattcaccaattgtatgtttttctactttttctttatttgctagaaagatgggcatctctaaatcaacaagttctgataatacttggcgacatgccccacatggagaagcaatcggactacaatcagcaacaattgctagtccaataatatcttctttgcgataacctttacaataagcgccaaagacagcatttctttctgcacacattgttgacccataagcagcattttcaatattacatccttgaacaaatgttccatcttttaaagcaatacaagctcctactttaaaatgactataaggaacatacgcattttctcttgctttccaagctaaatcgattaatttattttggtccatattatttcctttcaatatttaaagcattcaatatttctttttgtcttgaaaacatcactttttcatcctcttcattcatatgatcaaatccaagcaaatgtaataaaccatgtgtaaataaaaaacacatttctcgataaaatgaatgaccatattcttctgcttgcattttagcatgatcaattgaaataaaaatatctcctatttctcttggcataccttcaatataatattgttcactatcttctaaagcaaaactaataacatctgtactacgatcaattttacgatattccttattgatttcatgaatacgctgatcatctacaaaaataactgataattctaaatcatcatgaatatctaattgtttacatgcttcttgaataatttctaaataaatactttcataatcttctttaaaatcttctacttcattattaagtgctaaatctatttccataatcttcctcacccactatttttcctgaatcaattataacacagtcaaactggcagttcatcatatttatttgatgagaaacaataatcacgatgatcttttgaaaacttagataattgattaataattgtaatctttcttgatctatattactaaatgcttcatctaaaatcaaaacatcgggttcacttaatagtgcacgaataatcatcacaagttgtccttgtcccgatgataaaaagccaccctgttcatccagttttaaatctaaaccatttactaaatcatccaacataaaataatgcaataattctatcattttattctctaaaaacaaacgatcaaaaatcatattcgttcttaatgattctttataaaaaacgggagttttatttaaatatttaatatgactataataactatttaaatcaagttcttgtagattgattccattaataacaatttctccttttgttggttgtaattgattcatgatcagttttaaaagtgttgatttaccacttcctgttttaccttgaataaataatgaacgttctatttttaattgaaaatgatcaaaaagaggtcgggtataaccataactaaaacttacatattttaattcaatgctttttatctttttgattttctttttcctctctcttttttcaggtaacatttctttatatctttcaaaaataatttgtaattcatcatgcatcgcaataaagactgatattttcattaaaggatcaatcatataagaaagtaataaataaacaagcatcactgttccaagggtcatttgttgctttttataaatgatgattgccaataataagacagccataatcatgatttgaatcaaggcttctaattgaacttgatgaatattggtcatttcatcatgatgatagacattcataaagtaagtatcatagagatatcctagtttatttttcatcatttttttaactttatactggattgtttgaaaatagttttcttgaaattccaacaaaccatcatttaaatgttctttttgttctaatatttttttattttcaatatgtagttttttactataaaaataaaatactaaaaaaataataaccatcatcaataaaacaatcaaaaacaaaaagaattgaatcgataaaataaaaatcaaaatgaaaagcattaaaatactatcaataaagatcacatgataaaattctataaaatattgacttaattcaaataaattttgtgatcttgataacaatgttcctttttctaaaccatccatgtaatcataatcttgataaataagattttgcatggtttttaaagcatattcttgattaagttctctgcttaattctaaaatttgttgtcttcttaaataatctaataaaagtttaaaggcatagagcactgtaaagccaagagaaatgaaaacaatttgatagattggatactttgaaaaagaatcaatcatcaattgataataataagaaaaaatcattgtaagcattgaaataataatggttttaatcatcatcttaatgattgtttgataatgctgtttaaaatgatcttttaaaaaattttgaaaagtataattcgttcttttagtaattggcattcctacatgatcaatcatgataataattcctgtaaactgttttgaaaaactttcataagacatttttatgagtcctttagctggatctcctactaaaaaatatccatctttaactttatagaggatgacataatgatagagatcatcttgttttaaatgcacgattgctggacaattgacttcttcaaataaatgtttaaactcacattgatacgcttttgcttctagatgatatttctttaaaacttgtatcaatccataaaccgtaacgccttcttttgtaagacgacaacactttttaatatttttaatttcatcatctcttttataaaagcttaagagcattttaatacagtatgccccacaactgttttcattatcttgtaaaaaaataggatatttcaacatatatttatcacctcatcattatatatgtcaaaaacaccctatttttcttttaattttttaaaatttttaaatatttttttcaattgcttgatctaaaatagcaattgcttgatcaacatctttttcagttgtaataaatggtggtaacattcttataacattcgttcctgccatgacaacaataagtccattatctaaacaagtttgaacaatatctttaactggtcgatcaaattctaaaccaatcatcaatcctaaaccacgtctttctttaatacaagaatatttatcttttaaatcatctaatttttcaattaaatattcactgatatcttgaacatgatcaagcatttttgtttcttctaagattttaaagaccgttctacatgcttgaccagccattggatttccaccataagtagaaccatgatctccaggttccatagctgcagcaaactttttatttgcgacaaaggctcccattggaaaacctgccccaattcctttagctaaacataaaatatcaggtaagatatcgtattggaaataagtcataattgttcctgtacgacccataccacattgaacttcatctaaaatcaaagcaatatctttttcatcacaaagaattcttaaacctgttaagaattcttttgtacaaacgtaaacgccaccttcaccttgaacaggttcaacgatgattgctgctgttttttcacttattaatgcttttacgctttctaaatcattgatatttgcatattttacaccttcaattaaaggtccaaacgcttcttgataatgtgcatttcctgtaagtttaacagatcctgttgttcttccatggaaagaatgatttaaagaaataatttcactatccgcttttccatgtttttgataataatatttacgtgcaagttttaaagcaccttctgttgattcagctcctgaatttgtaaagaatactttatctaattttgtagcttttttaacacattcagctgcttcaattgtttcaaccgtattaaagtagttagaaatatgcattaatctatgtaattgtttttccatggcttctacataagctggataattatagccaaaagaattaacaccaattcctgaaaagaaatcaatatattctttttgatttacatcatataaatgaatgccatctccatgatcaaatgtgacattatatcttccataggcatgcattaaagcatccaatgatctatcataataattcatttttagtcccccaattgtacatttcttgcaagtttttcataaagttcaacagcttgtactaaaacttcttcatgaaaattgaaagttggtgtatgtagacctgaagtatattctttacatcttgtccccacataaaagaaaacaccaggaatcactttttgataatgagcaaagtcttctgctaacatcacaggctcttcaagttcttcgaagtttgcgccaacattctttttaagttcttcatataaatgtgcatcatttaaaacaggtgggttaaaaggttgacaggcaaaatcaatttgacaatgatatgcttgttccattccttgattaaaccctttcattgcttctacaatacgtgaaaagacttcttcactataagttctaagtgttccatggaaacttgtttgactagccacaatatttctgaccgttcccccatgtatttcacctatatttaaaacacaaggttgcattggcgaaatcattcgtgaaatgatactttgataattgctaatcaaaaaactcgcaatcacaatcgaatcaattccttcatgatacttacctgcatgtgcacttttaccatgaacagttacatccaattcaccactttcagccattaaaggacctttacgacaagcaatttttccttcatcaacatctgggaacatatgtaaaccataaattcctttaacatgatatttttcaaaaatacctgtattaataattgatggtgccccattgaccacttcttctcctggttgaaaaataagcaaaacattatgtggtagatcttgaacatcttttagcttataagcaagtccaagaagtgctgtcatatgtccatcatgaccacaggcatgcatttttccttgatgtgtacttttaaatgatacacctgtttgttcttcaatttctaaagcatcgatatcgcttctaaaagcaagtgttttttctttatgaaaatcaagataaacagcgattcccgtctctgttatttttaaaggctgataccccattttttttaattcttcataaagatactttgatgttttatattcttgaaaaccgatttcaggaatggcgtgtaaatgacgacgccatgtccttatttgatctaataattgttccataatcgtatcctagattttacgtaaatcatccattaattgtgttttaccttcagttttttcatctttttgttccttgatgattcttgctggatttccaacaacaaccgcaccagcaggtacatcttgagtaacaatacttcctgcccctacaactgcacctttaccaatatgaacaccttcgataacaaccgcatttgcaccaattaaaacatcatcttctagaataacaggtgaagcactaggtggttcaataacaccagctaacactgctccagctccaacgtgacaatgttttccaacttcagcacgtcctcctaaaacagcacccatatcgatcattgatccttcaccaattttagcaccgatattgataacagcacccatcatgataacggcattatctccaatagaaacattttcacgaatgaagcatcctggttcaatacgtgcattgatatttctcatatctaacattggaatcgcactattacgacgatcttgttcaataaatgaatctttgattaaatctttattttcttcaacataagcattaatagcatctaaatctccaatagcaattttaaaatgactatctccaaataaatggaatgcatctgtatcaggtaaattttcaccttttaaatacattttaattggtgtttgtttctttgcatcaccaatatacttaataatttcttctgctgtttgtaacataaatttcctccttatatttttatttttccttcaaacacagttgttgctggacctgtcataaaaatatgtccctcttgaaattcaatttctaactttcctccaagaagctcaactgttgctttttctttacaataaccattcaaataacttgcatacataacggcacaagcacctgttccacaagccattgtttcaccactgcctctttcccatacacgcatttttaaataatgatcattgattacttcaacaaattcagtattgactgattctggaaatatttgatgatgttcaaattgttttcctattgtttcaatatcaaaatctaatgaatcaacatacgtaatgacatggggattccccatagaaacagctgttaaagcatattctttatctccaatcattactttttcattaatcattttttcttgatcaaaaataacaggaatgtctttacaatttaaaattggttcttgcatatctacttttgcgccaacaacttcatccccatcaaaaataagttctacaatacgtaaacctgcctttgtttcaatatttaaaacctttttatctgttaaatgatggtcataacaaaatttagcaaaacaacgaattccatttccacacatcattccttcactaccatctagattgaacatacgcattttaaaatcatattgatcagactttaaaataacgatcatcccatctccaccaataccaaaatggcgattagaaatacgactaataaattcagcatccatcggtacttcttgatggatcccatcaacataaatatagtcatttccaataccttccatttttgtaaaatgtaattccactttatcacctcacattgtttaaaacaattttaccaaaatgataatttttttcaatcttctttatcatttaattttatgacatcacataaaaacacatgattgaaccattgttctattacagttttcatctatattataaccatgaaagatcaatcatctttcgttaaataataaattcatattcccttcccaattattatttaaacaaaaaactctttaaaaaaggctttttttgtttaataagaaatattcagttcacaattgtttattatgataataacaagaaagataaataatatttaaacatctttcttagaaaaaatttttttcaaatttccttcccttataaaacattatatatcgtaaacgaataaaggatccttcttggatcctttattttgtttctaattcttctttatattctaaatattcatcgtatgttgataaacgatcaatcataccatctttattaaattcaataattctattagcaattgtttgtacaaattgatggtcatgacatgtaaataaaatattttctttaaattgaataagaccttggtttaaagcttgaattgattcaagatccaaatggtttgttggttcatcaaaaacaagaacatttgcatcttccatcatcattttagccagcatacatcttaccttttctcctccagataaaacatttgctttctttaaagcttcttctccagagaataacactcttcctaaccatcctcttaaatcttgttcatatactgttccatctgtaaactgtcttaaccaatcaacaagtgataattcacagtcattaaaatattttgagttatctttaggaaaataagattggcttgttgtcacaccccatttaaattctccttcataatcttcatcttcacccataataattttaaagaacgcttctgttgctttatcatctcctacaaaagcaactttttcatttggttgaatagagaatgaaacattattaataagtttttctccatcaactactttagtaagaccttcaacatttaaaacgatatttcctacttctcttcctggtttaaaaccaataaatggatatcttctaagagatggtttaatatcaaccatttctaagttatctaataatttctttctagaagttgcttgtttggcttttgaagcattggcactgaatcgtgcaataaattcttccaattcttttttctttgcttcagcttttttattttgatctttcgcttgttgaatttgcatttgactatattcataccagaaatcatagtttccaacgtataattgaatacggctatagtcaatatcagcaatatgtgtacaaactttatttaaaaaatggcggtcatgagaaacaacaataacagtatttttgaaatttaacaagaagttttctaaccaattaatactttttaaatccaagtggtttgttggttcgtctaataataaaatatccggatcaccaaataaggcttgcgctaataaaacttttactttttgatttccatctaaatctttcatatacatatcatgaaactcagaagtaattcctaaaccattaagcattgtttcagcatcagcttcagcgttccaaccatccatatccgcaaattcaccttctaattcaccaagtaaaataccatcttcatcattaaaatcttcttttgcgtataatctttctttttcttgcatgatttcataaagtcttttattacccataataacagtttcaacaactttattttcatcataagcaaagtgatcttgttttaaaacagataatcttttatgaggttcaataataacttcccctttattaggttcaatttctcctgctaagatttttaaaaatgtagatttaccagcaccattggcaccaataattccataacagttaccttctgtaaatttaacagaaacattttcaaataatgctctatctccatatcttaatgagacattttgtgttgatatcatatcgtcattcctttcttttaagtagctttggtattatgacataaaacacaaaaaatgtctattaaaagtagataaaatggattttcaatatatttatttaattacaaatgacaatcttgaaatactttttcaatgactttccatatcatcaaagacgggttttctttataaaattgatatcctctataatttagcgtatccacttctttctatttcatctcttacaaaccaggttttacctgtttgtctggcacctgtaaaaatgccttatttgaactttcaagtcattttctaacaacaatctaaccctttctataaatgaaggaacagtttcatttatgctatattgccccgtttttctaaattatgacattaaaataaaacatccattatttatatatagaaatttattttttgaacataataaaagtgaatccttcatcgattcacttttattagatatcttatttatcttgagaatgtctttcaccaatttggaattcttcttgatgatcaaacatatatcttactgaaataggtgtatctcctgtaagtattgtaaagtcttttgtatgaatatccattttaccttctctgattgcttgagcaaatgtaaccattccatctgatgaaaatggtgcttctgaatctttttggaatacaccatctgttgttctaggaacacccatagcatcccaaatttgatagttttcttcatcagtcacattcacaaatggaacatgatttcctgtactgacatctccaatagcacagaatgttgaaattgtcattaattctaaaccattaatgttccatactttttgatggaattcatttgatctatgtaaagcataagctaatgctttcgcacagtctttacgtgaaatgtaagccattaaaccatcaccttgtgaatttgtaagtggtgcattcatatgtgcataagtaaagtagtttgtgaccattgcttcagcatattgagaatttctcataaattgataatctaaaccaacttcttgaatatatttttcagtataaatatgatctttcttttctactgatggatttgtttcatcatccgcattgactaaagatgtataaataatttgtttaacacctgcagctttagcagcatctactgcatttttatgcgcattttgtcttttagcaccaacaaatggcatagaaatcaatactagagcatctgctcctttaaaagcttcagctaatccatcaggattattaaagtttgtgacatgtgtttcaattcctttttcagcatatttctttagtgattcttcactatatccacaaaaaattaagttttctactggttctagtgttaataaaacatcagcagctaattgacctaagttaccatcaacaccagttaataacaatttacccatgattcttcctcctattttacattaatatgataacattttcacaagataatcatagtccttatttattaataaagactataagttttacttatagtctttaaccaatacttttacaatttctccatagtattgactatgaaccccttcttcttgataccattcataaacattttcatcaacacttttttgatcaaaatcacttttacccataaccttacataaaataacgactgaacgctcttcaaaataaggagcaacatctattttctctgcagttccactagataaaacttctctatttaaaagttttccctcttgaataataatttcagtattttttctttttattataaaagtatctttcaaatctcttgatattgtcacttcttttaaagttggatctaatgttccaataacggctcgtaatgtttttaaaaacacttgtctatcaatatcatttaataaaatcgataactcaatttctggatatgcgaaacgatagcttattggaccaataattttttcaatgaatttatatttttcattgcctcatttgtatgatcttctaattttgtaatacacttttcatatgaatccattttatcaatttttgcagattgatatttgatatcaatacttaatgtaactacatcaatatttcctattagtcgatgtaaacaaaatccgtcatttacaaaatcaattaaaaaagaacccgtttttcccattatcatatcatataaaactgcaatatttcctgtattaatataagtaattattttaagcaatgctttaccaatacttgtctttccagttgcatttgctcccattaagataacagcttttttatatctaaatcgttctctaccgtcaagatactcatcatcaataattgaattaacaacttttttaggataagtaaagtttatcttaaaatcatcaaatccataaatacgtctaattccaaatttaatacaatcatctttacacacctcgtcatttcttcgaatattacgaaataataacaacacatacccaaaaaccagtcaaatatattaacaattcatctatttcctaatgtattagtttttataagaaatatatacaactttattttgatttatattctatccacatattctctttttattctttgtcatttacatatgctaattttctaactagcttatattgattatccaatttttcttcaaacgtactgtaaatatatgttaatcctgaatcattataaacaacttttttcaaaatcttattttttacttttggattcgcatcatcaatttcattatgttccacgcgaaagatacgtttttggtactcttgtatcatctgatagataacccttggatctacattttgttttttatagttatctatatgataagctatttgttttatttcgtttatttcagtagacacataattaaataactcattatataatttcaatctatgccttttatcaaagaaaataaatttcatatccccataaatatcccagaaatcatttaaatttattttagaaatatttatatatgtatcaagaacttcatcaaaattttttattaatgttttaacatatttataataattattgagaaattctatctcttccataggatttaaattgcctttatgatttgtttgcttataatcgtcatatgttggaattgtaatttcttctaaataatttatattgaaaaaaaatttttcatactcagtaattttcttcattaaattttccatattttttcttttaaaagacaaatattctattattgctgttaataacataattattgcaccaccaacaatactcaaaagaatatcatttaaataaataataatttttgtattgtaagcaaaaaatgttaaacatacagacattcctaaaccaacaattaacaatccaatacttatttttattaatatacaatttaatcgcattagttaggttcctttctaaaatatattttcattttctatgtttaatatacactctataatagtcattttcttctttaaaagatgaaacaatttctttactcttcaatatatgtaaaatagattcatttgtatcattaattgtaattttaggatttttacccataaaaatatcattaaaattttctcccgatatatattcaaaacactttctaatactatcaaaatcatatttttcgatagaattattaatcaataacaatttcctattttcgtttatttcatattcatcaaataaattaaatagcaattcttgattcattgaaatattttttgatatgactattgataaattgccattaaaaacttcagatatcttattttttacatcatctgtttcattattaaaaccatctgagataagctgataatcatcctcatctaaatgattagctaaaatatctatttttactttatctaaataattaaaactataagttattgttctatctgtacaatccattaaattggttttttgtagtacagaaaattgattactttccaatatataaagtaattcatcataatcaaataactggatattatctataatcaaatcataataatcattagaataattatccagataatttcctatattattactgtattcttttctcataaatataagtgtttctgaattcatacgaataactttacatcttattaaaatatctactttatcttcattcaaattttcaatagagaaatatttataatatctattgcaatttttaaaaatactattgtactgtttatcttttaattcattacattttactatttgattaaaaaatttacttctaatctcttctccatatttctcttcaatcttactaaaatcaaagataatttctttttcaaataagtttataaaatcaatcagtacatcatccaattcttgatattcattaaaatagcgtataatgttatcttctgtttcatacacttttctatttattaacaaactatcccacaattcactatcaacacttgatatgtttgttacttttgtatctaatctttcaatatatgactcttttaaattattttctaaattattcatatttaaaatttcgataaccacttcttcattatcgttaattttattatttgagctatttaatatcatattaagataagtatttgggttttcgataatatattgatataacgactgttccttattagaaaaaactaaggttgcgtttttactataataatcacaatcagaagataatttgtagaaatattccatcatttgtttaacatggtcaaatgaaatatcatagcaatgatttttatagattatttctaaaaatgataagtcgaccttttgaaaatcaatgtgcgtaaactttattttattattttttaaattatttactaatttatctccaatgttttctgtgattctttgttttaatgtttcgtcttttgtattattaatgtactcaatataagaatacttatcataaacaattttataaccgtctgctatttctgaatgatcattaataaaatcgattgtattttcatctaattctaaatcattaaaagaaagtgcatactttatcatttctacagctttaatttcttctttaagaactattttccttataacttcactatcattcaaaaaataaaaacaaaacttatctgtatttatatatgtatcaaaatattgtgtaataaaatctaagttattatttgtttttagcaattgatttatttttaatagttcatcttccttatcagcgctcaacaaataagataataaactattatttaatacttctggatctaaataatattttttatttattctcttatataccttaataggtgaatctattctataatcataatctaatgctttttgatcagtaatacttcttaaaaaaatcttatcattttgtgaaataccattaggataaaaataagacatataatcaaaataagtattttcattaatatatccattgttaattatatattttaataaatcaaaatatggacttttcttaatataaagatatttatcgttcttatcgtcctcattattttcatcaaccttattattaaaaatttcttctttattatctcgattaattaattcacttaatgattttctttttatttgttcaagttcatttcttttaacaattaattctttgtcaattctttgaatttcattagcttttcctttagttaggatatcaaattttttcttatattctggtatttctaataatttgttaaaattatttttcaaattcttctcactaataaaaaaaccatttctaccatattcatcaacatcatagttattactttttatcatttttattaattctacaccattacttatatcttccaaatcagtcgaatctatttttaagttatcaggaagtacaaagtatgttgcatctagttcatcaatttcattctgacgaatatctttagtagttgatagttcggtttttaaattttctatttcttctcttagattgctttcaattacctcagtaattttcgtttttttatcaaaaacctcttttacatatcctaaattcatttgtaacattgaaaaatcttttggaaatatattcttataaacaatcattgcaaataatttattaggatctaaatctattacgtttaattttgaatcatatattaaatattcattacaaatgttttttaaaattctatattcatcgatatataaagaaatatcagatagaaaattttgatcaaattgatccaaaattccatttttttgaaatctttcttttaatttattataagagttactactatctacaactggtataactggaataataaaatcaaaaaacttagtcctatcttttgaaataaatgtatcatcttttaataaataaacaaaacgtattaccctattgtttactttattgttcactaacgtattaatctcttttaatttttcaaaaatataattatcattatatctatccatatcttcaaaaacaaaagtattaattttagaatttataaatatgtataatacttcatttaaatatttatcaaaaaatgagtcattactttcatcaaaaacctcaatttctatatcttttacaactgctttttttactagttgcttgtttttttgtattaatactacattataaataatataaatcaaagatgataataaacataagaaagtaacaatttgaaaaaaatatgaacaaaaaaataacagatatggtaattctaattctcttgaaatccctataattaaatctttccaattttcaaaacagatattaataattaaacaaataacaataactaaaattacatacaaaaatttctttattcttttctcatttatttctttttttattttaaaacgagtttgaggaatatcatctggattaatttgttgaactaattgattaataattttcccttctagaatatttattatattatcttgatcagtttcttcttccctttcaaaatgtgctaaagatatgtgtatagccggtaatttcttttctctcttatacgtttctattaaactgcttttaccagatccataactacctgttatagcaatatttctaacttttttattattaaaagcctcatctaatgcatctttatatagacctaattctacatcataagatggtgttaaatcttcaaatttatttgtctgagtcattttatcacattcctttcctataaataatttaataccttacctatatgtttgaattatatatatcatcccaaaatattaaaatatttatataaattataccatattaaaaaacattatacagatgctagcctatatcctattgctatttaaattacaatataatttataaagtatccaaattcatactcttttatataaacaaaaataggcaatggattttccattgcctacagtttatttacttgtcttttcttttcttcattagaacttttataattttcaggtagattaagtttaagtgactgaacacctaataactccatcaatatattcatatccatacaacttttcaaacatctttccttatacatattccttaaatctttaaaagttgttttaaatccatacttacttccaatacgatccaatcctctttgtagtttagtcacttcactgacaacatataaattagatgttaaataacaatcattttctttatcttttaaatattcttgtaaataaaaaaacaactccttaggaattgttatatctcttaacatcggccattctacatcataaacttcataaatcgttttcgatccgatatcatcatttttagttctttgagctcttttacttatatgaattagttgattttctaaatctatatcacttacttttaaagcaacaatttctccaatcatcattcctgtatccatcgcaagtaatatacttaaacaaatatcattgtttttatttaaacagtattgatgtaattgtttgaattgtttatctgttagatatgctgtttctttcttttcttcttctattttgagtaatgaaaaatcaatatggttgaaaccgtattgattttcataggttgtatagattgcttttaagacatttttgattgtttttactacacttgatgataatcctttattaagtaatttcatcaagtattctttgataatatttatatttaattgttccaatgaattatgatcaaagaaacttattaaataattattgataatcatctcatatttatcatatgtagatggttttacatcttccttcttacttcttaaccactcaaaacataatgtttgactattaagcaatgtgttgtcacctcctattgaatattttaaaattactacttcaaattacaaaaaacttatctactttcctagaatccatttacaatttttatttagtaatattgaaaaaatgtataaggtaatcaaggtaacaattaatattagaattttaacaataatcaaaatataaatacttgttattagtacacatatctcattaaataacagtaatgtaatttgatttaagcataaataaacaattgaattttgcccaatgtatatcattatgctctttaaaattttacacttaaaaaagaacttaaaaaaagcataccaccctattgtcattaagagtacacatgtataatacagtaaaatattaccatatatgccacttctaacattaattggaatattaataaaacaaattaagctacctaataaaatactcaaaataataaaaaatagattagattctattttaataagattatcagcggttcttaaaatatttcctatttgaaataatccaactcccataaaagaaatatccattcctagaggcaacctaaaaaaaccaggcataatacaaccaaaaaacgataatgaaattatagcaacatattttaaatatttattccttattctatcaataaaaaaataaattacctctacaaaaaataatgcagtcaaaaaccacaatgctccacaaattggcataccatctgtattaataataaaaatatgaaataaagtactaaccacagagctaaattcaataaaatgattttttaaaagttgtaatattgtccatactattagatgaaatattgaaaagaaacaatatggaattaataaagaagatgcttttcttttaaaaaaatctttaaaactaatatttctttttttccaaagaaacccagatataacaaaaaatattggcatatggaatgaatgaatccacgtatcaaaagcttttccaaatccaatatgccccattatcattagaacgatcccaaagcccttcagtagatctatttctacaatcctattaatgtagtttgattttctaatctcttccatataaatcccttgtatatactttttcttctacatcatctaaacaactatcatagcggttcgctatgattgcttgacttaatgatttaaatttatttaaatcattaactactaaacttccaaagaatgtacttccatcttctaatgttggttcataaacgatgacttttgctcctttggctttgattcttttcataacgccttgaatcgatgactgtctgaagttatcactgtttgatttcattgttaatctaaaaatacctatgacagtttctttttcttgttccttgtcataagtatttttgtcttggtagctatagtagtttgctttttccaatacttgatcagctatgaaatcttttcttgttctgttactttctacaatggcttctattaagttttgtggtacatctgcatagttagctaataactgttttgtatcctttggtaaacagtatcctccatatccgaatgatgggttattgtaatgtgatccaattcttggatctaaacacactccattgataatttgttgtgtgtctagtccctttaattctgcatatgtatctaattcattaaaatatgatactctaagtgctagataagtattcgcaaatagttttactgcttctgcttcagtaaatcccataaacaaagtatctatatcttctttaattgcaccttcttgtaataatgacgcaaatgtatgagctgcttctacaagtctttcatcttccatatctgttcctacaatgattcttgaaggatatagattatcatacaatgcctttaattaaatgtgttatactttgcatgatgaaatatcctttcgttagattttggttgacgcttaaaagtatatcttagtaatcattttattgtttatgtagataaattggaaggtagtgtatttacgctatttaatatagatttttgacactatcaaaataaaaatgaaagtgttatatgaaaaatcatgtaaaagtgaagattgatgtaatcttaaataatagtttatttaagattacaatgattgttctatgttgtttgatattgtctacttctattattagaacggataattttataaattgtatgtttaatgggttagtcatttttgctttattaataaatatctatcatttaccaatagtaaatgattatataaagaagtacaaaaagaaatgtggatttataatattattaatagcatgcattgtttttggtttttggtattattttcaaattggtggattagtaggttttacgatcatttgtatttccttttatttgattatatggggtatattaaatacttataaaattaaagaattgttttacatgttgttaaatcttatatagatttaacaatttttttatatgttggtgtacataattttctatgtgcaactcatttatgttttgttataatagaagctaaggtggtgattttatgccagttggcgttttaacaaatgtatgtactgtttttataggcacttttattggagggcttattaaaaaagttttacctaaacatttaatggaagaactaccaaaggtttttgggatttgttcagtaacaattggattaatgtcagtcattcaagtaaagacattaccaatggttattatggctattattttaggttttgttattggtgaactatgtcatttatatgatcatgttcatgatatctttgcatttttattagataaactaccttttcatatggaaggtaatcaagaagaatatatgcatctttatttattagttgttttgatgttttcaatgtctggaatgggattatttggagctcttacagaaggaatgtcaggtgatgcatctgttttaatttctaaatcggttttagatttttttacagctgttttatttggagctgctttaggttacgcacaaagtttaatatgtgttccacaattacttattttacttgcatgtttctttctagcaaaagcaatcttaccatttgtaagtgcaacaatgattgctgattttaaggcttgtggtggtgtcattacaatgattacagggttaactgtttctaaaatattagatgtaagagcgatgaatcttgttcctgcacttattttagtcatgccttttgttggtctttatgccatgatttaggagaaaatcatgttaaaacaagtaacgatacaagatttagaattactttatcatatagaaacaacctgttttcctatacaagaggcagcaagttaccaatcattaaaagaaagattaacagtttatcatgaaggatttgaaattttttatattgatcatcaagcaatcggttatattggtggtctaagaaataatgaatgtaatctaccagatagtatgtacgaaaatgcttttttacatcaagaaaatggaaaatatcaaatgattttttcagtctgcattttacctgaatatagaggacatggttatgctagagaaatggtaaaggaatatgtagagaaaagaaaaaatgatgtagacggatttattttgacatgtaaagatcatcttattcctttttatgaaagttgtggttttaaatttgtaaaagtttcagcatctactcatggaaatgctaaatggaatgatatggtaattgattgtcgtggagaaatataatatttctctttttttgtactatttgtccaatgacgaaaaggttatttaggaatagaataagaatatagaataaaggggaatgaatatggatcaaatatatagagaatatagtgaaaaatataaacatatattgcattatgcaggaatcatgaaaaaagaaaatgttctttttgaaaatcaagaaataattgttttaaaggatgttaaagattatcaagattttgattatagttattttgaaaattgtgaaatagaaaagagttgtatttatcataaaattacatatgctttagctgttttaaaaaaagtagaaaatgggataattgttgatcaaatgaaaactgtaggttggttaaatacggttttggatcaacattattccgcatataaaacagacctttggtatttacataaaggtaattgggataagtgctatttagaagaacattatgattttttatcagcgatagaggtctatttttatttatttggcaaagaggaaacatttcgattattagaagataaaaatcaagagatggaacattctttaaaaataatagaagaattaattaaacaatatcaaaaggaatgtcaagacgatcaatatgctttattaaaacactttttagtattgatttttagtcaacagttagaaaaaatagaagtagaacataaggaaattgttttccaattattaaaagaaatcatcgaattaaaatcaattgtattacctttattattattgtgtgatttttatcaaaaagattttgatgaagaatgggctactatctctaaagaagttgatcgtaattatttaaaagaacaaatagcctatataccttttactgaaagtgaagattatttagatttaaatattacagatgttttagtttataaagataaaatagaaaaaataccagcggggttaatgaaatatttcaataatttaaaagaagtatatgatgatttaaaagaaaaactatcatttaatcaatctcttttagaagtagaaagaataattttattaatggaaaaagactatcaactttatccttttgaatcatttgttagtgaattaaagattcattattcaaaagaatattttattttaatgaaattattagaaatagttatgaaggattgtcaagaagcaaaattaggaagagaaacagttaaattaactttatcattgatgatgaatcaaaaactaagattaaaaatatttggtttttaaatagggaatactttgtgctacaataaaagtagtaggaggtatttttatggaaaaaagatactatagtgaatacagtcaatgtttagatagaaatatggattttatcgtttatggacatagtggtgtgccacttcttgtatttccagcacaagatggtcatcctcaagattatgaaaattttggaatggtcgatgtgatcaaagataaaatagaaaatggttatgtacaattgttttgtgtcggaagcattgatgaagaaagttattctgatgaaatgggagacaaagcacgtcgtagttatttattagaacaattttattactatatttgtgatgaaatagtgcctagaataaaagaaattaatggtacaggaaagatgatttatacgacaggatgttctttaggagcaacacatgcaacaaatatgatgcttcgaagacctgatttatttatgggttgtgttgctttaagtggatattatgatactgatcttttctttggacaatatgttgatgaaaatatttataataatagtcctttaaagtacttaaatgggatgtcaagaaatcatccttatgttgatttatacaatcaaagacatattattctttgttgtggacaaggtgcatgggaagatgaaatggttaaatcaacaggattaatgaaagaaacatttgatcgtttaagtgtcaatgcatggtgtgacttttggggaagcgatgtcaaccatgattggccttggtggcgtaaacaattaccctattttttaggacatattttataaagggggaaatcgaaatatgaatttagtctttatttcaccaaattttccaacatattattggaatttttgtaaatcacttagagaaagaggtgttacagttttaggggttggagatgcaccttatgatgatttagtaaatgaaacaaaggaaagcttagtagaatattatcgtgtaaataatcttcaaaattatgatgaagtttatcgtgcaatgggattttttattgggaaatatggacgcattgattatattgaatcacaaaatgaattttggcttgaattagaagctcaattaagagaagattttaatattcatcatgggttgagaccaaaaaaattagaagtgatgaaatttaaatcaaaaatgaaagatgtttataagaaagcaaatgttccaacagcaagatataaagtatttaaagatgatcaagaacttttagatttttgtaaagaagttggttttccaattgttgtaaaaccagataatggtgtgggtgcttcttttacatataaattaaaaaataacaaacaagttaaggaatttttaaagaattgggatcgaaatattagctttattgcagaagaatatattgatggtcttgtagaaacttttgatggtattactgatagtcaaggaaatattttgatttgttcaagtcatgtgatgatggaatctattatggatacggtcaatgaaggtggagatactgctttttatggacaaattgttgaaggtagtgatattaaagaagtaggaagtcgtgttgttaaagcatttgacgctaaacaaaaattcttccattttgaattctttagattaggtaaagataaagcgggtttaggaaaaaaaggagatcttgttggtttagaagtcaatatgagagcacctggagcctatattccagatatgatgaattattcatataacgcaaatgtctatgatatctttgcggatatgttgatttatgatcgttgttttattgaacctaaacaacaatattgtattggatatgctggaagaagagatggtttaaaatataaacatcatagtcaacaaatacgtatgaaatttaaagatcaacttatttctcatgaaattgtacctgatgcattagcagcggcaatgggaaatcaggtttatttattaagagcaaaaaatgaaaaagaaattcaagaaatgattaaatatgtattagaaaaaaaggattcgttttgaatccttttttatagttcatgaacaattaataaatatttcataaactcattattatgttataataaacataccaaggaggtcatcgttatgaaaaaaaagtttctagcatgcatgcttatcatgatgcttacaataacaggttgttcaagtaaatcaataacacaaacattatttgttgaaaaaaataataaatatgctttatgtacattagaaggagatttaaaaacaaagtttatttattcttcttataaaaaggtagaaaatgaaggatacgtggttgttcatgataaaaaatatgaatacatttcaacagatggtaaaaaattaattaaatataaaaaaggaacaacattatccgttgttgaaaatatgattgttgctaaagatgctaaaggcaagtatacaatttatgatcaacaagggaaggaattatataaagatagtaaaaaggtaaaaatttatatgtatgatttacctgttatctataagaataaaaaatattctgttttaaatagtgaaggtgaagttgtaactacttctaaaaaagcaatcaattatgctggaatttatcatgattcatttattacagtagcatataaagataaaactgtactttttgatacttcttcaaatagtcaaattgatgaagaaggattaactattaaattaaaagggcaatataaaattgtcgctaatgattataaaaaaggttttgttttatatgatcaacaacaaataaacttagcgtatgtttctttaaaaggaaaggttaaatttgaaaagaatatagaagttgattctgtaaaattcaaagattcatcacttattttaaaaaatgaggatggtataagattgttatctttagatggtaaagaggatgttgtagcgacaagttattataaagatgtaaataattatttatctaaaaatgcaagttatatttatggtccacataaatttactaaagatggtaaagaaaaagatgttaaaggtatccagttaaatcctaatgttgcttcggtacacggtcatattttcccagtatatgttcaaaataaaggatatcaatattatggttttaatggtaaagaagcaattaaaacaatttataaagatgctcaagattttgatcaatatggagtggcggttgtttctaaagatggtgaaaagtattatttaatgaattctaaaggagaaaaacaatctaaaaattatgtaaagattgaatctattggagaaggatattatgcagcctatgaaacaaatagtaagtatgaaattattaatactgaaggaaaaatagatattcatgattatttcatgggtgaaagtcaagcttttgaatttgatggtaaagtttatgctttattaaataaaagtggaacaacatatttatatgatatggaaaaaggtgaatctgtattttctcttgaaggagaatatcaattatataatggtaagtatttaagaaagaaaaatcataaagcatattatgatttggaaggaaatttaatttataaggggtaatctatggaatattatattgtattattagttttctatgcaattacacttatctttttaagattagtgtttgctgaaattgaaggtagacaagcaagaaagatgtcaaatgtacgttattttttaagataccattcaaagtttgtttatcgtaatcagttttcaattatttttgtagcatttctttgttatatgattgtttctgtggaaaaagcattttctacaatgtggtttttacaattgttaggttttattgcggtaggagttattagtgatgctctttcacaaattgtttattattattatattaattttcgttttaaaaaggatattgttgaaagtgaagaattaaaaaatgaaatagaacaagctgttttaaatcaaggcgaagagctcatgcaacaaacaattcctagttatgaaccacatagaataattgaagattatttaaatgaagaaaatcatttagctgttatatcagtagatggtggaaattttacttcacaatttgaaaaattaccaccaattacgtattctgtagaattaaatccaacaaaagcaagagaaaccttagaagagaaaggtgtcaaagtaacaacttttacttcacaagggaaaatgccttttaaagatgaaaaattagatgttgttgttaatgagttatctaattatgataaatttgaaatgtatcgtattttaaaaccaggtggttatttagttgttgatcaattaggaagtgacaattataaagaaattattaatatgtttattccgtttaaattaaaaggacaatggaataaagaagcttgtcagttaactcttacagagataggatttgatattgttgatagttatgaagatgtaggacatattcgttttcattctttatcagcagttcttgcttttatgaagagtatttctcctgaaagagtggaaaaatatgagcaatttatgaacttctatgccgatgtattaaagaaaatcaaaaagaaccaattttatgaaattactactcataaatttatggtaatagcaagaaaaaatggtaatttaaaaaagtgaggggtttctcatattttgattatcaattatagtggggtgaattcaccccacttttgtgtatagacaattttttgattaaaaatcaacttcgggaatatctaaatctgatgatgtttcaacctcattttcttctaataaagatatttgaatatcatcaattctgttagaaatggattctagagaatttaggatttcttctaatacttcattttcttcaagtgtgatagcttcaataccatcttcaataataagcgaatatacttttttcatatcaatttcgatcctttcttatacatgtaaaatagtaagtcgtatcatcgttaaggctgaataaaatacgattacggaatctttcccagtttaagtagccatttgaagcatgtttgataagcttgatcgtcttatttctgttttcaacgatagcagtgttcatccttctttttgatttgtcatcgacaataataaagctgttgatgatttctgttttccagttggtcaaggtatttgtgaaaggtgacatctcctcaacaggacaacttctgaaatcagtaatgatctgttcaagagctttttttgcgttatcataattacagtttgtatagaattgaacaatatcttctttaagcccacaggctttttctaattcatcatcaatttccaacatgtatgtatagaaatcactgtaattacagtatcgagccaatactctgttatatttcttttcattgttttcatcgaatattttattgttgtttgaaaaaagcagccaattgaatttttttaacacataatagtgtctggaagcttcttctaattctaacttttcttctacagtaattgttttatttttgatcttctttttaaggtcatcttttattttcttatattttttttgaacacggattctgactttatcgacacgtttattaagatcctgaatcatatgaaaatgatctactatacagatacagttgggaaaaacatgtttggcaacgatgcgataggtattccacatatcgaaggaaacatattttactttttcacgttcaacgcggggaataagcataaaatagttgatcagtacatttttatgccgtgaaggaagcacatcgattatcttcttgtcaagataatcgacgattacacatacatagtcactgtcataagatttaaaggcatagacttcatcaaaggcaacacattcaggtaatggtcttcttgaaatatggacatgtctgtcaaagatgttgatagctgatgttggagaaatattatgtcttttggcaacatcagtaaaagttgcatttggagatttaagatctttgagaacattggaaacagtaacaacagagaacttacctccaaaggtaaatggattattttcatagaatgtctttttacaatgaaggcactgatatcttcttgccttgtagatgatataacagttggtgacggacaaaacggaatgagtgatctttttttccttgtagtccttgatcttttgagtcatgttaccacaaacaggacattggcagtatttctgattaagagtaataccaacatagagaccatcacttttgtgggtgaaggttatttcctgaacattgtctctttcaagattgaagaatttgaggatgtcattgtcggaaatgagcgcaggagggctatcgtcaatgtttggatcatcagcagatgcttttttatattcagttttcatattagaacagctcctttcgatatattacaaacaaagaatatcgaaaacgaagcgattctaatataaaagtcatgtggtaaaagtaaaaaaagcaaagaaagtatttctaaagttcaaaatacagaaaagaacataatcaaaagatgaataaagatacttcaactttagaaaataaaggtgtgaagatgaagtagagtcattgtttaataatatatctatgatcaaatcaaaagaagaaacagaatagggaatcatatcctgaatcaaaacggcatgagtagacttacaagaaggacagatgagtcttaaaatacgaatagtgtgtttacgattgaaaagatcgatatgacggtcatagtaggcatgaacaataagaccatgtaaaagacatttagggcaagctaatgaatcaaaatctaatgagtaaatgattttattgtattgattttgagaaatatacttgatttttttagtaagttttattattatcatattgtcttatggacaggatagacatcaaactgtggttggggagatgcttatccttttttctttctataaattttttaactataactatatgataaataatttatggaaataacaaaatagaaaaaataaaagaaccccaaaaaaatgaaaagccataaatagaatccagaggaatatacccctggattatttatagcctaagaaatccccatgaatttttagttactcgaaaaaatgatatgaaacaggaaaattaaaaaaatttcctgtttttttaatttataaattaaaaaaatgtagtatatatcgactaaatttgatttgaatatgtaaacgctttatttttttagaaaatctctagaaattctaaaaatatgatgctataattgtatcatagaaatttttaaggaggagtcatataatggcaaaagaattatctttcgtagtatctgatccagttggattacatgctagaccagctactatcttagtaaaccaagctagcaaattcactagcaatattaaattagtttataatgataaagaagtaaacttaaaatctatcatgggagttatgtctttaggtgttcctactaaagctacagttactatcgtagctgaaggtgatgacgaagaagatgtaattgcttcaattgctaaagtaatcaaagaacaaaaagttgctgaataatagcattaatgaaaagggaatcaacatgattccctttttttatgctataatgaattcagaggtgtaaatcatggctaagaagtttaaaacaaatgcgcttagaatgttggataaagcaaagattgcttattcgataaaggaatatgaatatgatgaagatcatttagatggaagacatgtagcaagtcaggtagatatggtgccagaagctatttttaaaacacttgttttacatgataaccataatgaatatcttgtatgttgtgttcctgttttagaagaaattgatttaaaaaggcttgctaaattagcagatagaaaaagtgtagaaatgatccatcaaaaggacttattacctgtaacaggttatatgcgaggaggatgttctccagtaggaatgaaaaaacaatttccaacgtatatggatgaaagtattttaaatgtcgatgaagttgctttttcagcaggaaagcgtggttttcaaatgattgttagggttcaagatattttggcatacttaaatgtcgaaacgggagatattatacgaaaataatttgaaaacggttacatttttctatagtttttgacaaagagctttgatatacttatattaagaggtggtaaaaatgaattataacgaaaagtatcaaaaatgggttagtaaagaagatttagatcctgctttaaaagcagaattattatcaatggatgaaactgcaaaggaagatgcattttatacagatgttgaattcggaacagcagggatgagaggtatcttaggtgcaggtacaaatagattaaatatctatgttattcaaaaagcaaatgttggttttgctaaatacattgcatctttaccagaaggtaaagaaagaggtgtagctattggatatgataatagacatatgtcttataaatttgcgattgaatcagcaaaagtattagcaacatatggtattaaatcatatatctttgaatcattacgtccaacaccagaattatcatttgcagtgcgttatttaaaatgtgctggtggtatcatgattacagcaagtcataatccaaaagaacataatggatataaagtatatgatgatacaggatgccaattattaccagaagcagctgatcaagttgtacaatatgtaaatgaagtagaagatgaattaaatattaaagtgttctctgatgaagaagcttatccatatatgacatggattggtgaagaagtagatgaagcttattataaagaagttatggcaattgaagttaatccaggaatggataaaagtgattttaaaattgttttctctccacaacatggaacatcaaatattgcagttagaacatgtctaacaagacttggatatgatcttgtaccagttttagctcaatgtgcaccagatccagatttctctaatacaaaatctccaaatcctgaagtaccagcttcttatgaattagcgattaaaaaagcaaaagaagttgatgctgatgtagtagttattactgatccagatggtgatagattaggtgttgttgctaaacataatggtgaatatgttttaatgtcaggtaaccaatctgcagctgtttatttggaatatattttaagccaaatgaaagaaaaaggaacattacctgataatgcagttatgtataatacaatcgtaacttctgatttaggtgaattagtagctagaagttatggtgttgatgtagaaaaaacattaactggatttaaatttattggtgataagattcgtaaatatgaacaaactcatgaaaaaacatttgtatttggttatgaagaatcttatggatgtgttattaaagatttcgttagagataaagatgcagtgcaagctgttttaactgctgcagaagcaggtaacttctataaaaaacaaggtaaagatttagttgatgttttaaatgaattatatgctaaacatggtacatttaaagaaactcaaattgctttatctaaagcaggagctgcaggagctgcacgtattaaagaaatcatggataatttaagaaaagatgcacctcaagaaattggtggtgttaaagttgtaaaagttgaagactatggaaatagtacttgttctgatggaacaactattcaattaccaaaatctaacgtattaaaatattacttagaagatggctcatggattgcagcaagaccatcaggtacagaacctaaatgtaaattctatttctcaatcaaaggcagcgatgctgatgatgccgctagtaaaacagaagtattccataaagcaatgatggaaattattggtgaatagaaaatgaaagaaaagcaattcataaaaaatgaattgctttttttataaaaatgctaattaagtttataattaatttagtagaagcacttattgtttcttattctttaagtcgattatgtcatgttaaaaaacaaaaactctattttgttttgaatacattaatgactttttctatagaaataataagtgactattttgatgcgaattatgcaccattagccattgcttatattatatgttggaatattttattattattttttactcgaaaagaatatatatataatttatttatgtgtatatttaatgaactcttaattaccttgagtgcattgttacccttgatgtttataagtcattattatctattattagcggccgtagaagctaaaatctatcatttattattatctgttctttttataagatatcaaaaaagatatcgttattttattaataaatattgggttttagtgatgatgaatttgacagcttgtttattgattttaaatttacagggtagaataatcatggaaggcagttatacatttaaaacaattatgactattttcttgtgtatatttgttgtttttttatcattaacattttttgcttttttagaagaatctaataatgaaaaagaaaaagttacaaaacagttagaagaacgtaaatatcaaaatattacatatgatatgatgaaaaggacaaaagaagaactctatcgtttagaacattcattaacttattatatgttatctataaaaaatatttagagacacaaaatcaagatgaagtatataaaatcattgattcgtatattgaacgcgtatctaatgtgaatattgtcatttatacaggaaatgatttatttgatttatcacttacaacgcatttgagtcaaatgtcatctaaagtcaatatgtgtattatgattagtaaagatgaattttataatcatattcaatttattgaatttgttttatcattgttagatttgattgaatcaaaagatgtaagtttattaataaaagaagatggttttgttaaacttatacaaataagtgcagaatatgattttattgatgaaaatcaagtaaaagagattgtgaaccgtgattatgaatttgattgtcattatcaaatgataacggatcaaaatctgcatctattaaaaataaaaataattgaacattttgaataaataagtgttataatttttgagtattaaagagaggatggagattatgtacgctaaaaatacttgggaaaagtataaagatcaattaaatgaagtatttgattataatgaaggttataaacattatatttcaaaaaataaaactgaacgtgcctgtgttaaagattctattaaattagctgaagaaaaaggttttaaaccattagaatcatttgataccttaaaatcaggggacaaggtttatgtaacaaatagagaaaaaaatattgctttatttattattggtaaaaaacctttaactgaaggaatgagaatattaggggctcatattgattcaccaagaatggatttaaaacaaaatcctttatatgaatcagaaggttttactttagctgatacacattattatggtggaataaaaaaataccaatgggtaacaattcctttatctttatatggtgtgatttgtaaaaaagatggaactgttgttgatgttgtcattggtgaagatgaaaatgatccagttgtaggaattagtgatttattaattcatttatctgcagatcaattagataaaaaagcagctaaagttattgaaggagaaaacttagatgttactttaggaaatatgccattatttggtgaagaaaaagatgctgttaaagcgaatgttttaaaattattaaaagaaaaatatgatattgaagaagaagatttcgtatctgctgaaattgaagttgtaccaagtggtaaagcaagagactatggtttggatcgttcaatggttgcaggatatggtcatgatgatcgtgtttgtgcttatacttcacttacagctattttagatagtgatgtcagtgaatatacaagttgtgctattttagtagataaagaagaaattggttcagtaggagctactggagcacattctttattctttgaaaatacagttgctgaaatgttacttaaaatgggaattgatagttttgtacaaacaagacttacaatgtctcgttctaaaatgttatcaagtgatgtttctgctggtgtagatccattatttgtaagtgtaaatgataagaaaaatgctgcttatttaggaaatggtattgtttttaataagtatactggttctagaggaaaaagtggtagtaatgatgcttctgcagaatatgtagctcaagtgcgagcagtgatggataatgctaatattcactatcaaaccgctgaacttggacgtgttgaccaaggtggaggcggaacaatcgcttatatcttaggtaattataatatggatgttattgatgctggaattgctgttttaaatatgcatgcaccaatggaaattgtaagtaaagtagatgtttatgaaacatatcaagcttacaaagctttcttaaaagatgcttaaaaaatacttcattttgaagtattttttattatctattttttcgtcaatatgatatgatgattgtattgttagaaaaggtaggtttttatgaaagaaagagaacaatttaaatcaagaattggatttattctgctttctgcaggatgtgcaataggtataggaaatgtttggagatttccttatgttgtaggagaaaatggtggaggaatatttgttttattttatcttatttttcttcttttaattggagtacctattttaagtatggaattttctgttggaagggcaagtaaaaaaagtcctgtaaaatcttttaaagtattagaaaaaacaaatcaaaaatggcatttacatggttatatgtctttactaggaaatatttgtttaatgattttttatacgacagtttcaggatggatgttaaaatatttttataattttttaacaggtcaatttaatggattatcaacagcagatgttcaaaatgttttttcacaagttttagctagtccttcaacaaatgttttttggatgattgttgtagttgctttaggtatgtttatttgttctaagggacttcaaaatggagtagaacgtattactaaagttatgatgataggtttattaggattaattgttgtattagcaattcatggtgttttattagatggtggtatggcaggtgttaagttttatttatatcctgattttcaaaaaatttctgaaattggtttaatgaatgtcattgtttcagcaatgaatcaagcattttttacactaagtattggaattggatcaatggctatttttggaagttatttaaataaagaacaaacgcttttaaaagaagcaacgaatgttgcagtactagatacttttgtagctattatggctggattaattatttttcctgcatgtttttcatttggtattaatccagatagtgggcctagtttaatttttattactttacctaatgtatttgtttcgatggctggaggacaaatatggggtgctttatttttcttatttatgtcttttgcttcactctctactgtaatagcagtatttgaaaatattattgcatgtacaatggaattattaaatatagaaagaaaaaaagcagttgttattaattttatagtgattagtattttatcattaccttgtgcattaggatttaatgttttaagtggtattcaaccattaggaacaggttctacaattttagatttagaagaccttattgttagtcagttcttattaccgttaggatcacttgtttatttattattctgtacttctaaatatggttggggatttgaaaactatcaaaaagaagcaaacataggtaaaggattaaaagttccacattgggttaaattttatgttacaataatcttaccaatcattgttatttttgtttttataaatggaattatataggagtttaaaatgaaagtaagacttgcatgtgttgatgacttaaatgaaattatggaattatatcatcttgttagtgaaatgatggaagatagtgcatatgatataggctggcgtaaagatgtttatccaaccaaagaaattgttcttttagatatagaacaacaaacactttacgttttagaaaaaaatgaaaaaattattggtgcaattgttttaaatcatgaatatgaagaatgttatcaaaatatttattggcaaatttatgctgaagatgaagaagtaacaattatacatcgcttttgtattcatccagattatagaggatgtggaaaatatttattaaaacaaattataaaaatagcaaaaaaagatggacaaaaatccatccgtttagatgtattatcatctaataagccagctatttgtctttatgaaaaatgtagttttttattacaaggtcatcaaataatggattatggaaaaccagttattgcaagtttatatgaaaagatcatttaaacaggttgtcaattgacaacctgtttttttattcgaattcattttgattaaaatcttcagatgtttttgaatacttaaatctcataactgctttattattgacaattgtaccacttggtatagatttaataataaaagtatttcctccaataacagatccttcacccacaacagtatctccgcctaatacactagcattagaataaatagtaacattatcttcaattgtaggatgtctttttacattctttaaactttgtccaccatgagtagaaagagctcctaaagtaaccccttgataaatttgaacatgttcaccaataacagtagtttcaccgataacaataccagttccatgatcaatcattaaatatttaccaagtgttgctcctggatgtatatcaattcctgttaaactatgcgcatgttctgtcataatacgaggaattagtggaatattcaatttatataattcatgagcaatacgattgaccataattgcataatatcctggataagaaagtacgatttctgaaatagaaatagcggctggatcgccatcaaatgttgcttgtgcatctgtagcaaggtattctcttatttggggaattgtcttcaaaaaagctaatgttttatctcttgcttcctcttctttacaagcatctttacagttttcacaatagtcaaaggcaagtaagatttgattttttaaatcattataaatgatttgaatttgatcacctaaataatatttaacataatcacttttaagaccttttcttccaaagaagcctggaaaaataatatcttgtaaacgttcaagaatatcaatgataattgttttatcaggctgtctaattgtatcgaccttagaaatatcattgtgtttttgataactttcaacaatatcatcaataacagtatctaacttcataattaacctccatttttattataaatatagtatcaaaaaataggattatgttcaaattattgaataataaaatataaaaatgtatacaatctttattgacaaagaagaaatgatagtatatagttaaatcatactaaatccataggaataaggagaagtaaatatgagcaaagtaaaaaacagttttttagacctagtagggaatacaccactagtaagagtaaacaacttaatcagaatgccgccctgtcacggcggaggtcgcgggttcgagtcccgtccagaccgccagtaattgtaattaagagagtcattcatgactctttttttgtttattaagaatttgaatgcgtgggaaatagcatataaaaattcatactaaaataccatgacatatttgtgtgatctggtataaatttttttatcctgcaatcatacagtggttatttgattcttctcctaggatcattgcatacaggacattctatttcaacttcatcatgtttacaggacattctgtcttcttttgccaattcaccaacgatccagttaggaacattggcaatatggccacaagcagtatgtttcattttgataagtgtatcttctgcaatcattgatgcatttttcactgtagagtctgtcattaggggtacctatgtatattcacatttcataagattgccacatgaacataaaagagtatttttttgaaatgattctatcacatgtgtgcggtattttagatggtcaagtttgttttttaaattttttttctttctttcaaatttttgatacgtcttttcttttttataccataaagttcatatactttttattcctgtttgaatagaagccatagtatctgaccatttaaaagttttcaacactttcatatacttcgatatatttttcaccctcatgacggttgtaccaccatctgatcatctttttgtcatcttcatatttgatgcagttttcagccatgggaggtctagaagtgtatctggtaatgtagttgacgcaatcatcaacgttattgtcatcattgtctttttctttctttttggcgtagacataaaagccgtttacaagttctttatagaaacgttgtttgagataattgaaactctcaagttcttgttttgagagaagatcaaggatttgatacattcaagtctttctgagtttttcacaggaaataaaagttcttcattttattttttttgtatcaaaagcttcttcacaaacaaggcagtggatatggggattccatttcaaatctctgccaaaagtatgtaaagtcaaaacagaaccgaaaacgattttgtttctgttatttttataagagtaggggcatttgcttttttaataaagagctttttctttttgatttttctgtactttgcatcattaaaaacataggcaagagtatttctgtcaccaataaaaagaagattcaaaagggatctgtctttaataaaataacctcttagatgttttggaatggtaaagacgatatgacggtgcttggcatcgagagcgatagagaaaatatgaacagcacgcaatttagcctctttagagccacaagaagtacagagcttggagtgacatttgtgaggaacgatagattcgttgccgcaatgagggcagacaaaaagatcataaccaagatagatagaaccacaaagaatagttttctggatggtatcataggtaacatttctgatcttacctctatttaatttaggagaaatgatagccagagaaaatatagaaaaaggacattctatggggattgaacaaggacaaaagttggaaagaattacattaattaaaaatatgacggaaagtttataatgttccatgcaaagagctatggatgttttaaaattgacagctgatgaaagaaaagatgttgaagaatattttaaatcttaaaatcataggcgatatgaatttcatatcgcctattttcttttaatgattgttacatttctttgaccatcatgattgacacgatgtgaaaagaataaatcattattttcatttgtacaataagaagaaacttgaatattttcttctaaaacccctaaatttaataattgttgtttatttaatcctttattgtctaataaataatgagtttcatctgttttttgataaaaaggtgaaatatcaaagttcattttcttaacttgattaatcacatcatcttgcacttctaagtgctttttagaaagacaaggacctattaaacaatacatttcttttggattacaattttctttttcaataagataacgaattgtatgatcaacaatttgtctaactgtaccaagccatcctgaatgaatagcacaaacgattttttgatctttgcaataaactaaaattggtgtgcaatcagcatgaaatgacagtaagaataaatctttatctttcgtataagttgcatctacttcatagaggtcatctgtttgttttaacatattggtaccaccatctttcattaaaaagacttgttttaaattggtagaatgtgtttgtctaggggctaccatatgttctaaatctgtatttagtaatgaagcaagttcttgtctattttctaatacttttaaataatttggattatttaaagaaatatcccctaatttcctagttgttgtatatgcttctacatcttcatgtaaattccattttattaatttcatttgtttctcctttacaaaagtccaattctttttaatacatgaccataccttatattaggaggtgttattatgagttgtaattgtcaacaaaatacatgctgtcaaggacaatatggaaactttgataataacggttatgcaaattattttaattcaaatataggaaatggttttactccacaaccaattatcgctcctaagaaagtatgtacaacatttcaaaatcaatatgtagaacaacctattatttgtccaattgaatgtcgtcgcgttaataacattgtttatgttccacgttattaccctcgctatgaacaaacatgttatacacaaacaaatcgttactaaaaatagatgcttagcatctatttttttgtaagttcttgtaaaaactcatcatctggatcaatatagattgttttataattatccaaaattacttttcctggtttactacctgcaggttttttgagtgttttgacgagtgtatagtttaccggaacactacttgaattttttccttttgaatagtatgcagcaattttagcagctaaacgaatcgtatattcatctaaatcttgtgctttaacaatgacatggcttcccggcatatcttttgcatggaaccacatatcataacgatgcgcatatttaaatgttaaataatcgttttgtaagttatttttaccaatatcgatttcaattccatcttttgtaagatattgttgaaattgaggacgttttttcttgcgaattgtatttttttgttttttcttttttaaatatccttcgttttctaattcttctttgatttctaaagcatcataatatgttgcttgtgacatagcggttattaaagaatcgaaatattcaatttctttttcagttaaatcaatttgttctaaaagaacattgattgaatttttagctttttgatatttttgataatatttttgagcattggcttttggatctaatttaggatctaaagtaatatctaattttgtattatcataataattgtcaacaacaacatgagtcattcctttttgtattaaatgtaaagaagcatataataaatctcctttaatacgataatcatcgctattatgtgaatcatctaaggttgcttttaatttctttaattttgaagtatttttttgatattcattttgtataaattttaaaagattacttgtttgttgtttaattctttctttttgatctatttcattaaagtgagtatctaaaccatcaaataaagaatattttgaagtttctccttgtaaatgtgttagttcaataacatgaaaatattctttatcattcactttagtaatatagagattttgagaattttctatttctttcataatctctttaaaagattcatcttgatcaatacgatataagatttctttagataaaataggagacattccttgatagattttagtaagttggttatcttctacaaattcgcttctaaaaggatcgagtttttttatcattggtggtaattgataaagggctccgggttgtaaaaatctttcactattcatacttggtgaaatatgtttaatacaatcaatgattttatcgttttgacctactaagataatatttgaatgtttacccatcacttctacataaagaatatattcaatataatcacctaattcattatgacagctaaaagtgattttaaaaatacgatccaaatcgatttgttcaatatctttaatataaccaccttctaaaagcttacgataaagcatagtaagcggattaggagattctggtgttggataagataaagatgttaattgaacacgtgcatacattggatgacttgaaatcaataactgataattctttttatttgcgcgaacttgaaataaaagttcatattttgatatttgataaattttattgatacgaccgccttttattgtttctatcaataaattttttacttgatgcatcataatgccatcatatgccatagttatcaccccaaaatactataacatatttgaaatttaattgacattatctctttgttattgtagagttatttttataaaaaaggggtgtggaagaattgaaaagaggaatgttaatcattcttagtgggcctagtggtgttggaaaaggaacagtaagagaagaattgttcaaagatgatagtttaaatttaagttattctatttcaatgacaacaagaaaacctagacctacagaaacagatggtgtggattatttttttgttgatgaaaaaagctttgttgataagattgctcaaggtggcttattagaatgggcaagatttgtaggtaattattatggtacccctaaggataatgtagatcgattattagacgagggtaaaaatgtcgttttagaaatcgaagttcaaggagcattgcaagtcatgaaaaaatgtcctgatgcattgactattttcttggtaccaccttcattagaagaattagaaagacgtattcgtggtagacgtactgaaagcgaagatatcgtaaaagaacgtttggataaagcacgtaaagaaattcaaacaaaagatgaatataaatatgttgtagaaaatgacgatgttcatctagcgaaagataaaatagcaaaaattattaaagaacatcaaaagtaactgttggtttttataactgacagtttttttgataaagctccaatagatgtggtaaaatacaaacaaaagagaggtggaaatatgtatattgttaaagttcttgtggaacatgcaatctataaattagatacgacctatgactatttatctaaatatcaagttttggcaggttgtcgagtccatatccgttttggttatcaacaacttgtaggttatgtcgttgaatgtcaagaaacactttttactcaaaaacaattagaagaaaaaaatggttttaaatattcttttatccaagatgtcattgatcaaaaaccattacttaatcaagaattacaagaacttgcaaattatctttcaaaacaaacgctttctacaagaatcagttgtttacaatgtatgctaccacctcaattaaaaccaagtaccaatcatagtgttggcattaaatatcaaaaagttgtttcctttgtaaaagatattccccttaaaacaacaaaacaacaagaagctttaaattatataaaagaacacgatttattacccataaaggattatcctttttcaacagctcttttaaataatatagaaaaacaaggagcaattatttataaacaagtagaagtttatcgaaatccttacaatgaacatctacaacaagaagattatcccttgactactagccaacaaaaagttgttaatcaaatattagcatcttttcatcaatttaaaacctttttactttatggagtcacaggttcaggaaaaacagaagtttatttacacctttctagatttgtgattgaacaaggaaaaactgtcttgatgcttgtccctgaaattgctttgactccaatgatggtctctgcttttaaaagccgttttggaaaaagtgtcgctatcttacattcaaaattatcagcgggagaaagatatgatgaatatcgtcgaatcattgatgatgaagtaaaaatcgtcgttggagcaagaagtgctgtttttgcaccactggaaaatataggtttgattattatggatgaagaacatgatgccagttacaaacaagaaagtccaccacgttatttaacatctcaagtagcgagaaaaaggggtgcttatcatcaatgtccagttgttttaggtagtgccacaccttctcttgaaagctatagtcgtgctttaaagggtgcctatgaattatgtatactttctcaaagggtcaatcaaaaacctttaccacaaattgaattgattgatatggtcgaagaaatgaaagcacatcattatgaagtattatcaaggaagatgaaagctaaaatacaagaaacaatcgataaaaatgaacaagtgattttattgcttaataaaagaggttattcaagttatgttcgttgtttagattgcgatgaagtattaaaatgtcctcattgtgatgtatctttaacttatcacaaagatactcatacaatgcgttgtcattattgtgactttcaagtaccttaccagcaaaaatgtagtcattgtggaagtactaatattaaactgattggtagtggtacccaaaagatagaagaatatttacaaaataattttataaattcaagagtgattcgttatgatgttgattctacaagaaagaagcaaggacatcatcaattgcttaaacaatttgaaaatcaagaagcaaatattttaattgggacacaaatgattgctaaaggattagattttgaaaatgtgacttttgtaggagttattaatgcagatctttctttaaatattcctgattttagagcaaatgaaagaacatttcaattattagaacaagtttctggtagaagtggtcgagggaagaaacaaggaacagtgatgattcaaacgtataaccctgatcattttgttttacaatgtgttaaaaatcatgattatcaaagtttttatcaaaaagaaatggaaatgagaaaacttgcgaaatatccaccttattgttatttaataagtattttagtgcaaggtaaaaaagaagatgatgtgactttttgtagtcaacaaataaaggaatatttagtaaaacaattaccgaaggcaattgttttaggacctgctaattgtacgatttataagatgaatgatatttatcgaaagagaatgacacttaaaataacgaatacaacacatgtttatgaggtattgcatgcaatgagtgattattataataaaaaaggaagaaaggtaaatgtgatatgtgattttaatccatacacaacgatatagttatggcaagagaaaatgcatatatgattttaaatcaatattttgaagatgagagttttttaaatattgctttaaatgaacaattaaagaaaagtaatttaaaaagagaagataaagatttatgtacaaccattgtttatggaacaattcaaaatcttttatatattcaatatcaacttcaaccttatattaaaggaaaaagagtaaagaaaaaaataagggcacttctttatatgtctttatatcaattgatatatttagataaaatacctgaatatgccattattaatgaagcggttaaaatagctaaaaaagaaggttatcaaacaagtcaatttgtaaatgcggtattgaggaattttacaagaaacgaaagaagatcattagaggaattagatgaattagaaaaaatctcgattatgacatcacatcctttatggatggtcaaaatgtttaataaacaatatggcttagaaaaaacaaaaatgatttgtgaagaagataacatgcctcctacaagaagtgggagagtcaatacattaaaaacaacaaaagaagagttattaaaagaaagctgttttgaagaaggaacattgtctcaagatgctcttttatataaaagaggaaatctagcctatacttcttattacaaagaaggtaaagtaacgattcaagatgaatcaagtcaattagtagcaagacttttagaccctcaaaaaacagattacgttttagatatgtgtagtgctccaggaagtaaaacaacacatcttgcagcattaatggaaaatcaaggaaaaatagaagcctatgatttatataagcacaaagtaaaattaatagaacataatttaaaacgtttaggtgttaaaaacgtacatgttcaagcaggtgattctacaaagctcatagaacactatcctcctgaaacgtttgatcgtattttattagatgcaccttgttcaggatttggggttttaaaacgtaaaccagaaattaaatatcatgattcgagtgtgatggatggtttaatcccattacaagcacttttattagaaaatgcgtataatttattgaaaaatgatggtacaatggtttatagtacatgtacaatcaataaaaaggaaaatgggatgatgattgaacattttattcaaaaacatcctgatatgaaagttattgaacaacgtacaattttgaattatgaatatcacacagatggattttatatgtgtaaaatgaaaaagggatagaagatggaacatttatataattattctttagaagaattaactgaatattttaaatcaatcaatgaaaaaccttttagagcaaaacaggtttttcaatggttatatcaaaaaaatgcttttgattttcaagaaatgtctaatatatcaaaagatttaagagaaaaattggaaaaacaatgcatcattgatacctttgaaatacaagaaaaacaagtatcaagtgatggaactatcaaatacttatttaaaatgattgatggtaacttaatagaagccgttttaatgagacatgattatggtcaatcattatgtgtaacaagccaagtaggatgcaatatgcaatgtgcattctgtgctagtggacttttaaaaaaacaacgtaacttaacagctggtgaaatggtgaatcaagtcatggcagtcactaaagatacaggtattcgtgtttcacatgttgttgtcatgggaacaggtgaaccttttgataactatgatgaagtgatgaaattcgttagaattattaatcatcctcatggtttagctattggagcaagacatattacgatttctacatgtggacttgtcaatatgattgaaagatatagcaatgaagggattcaaacaaaccttgctatttctttacatgcccctaatgatgaaattagagaccaattaatgcctgtaaataaagcgtttaatatggatgctttaagaaaaagtgttgcagattatatcgaaaaaacgaatcgtagagtgacatttgaatatattttattagatgatgtcaacgattcacttgcacatgccagacagcttgctcattatatgagaggattgaatgcgtatgtgaatttaattccttataatagtgttgatgaacatggttttaaaccaagtagtcatgtagaggaatttaaagacgaactattaagattacatattaactgtacggttagaaaagaacatggtagagatatagatggagcatgtggtcagctaagagcaaaacgtagtggggtgatataatggaatattatgcattgactgatattggaaaaatcagagaaaaaaatcaggaccaggcagcaacagcaattaatttgaaagatcaggttttaggtgttgtttgtgatggtatgggaggacataaggcaggagaaattgcatctcatgttgtagaagaacatgtacttacatgttttaaagccaatccaccttttttggatgatgaagaagtgacaaattggttaatggatactgttttagaagctcaccaaattgtaaaaagaatggctaatatgcaagaagatacgaaaggaatgggaacaactgtagcgattgcggtggttgatggtgatgatgctttcttttgccatgtaggtgatagtcgtatttatgtttatgatgatcaagaaattattcaaatgacaagagatcatacattagtgaatgaacttattcaacgaggtgcgattactgaagaagaaggaaagaatcatcgtcaaaaaaatgttttaatgcaagctattggtgttgaaatgaatattgtaccagatattcaaaagtataaattaaatgggaagaatattttgatttgtagtgatgggttatttaattctttagaagatgaggaaattttaaatattgttaaaaaaaatatgaatgttaaagataaagttcatctattgattgaacaagcaaatgaacatggtggacatgataatattgctgctgtgttaatagaaggaggacgttaaaaaatgaataaaatcattgctgaacgttatgaattgattgatattattggtcaaggaggaatggcagatgtttatctagcaaatgatacgattttaaatcgtacaattgctatcaagatattacgtacatctttagcgaaagatccaatttatattgcaagatttcaaagagaagcttcagcagcagctgcgctttcacataaaaatattgttgaaatttatgatgttggtgaagataatgatcaatactatattgtcatggaatatgtacctggtagaacactgaaagaattaattgctaaaagaggtgctttacatgtaatggaagctattgacattatgaaacaagtgctttcaggaacagcaagagcacatcaaatgggaattattcatcgtgatttaaaaccacaaaatattttagtaacggatacaggaacagctaagattgctgattttggaattgcttctattcaatcacttacacagtttacacaaacagatgtgattatgggttctcttcattatttagcaccagaattagcacgaggagaaaaagcgacagttcaaagtgatatttatgctttaggaattgttttttatgaattattaagaggacaagtaccatttaatggtgaatctccagtgaatattgctttaaaacatatgcaagaagatttaccatcacttagagaatttaatccatctattcctcaatcagtagaaaatattattattaaagcaactgctaaaaacttaaatgatcgttataaaagtgctacggaaatgttagaagatttacaaacatgtttatctagaacagatgaagaaaaacttgtttttgatcatagtgatgaagtgaatgatcctacgattgttgtaaatccacgacaaatctttgatgaagaagaaccagaagaagttgaagaaagagctgttgaaaagaagaataataatggtaaaggaaaacaaattttagaaaaattaaaaaatcctaaagttcttgcaggagtcgttgcaggtgttgttttgattattggaattatttgttatttcttactttttggtggaaataaacaaccaaatgtaatgccaaatttagttggattgaaacaaagtgaagcagaaaaaatattaaaagattatgatgttacaattaataagacagtttttaaagaattatctgatgattataaaaaaggtttaattacaaaaactgatccagaaaaaggttcttctattaaagaaggagatgttatcacaattactgtttcaaaaggtaaatatattgttttagataattatacgggattaagttatgatgaagctaaaaagaaattaaataagattggctttaaagttgatataaaacgtgaagtttctgataaaaaggcgggaacagttttagaacaaagtttagaaaaaggttataaacaagatcctacagataaagatcgtacaattacacttacgatttctaaaggatcctatgtgattttagatgattatacaggtatgagctatgatgatgcctataataaattgagtggtttaggattcaatgttacaaaacgtgaacaaacttctgatcaaccggcaggtaccgttattgatcaaaatttagcgaaaggctataaagtagatccaacagatacaaatagaaatattactttaacggtttctacaggatatagtcaaacagttccttctgttgttggtttaacacctgatagtgcgaagtcgaatcttgaaaacttgggatttaccgtttctatggaaggaacacaattcccagaatctggtggagatgaacgttatattggtgcagtttataaacaaagtatagttgcaggaacaaaagtagataaaaaaggaacaacaattacaatctattattatgaagactaacatagataaagggcgtattgtcaaggcattagctggtttttattacattgatgatggtcatgaagttcatcaatgtcgtgcccgtggaaaatttagaaaacaagatataaaaccagttgttggtgattttgtagaatttcaaaaaggtaaccatgatgatggttaccttctcaaaatattagagagaaaaaatgttttaagaagaccaccgattgcaaatattgatcaagcattacttgttttttcaagaaaagagcctgatttttcaacaatattattagataagttcttattattgatagaacactatcacattagaccaatcattgttatttctaaaatggatattgaaggggatgactctatttatcaatatattcaagaatatagaaatgcagggtatactgtgattgaaacaagttctaaacaaaataaaggaatagatgaaatcaaggaaatctttaaagatcaagtgactgtgattactggacaaagtggtgttggtaaatcaacgcttttaaatgcgttagatatttctttgaatttagaaacaaatcaaatatcgaaagctcttggaagagggaaacatacgacaagacatgttgaactcatgaatttatatgatggttatgtagcagatactcctggtttttcatctcttgaattagagatggaaccaatagaagcagcgagagcatatcatgattttgatgaatatgctactgattgtaagtttagaggatgtttgcatgatagtgaacctcattgtgctgttaaagaggctgttgatgaaggaaagatttctaaagaacgttatgaacattatttaacaatgttaaaagaattaaaggaaaaaaaggagaaacgatatgattaaagttgcaccttctcttctttcagcaaattttgcttgtttgaaagatgatattgaaaaaattgaaaatggaaaagctgattggcttcattatgatgttatggatggacattttgtacctaatatttcttttggatatagtattttaaaagatgtttctaaagtaacaaatttatttttagatgttcatttaatgatcagtgaacctcaaaagtatgtagatgaatttattaaaagtggagcaaatttaattgtttttcatattgaagcaatggaaaataaagaagatactttagcacttattcatcatattaaagaaaataatgtacaagtaggaataagtattaaaccaaatacaccggttgatgctattcaagattatttatctttattagatgttgttttagtgatgtcagttgaaccggggtttggtggacaatcatttaaagaaattgctcttgataaaattaaagatctagctactagaagaaaagaaaatagtgcacactatttaattgaagtagatggtggtattaatgctacaactggaaaacaatgtaaagatgcaggagtagatgttttagttgctggaagttatgtatttaatagtgatgattacacacaaaggattacttctttaaaatgaaaatagcgttatgtgcaacacatttagaaaagatgatacttcctcaagacagagaatacattggggtggatcatggtgtggaagaattattgaaacaaggaattacgccaaagtttgccataggagattttgattccttacaaaatagacaaactttagaaaatctaaatattcaaattttaccggaaagaaaagatgtgacagatacgcatgcagctatcgaatatgcaatttcaaaaggttatgatgaaattgaaatctatggggctaccggtggacgtctcgatcatttctttgcagtgatgtgtttattagaaaaatatcaatatataaagttaaaagttattgatcaacaaaactgtattcaattattaaaaccaggtaaacattatatttataatcaaggatattattatttctcattgtttgctttaaatgaaagtattctttctattagtcaagctgaatatacattagatcattatttgcttaaaagagatgatccattatgtgtatcgaatgaagttaaaggtgaatatacaattattgaaaataatgaaaatattattttagttcaatcaagagatgctcaataggcatcttttttgattgcttaatatttaccaactaagatattaaatttaataattgtgcaggtgtaaaagatgtttttagaataaagtgttatattataagaagaatatttaaaagaggatgggtgaactaaagtggaacaaacagtaagtaaaattgaagaattattagagaagccatgctatgtgataaattttcttcctgaacaggtaaaaccaagttcaagaggacaattttttgatgtggaatgttatttactcaatagtgataaacattttttgctgaaagataaatttgtaaatatcattataaaattaatgtgttattatcatgtatctatacaattggatgattggattgaccgaccatctttacaaatattagaggatgcaatcaatacaatcatgaataaccattcaggttggttgaatatattgcttccagatgaaactgttcttgtggtttttgagtgggataacttaaatttaacagtgtataatccatcaaaggaaatacaggcacttatgcaaaagatagcttgttcagaaggccttttttggcgaaaatcagatatgatattgataatatttcaaaattagaaatgttttataagagaagcaaataattcttatataaaataaattaatggagggtatttgtttttatataataacatgaaaagattttttgtagaaaaactgtgtttttgttttcttttttattatatgctatgatatcaaaaaggatgtgatggtatgttattaattgataaactaacaaataaagttgatttttctaaaagtgaaattataattgctgattttattattcaattaggagaaaagataaaaaattattcagcaagaagtattgctaaagaaacttatacatcaccagcgactgttttaaatttatgtaagaaaataggtattgaaggttttgataactttaagaaggcttatttaagtgaaattgagtatttaaatcaacaatttggagcagttgatcctaatttaccctttgatcaaggagatactatttttaaaattgctaataaaatgggttctttatatgaagaaacaattaaagatacattatctttattacatcatgatttatttcaaaaagctgttcaattattaaataataataacaatattcatatttattcatatggaacagctttaaatatagcagaatcatttaaagaaaaaatgatgaaaataggaaagaatgtatatattactaataatttaaattatcaacgttatgaagtaaattgtattcctaaaggggattgtgtgatttttatttcttattctggagaaaccaagacacttatcaatatggcaaaaatatgtcaaaagaaaaatattccttttttaagtttaacttcttttggagaaaatacgttaagtcaaatgagtgatgctaaattgtatatttctacaagagaaaatttaacgcataatattgcaaattttaatagtaatttatctatttattttttattggatttattgtatgcttcttatttttctttagattatgaaaataattttaataaaaaattacaacttacatctaaatcagaaagtacaagacattcttcaaatccaatattaatggatgaatctaaacagtgttaaataataaaaaatatttaattctaaaatttttaaacattgttaaaaacgaaagctattcaattataaaagcctttcttctatgttttaataaccatagaaggagggctttttaaatgaaaatatcagatcaattcttatggggaggtgcaacagcagctaatcaatatgaaggtggttaccttgcagatggaaaaggattaagtattgccgatgtagagatgggaggaaatattgatcatcctcgagaaatacatgagagtgtgcatcctcatacttattatccaagtcatgaaggaacaggcttttatgatcattataaagaagatattgctttgtttgcggaaatgggatttagatgctttagaatgtctatcaattggacacgtatttttcctctaggagatgaagaaaaaccgaatgaagctggattgaaattttatgatcaagtttttgatgaattattaaaatatcatatagagccagtggtgacaatttctcattatgaaacaccattacatttagttcaaaaatatggttcatggagaaatagaaaaatgattgatttctttatgaattattgtcaaacaatttttaaacgttataaagataaagtaaaatattggatgacttttaatgaaattaatgaaacgatgaataagaaaaatccttatcatcaagctggtattctttttcaagaaggagaagataaggcatcaactgttttacaagcaagtcatcatatgtttgtagcaagtgccaaagcagttattttaggacaccaaattaatccaaattttaaaattggttgtatggttcaatatccagaaagctacccagcaacttgccaaccaatagatcaaatagctaaaagagaatatatgttgtttacacattattatttagatgtgatgtgtagaggattttatacgaatacatgtttggctaaacaagaacaattgggaggaaaattgattattgatgagggtgatgaagaaatattaagaaagggaacggttgattttattggctttagttattatttttcttctattgtttcttatcaaagagatggttcaattaatgctaaaggacgtaatccttatttagaacttacggattggcgttggcatattgattctttaggattaagagttgcacttaatgaattatatgatcgttatcaaataccattatttgttgttgaaaatggattaggggctgttgatcaacttaatgaagatggtactgtagatgatcaatatcgtattgattttttaggaaaacatattgaggctttaaaacaagctatagaaattgatcatgttgatgttattggttatacaacatggggatgtattgatttagtttctgctggaacaggagaaatgaagaaaagatatggttttatttatgttgataaagatgaccaaggaaatggaagtttaaaaagatatagaaagaaatcattttattggtataagaaagtaattgaaaccaatggacaaacaaaatttgaataggaggagaaaatgatgaatagtttttttgataaaatgggtgaaaaactgatgccatttgcatctaaagtaagtgcaaatcgttatttaaatgcgattaaagaaggtttctttggcgtaatgccagttattattgttggttctttattcttactttttacaagtattcctattaatggttatagtgaacttatgacagggcttttaggggaaaattggagtcaaatatttatggttccttatcgtatgagttatggaatcatgtcaatttatgtagttgtaggaattgcacgttctcttgcacatttttataaagtagatacaagagagtcaattgttgtatcatttattgctatcttcatgttaacacctgttttagtaacagaagatggactaaaaggattaccacttgataattttagtgcatcaggattatttttagcaattattacaacttgtttagcagtagaaatctttagatttgttgttcaaaaaggatggacaattaaattaccagattcagtacctcaaaatgtggctaaaccatttgaagctttaattccagtagctattatctttattatttttaactttgtaagaattggttttgaaatgacaagtttcaaaagtgcacaaaatttcatttttacaatgttacaacaaccattacaatctattggtagtacattaccagctacaattttagttttattaatagaatcaattttatggatctttggtttacatggatcaagtattgtttcttcagtaatgaatcctatttggagatcattatctgctgaaaacgctgcagcaattggacttggaaaagctgctacacatattgtcaattatcaatttattgctaactttgttaaattaggaggaactgcagctactttaggattagcacttgttattgtctttactgctaaatcatctagatataaagctttaggtaaattatcattaattccttcattatttaatattaatgaaccattgatctttggtatgccaattgttttaaatccaattatggctattccatttgtgattgctaatattacaatggcaattgtcacttatgcttctacatatattggattagtcccagtaagtattggagttgaagttccttggacaacaccaccaattatttcaggtttcttattatgtggtattagaggagctttattacaaattgtattattattaatttcaatggctatctattatccattctttaaaatgttagataaacaagaagtcaaaaaggaatctattgaaaaggcataattgccttttctttaatatagggggaaaaatatgttatataaatatgaagaagattatgttgaacaagaagctgattattctatagaacttttaaaacagttagcaactattccagcaccatcttatcatgaagaaaaaagagcacaattttgtaaacaatggtttgaagaaagaggcattgatgcaaaaattgataagatgaataatgtagtgattaagatgtttgatgataatcaagatattgctgtattttgtgggcatcttgatgttgtttttgatgatatggagttattaaaaataacacaaaaagggcattatttatatggaccaggagtaggagatgatacagctaatgttgttcatttaatgcaagtgattcattatattcaccttcatcatttacatggaaagacaggtgttttatttgttttaaatacgtgtgaagaaggattaggaaattctaatgggtgtcgctatattgttgaacagtataaaaatcgtattaaatcatttatttcttttgatggatatttgaatcagtgtacaaatagtgctgtaggttctaaacgttatcgtttgactgttcattgtcaaggaggacattcttatgctgattttggcaaagaaaatgctattgagactttaagtaaaattatgtatgaattaagtcatcaacaaataccaacagaagctaaaacaacttataattttggaaaaatagaaggtggaacaacaattaatgcaattgcttctacagctacattactctatgaatatcgttcttctatgcaaaactgtttagatatcatggagaaacaatttcaagaaattgtttcacactactcaaatgtagaaattgaaattttaggagtaagacctggaaatggtttattaaatcaagaaaaatttgaaaaatttacagatcataatgtgagattgattaaagaatattatttagatgatgtagaaaaatgtgctaatggtacagattcaaatattcctttatcttatggaatatgtgctaatacgattggaaccttaatgggagaaaaagcacatacttatgatgaatggattgatttagattcttataagataggttttaaagtcatgatgaatattattttagaatattttagggattaaaatgaatgtttatttagtaattaataaaattttacaattgtttatgatgattgttttaggttttatcttaggaaaaatgaaagattttgatgagagttttattgataaaatgaatcgttttgttttaaatataacaatgccttgtttaattatttcatctgtaagtgccaataaaaatggtattccttatcaagatttatttttatcaatgattattttaattattatattacctatttttgcttatttgtgtttgaaaataagttctttaaaagataaatcactctatttatttatgataatctaccctaatgtaggtttcattggttttcctctattacaatcattatttggtaaacaatcgcttttattaacagctttaatcaatatgccttttaatctatcattgtttactttaggaatgatgattatgtcaaataataaatcatttcaaataaaaaaactcattacgccaggaattattgcttcattgattgcagtgttattatatattttttcaatatcattacctgaaacattgttacaacctattcaattgataggtaatatgacaacaccattagcaatgattattattggagcaacactttctaaatatcctatcaagaaaatattactcgatagaaagatttacttatttacaatattcattgatttaatcattccaatgattttttcgccattagttcattttcttatcaaagatacaatgattcaagcaataacgatgattattttagcgatgcctgtagctaatggtgctgttttatttgcgaaaagatatcaacaaaatgaatttttagcagcaaaaacagtttttctatcaactttattatcaattataacaataccggtggtggctctatgtttcatttaaataaaaaatattttttaacattgataacagttattttaggtgcttttgtacaagcttatgtcatcaaagtctttattcaaccagctaatttattatcaagtggatttacaggagttgcgatattgattgaaaagattacatcaacttattttcatttctcattttctacttctttaggaatgattgtattaaatgtagcagtagctattttatgttataaaagtattagtcctagatttacgttcttttctttattagaagtttttctagcaagtttctttttaaaaataattcattttccacctatttttgatgatactttattgaatgtgatttttggtggaactctttatggattaatgacggcaagtattttaaaaatgaatgcttcaacaggaggaacagattttgttgcattatatatttctaataaaaaaggaaaatcgatttggagctatgtttttatttttaattcaattatattattgatttttggatttatgtttggttggatccatgcaggatattctattttatttcaatttatttctactagaacaatagattcattttatcatcgttatgaacgtgttactttacaggtaacaacaaaaaaagcacaagctgtgatgaataaatatattaaaaattatcgacatggaatatcatgtgttgaagctattggaggatatagtcatgaaaagatgtatttattacatacagttgtttctagttatgaggttttagatattgtagagttaatgaaaacagtagattctcatattattgttaatgttataaaaactgaaaatttttttggtggcttttatcgcccaccgattgattaaagcaattgaaagattgcttttttctttttaaaaaagagttataataatagaaagagttaaataatgtttctaaagagattgacaatggagaattatatgttatacttaagtagtaatcattcctaataaggaattaaaaaaaggagaaaagaaatatggctaaatttgtatgtaaagtatgtggatatgtttatgaaggagatgcagcaccagctgaatgtccagtatgtcatgtaggagctgacatgtttgaagaagtaaaaggtgaaatgaaattagcggcagaacatgaatatggtatttacgctaaaactgtaaaaaataatcctgatattagtgatgaagataaaaaatatatctttgatcaattaaaagcaaactttgaaggtgaatgttcagaagttggtatgtatttatgtatggcaagaattgctcatagagaaggttatcctgaaattggtttatattgggaaaaagctgcttatgaagaagcagaacatgctgctaaatttgctgaaatgttaggagaagacttagaaccaaatatgaaagcaactactaaagataacttagcttggcgtgttgattgtgaatttggagcaacagctggtaaagttgaacttgctacatgtgctaaaaagaataacttagatgcaattcatgatactgttcatgaaatggctagagatgaagctagacatggtaaagctttaaaaggtttattagatagatattttgggaaataatagaattattgaattatagaagggctcaattgaaatgagctctttttatctacagtagtaattaaattctcaaaaattaaaatattataatcaaaaaaatgtgaaagatatttattgaagtatgatagtattaagtcgctagatataaatatttagcaacgccattaaaaagtattgtaatgacaatcctatttgtatttccagcttctataaacaaaaggctttgataatttaggagaaatgatagccagagaaaatatagaaaaaggacattctatggggcttgaacaaggactagtacaaggacaaaaattggaaagaattgcatcgattaaaaatttaatgaaaaaaatggcaataccattagataaagcaatggacctattagatttatctagtatagaaaaagaagaaatgaaaaaacattttcaatcttaaaagaacgtgcacctacacgttcttttgtttattaatcaatattttacggtaaaattgagaatatttagtgacttcactattaattttctttaccccatatttttctaaaagtgttttttcatcactaaataagtttgttcctaatcctagatgttcacctttgatcttgactcctagactcgcaagaattgttggataaaaatcaaagatagcaaattttctgtttttaggttgaagaggttcaattgcactattaataaaacaattataaggagtacgtaaataggttttatctaagtgcttaaagaatttttcagacatacttttatgatcacccgtaataacaattgttgtattttcataccattcttgtttttgacaccatcttacaaaagcttccacttgtcttgattgacaactaataacattagcgtattgactatcatattcatgtttacactcgtcacaaatatatccatctggtgtatgagtatcaattgtcaccagttccatacaaaatggttgattacttttagccatttctgttaaatcttctttcgcaaattcaaagacttttttatcttcaaatccccaaaaaacatgataatcttgaggaagtcttccttctttctttaaagaagttgtatcttctattttaaaatttccatgttgtttataaaaattagaggtacaaccaaagttagcatctgatcccattaaaattcgattttgataaccttgtttttctaatatttcacccaatgtataacatcctgataaaaatgaagaattttcatcatatttattttttgacatcggtaataaaagcggaattcccgcttcttgtgcaaccattgaagcaatagtccattgtgttccttcaatagtataagaaccccctattttattcgaatgtgaaaaattaatattttcttttgctagcttacctaattctttaatataattatttttttcttgtccgccatcttctttagaaagatacgtattttctacagattctaaataaatatgaattaaatttcttttttctttaaattctaattcaacattttgaggatccacataatgttcttcataaagtttagatgttctaaccatatcaaaaacatacgtaataatttgataattaattaatgcgtaaagcaatgttccaagaattaaaatagtaatacaaataccttggtaatcaaataaaaaaacaagtggtgttttatataataaaaatactcctattaaagttgttaaaaaggttggtggtgcacaatttaaaaaccaatctttaaaaataccttcatctgttccatcacaaggaacaatcatgtgataaatcatttgatttaaggtttttactgaaaaagtacgatttccccataaaatactaaagattactaacattacaataaataaaattattattaaactcatatcatcattcctttttattggttcattctatcataattttttataaagagcgagaaacaaaataccctttttttcgattattcgttataatacttacgaaggagtaaaaaaatgaaagatagaaaattattattttttgatattgatggcacattattgagtgaaaagactcatactgttcctcaaagtgctaaagaagctttaaaaaaagctaaagaaaatggacatctcatttttattaatacaggtcgacctatttctacaatagatcaagagattcataatttaaaccctgatggttatatttgtggatgtggaacatacatcacttatcatgaccaagtaatctatcatcatcaattatctaaagaaagatgtaaagaaattgcatctcttataaaaaaatatgaaattgatgctgttttagaatcaaaagatcatgtttattttaatactcatattaaaaattcttttgttcaaggaattcaagaaagatatacaaataatggtttcaatgtttcaacaagtgaagattcaaatctttcctttgataaatttactatttggtttgatcatgatatccaagcctttagagataatatttctcaagattttgatattattgaacgtagtgaagaaatgtgggaaatcgtaccaaagaatcactcaaaagctacaggtattcaaactgttgcggatgattttaaaagcgatttagatcattgttatgtctttggagattctttcaatgatgaaagtatgttacgttatgttaaacattctattgttatggctaatggtgtacaagctatgaaagatattgcttattttgtgacaaaagatattgaagatgatggtattgcatatgctttagaaaaacttgatcttatctaagattaaaaacgcctgcttggcaggttttttcatttattatattaatctaacttacataacataatgcctggatcttcttcaaatgccttaaatcccattttttcataaaatctaaccgcacgtttattatttgtatcaactaaaacacatataccaggtactttttcttcttttaaaacttcaaataaagcttgcattaactttgaacccacaccattacctgtatattcttctaatatatcaatatgaatatgtgctggatattcaggataaaaacgttctagttcacaattagcattagaaaatctttctgcctttacttcatctaattcgtttaaagtcaaataataaggataagcatttttttcataagcctttaaatccttggcacataaaatataaccacacacctcatctaaatcatttttaagtattaaacagatttctttatcaatataaggatcacaatataaagctaatgttgcctttttagcattatcatctttatatctagatgttgattgagaaatacatacattttgtacttgttgtttatattttagttcatatttaattatttccattttttctttcaaaagaaccattgcaagttcttcccctttcctttttatcattcaaattattacataaaaatgactataccatcaagctcttaatcttcctaaaaaaaagagtatttatgaaatttcataaatactactctacatgttctacaactttttttaaacgtttttcaaaatcacgtctagaaaacataacaatagcattacatcctaaacatttaattttaatatcagcacccattcttacaatcttccattgatttgattttttacatggatgttgtttcttcatttctactatatcatttaattgataatccatatttactctccttgatgatgataaaatgcttctaaagtgttttgtaataacattgtaattgtcataggaccaattcctcctggaacaggagtaattgcataaaccttatctttaacatcctcaaaatcaacatctccacaaagtttattattttcatcacgattaataccaacatctaaaacaacagcgccttctttaacatagtcactattgatcattttagcacgaccaacagctgcaattaaaacatctgctctttgacaaacttcttttaaattttttgttttactatgagcgattgttacagtggcatttttttgtaaacataaaagcgctactggttttcctacaatgttacttcttcccacaacaacaacttcttttcctgttaaatcatagttgatttcatctaataaaaccatcattcctttaggtgtacatggtactaaacttctttgtcctaaaaataacttagccacattttctggatgaaaaccatctacatcttttgatggatcaatggcttctaaaactttatcttcattaatatgtttaggtaaaggtaattgtactaaaattccatcaactgtttcatcttcatttaattgtttgatttcgtttaaaagttcttcttcactaaaagttgcatcatgtgtaatttttaaagaatccattcctacataagaacatcctctttctttatttttaacgtatacttgacttgcttgattttcccctactaaaataaccgcaagttttggtaatctattgtatttattttttatttcttcaacttcaacttttaactgttcttttatcttttttgatatctcttttccactaataatcatgatatgtccccctcatattatttatgattatataggaatgaccttgtaaattcaatataaagaaacacatgtatttatattaaacatcgatatcaaaaacaatctttttctatcctgtatgtttcgcataataaagtttgtgatccgctcgattaaacaatttaacaatttcatcttcttgataaaaaacttctacaccaccactaaaagataattcaattccttttgattgttttccataaagtgcaaattcttcagcaactttattcaaggtatcctctataacttcatgatttatatcatcaaatacaagcataaattcttcaccaccaaaacgtgtaacaattcctttattatccatatttttcttcatagaatctgaaaaagcttgcaatgtttgatcaccataaatatgtccatattgatcattaatacttttaaaatcatctatatctaataaaacgaccgcaaattcttgattttcaatcttcttttttttatttaaatattcaactaaatatcttctattataaatatgtgttaaaggatctaagtgtgccacctcttgaagttggtttgctagttctgaaagtttatcttgttgtaaacgataatgtttcattaaaataatcgacatcataacaatactgatcattgctataaaataagtcactaaaatagcaataagattaggattaatctctattcctgcaaaaagatgcggatacatcactttaatataaataacaattccatcataaaaaaaaataaataaagaacctattatttgccacttttcttctaaaaataatactgtacttacaatacctaaaatcatatacaaaatataataagcaccataaaccaaatataaaacaggaaactctataatatttcctaatactaaaataattactgacggcaacttgctatttttagtatacattcccataattcccgcaatatacataataattgcacaaactaaagtaaatattgttatagacgtaaaaccataaataatagcattagatataaatcctatcgtattagcaacaatagctgtaattgatagtacataaaataaacgtatttttaattcctcattcatctttacaatagattgcatttatcaaactccttaaaatactttttgtggatttcataataatatatgtgtaaataaaaagcaaacaaaaaagctactttttatcgtagcttttcaatatattttattcaccttcatgatccaaagtatttttttcatatactttaaagaatggatagtatactgccacagaaatagcaataagtacaaacataaagataacatttctgatatctaatgctgataagaatccttgtgcaaagaatggtgtaaatgaaggatcaacaatatatcctaatgatacaattcccattttttgaacaagatatccaagtcctgatgaaatacatggcataattaaaaatggaatagataaaataggatttaatacaattggtgttccaaagataattggttcattaataccacaaataccaggtaaaacacttaaacgaccaattgatctaatgtgtttagatttagatttacacattagtaaaacaagacctaatgtattaccagctccaccaattaatacatatctaaacatttgtaggttaattaaagctgttggttcttttccagcattcactaattcagcattgattccagtatttgaaatacataatgcgaatacaattgggaatacaatagaagaaccattaattccaaataaccataaaatattagagaataaataaattcccataaacatccaaatattatcaacacctgaaatagctggtgttaaaatagacataatgaaatctggtaaatttttacctgaagctgctactaaagcaatatttaaaccataaataataataatattagctgcaagtggtaataaactatttacaaaatcagtaactgcacttggtacacttgctggaaatgaaataactaatttcttgcttacaaatcgtgaaatttctactgaaatcaaagcaataataattgcaacaaataatccatcagctcctaaatagcttgtttggataccaccatcttttaatggtgctgacaccattaagaaagtacacattgcaataataccatagactgctgatttcatttgatagctttctgctaaacaataagcaataccaaatgctgaaataagaccaacaagtcccattgtataattatatggtaaagttaatacatcataatttgcgacagcaaattgtttccaactaattaatacttttaaaaagatatttcctgtatgtaaatcaactaaatctagattaattggtggatttgcaacaattaaaaataaagatccaataacaattaatccaagtggcatcatcattcctgatgaaatagcttgtaaatgtctttgttgtgctaacttattagcgaaaggctctaatagcttttctaatttttctatcattttttcctattccccttaaatatttaattaaaattgccaaccattaaatgtaaatgctgtatctactacattttctggatcatattcttctaaaattttagcatagcgttctttataatcattatctacttccatttgtggaataaccttgcttgcttcatgtaagaaatggaaagaatcacgtcccattgcttttcctcttactgtatgcttatctaaagcaacatcaggaatttctgggaatttacccattgcaaatgatttaatacaaatattttttaataaatcgcttgaacgatctttttgacagctacataagtagcgaattgcatgaatgaaatacattggttgatcaccatctgcatattcaaagtttttagacatttgatagagattattgactagaactgcagccattgggtctcccattccaatatcttctactgaaattgtaagtaaacgtctccacattttttctaataattgtggtgaagaaatatacatttcataagcaaacatacatgcatcttcttctttggcacgtctaattgatttttgcaaagcagaaataacctcatctcctgcatagccattttttgtaacgatttttgaccaagggtcgtacattgcttttgccatttttcttgctcctttattttttctatgacataattattgcgaggtgaaacttatgaatattgatcatttaaaagataaatttgatttaaatgaattggaagtctctttattggaatatattaagaaaaatcaaaaacaattgaaaaatattaccattagacaaatggcaaaagataattttacatcaacttctgccatctatcgtttatgtaataaattagaatttagtggttatagtgacatgatttatcatctatctagtaatactcataataatgctcctgctcaaaaatacgaaaactatttacctcattttattcaattattaaataaacataaaaatagtaaaatcgttgtttttggtatgggattttcagctccaattgctgattacatttcacaaagattaactcttaatggcttttgtgccatgagtgttgttcatatggaaatgttggatattagttttcaagacccaacctttcttattgtcatctccaattcaggaattacaacaaggcttgaagaagttgttaaaacagctaaaaataatcatattgatatcattacttttactggtaatgaaaaatcaaaaataagtcaatatgccactttacctattatcatcggtcactataatcctttttaccatgataaccttgttccaaacgctttctttggacaagttctcattatttttgaatctcttctctattcttttttgtcctcaaaaaaataatatactttcatctcttcgattaaaataatttattaagataaaaaaacatgtttccatttttgaaacatgttttttctttttattatttaatattttcaacaatatgtcgtgcgactaaaataccatttgcacccgcttgggcaagccctcttgtaagtcctgctccatccccagcaacatataaatcatcaatttcagattcaaaaccatctcttacttttggtcttgctgaatagaattttgcttctacaccatataataaagtatgttcattcgcaattcctggtgttacattatctaacgcttcaatcatttcaataattgatttcattgtattgtatggtaacacaagccctaagtctccaggtactgcttctggtaaagtaggatctgtatatccttcttttaatctcttatatgttgttcttcttccacgtttgatatctccatatctttgaacaataactgaaccatttgataatttattcgctaatcttgatatttcatgggcaaattcatttggttcattgaatggttcactaaatgtatgagatacaagtaaagcaaagtttgtatttttacttccaagttttggatcatgataagcatgaccattagcaagcattgttccactatggttttcaataacaacatgaccactaggatttgaacagaaagttcttacttttgttcctactgaagtattgtaaacaaatttaccttcatataagttcttattaatttcttccataacaatattgcttgtttctacacgaacaccaatatctacttgattattataaagttttaatccttgatttgataaaacttttgtaagccatgctgaaccatctctacctggcgctaaaacaacttttttagcgtgaatcgtttgtccattttctaaaacaattcctgttgcatgatggtcttctacaagaatatcttgaacagatgttttaaattgtaaatccatatgttgttttaattcattagacatttctgtcataattcttaagttttcttctgtacctaaatgtcttacttttgctcttaaaagttttaacccaacagcatatccacggtgttcaatttctttaactttatctgtagtaggatctgtaatttctttagtagctccatgttttaaataaagattatctacataatgaatcacatcttcaacttcatcattatttaaatagtcagttaaccaaccaccaaactcacttgtaatattaaacttaccatcagaataagctcccgctccaccaaaaccatcagtaatagaacacgctgggatacatccaggttcacgatctttatgaactggacattgtttgatctttttatctttaataggacaatgtctattcataacgtcatgtcctttatctataagtaatacttctaattcaggattttttaaatataattcgtaacatgtcataattcctgctggacctgcaccaacaacgattacatcataattttctttcacttttttctccttcaatttccaaaaatatccaaacctttcacattatagacgactctttcttatatcgcaagtatttacatgtttttttattttgcaaaatgtttttatagttgatgaaagattggtttcattttttcaaatgtacaaaaagaatcaaaacctatttcttttaataattcttttgcttcatcaatataagctcctaaatgttctggcttatgactatcactaccaatcgtaataatctttccacctaattctttataaagctttaaaatatctctcgaaggtgttgaatcctttaaaccataacgatgacttgaagtattaatttcaatacctttaccatcttgaatcacagtttttaatatttctgtaattattgattttactttttcaaaaggataattgccaatttcatcataacgtgtcatcaaatccaaatgacctaacacactataatttttatactttttaaccacattcaacatttcttgataataaccttctatatattcttgttgtgatttttctttttgataatcttgtgtccaaaattcttgatcattgacttgatgtatagataaaatgataaaatcaaaatcatattgttcataaagtttttgataacgtggtattgtatgaacttgcacaccaaattccataccttgtctaattgtaattttaggatatttttttcttaaactttcaatttctttaaaatactttggataatctacatttacttgcggttgtccgtaaaggtactctatcggaccttcatcccaatcttttttgattccataatccacatgatctgtaaaacaaatctcgtccatcttcatcttaatcgcatctttaatgacatcttccattaaataagtgctatcatcactataatttgtatgtacatgataatcactatacattttcatcaccctatctcattttatcaagtttataaacacaaaaaaagcctctcggctctctttgatatataattgggaagggaatatgaaaaactattcatattgtaaaagattgttttatcttttacatgtttaatatacccagcttttgtgaactctatgcaacttttttgtgtcaaacatgtaaagaattattgtgaattatgtgatgataatcttaagtttttattcacatactttagatggaggtgattttgtgtctttactttataaagaagtagatgattttgaagcctatgcttatcatcaaaaacaatttaagaaaatcacaaagaaggatttactaggaaaatggactttatttttcttttatcctgctgactttacttttgtctgtcctactgaattagaagatctacaagaaaaatatcaagaatttaagaaagtgaactgtgaaatttatgccatttctacagatacccattttgctcataagacatggcatgatatttctgaaaacatttctaaaatagaatatccaatgattggcgatcctacacattcacttacctatgattttgatgtctttgatgaaaatgatggtttagctcaaagaggaagttttattattgatcctgaaggtaaaatcgttgtctatgaagtcaatgctggaaatgttggtagaaatgctgatgaacttttaagacgtttacatgcctgtcaatttgtatatgaacacggggataatgtttgtcctgctaaatggaaattaggtgaaaagacgattcaaacaactattgaaaatattggtaaatagaaataatatgataaaatgatattgaggggaggaaataaggatgcttattgataagttaaatattattttaaattctaacgatgaattttctcctaaatatattattagttcatttgttaaaaataacttaaatgatattccaactatgtctattgatgcaattgctctttcctgtcatacatcgaaaagtcaaatttctaaatatgtaaaatctttaggttatgaaactatgaaagattttaaagatgcttgtttagataatatttctagtatggaaagaaccaataaaaccttattttcattacagaatagtatagaaaaacaattttcatcttttacaaatcacatcattgatgaattacattacacaatgaatcaaattgatgaaatcaatttattaaaattagtaaatgatataaagaaaagtaaacgtatctttgtttatggtcatggtcatgcaagaactctttgtacctatattcaaaatgaactttccgcaaaacaaaaagaaactattatctgtgatgttgattttgaaaaagaatataattttcaagatagtgatcttcttttactcattagtatcaatggaaatacgttttactttgataaaagagtggtgcatcatattttaaagtgttcagttaatacatggctgattagttgtaaagataatataaacttttcaaagaactatttatatattccaacattaaataataaatataatgattatttattaagacatattcttgattttatcttgatgtattaagtttccattttggaaacttttttatttaatttctatatattttctataatacctttgtaattaaaagtaaaggagaaacaacaaatgggatttagaaaagattttttatggggtggtgcgacagctgccaatcaatgtgaaggtggagcaaatgaaggaaacagaggtgttgctaatgtagatcttatgcctttaggtgaagatcgttatttagttggtactggtaaaatgaaaatgtatgattttgatgatcaacatttttatccagctttaactgctgttgatttttatcatcattataaagaagatattgctttatttggtgaaatgggatttaaaacttttcgtttatctattgcttggacacgtattttcccaaatggtaatgaagaaaaaccaaatgaagctggattaaaatattatgaagatatttttaaagaatgccataaatatggtattgaacctcttgttactattaatcattttgattgtccaatgtatttaattaaaaaaatcggtggttggcgaagtagagaaatgattgattatttctacaagctttgtaaaactttatttattagatacaaaggattagttaaatattggttgacttttaatgaaatcaatatgattttacattttccttttgtcgctgctggtctttgttttgaagaaggtgaaaatgaaacacaagctatgattacagctgttcatcatcaacttctagcaagtgccatggccacaaaacttgctcatgaaatagattcaaataatcaaattggttgtatgctagctgctggttcttattatcctgaaacatgtaaaccagaagattattggaaagcaatttgtgacaatcgagaagtctatatgtttgcagatgttcaagcaagaggttattatcataattatgcattaaaatggcttgaagaaagaaatgcatctattccttttgtaaaaggagataaagaactattaaaagaaaataccgtggattttgtaagtttctcatattattcatcaagagtaagtagtagtgatttatctaaaggaaaacaatcagaaagtaatattttttcttctgctaaaaatccttatttaaaagaaagtgattggggttgggctattgatcctttaggatttagaagtactcttaatgaactctatgatcgttatcaaaaaccattatttgttgtagaaaatggtttaggggccaacgatgttttagaaaatggatcaattcatgatgattatagaatagattatttaagacaacatattcaagcaatgaaagatgctgtagaaaaagatggtgttaatttattaggttatacaacttggggatgtatcgatttagtttctaatggtacaggcgaagttaagaaaagatatggttttatttatgtagatcgagataatttaggaaatggaacgtatcaaagaattaaaaaagattcattctattggtataaaaaagttattgaaacaaatggagaagatttgtattaaaaaaacagctactgctgtttttttaaatatctttctaaaaatgaatgtgcaagagagccttgtttgatttgttttcttgcttcttcaattgaataccaatgagcttcatcgacttcatttgtcagtttaaaatcttcactatcaacgacaactgcataattatgcattaatgtattagatggttgatagtattcattatcattatatgtataatcaattacatttaaattaacttcttctttaatttctctaatcaatgtttctttcgcattttcaccttttataatatatccagctactaatacattaaaatcttttccatattgtttaataagcaaaatcttatcttttgtaggattaaagataattgttgaaatagcactattaaacattggaaaacgaaattgtttacaagttggacaataaggtacaagtccatctatctcacattctttttctataagtttagttccacattcactacaatatttcattatttatcacctacgccattataacgtaaacaaataacaaccaacaatatcaaatttattagatgaaagcataaagcaatgataaaaaccatttgataactctgtgtaaaatcatataaatatccaattaatgttaatgaactggcactccctacatttgtaagaaaaccaataaaagaataagttcttgcataattttcatttccaaagaaataacgtgttaacattggaattcctacagcaccaactgaataaatagaaccaaacatgaatgaaccgatataaagtaacatgatttcttgatgaattacacctaaaaacaataaacctaaagaaaaacaatttgttagaatcatcatgattactgcttttataggacttaataaatcacttaaaaatccaattaataatttagtactaatattgcctatcatggtaaatgacatgaaagttgctccgatagtaactgataaatgaatacttacagcaacacccgatagatgttgagaaattcctgtaattgaagtatgtaaaagagtaaataaacacatacaaaggaaactgatggttagtaactttattttattattttgaactttagttgtttcttttctactttgataaccataaggtagtaaatgttcttttcgaggatcgatattccaaggaacaattaatgctggaagaactaaaacaagaatacagatagccatgaaacgataagtcatttgccaaccataacaagtaatccatgaacttaataaaggtgaaaagatagcccctgaaagtccactaaaacttaatgctaaactcgtcgctaagccatgttttttatcaaaccaatttgtaataacaactgtaataggaaccattccataaatacctacaccgattcctcttaaaatacctaaaatataaaataaatacactgatcgactataagacatcatccatgttgaaatacttgataaaagagagcctataagaagaatctttttatagttatatttttttattatttttgacatttttaatgatgtcaaagctgttgttaatgttgataaagttgcatgcatcgcaaaagttccttttaacacttttaaacttttagctacaggtgtataaaaaacacctatcgcattggtacataaaccaatagaactggctgctaaacaacacataaaaaaaacaatcatccaatgtttataacttttattgatcataattttcacctcaacaaaaacatataactttataatctctaacgcattagatttcctaaattaagaaaaggaggatcaaatcctccttgcatattcttgagctattaaacttgctataaattgtaattgatatgggtggctattttgatcttgtttagaatcaaaagtaatcacatgatcaataaattctggataactttcttgtttacttgatataagccatatttgtggtttctttaattgattctttaaaattcttatatcaggataatcaaaataggatcctgtataagaaaaaataataagtaaatcattttcatcagctaatgaaatatattgtaattgttgcttataagaaatattagaatacgtttgttttcctaacattaataaatcactttgtaaattaaaagctgctgaacctgcttttaataatccaaatattgcaatatgatcatgtttttttatttctttacataataaatcaatttgttgtatatctattgatttttctaccattgtaatactttcttttacttttgaactatattcttttaatctatctttagctttagaagatgtagaatattgttcaaaagtcatatttgtagtaatcaacaattctcttagttcattaaaatcatttaaccctatttccttacaaaaacgagatatagaactcattgctacagaacattccttagccatctcttgaataccaatacccttaatatcatctaaatgatttaataaatacgttgcaatttgactattcgttgaatctttcttttcactcgctaaagtacttaaaaaaacaatcggtaactttccataaagcatatcatcatctactttccaccagcaaaattatacattaatccttctttcatttcagtaacatccttaccaaagacttctaaaattttaaaagaaaaaggataaggtgttgctggtccttgactcgttacaatattttgatcaaaaacagcgacttcatttacaaaatctccacttacaagtttatcttgataacctgtatatcctgttacttttttacctttaatgacattggctttttctaacacaactgttcctgaacacatcgctgctatatattgatgatgcttattaaaatattgaacaagtgaaatcacatcttgattttctaataaattttgaccaccaggtcttcctccaggtaaaacaagcatatcatagtttttaatttcttcattaaacattttatctgctttaatatacatatcatgcattcctctaacaaattcattattaaaactaaatgtctgacattctaatccacctcgtcgaagcaaatccacaattgttaatgtttctccttcttcatatccttcagccattaatactgcaacacgtcccattttattcatcctccttgacatcaaatgcattaaaataaaccattctctttttaaccactaacgaatctccacctaataaatctacaagtttataagcaaaagcataagctgttgctggtcctctacttgtaacaatattgccatcaatgaccactttatcatttaaataagtcccttgttttattttttgatcatagccttgataagctgtaaattttttatcaactaataaatttgctttttctaaaacaataggtgctgcacacatcgcacaaacatatttacctttttcattcatttgttgtaaatatgaaataagtgttgggttatttttcatcgcttctgctccaccataaccccctggtaaaataaccatgtcataatcaagaagtgtctcatttaagatgtgatcacttcttacaatgatttcatgtcctcctttaacctcttgttcaaaacctactaaatcacattgaagatgtgctctttttataatatctgcaattgttagagcttcaccttcttcaaaacctgacgctattataattgctgcttttttcatcattattcctccatttcatctttacaataatctttacaatgaaatgaaacaatggatttcctaaattaagaaaaaatcctaagaatttcttcttaagttttaagatattcaataacatctttagcatctttggcttctaataaaacttgcatggcttttttattatccataactgcataaagatcttttaaagtatttttagttacttgaggttctttcatattcatagcaattataaatcattgtttctttatctcctgttaaatctagtaagataagatctttatcaatcaccattttctattcctccgttccttacacctatatattagtaaacccctctattcttgaatataacaaagaatcgcaaaaaacatgcaactcttggtatactatttttgcaaaaaaaatgcacataaacctgtaaaaaaaaagacttcactactcagcaaatccttcttctaataattctttttcaatcttttcttcctcaacaccatttgtagaagaaaataaaactctaaataaatatctcgccatggctcctacaataaacagttgaacaggtaaagctatcataaaactacgacaatatgttatcaaataatgaggaataaattgagtatcaaaaccataactatgatatacacctaaaatactagcaagtgccacttgactaataaccgtaaatacttgaatcattaaaacaataacaattcctcaatctgttggctgcacaactttaaaagcaaaatacttagcaactttacttgaaataaaataagcacataaaaaaataatcgcaaactcgatccacatactttttaaaacaattaaaaaagtactattggtaaaagatgatgttgcaagtactgtattgtagagtgtcatcacataaactatcatccaagctgtaatagctgtaaaaacaatagcttcaaattttgttttgggcatttttactttttttcataaatttcctcctaaaaaaataaatgccacctcgccctctgacagtagcaaggtgacatttggtatctaggtgtattttagagatattttattttaaagacaagaaaaaatatttttcttgtgcatctatcacaaaaaacaatcaagctttatttatgctctatgcacaacagtgccttttttaattgtttcttcaaagagatgatctttataactttataaaccaaaattcctaaaataatcaagcataaacaacttaattgattatatccacccaaataatattcatcagtatttctaacaggataaatatcaatttctatacaaatccaaataagtgctaatactcctcctgataaataatgccaaaataatttattttctattttctctttcgtcatcatctttctcctttattttaaatcttccaatttatgaattatttcttgggaaataatttgttaaaaaggaattatattattatactgattcattttttcaaactaaaataacataataaataataaaaaacttattatcaaaataactattttttctattttatactcttctatcaatggattatgtgaaaattaatttttttaattattttgttttatttattcaataaaatagtttataataaccatgttggaagtgtagtgtttgtatagagattgagcatccttgatggatgctcatcttttttataccattttaataaccatgatctacatgtttccattcaccctgtttatttcttacaagtaaccaaatccaatctttataagtactattaggatttaaagaaccatctccaccacttccatcaacatcaaatgttgatgttaaaacaatagcttcatctccaccatattgttgtagtatttctttaaaataattttcattatctcccgcataataaatttcttttaatgtacagcctttaaaattttcattaaaatactcaataactgtattaattgctgaagtaatatcatcatagctataaatatttgaagtgacttctttttctacaatatcattttcttctcttttttctatacgaacaagcatattgatatctgtttgaataacatattgataaaaatcatcaatatatgctttatagtttcctccactataatgactaggaaggatgacttctgtaagaggaagttgttgattcatcaaaatatcttgtgcatgtttaataatttctattgggtctttttcaagagttgatgtaatgctatctgtaaaaccatattcttttgaaacatattgaatgattttgttatttttatcataactaacatcaagtcttaaagttggttcatctttatcattactgaaattaaaataattttcttttttatcttcataaacataaccatttttcatcaattcatctataacttcttgaggaaggagttcttttaattctttgattgtttctgattcacttaaagtactaaaacgtaagtatttatgttttgattgctttaattcggtattgatttctgtacgttttgtttttcttttttgaacaaacatttgtcctttttgattaaaagaaagttctacttcaaaaagtttacttgcttttgatttatagttcacttcaattctaaaattatcagaaatatcttttatcttagagttaaaaagataatcttctggtttccaaataacttttaaacctttttttgtatgataatattttttataaagatcataagaaatcgtagtatcactttgatagacttttccacctagatgaatctctaaaggatttcctccttgaacaatacgaattgattctattttgtcactttgtacatctactgtaaaataacttgttgtaagatacccatctaaataatattttccatcataattttttaaatctaattgcgattgtttaaaatctgtttttttagaaaaatacttttcttcatatctctttttcaattgcactttatccattatatcgacctgatcatgaattaaataataatccataggtgttgcttgagtagtaatagaattataggtttgattataagcaagaatttcaaatgtatcttttgtttctttgttttgaatacctaatacaaataaaagaactacacaagaaataatcaaaataggtttatagtaatgatgtttttttataggaatttgttgaataagattttcatcaacttgaatttcatcataataatttttaaatgatttatttttcatcagcctctatctcctttcttaattgatttcttgctcggtttaataaaacacgaacattattttctttgatatgtaataattctgccatttcttttgttgaatatccttcataataaaataaataaagaactacattatactttttagaaagcttatttaaataaggggtcaaatcaatttcttgcttttcaaaaatataagtttgttcatcgatttcatctactttattatgccaaaaagacttcaaagatgttttactacaattaagtgttacccttataaaccaagctttttcatgttctaaagattcaaaaacaggttttcttttcatataacgatacatcacattttgaaagatatcatctgcttgatctttttgatgacattggctaaaagcaagacgataaaccagatctttttcacgttgaatgacttcttccatatttaaaacctcctttcattagtaatactttttaaaggtatcatatgttacaaaaattataacattttcataaaaaaaataccttggtattaccaaggtaaatgatctatattaagtttttcataatttatattttgactttgataataatgaacttgatgattctcatcatcaaggattttaatgatattatttttaagtatgacaatcgttacttttatatcacctttttgactcataatataaaattcatattgtttttcttgattatcttgattaatataagaaattgtaggattatttgaaaattctgttttaattgttttaatctttttaaaatcattaatatttaaataatcacaaaattgaataactttcttttgtgtcaaaccaccagaatacataaccactaacgaagcaggttcacgataagctaaagccaattggtcacctacataataatcactgcataatctttggatgatattattataattattttcatatttttgttgtttttggactttatacataccaattaatgtaattgcaaaaataaaacaaacaatactgatgataaaaatatcttttctttttttctttcttttttgaataatatattcattgctttgaagaagttcttcatagtctagttttaaaacagatgttattttagcaagtaaggtaatatcaggataacctctccctgtttcccatttactaattgttttgttgctgacttttagtaaatcagcaagttgactttgagtgtacccttttttaagtcttgcattttttattgttctagcaaatctatcattatccatataccttacctcctactttaactatacatgaacctcattgaaatagaaagaaaatgactatctaccaattgtagacatgtttagaaatgtttccaatttggaaacatttttaattttatagataaatgcttctataatgcgtggtgaggtgattaaaatgaaaaaaagaagaataaatagtgagatattgtatttaattgcaatattagttttatcattttcaatagacttactgactattgcaaacatggggttatctgctataaatggacccgcttatattttaagtgaaaaagtttattcacttacttatgggcaagcagaatatattgttgaagggattatttttatcattttttgtattttaatgaagaaatttaaaatgacatatttgagttcttttatcacaggtgttttatatgcaacaatggcagatatttggaaaataattattcctttctttcaaactcaaaatgaaatatgttttcaatttcgtattgtttatttttttataggttttatactttcagcaatggctgtcgctatgttttataaatcttatttatatcctcaaatctatgatttttttgttcaagaaatatcaaaaaaatatcatattactttaaaaatatttaaaacttgctttgattgtacattccttattttatcttttatcatgtctttattcttatttcatggaattgttggtattggtataggaactattattgttgctttgtttaatggaacattcatcagttttttcaagaattttcttgataaacattttatatgtattccaaaattcaccaaacttgaaaaatatttaaagctataaaaaaggctataatgaaaacctaaaagctaggtttctttatagtctttttattcagcaatcatccctttatagttcataccataaagtttagcaaaacgactcattgtatattcaccagcagctaattgttcctttgtaggtgcatatccttggaaaacaaaatacatatcttttccttgtaataaacattcatctacataaccataaaaacgatctaaaacattacgaattgctcctgacatactatgccaataaagtggtgaaccaataacaattgtatctgcttgtttcatttgttcaataacttcatctaattgatcatcttcaaagttttgaccataactgtagattttataatcaactagatttaatgttttaaattcttgatcttttaagaattttttagtaagtcttacagtatttccgcttctattaggacttccattaataaataagatattcattttatacctcccaataactaatatagaattgtgttttatttctaacgattttatagtgtttagtaatattaattaataagttaatttgatatctcctatcaaataaagttgttcatttgaatcaagtgattgaaaagaatagtcattttataaaccaatccaaaaggattagaagaaaagggaaaagcttcccttttatctaattgaatcattaatgacctccaaatactttaaattccattgtatttaatttatcatcaattgttttaacttcttctggacttaattcaacattacctgcttcaaagttagattgaagtctttcaatttttctagatcctggaattggaataataaaatcatatttattaatcatccaagcaagtgacacttgagcatttgtcgcatgatgtatttcaccaatttgtgaaacaacttctaataattcatttgtctttttaataccttcatcactatattgtggcatatctggtctaaaatcttgttctccactaccaaaatcttttttagattgataagctcctgtaagtgccccattagcaagaggagagaaagcaacataagtgattcctaattctttacatacaggcattaaattttcatgccatctagccatcattgaatatctgttttcaataacagttacaggacatacagcatgagcacgtcttaagtattcttcatttgtttcagaaataccccatgctttaatttttccttcttcaattaattctttcatcacatcagcaacaacttctggttctactttaggatcaatacgatgttgataataaatgtcaacataatctgtttgtaatctttttaatgatccttctaaggattttctaattgtttctggtgtactatcaaattcaagatgatctcctttatgtgttactccaaatttagtacataaaacaacatcttttctaaatggtttaatagcttcacctaccacttcttcattataagcaatgcttccatcaggattaactcctgtataacattcagctgtatcatagaaatcataccccatttcatgcgcttttcttaaaatttctacagcttcatcttttggtgttggtacaccactagcatgagataaccccatacatcctagcccaatcgcatttacatacatatctgtctttccaagtcttactcttttcatctttctattctccttcatcatagtcacatgatgctgatacttcagcccatttatctaattctgcaatttttgcttctaaagttgatttaacagctgttacggctgctttacctaaagttaaaatttctggtaaatcatcattatgcacaacatctacaatgactttaccagctttatctggatcacctgcttgttgatgtttgttttcaaagttacctggtcttgatttacccacgactgcttcataatcaccaatttgagctttagttccttgtaaagattcaccgtcatagaatcttgttctaaaagctcctggttgaacaaccattgctttaatacctaatggagcaagttctttcattaaaccatttgtaagtaattctaaggctgctttacttgaagcataatatcctgaacctacagcggatcttgctgctgcaatcgaagttacatttagaatatagcctgatttttgttctctcattttaggaagaactgctttgattaattcaataggtccaaataaatttgtttgatataaagtttgaaccgcttcaatttctccttcttctacagcactacgataaccatatcctgcattattaacaagaacatcaattgttccaaatttatcgtatgcttcttttacagcgtttttaatactatcttgactacatacatctaaagaaacagctaaagccgtttctggataagcttctacaatatccatcactttatctttatttcttgccgtaacaattgcttgatccccactttctaaaacagctttcgcaattccttttccaataccacttgaacatcctgtaattaaccatgttttcattttttagtttctcctttttacacacatattttatttttttattacttaaaagtacaataccaataaagaaatgtgctataatttaaacgcatagtaggaggtcattatatgatagaacttaatcaacttgaacaacttatttatatcgctgaaaataaaacaatttctaaagcagccaaagaattattaatttcacagcctgcactttcacgctctatgcaaagattagaaagtgatttaggagtagaactctttgatcattataaaaataaaattgttcttaataaaaatggtgaattagctgttaagcatgctcaaaaaatcattaaaagtattcaaacaatgataaatgatgtacaagattatgatcaatcatttcatcgtatttctattgcaacttgttctcctgcacccatgtgggatattgaacctttaattaaagaactttatccacaaataacaattcaaacagccgttattaacaaaaaagatttacttacaaaattaaaagaaaaagagtatcaccttgtgattactcctgaatatattgatgattctcaatatttttgtattccttatgttgaagaagatcttttattatcattaccattaaatcatcctcttgcaagtaaaaaagaaattaaatttcatgatttagatggtcaaaccatgcttctttattcaaatattggtttttggcatgatttacatatgcaaaaaaccccaaaaactaaatatctcttacaagaagaacgccttacttttaatgaaattgtcaaagcatcaacacttccttcttatacttctaatctttctattaaaagagagggtaagatgtctgatcgtgtaattcttcccattaatgaagaagaagcccatgtcacttattatgttgtgatgcttaaaaaaaataagaaaaaatataaagatctcattgataaaattgatcattattatgattattaaaaaagagcagtgtatttttatttcttacactgttctttgctttctataataacatctaacaaatcatttatatgattaatttgttcatttgtaattacttttgtttcaataggtttcaataatttacttatatttttaaaattatatctaatttgcggcataagtaaaactaagtcataattacctattactttactacaatcttctgtatgaaatgcttcaacttctatgttcaactgctttttttcaatttcttcttgcaaaacatgacagatattttttgctgaaattgaaaacgaacaaattatcgcaactctatacatctttttctaaaatatataatgcatctctattaaaatatgtcattttaataatgcttgtctttccattaattgtttgaagtggtgaaacatatcttcttgttaaatcaattgcaattgctttatagtttgataaatctaaatttaattcaatgtcaatattgtgtggaacatataacacaattttatcatcttttctagcaattctaatttctggattttcttttacaagtagttcttgtatagcttttaacccatataaatcataagtttcaaatatatattttatataaccataatcccaagcaccatcaaagcataaagcttgttgccaacatttaggagtcgcaaatccttctcccaacgaagcttcaaatcctttatttgtagtatgccaactatagattcctgccgctccataagtaattccagcactggctccagaaagtaaagacatccatgcagctctaatgatatcttctttactccatcttccatacatttgtctagaatatcccatatcttcataacatggttcactatttattactggtttacctttatatttatctgccatttcttctgcaagtaagtaaggcattcctaagttttgagcattatgaccactttgataaaaacataaatccaaatatgaataaagattatctggtatatatgtatatcttccttttatgtgtgttgtatataaacaattaggtgctaattcttttatttgtttagcacatttaacataatattcaatacattgttctgtattaaaatcagtatctccactaataatataaagtggttcatactttgtaaatgtttcatgaataatatttatataattgtcaatacaatctattggcataataccttttgaataaaattgacttgcccatgtatcaggaacaaaattacaccacattataacaagcgctaattcaaagcctttttctttagcacgtgcgcacattttatctgcatgctcaaaataagataaatttaattttttataattatattttccatcaataacttcaaaaggttcataacataaatctgtggcggatgcgtcccattgagggaggatgttgatttgtaatgtgttaaaaccttgtgatttacgataatctaaataataatcccaatcattatctttaatatttgtaaatgcagaccagcatgtatctgctaggtaaaaaaatggtttcccatttttcattagaatattgttttctattgtaagtgacataattttcctcctatttattttctgttgtaaatgctattctacggtagcttctaaactttgttcttgttcatatctttgtttatcagaaactttaaagaatggataccaaattaaacatccaatgaaaatacatacaacttgtaaaattgcagcttgccaacccccagcaagtaatggttttaagataattggcatacaccatggtacttgtacacctgtaaatcttggtactaaacctatgtacatactgaaataagcaactaatgtttgtacaattggtgttagaataaatggtattgccattaatgggttcataattaaaggataaccaaatacaactggttcattaattgtgaataacccaggaataatacctaatttccccattgtcttattttgttttgatttagcaaataataagataacgatacataatgataaagtacctcctgcaccaccaattccactaaaagtatcatagaatgtattacataaaatatttggtaaagctttaccagcagcatatgcttctaagttagctgttgccataggtaaatatacagcagtaattacaccactaataacatttgatccatgaattccaaagaaccataaaagcatttgtactaaaattaaaaccactaaagaccatacacttccacctaaagaatttaaaggtgtcacaataactgtataaactaactgtgtaaatgaaccataaggagtaaatgagaatattgtagccacagcaatgaaaattaatcctactaagattgctggaattaatgctgtaaatgtattagcaatcattggtggtacaccatctggcattttaatttttaatttatcaacattcataaatgcacaatagattcttgtagctatcaatgcagcaatcattgcaccgaataaacctttagcacccataaattccatcatcaatccactatcttttgttagtggtgtagtaataaaaaatgcaaaaactgaaattaatcctgctggaatttgatcacatttaaaacttccagctaaacgatatccaattaagaatgctgcataaattgataaacagcttgttgttactgttgatgcagctaagaaataagttttaactcctattttttcaataaattgtaaataaggatcaaatgggaatacccctaaaagacatccaattgaaccaataatcaagataggtaatgtccccatcaatcctttagaaatagcatctagataaacatttgatgcaaccttagatgatagttccaaagctttattaacatatttgttatccattttatttttccttccatctcatacatattctagtagtgttgcaactctctacaaccaaaagtataatgaaagtggtttcatcggtcaatactcaaactaaatttttatttaagttttaactaaatattttacttatttatttagtgctatcacgttctattatttcagtacttaccattatttttaatgtattttcattttcagaaaatttctctatcaatctttttactgcaacttcccctagatatcttttatttactctgacagttgttaatgatggtgttgaataacttgcaaatgaaatatcatcaaatcctgttattgggacattgacattaagctcttgcatagctcttatagcccccaatgcaatataatcattaactgcagcgaaggcatctggcatctcatcttctccatttataagttctactaagtagtccttaaaatctctataactatcatctatcgttggttgaacaaaggcttctaattctggaactacatttaatccattatccatcatagcttgtaaataacccatttttctttctttaaagttatttatttgattaatagaattaatcaatccaattcttttatacccttttttaactaaataatttgttatttcatacatcccatctctattattaatagataaaaaatcacatttttgatttgtataagcattatcgataataatatatggtattctaaaattttcaaatctttcaacatcttctaactgcatttctgttcctaaaagaattaatccgtcactttttgaaacatcatcaagttgttgtatttctcctatctgatcactatctatatatataatatttaatctataatcttgtttcgttgcctcattttctaaacctctaatcaattcagaaaaaaaaggtgtgtcaccaacaactcgctcttttttactataaataacaagtgtcaaaatacctgtcctttttccagttttaaaatatcctaatttttctgccacttctataatatgatctcttttttctttactaatagatccttttctattattaagtgcattgcttactgttccaggagaaactcctgcttcttttgcaattgcagctactgttacttttttcaatataatcacctcttctttgattatatcacaataaacaaataactaaatatttattatctttatttacctttaaaataaaaaaagatatgatatttttaagatttcactttttaaaaattatcatatccattatttcctaatctaaatcttctccatttgattctattacttttttataccaatagaatgaatcttttcttcttcttgataaatctccagtaccatcatcgtatttatcaacatggacaaatccataacgttttgctgtttctcctgtagaagctgaaactaaatcaatgcatccccacatagtatatcccattaagtcaacaccatcttcattaacagctgcgtccatagctttaatatgatctcttaagtaattgattctatatgtgtcatgaattgaaccatcttgttcgattttatcaaaagcacctaaaccgttttctacaacaaataaaggcatttgataacgatcatagagtctatttaatgcatttctaagccctgttgggtcaatttgccatccccaatcagatgcacttaaataaggattttttaaaccaagtgataaatttccaccacctgctccttcataatcttctggattataagcagctacttgtgacatatagtaagagaatgataagaaatcaactgttccttctttaatgatttctaaatcaccatcttcaattggaagaataattccttctctttcaaattcttttaatctataacttggatagtatcctctacattgtacatctgtatagaaaatattattatgagtatttttccatgcagctaatgtatcttctggatgacatgtcattggataagtgagtgtataagctaacatgcatcctattttaaaatcaggattgatttgatgtcctaatttaacaactttagcacttgcgacaaattgatagtgtgccatattgatcattgtttgtttatcttttgtaagcacaccaccttccatccatggtgacatttctatacagttgatttcattaaatgtaagccaatatttaactttatctttatatctattaaaaacaacttcacaatatcttacataacaatcaactgttcttctatcagcccatgaattccaagcttcagttaaagcaagtggtgtttcatagtgtgataatgtaactaatggttcaataccatattttaaacattcatcaaaaacatcatcatagaattttaatccttcttctaatggttgttcaccttccatacctccattagcaaaaattctagaccaggcaatagataatctaaaacatttaaatcccatttctgccattaaagcaatatcttctttataatgatgataaaaatcagtagcttcatggttaggatataaacaatcatcaaaacattcaaaatgatctacatcttcataattagcccctacaaacataggtgcttttactttatcacctgctttattaacaaaagtaatacaacgaggttctgtatgtgttccattagtaataacatcatcactcgatttaccacgtcctccttcattccatccaccttcatattgatttgcagctgttgctccaccccataagaaattttttggcaaactcattaatatttcctccttcaatttgtatttatactatatcataagataaataattattgttgtatgttcattattagaaaatacttttacatattttctaacatactttttgttctttgataatcttgtgaaggttttgtattatactctaataagtcgaatgatgataaatatgacatttcttcttcatttaattgaaagtcaaataaatttaaattatctttcatatattgtttttccatcggacgtgtaataacacttattctattttgtacaagatatttcatcgcaatttgtcttgttgttttattatactttaatgctatactttttactttatcatcttcataaataggcaaagtttcttctttaccaaagacttgatatccttgtaagactgttcctttttcattcataacttctaacatttgtttgctttgacatcttaaagtaacctttatttgattaacaaccggaataattttattaaaatgaactaaatcaagatattgactctcttgataattagatataccaatacttttaatgaatccttcttcatacatcttttcaagttcacgataagcatgatatgtatttccataaggccaatgaataaaaacaagatcaaaataatctgtttgtagttttctcattgattctaataaagactttctaacttattatccttcaaagtttgtaaaccatacttttgtcattaaaaagatttcatctcttggaattccagcttttcttaaagcactgcctacaatttgttcatttccatatatttgagcacaatcaaacaaacgataaccttcttcataagcttcttttaatatttttgtacactcctcttcatcaaaaatattcattgttccaaagcctaataatggcatttttaaaccattatttaatgtaatataatccatataattctcctttacatctattatttttttactacaatagaattgtaataccctcgtgtaactcgaggtcaaggagaaaacaatatatacattaaaacaagcatgtcaaatattaaatttaactgaacatactatccgctattatacagatatcggtattgtagaagtaaaaagagataaaaataatcatcgtttatttgatgagcaagcactcgattggcttaaaggaactaaatatctaagagaacttggaatgtctattcaagatatcaaactttttcatgaattatgtaaaaaagaaggcgatcaagcaattcaagagcgtcttgatattttaataaaacaaaaagaaaaagctgaagaagaacttgaagcggcaaaacaacgtctccaatttttgaatcataaaatcgaaaaagaaaaaaggattctgaatcatcttattgatgataatcaaaatccaagtaaaaaaatatatactaaagattaatacttactttacttatgaacaattgcgttccattgtgaataaaaaattatttctttatatatctagttgctgtactttttcctatcattccaagtaatccttcttttctcattttgcttgtttttctattgtttttacatcttttgtaccaaatactcctaaaacacatataagaatactaacaacaaagaataaaaccatacttatgttttgatacagttaccattctttcaataattggattaataccatttaaaagagctaaaacaacactataaacaatagcaatcaaataaatattatgaaccaaaataaaactaaaaccaaaaatagatgaaataactaataaaatcatatttactttctttttatcatatcgatcacataaatcaccaataaatggttgggtatcatagataaaatataagaacatgatacaacaaaacttacttcacttgctttatctttatccattaaatatactgaaataagtccagaaaaaacaaagccatagataaataataaaacatatacatcaaaaaataactaccttcgtatttttttatgattgtctcctaaaaatcaaaattatctggatcaggtcctgttcttttatgttgatttaattgattaattaattcaacatcttcattttctagtacaaaattaaagagatctatattttctttaattctattttcatgaactgatttaggtaatataacaatacctttttgtaataaccatcttaaaataatttgtgccgatgatttttgatatttattagcaatttcttgaatttttggattatttaaacaagctccacttcctagtggtgaccatgcttcaacaccaattttattttctttacaatattgaattgtttcttcatcaaccatttgcggattagtttctatttgattaatactaggaacaatgtgaacctttgataatagattttgaagatgtgattttctaaagttagaaactcctatacttctagttaatccttctttttgtaatttttccatttctaaatatgcttctacataaccttcagctggccaatgaatcaaataaagatcaacataatctaatcctaagttttccaaacttttctttaaagcttctctcgtgttaccactacgaacatcatcattccataattttgttgtaacaaaaatttcatttcttggtataccactttctttgattgcttcaccaacagctttttcattatgataaactgcagctgtatcgatatggcgataaccattttttaatgctgtcaaaactgcattttttgtaccttcatgactttgccacacacctaacgccactactggcattgttaaaccatcatttaatttaattcttgtatttttattcataatcttcatctcctaatttccatccataatcgttgtgatatatcattaattttgtcattccaccatcaacacaaatattttcacctgtaataaatccagcttcttcactacataaaaaaagtactaaatgagcaatatcatcaactttacccactctttttacaagatgttgattaacatcacttccttgatattctttattttctgtatcgatccatccaggagaaatactattaactcttgcctttttagaaagcgaaacagccaaggcatgagttagtgctgaaagaccacctttagctgcactatagctttcactttgtggttgtgacatacgatctctcgttgatgagatattaatgacgcatgcatcttcatttaaataatcttttaataattttactaacataaaaggacctgtaactcctacttgtaatgcttcattgaattcttcatagctacaactatcaattcctttaaatataggcttagcattattaataatataatctacatgtccatagtctttgataaccttatttgtaaaacatattagatcctctttattccctatactccctacaaaatagtcattatctaaaacatcaattatacaaacatgcgccccttgtttttcaaacgtctctttaatacaccttccaattccttttacaccaccagttaatacaacaactttattttcaaatttcattttcattccttatttatcaaaaacatttgatacttcttttaataaagaaataattttaagatgttgtggacaaacaccttcacattgaccgcatttaagacattgattcgcctttgcatgatcatcacttgtatgatcttgataccatgtttgataacgtgaactttcaccataaagtatttgactgttataagctgtaaatagatctggaatttgtatatttaaaggacatcctggtgtacaataacgacatcctgtacatggaatagttggtttagataaaactgtttttgttacttgatctacaagtttatattcttcattatttaagggcacaaagtttgacattgttgctaaattatcattcatttgttcaagcgttgacattcctgataaaatcgtcattacaccttctttagatgctataaatcttaaggcccatgaggcaattgattttgaagaatcataatttttatagatttgttcaatatcctcactaaaacttgcaagtgttccacctttaattggttccatgaccacaactggtttatgatgttttctagcaatctctaaattttttttagattgaataaccccattattccagtctaaataattgagttgtaattgaacaaagtctacttctggatgttctgttagtacttgatctaaaaattcaggtgtatcatgaaaagaaaaaccaatatttttaattttgccttgctttttcatttctttaataaaatcaaaacaatgatatttttcataggtaagatagtgtttcttttctatactgtgtaataaataaaaatcaaaataatcaacaccacttaacgacaatgattcttcaaagattctttgaacatcattttcatcttttaatttccatgcaggtagcttatcagctatcgtatatgcttctcttggatagcgttcaactaaagcttttttcatagctttttcactaccagcataagcataagctgtatcaaaataagtaaagcctgatttcataaaagcatctaccatagtatttactttttcttgaataattgttccatttttatcttttggtaatctcattaaaccaaaacctaattttgaatttgataacatttttctctcctctttccttaatccacttatagtttaaaaaagaactcttttccttacaatatttcatcattcaattaaaatgccattttagaaaacacatcttaaaattattatttttgtaaataaaatttacatttcctaattatgataatgattattttataaatacctttttaaacttcttatgatatcttttcttcaaaataaaaaaagatatcataggagtgaggtgaaaagatgaaacatatttatttggaaacattatttaataaaagaaaaaagattcaaggatggtataattcttaaaaaaatagattaaaaaaaacaaaatgaaaaggacacaaggagaaagaattatctatccagtgggagaggaattcgatgtagagaaagtagtaaaagatacaagaagtgaatatgaacgtatcaatataacatttataaatcatcattgtgaaagatgctcactgagaggaaaatatacaaaatcaaaatttggaagagaaataacacatattttccagatggaagaatatcaaaaagaagcaagaagaaatgtgaaaagcggtgaagaattaaagctgatgtttcaaagaaacaatgaaacagaaggaacatttggagactggaaaagctaaccaaaaatatgacagattgtatcgtcgaggagaaaatggtgtaaaattggagatatatctggtggcaataggtcataatataaggaaatatcatagccaaaagaaaataaaatgaattaaaaaagcggtagttctttttaagtacatcaaaaaaacaagttcacattgaaaaaagtgaatacgatgattttgatatttctttaagaaaataaaaagaaaggctgtaacctttcgaaagttgttaaaaatctacttactcgttacaacaccccctttatttttttattactcttttcgagataccaaaaataagaataagaataatatataaaatcccagtaataataaattgactatttaacgaagaggtaaaatgatttaaaagcacaccataataaggtgtaataaaagaccctaaactttgtaatattaaaagtgctgttgttccaacactaccatagattgctactttttcctgtaaaaagggaacaaaagccatataaccataaccaagcaagaatgctgatatataaacaatccataaattatgaatacatcctgctaaaataaatgatactgcacaaataatatagaataaaataagggaatgatcttttaatctattataaatagtgccatacatagcgcctgcaagaagtgatccaatagaaatcaacataataacagtagagccatctctaacacttccataatgattaattgtaattaaagaagagcctttaattacaaagaaagttgcaaaattaacagacataaaagacaagattgaataaaaaattattcttttataattcacttcttgctgaacttcttttgaattttggctatcttttgcattaggaacatattttaaaacaaaaaagaaaatcaaaaatgcaataacatataccagaaaagaaacatgccacccataagcaagtaacattcctgctacataagtcgttaaaaaactacctaatcctccaattgatccttgtagtccaatcatttgacttctttcttttccatcaaataaacttacaatcataattaataaattagaattaatcattcctaccccaaaaccaaaaatagctcttgaaataagcatgatatatacttctttaataaaataaggaataattccacctattccacaaataagcaatcctattaaaagtgatgtcttatgattcattctttttgctaaaaaaccatttaataaaatagcaagcattacaaataacgaaggaattgttgtcattagctcaatcgtagataaagcaacatttttaaaagtatatgctatagctggaatatttccagctatagcattttgacttgctgttactaagcaacaactcaatatagctatttttaatatcatttttttattcatattttcacctcactagcattatatcaagaacctaatgattaaaattaatcatttaaatagactatttttaatatataatagatatggtgataaaaatgataaataaactaatacaatttgatttagatgaaaaactctttagagaatattactatttagaaaaaacagctaaaaacattcaagacttcaaactaaagtatcaagatgatgcttataatttaaatattgttctaaatcctgaaattcttcaaacccatagtttagaagaagattattttgaaaaaaatcaagatataattattttaaaacatccccgttacattcctttttttattcatgatcatgattattttgaaatcatatatatcctaaaaggaaatgccattcaaacgatagaagataaagtagttgaattacaagctggtcatcttttcttactagcccctcaaataaaacacggtattaaagtttttaatgatgaaacagtcctattaaatattttaattagaaaaagtacatttctagatacattttctaattacatgaaagaacatgatataacttttgatttctttttaagtcattactatgcaaaagataaaatcagttatcttcattttcatagtaagcaagatatacaaatacaaaatattattttacaaatgtacgaagaaaataacatgcaagattcttattcgaatacaattttatgccatttattttctttattgcttgcttacatacaaagaaaaactcaagaaaacactgaaatcacaacaaatatcgaaaagaatgaaaacttaaaaatcattcaatatataaacgatcattataaaacaatttctttagaaaaaataagtcaacattttcattattcaattccttattgttctaaatggataaaagaaaagactggttattcttattatgaattattaacacacattaaattacaaaaaagtaaacaattattacttaatacaactttatcaatttctcaaatttctaaacaactcggttacaaaaatcccgaatcttttattcgcacctttaaaaaatacgaagccataacgcctcaagcatatagaaaaaatgaacaataaaacctattgttcattttttcaaacatcgaatattaagctttccataatccatgtagattacaatatgcataaacttcttccactgtttcattatcacaaagtttaaaatcaaccgctggtttttcaccaggttttaaatattttctttgaatgccttgatctgtttttaaagaaatccattcaatccaatgttctgcaaacattggatgttcaacttctcctacttcaacatgtacaagatcaccttctactgtataaactggtacatgtttttcaacagctccatcttcaataccagcttggagttcttgcatcacttcaccacaacatacaactggtactcctttgtcttcaactttttcaataatgtttccacaatgtttacaaatataaaatttttgttccatagccttttccttctttcattatctagtaattattcctatttataatatactctattattcactaaataacaagaaaagtacatatttttacaaaaaaagtagtttgcactacttcatttcctgttgaacataaaatcttgtatcttcaataacatcttttaaagtaatggaagataattcatcttccattgctttttgtactctcattaatttattatctaagatattatgtatattctttcctactggacaattattattgggattttcatgaaaatggaataattcaccattttctacacattctactgattgataaatatcaaataacgtaatttgatctaatggtttagcaatcgtagtacctcctgttcctctttgaacatttaataaatgacttttctttaaagaagaaagtatttttctaatgattactggattgacattaatacttgtagaaagaaaatcacttgttatcttttgatcttttccaaaggtatcgatacacgcaaatatatgaacagctattgtaaatctacttgaaatttgcataacatattcccctttcgtttttatcttacaaaacacaaattgtaatgtcaatcattacatttgaatattattcatcaaaatcagtttgatcacttatatctttccatttttttatttcatcaatttgattagataaaatttttactcctaaatttgttgtacctttacctaaaagaatcattttaggataatcttctttttcaattgttgaaacaatgacttgagctgctttataaggatctcctttttgaccaaatggatcttgagctaatctttgacgtgcttccttaattttcgcataatcatctatacccctatcttcactaggaatatgtgaaaccctaaaattcgttctaaaagattctggttcaacaatcattacctttattcctaatggttctacttcatcccttaaagcaatactcatcttttctaatgccgatttgcttgctgaataataaccacttccaccattacatgtcaatgctcctaatgatgaaatattgataattgcgctagattttcgttttctcatttctgataaaacttctttaattagacaaactggtcctaaaaaattagtattaaataattcttttacaccctccaattcgctctcttaatgatctttatcagttaattaatcaagaattttctaatattcattatgaatcaaaagtctgttcatctgaagaagacttaataaaaggattatataatgaggcgtttcaactcattattctcgatgaaaatgttatttgccactcatggtgtagtaagtttgaagagacttcttaatcactcaattttagagaatgggagctccaaattgattaaaaagtctcttgaggcttatttttttacctcaaagggcaaaattgtacttttttaaaaacatttcaaagcaatacgactttttaccctctgccacctgtgtatagtgtaagaaacttttttaccgacacgaaatccaggaaaatgagaaaagttatgttacgatcctgtaaaaaggcgtctgagcaatgggttatgtgtaaggaatttttttcggtttcttacacgaaccttggaaacagaatagcctgcccatagggataccagattttttctggaaatacgtcccggaaacatcagaacccggtacaggaacggatatggggtgagaacaggagccaaattagagaaaggggggcgtcagaggatggcacagacacagggattcatgacagcgttgtatgagcgtcttagtcgtgatgatgaattaaacggagagtcccaatcagaaaaagcttctggagcagtatgcaaaggaacatggctttacaaatctgattcattttacggatgatggaatttgcggcacaagatttgaccgccccggctttcttgccatgatgaaagaagtggagtccgggaaagttgggacgatcctgattaaagatatgagccgaatgggaagggattatctgaaggttgggcaatatatggaactgcttagacagaagaatgtgcgtctgattgcaatgaatgagaatgtagatagttttcggaaggatgatgatttcaccccattccgaaatattatgaatgaatggtatgcaagggataccagcaagaagattaaattaacctttaaggcaaagggaaaatccggcaagcatgtagccagcacaacaccatacggttacttaaaagatccggagaaccctgaccactggattggtgatgaagaagcagcaaagattgtacagcgaatttttcatatgaccatggacgggcgtggaccgtatcagattgcaaggattctgaaagaggaacaggtggagattccggcagtgcatatggcgaaaaaggatgcagggttatggaaaggcagggtggatgaaatcaaagatccttatggatggggttcctccactgttgtagggattttgaagaaacgagagtaccttggtcatacggtgaactttaaaaccagaaaacatttcaaggataagaaaagtcattatgtcggggaagatcagtgaacagtattcggggacacacaggaacctatcatggatcaggaaacctttgataacgtccagaggatcagaagcaatgtaagaagatacccagatggatggagagaagcacatcctttgaccggactgatgtattgtgcggattgtggagcgaaaatgtatgttcaccgggtaaacaatggaaagagagttccacagtatacctgttcagcatactcaaagattccggttggaacactctgcccgacacagcacaggatcaacgctgatgtggtcatggagcttatcaaggagcttttaaaagcgattgcagaatattcccagctgaaccgggaagagttcatagagacggtgagaaaggcacagacctcacagcagtccagtgagattacaaggctgaaaagcaggctgtcagaagcacagaagcgtgtacaggatctggaaaaactgctctgccggatttatgaagataacattcttggcaagttgccggatgaacgttatgcagttctggacgggcagtattctaaagagcagaaagaactgtcagcagagattgcagagatggaagcagaattatccggttatgaggaagaaaagcagtggcttaaaaaacagaatttcaaaaatactgctgaagatgcatatacgggataaatacaaatcggaatttacttctacttagacatacaaactgttgacagtaaaactcctatatagtattatttgataaaatactatataggagtttttgtatgaaaatgaatggcggatttcttgttaccaaaataaaacaacttggagatcgaatctttgagaagattctcagcgaaaagaatattgatgcgtttaacggagcccaggggcgtattctttatgtactgtggcaggaagatggaatctcaatcaggtcactctcgattaaatgtggattagcgataacttctcttactacgatgctggaaagaatggaaaatcgagggctgataagacgcgttcagtctgaaacagacaaaaggaaaacactcctgtttctgactgaaaaagcacatgccttaaaggacgaatacgattctgtatctgataaaatgggcagtatttactacaaaggtttttcgaaggaagaaattacccagtttgaggaatacctcgaccgtatcagaaagaatcttgaggagtggcagaaatcatgagtatttgtatcaaagatcagattcaaaacatgaatatcgtcatcggatgtacagtggggtgtgcatattgctatgcccgcaataatgtgaaacgctggcatatgattgatgactttgctaaccctgaattctttccgggtaagctcaagatgatggaaaaaaaacgtccgcagaactttcttcttaccggcatgagcgatctttccggctggaagtcagaatggagagacgaggtatttgaaaaaatccgtgaaaatccacagcatcagttcctgttccttacaaagcgaccagatctgctggattttgatacagatttagaaaacgcatggtttggtgttacggtgacgagaaaagcagaactgtggcgtattgacgcactacgggaaaatgtcagagcaaaacactatcatgttacctttgagccgctattcaacaatccaggttcagttgatctttccgggatcaattggatcgttgtcggcaccatgactggagttcagagcagaaaggttcatacggagaaggagtgggcatggtctctgacagatcaggcgcatatgcttgacattccggtatttatgaaggaagatcttgcccctatcatagggaatgaaaatatgattcaggaaatgccggatgaattcaataaagtgttggaggtacagagatcatggcagaagtaataaatggaatcctcattaatgaggcggaaacaaagaacatcatgaccaagtccagtctgcctgtaggcggttactcggtcaatccatatgtaggctgtacacacgcctgcaagtattgctatgcttcttttatgaagcgctttaccggacacaaggaggaatggggcactttccttgatgtgaaacattggccggaaattaagaatccgaagaaatatgccagacagcgggtggtcatcggttctgtgacagatggctacaatccacaggaggagcaattcgggaataccagaaaacttctggagcagctgatcggcagtgacgcagatattctgatctgcacaaagtcggatcttgtggtacgagatattgatctgctgaagaagcttggacgagtaaccgtttcatggtcgatcaacacactagatgaaaatttcaagaacgatatggactctgcttctagcattgagcgccgtatcgctgctatgaagcaggtatatgaagcaggtatccgtacagtctgtttcgtatctccggtattccccggtatcacgaattttgaagcaatctttgagcgggtaaaggatcagtgcgatctgttctggctcgaaaatctcaatcttcgaggcggtttcaaaaagacaattatggattatatcgccggaaaatatcctgatcttgtaccactttacgacgagatctataacaagcataaccgcagctactttgaagcacttgaagtaaaagctgaggaaatggctaagaagtatgattgcccatttgtggataatgaaatgccttatggtagagtcccgcagggacatccggtgatcgtagattatttctatcatgaggaaatccgagggacagagaatacaggaaaaagaaatcgttaatctaaatgaaaattaaactgatgatggtggagagatttatttatcgccatttgaaatcgaaaagttcttgtttgaaaaatagagaaattgtaaaattgaagaaaaaagaaatgcacagttcttagcttatcgagagctgtgcatttttgtaaataaatacttttaattagccgattacggcgtcctctgctgtaaaatgttccagagaattttcttttacctgaatgcagatataagtaattccggaaatatcggatgcaaaaaactgacgctttgcagcaggtgcgatttttagccagtctccagttgaaaggctgatttcttctccatcaattattgctttgccgttacctgaaagaattccatagatttcttcattttctttatgagaatgaacaaatgggacatttgctcctgcaggtagttcgtttaaactgatttctgaacctgttaaagacaacttttcatgcagctcaattcggttttcctttccaatagttgtttttgtgtaatttgtcataataatacctccatagttgatttgtagtttctaattacatggcattagtatagtgtgagacacatacaaaaacaagtacgcacctttttgtaactgcacactcaaaattgaatgtgttacaatagattcggaggtgagaattatgcgagcaaaagaagaattaccggaatgcccagttgcaacagcagtatctctcatcggaggaaaatggaaactgctgattttgcgtaacttgaaagagcgcccatggagattcaatgagctacaacgaagtatagatggtatttcacaaaaggttttgacagatagtttaagacaaatgatgagtgatggactggcatatcgccacgattaccatgagcagccaccgagagttgaatacggattaacggaactcggaacaaaaatgcttccaattgttaattcacttgctgactttggtaactactataaatcactttttgaacaaaattaagtacgttagtatttgaaaagctcgaacaatcggaatttatggagaagacaatgatggataaaaagacacaaaaaataggagtgatttgttcaattgtacagattatattaagcataatatgcttgatttatagtgcgataaatcaagaaaatattataatgtgggtattatttttatgctctggaattttatcgttaagctcgaatattagtagaaacaataaaaaagaagacgagtgaggaagtgcaaattccgattttgtagaggactcgatgaatccttgtaatattgggcgttgcatgaatgttaatttgcgttgcttgatgtattgagggctaatcagtatactagttttatcaaacgaaaggagcaactagagatgcttggtgaaaatataaaaacttatcgacagaaaaaaggatatacacaggaagaggttgccaacagacttcatgtgacaagacagactatttcaaaatgggaaaaaaactattcggttccagatgctgaagtacttgtaaaattagcagatgtattagaggttcaaacaagtcagttacttggagtaaaggcagatagtgatgcgcaaacaactgaagaaaaacagaatgcttatgcagagcaactagcacatattgccgagcagatggcagtcaaaaatcgtcaaagtaagagaatatggaaaacgataggaatagcgtttgcagtaatcattgccgtatgtattattcttatagttatgaatattgcatttttttctgtttatccgaccacagaggatgttcggacacacgaagagactattatgttggaacaatagagttacaaattccagtttgtcgaactcaaaaatattattaaatgaaaaggtagagtgtatagagaaatctatatgctctatttttttgctcatttttagaaaaagtgattaaaaaactattgacattttgttactgggaaagtgaagaactctatttttctcttccaagcaataatcttttaataaataaaaaagaactttcttttaaagatcttgatggtcaaacaatgctactttataaaaatattgttttttggaaagaaagagtattaaaacatatgcctcatacacatttcattatagaaaataatcgtcatgattttcttaaactcttagatcattctgattttgtttgctttacaaccgacctagcaatagaagaaggtatcttaaaaaatcgtgttattaaagaaataagtaatccagaagcattagttccattttatatctgttgcttagaaaaaaataataaaaaatatcaatacctatttaaataaaatcgtttctttcgttccactaattttgcaacgaaatacttttcgttgcaaaacattgcaaacaattttttcattttaataaaaatagtccataaacactagatgttctagtatctatggactttattttttgtcaatccttatacattttattcatcgtttccatctattatttatatttcaataattttttgatgtcaaaatgatgtcacaatatatttattaaaagagcaattctctcatacattagacattttctgtaatttcacaatttattatttccattgtaatatataattttactaagtttgatcatatatcattcatgtaaaaggtagtcttttcctatacatttttattctatcttttacaattatttaaataatcaatattcttgttacaataattcttcgttattaagcattacatctataatattcaaatgctttacaccacttctcctttgtaaaaatctatccaatgtcaaaagatacttactatacccatcggggatgttttctaaaggccgatattctctttcctcagttttatttttcccattttcatcaaaattatcattatcaatagtacgtgcaacttgaatataagcatagttattttctaagtttcgaataataaaatcgacttcaaatcttcctatcttaccgatacttatgttgtaacccaaagatttcaaatagttataaacgatattctctaagacaggaccgaaattaattctattatcagtgttcttaacaaaatagaagcttaaatcagttaaataatacttttcttctccatttaaagattttttacttttcatatcaaatcttttacattttgatataatcttagcattttcaagtattttcaaataattataaactgtggtttttgatacattatcaccatttttctttaactagtcacacaaagcattcacagaagtagttgcaccaaaggtgttaataatgtatgttgggattttttcaaaaatgtttctttttcttattttattattctttttaatatctttatcatatatttcatctattacactatttatgtataatcttttatcttatgatgaatgatattgtaaggttaatggaaaaccaccttctaaaatataagaaattaactcctgatctatatttggattaacttctaaatctaaatattttttcattccaatgtattcatcaaaagtaagtgttgtcattggaaaatcaatataacgcccagtaagtttggtaactaattcaccagaaagaagataactgttacttcctgttataaagatagaaaaatctctttcttctctaaaggaattgactaccctttcaaaatccttaacattttgaacttcatctataaaaaggtattttgttccattaataagtttagtctttgaatcaataatttcttctaacacttcaggtttactaactcttgaatatggtcgtttatcaagatgaataaaaactatgttttctttttttacatcatcttttaacaactcttcagcaatcatctctaaaagagttgattttccacaacgatgcactccagtaattactttgatcatctcagtatcatgataaaaccctctcattttttttagatatttttctctaaaatatattttcttcataagtatcaccattattaatatgccataaagaggctattaactaaactttttttagatttttaaaattagtttagttaaaaagacattttgaacattataaacaatgtattatacatcataaaatattttgatatagtttcatttacttttttaacgaaataaaatcaacctaatcaatagaatcttttaatctaataatggctgtgtccccactttgtccccattttttaaacactaaacaaaaaagcgcccttaataggcgttttctaattattattcaccaacgtatgataacgtatattctatttgtattatttttctttatattttgtctatttttacacattttattcatcatttctgtctattatttttattttaataattttttgatgtcaaaatgatgtcattcttttaaagaatttaaactgaatctcgactaaatctatttatttaaaatccaacttgttcaatcattatccattgttttaattaatttctcattttttaacttcttaaaatcttttctactgagattttttttatatataaattttgaataaatgtactaataatcactattgcaaaaacacaagctaccgataatatgacattcattgttattgttatattatataaaataccaataattaccatatttaacaataaagctataagacattgaaaaattatttctatcattgtcatatttcttaattgcttatgacttatcccattcattttcaacatcataaattctttatttctttttctaaaatactgtatttctataatattgaataaaacaattattaaaataaaactcatagctataataatcatttttattattacatttatttttttcaactcatttatttcatcaatattatcaaagaaaagatgaatacctatccttttatctttcaattcatcataaagtgtaacatatccatcataatcatcaacaaaaacagtatatccctgatatgaatctaatttatcgatatgacactcattataaatttgttgtaataactgaaagctacaataaacatacctattttcacctttaaaatagtgacatttgttattctttgttaaaactccacctataggatatgtttttgtatctttatatagatcgttgtttgctgatacaacaaaactaacttctaatgattcaggattaatattgttatcagctaattctcgataacaataataacttaaatatatagattgactatcatattcaatcagcttttgatgagataaatcattttgttcaaacaagggcacaacttgatataggttatcattgatttgaacttgtgtttgaatataaggatagactccagtattttctttatcaagtttaaagataaaaggtactaaagatgaatcaatggttgtatttgcattatcttttgtgataaacatctgattttctgataaactttgatagctttctatacttttattggttgaataatcagtatagataatcaatatattcattaatagtaaagctattgatataatagataccattcccaattcaatttttttatatttttttaaaaaatatttgatataagaaatataaaacgataatttcaactgatgcttttttgttttttgaatataaatatctttctcattatcatgtttaacttttttaatttctttatcttgaatctcatatatttgatctgcaatcgacatagcataatcactatgacttgaaataataatcgttttttgataagtatcacaaatatgtttcaaagtatcaaaaaccagcatctcattttctttatctaaaaagctagttggctcatctaaaattataatttctgtatctttacataatgcacaggctatggcgactctttgtttttgccctcctgataatgtctgaattgattggtgtaatggtatatctagattaacactttttaaaatttgacgatatttttcttcactgtatcttttattatgaaaagctgcatataactgcatatttcctaatacatcatactgttcaaataaactgttatcctgtaaaacaaagctaatatattctcttcttaaaatactttttttatcatcatcttggatgtcttcatatatattatagtaaaaatgatcatcctcacttatcagtcctatacgatataataaagatgtctttccactgccactaatccctcttattaaagtaatagcatgttcaggaatatcaatatccgttttatttaatatgatataatcatcataaacaatttcaatatctttaatttcaatcatttttcaacttgtcaaataattgaggtaagatatagtggcaaatcatatgaagaacaattgctaaaataattgatattatatttggaaaaaataaagcatgtatttttattgatcttaagccaaataaaacaatcaatattaacataagttttttgaattcatgaaaaacgttcaataaataatagtgttttcttatcttcaatatatcaaattcactcaacccaagctgtttaaaatattcgttgatccttgcattttgttttctttgtacaaacaaaatacttgcagcataaataacaataattgcacttatgataaacgagccataataaaagacattcatcaatgatacaattcctctattaattgcttcactatcgatagattcattatcaacataatatcccatatcagataatttttgtgcaactgtataaacattttctgaaccatctacataaacagataaagcagttggttgccagacgctatcctcaaatactctattgacttcaccatcaaaatctttaggaagttcattttcataatatttatcataatttacacctataacatataattttctatcttctgtttttttatgcttttcaatcatattctcaactatatctcgttcaacataaagagaattgctataagtgttatttaatccgaaagaactccaatttaaaatcccagctataggaagtgatactgattcatgagttacagttacactatatatatacattgactcttcatcatctgttatacccatccatcttccatgagtattgtacaaaggtacagatatatcaaatgttaagtacactccttttaattcatcatctttagaaatattaatactttttttaatcatatctgcaacgtttctagaaatataaacaccttcatttttaaaatctatttctatattttttgattgcttatgattttttatataagtggatactgtaatattatcttctatattaacttgtgcgagttcttgttcattttttatgattgaaattgtataatcatgctttgcattttcgggatcataggatacttctttaatatcttcattaaattcataattaggttctaaacaatcataacgccattcaaccgtttctatattatccaaatttgctatttttttgatgtctttgtctttaagaggaacctcatgattaaatgtataatcagctacgccatcatgaatagcttgtgctgttgatttatagacagttatttcatttgatgatattttttgtgaatatgaatggtgaatgtctagtacatccctactaaagctataaccaaaagctaccattgcaatagaaaatgtaatcataaaatgaagtatttttacatatattttttgcttttttctcattgtaaaaaaagcaggagatgttttattaagatttttactaatatgttgagataggctatattcagtttctttcttctcgtttgatactgtgtttaatattttatccttgatatgatattttatatttcctatagataataacttctcatcatgtgtaaataatacaatacctttccctttttctataagtaaatttaatatgtcacaatatattttagaataggcgttatttaaagatgatgttggttcatctaaaatataaatatctacatctttagccatacacaataaaaatgctactcttttttgttctccgccagaaagttgtgaaggatacatatccatcaattcattcaaatgaagtttttcaacataattatcaagacttatatgacaatctgtcagtttttctatatattcaatatgttctcttatcgttagtccttctaaaaatacaggttcttgtgggcaagttgatacattttgatataaatctaaatctttccaaccatcattgccttttgtcatcaacctaaataaggttgtttttccactgccactttcaccagtaataattgtgatctgtcctttattaaattctatgcatcccttatttaataccaatttattattaaaaacgatatctttatatttaaattccatttgacatctcctcatataaaaatttatttcatagaccatctgacacacttgacaactaaaaataatttttaaaaattaaattccaatattaatacaagaatttttaatcgactatgtcaatcgaactttataaatgtttcaggtggtctatgaagaaaatttatcagatacttaatgacttaagtatctgattttgttaataattacctacaactttagaaccatcgaatttatacttaaatgttttttttgcgttagcagttttgtaattataatttgtcatcgaaattgtccctgttgtattcatatacggatctgaaggtatcgtcatagtagaagaaatataagttgctttaagtccatttgtagaaacagttccccatgatctattccatcttgtatttccactactataataggtagctgagcattttacttttgctgagccaacacttgaactaacagtatcactttgtgtataactataggatgctgcatatattccagttattgacataccaatgatcgcaaaagaactaatcaatttaagtaatgtttgtttcttttttttcatattattttttcctttctctctattttttgaaaacgttttcacatttatatagtaacacatattatattgtttgtacatagtttatctatgtattgatgttttttaaatgtatattataatatagttatcttaacgttaaggaagtattaatatggctagaaaaaataatttttttaaattagatatgttacttctatgtataattgccaaacaagattgttattccgcctaataatttagagtgaacctctaagcaccggataatttaatataccgttatctaggtaacacttttttgtgcaaaaaacgcacataaaacatgatattcacgtacgaaaagtagccgttcgtgaacgaaaatgggaaatagagggagcgagttatataataatattaatatttatattttataacaaataataaaagaagtaaatttttattattaacttatttttgaatataaaagagaggagatttgaaaaatgggtgacaaatatataggaacaagaaataataaaataaatataagtaaagatgatcctgatttagttgcatatttaaaagaaagagcttcagttacagatgcagatattagactttatcttagagaggtaaattttcattgtcctctatgttgtaaagatttacaaagaaaaagtcaaaaaaaagaagtgtaaaattatttgaaatagcacatatatatcccaatagccctactgtagaacaatatttggaattaaaaggcctagaacgtttaggagataattcagaatcttttgataataaaatagctttatgcaaggactgtcatagcacacaagattatcatacaacaaatgaagattatttaaagttaataaaaaatccaaatttgtcaaaaaaaaattgaaaagacacaatgaatttaaaagtaaaaaagatgaattggaaatgaaaaatgatgcatataacaaatttatagaattaaaaaataatgaatctattgataaaaaaagagtatcaaatataaaagatcaacaactatcaattctttcaagtaaaattaatatagaaatgaatagattgaataatataatttataaggaagaaaataatgcacaaattttaagtttttcaaaaaataattatagttttgcaacacctgaaaatacaggtacaggtatagcttataagggattggttatatttgatatttctgttctgaatttgactaatttacctattatagtgcatgactcatttgttttaaaacaaatatcggataaagcatttgaaaaaatattagaattgtatattaaaagtgaaaaacaagtaataatagctattgataaaaagaactcgtatacagatgagacacaaaaaatattagatgaaagtgttattttaaatttaggttctaatggaaatgaactttttggaaaatcgtggggatagactatgtgttaaattatgaatttaaagatataaaagataaattatatgatgacttgaatagattaattaaagcattagaaatttatttgtatcagtatgttaataaaataaattgtgaaaaaaattaccagatatacaaaaaataattgccaaggaggaaatatgtaaaatataaagttttaattatacgaatacaatagaaagagtatatatagataaatctaatatggatattgtctttatgcatgataaagcaaataaagatttggaaattgaaaaataatatggttttgggaattgacgaatttcttccggttgaaaagcaaaatctaagtattgaatttgtgggatttaaaaagttttatcaaagaatatataaagagacaggatgtaagtataaaaattgggttgatgaaataaaaagtgagtattcattatatgtgagaaaaataacgaaaacggatttttgtatgatgaggctatgatatgcaaaaattgtaaaaaacacaatttatatatttttggacactcattagatgttacagatagagatatattaagagacttaatattgaatgataatgtaagtacaactattttttatcataataaggaaaatatgggaaaacaaattactaatttagtaaaagtagttgaagtaaatgaattgataggaagaacgggaggaagtactagaacaataaaatttaagttacaaaaaaatttagtatagatttttaatattaacatttttaaaaggaggatattattatgaaatttgatagaataaatgttaatcgtttggatgatataggttatgtgattgataaagaaaaatttttaaagtttgttaatgatttcaggattattggtgttcattggtctcaacctacaaatattagtgctagttattttttaagattattacaagatggctcaaaagcacgagcgcgtggatttggaaaacaatcatatattgaaaatgatgaatcatcaaatcaattaagtgaattttacgataaattatttgatcacggagcattatggaaattagaaaatggtagagtaatttgtacagcaatgccatatagtgatgaaaaaattgtgcttgatgaatttgaaagattgaagaataaatatgaatatcccgatgacgtgatattaaatttcttagataaaaaatataaatttagaaaaaatggcgatattatggttgttatttcgtttgatgaaatttagattagatagattaaaaatattattttttaaacaacttaaatactataaaaatttatgaaaaaagcaatctaaataatcaaatactttagtaaaaaatcactttaaaatatctgatactttttaaagaggaaaattagataaagcaatttctgattttcctccttttatttttctattttactttttatagtttactctagaattgcctatacatttggaatttatccatgtaaaagagttgagtatttcttttttatgtccaaacgtttttgtaatattatttttaatgtaagcgccaaataaaatagtgtatttaaagaagtcgattgaattgatataataatccgcctaataatttagagtgaacctctaagcaccggataatttaatataccgttttttttacttaatcctcttctttttttaaaaatgaaagtattttttcattaaaagcatcatcttctttaatttcatttaattgtcctacttcattagcacattctccacaaatatcaattccaattgtttgactgtttttaaataaataagcgagtaatattttaaattccatgagttgcatagaaccttgatcccaatctgtttgaataacattttgactcaaaacatctttatcaattgaaatatataaaggatattgacgtaataaatcatcaacttttttccacacttctctattttctaaatcatcatctgttaaatagagaacctgatcttgacgtttaatcaatgaaacctgtttttcatcaatacctattaaaatcactttttttaaatatttattattttctaaactatttaaaatccaagatccacaacttaaaatatcatcaaacatcggttgcatcatatcactatgatgatcaaaaacaactaaaataaaatcatgtttcattttttctatccaaaactcactaacataatgaaaattaccagaatctataaaatgtatgccttcaggagatagattacttattttagcttctattgttcttcttgcttcttgactacaataaccataaacaccttgtaattcatgtaaatcaagccatctaatatttttatgtttataaaacttttcattttcataaattcctgtaaaatccatgaccgtcatgttattttgttttttaaacattttaaacacttcctttgtttttatcctagcataaaaaaagtaacttccgttactcttttaataaatatttttcaattgcttcaacgcacccatcatgatcacaatcacttacaataacatcaccatattgtttaatttcatcaatcgcattatccatcacaaccgcaagtcctgctacctttaaagcttcaagctctgcagagtttcttcctgtatttaaaatcacaattttattatacgcaaccgctctagcaattgcttcttgagttttctttgaaatttgtttattagaatttaataatgttccttccatatcaaaagctattagtttatattccatatgactttctccactacaaatggtagtgtatcatttttaatcaattaaaaaagtctctttccattttagaaaaaagacttgtttttctacaatacatcacaatttacatgctcaataaattcaagaaatgctttagatttttgcgtattctttaaataagccatataaaatgtttgtttttcatctatatctttaatttttatttttttgattggcaacaaatcataaactgccatatcaggaacaatcgctacccctaaatcatgacctacaaaaccaccaacgacttcatcttcctctaattccattgatatatgaggatgtatttttgacttttctaaaagatgatcgatcattggacgaattccactatttttagtaaaagtaataaaaggtagatcttctatttgttttaaatcaatttcatcatttttagcaagtggatgattaagactgacgattacataaaactcttgtgttacaacaggtttaaaaaatatatcttgatcatctacataggaacaaaaaacaatatctaaatcatttttctttaaatcatgaataagatcataagaaaaaccactatggcattgaaaggccacattttcattttgaaaagaagaaattagttggggaatatagctcatccctaatcttcttacaaaaccaatatttaaagtttcttttccttttgaaatttgtttaatattttctatagaatcatctaaacgattaagaattggctcgatttcttttaaaaaaagttttccatactttgttagaacaacatttcttccctttttttcaaacaacgcaacatctagttcatcttccaataaatgaatggcatgcgttaaactcggttgagtaatatgtaattttaaagctgcttttgtataatgttcttcttgtgctaatgtcgtaaaataacgtaattgatataaattcattgtcatcacctaatatgattatactaggacttctttttcttttcgagtacgttttttaaataataagctaattaaaacaccaacgataataaaagctgatcccaatacaaatgaagttgtcaaaacttcatgaaaaacaacaactcctaaaaatgaagaagttaatgtttgaattggataaaaagcactacaagtattagcaggtaataatgataaacttttattccataaaatattcgtaaatgccgtacaaacaactcccatataaacaagtcctaaaacagcacctaaatctacttgaataagagggtgtgtcacttgtacttctaaaaaggaaactggaatattacaaactgttgcaatcaacattgatacttttgtaagtgttaatgcactgtatttattagaaatctttcttgaaataacggacataaacgcccaaccaataactgcaataaaagaaataagaactcctaaaaactgaatattagctcctgtacctataatcatataaaccccagccaatgataatataataccaacaattttattcatttctaatttttcatttaaaataatcatggccatcacactaataatcactggatttaatgaattaataagtgaagccattgatccaccggcaatcttagttcctaaaagttgacaatcaacagaaataaaataaccaataaatcccataataaaaaaatatttataatcacttttttcaattttttctttctcactttttaatgagattaaacttagtgctataaaagcaattaaatagcgaaacattgctactgtaaacgtaggaatctttcctaaaacaaattgactgacaacatacaaacttccccataacataaatgttgtcaataaatatacataagattttttcattttcttctctcccttagttctacagtatacatttctatttatataaataaaaatagataaaaattatcaatttgatagtttttatctataatttattattttgtataacatgtataaccatttctaccttgattctttgtttgatacaaagcctgatcagctaaattatacaagtctttaaatgttgttccatgttcaggataaaaggcaatcccaatactacaagaaattgttcctttaaaattgtcaatttcaatatttcttatcttttgacatatttcttgggctttatttatcgcatttccatgctcttgaatatctttaacaaaaacaataaactcatcaccacctgcacgccctacaatatcctctattgtaaaagactcttttaaaattgagccaaagttttttaaaacttcatcaccaataacacggccatttaaatcatttactgttttaaaattatcaacatcgatcataaaaagtgcccctaattgttgagaagaatcattttttaaatatgtactaatttcattttgcaatgtttccttattttttatacctgttaatgcatcgatacgtgcaaattctaataatcttttttgatgtttattgtttactttataaattgtaaataacaaaatcactaacgcaaaaacaaataaagcaaaaagcaaatattcagcataaatgataaatgtataagattcctgtgctacatctgcatcaatgttataacacatgatccaatcattgatttttaatggataataagctatataagatgttttattattataatttaaagtcatataaccattttcttgtttaatccatttttgttttaaactttgaagatcatccggagataaaacattgtattcagcaaaataactaaaaatactttcagaagctaaaaaatctttatttttaacagcattattataagtaatcaactgcccttctttagaaacaagaaaggccgatccttttccatcataaatacctctaaaaacaattttatttagattcccaatatcatagctaccacctataactcctacaatttctttttgttgatcataaataggtaccgctataataacacgtgtctcccctgcaataacactttcaagtggagcacttaagactctatttccctttagtgcttcttgaaaatattcacgttgacttacattctttacggcaccattatcataatgactttctccatttttatcaataattccaacattttctaattttgtatattctttaatggaatgaattaaatttatattatcttcgcaaaataaatcttgctggcttatatgattaccaacaccttcaagatatcgatattgaatatctatatactgttttaaactttctgtttgtttttctgtattaacaaccactttattaacagattcattttctatatctttttttatataaaagaaaaacgaaatagaacaaatcattataaaaacaataaaaatcatcattgcttttaaatatgctttaaaagagagtttataaattgcttttcttttcatatcgttcaccatcttttctttaaaatattttaccatatttaaacaaaggtaaacaaagattttaataaaaaaagaattatagtatcgctataattcaattaattaaaaaaccttgaggatttcttgagcaacaaataactcaggaaatcaacttttggcttttctgttggttatcaacttttttaactattctattattttcacaaatgttatatcatcttcttaaaatcaaatatattttccaaattcaatacgataaaatcattaataactcttagttcttttctacttgtttttttaataaatccattaatcttttttgtttagcgtagagtttaattatattataaacacgtcgataaacaattcgataatcaaaaggtcttttaatgtaatcggatgctcccatcgcaaaacctttattaatgatatttgctgaatcttcacttgaaattaaaataacaggtatatcatctaaccatttttcttgttccatccattgtaaaacatcaaagccatcaatttcaggcataataatatctaataaaatcaaagaaattcccgaaccatattgtttaatatagtctatacattcttgcccatttgtagcttccaataaataaaaatcatcttttaatatttcataaagaattgcacgatttaactcagaatcatcaacaataagaattgtttgtttagtatcatttctatcagaataatactgatgatctaattctgtaaatatgcaattcttttttcttttagcatggtataataaatgatctgccaaagaaactgcttcttcaattgtccctgtttgatacattgtaatccctgcactcaaagaaaattgaacactttcataccttctgattgttgcatgatgaatattttctaaaatattttgcataattaaataaaaatcttctatttcaatatttggcaaataaataatgaattcatctccaccatagcgaataagtttatcttgatttctaagtgaattcttaatatgttcaacaatcattttaagaaccctatctccgaaatcatgaccaaatgtatcattataaatcttaaaatcatccacatcgagcataacaattcctgcaggagttgtttgatgttttattttttcttcataaaaacgtctattataagcacctgttaatacatctaaataaaaatcatcgtgtttacccaaatactttaaaataagattgctattttcttgtcgcgataactctagttgttcgtctaaacaacaaataatttccattacatattctttttgatctacaacatagtatttagaaatgacatgataaagtttatctttacaatattctaattttgtacaatctttttttaaacgaaatgcttctattgtactgcttaaacaattagagttcatttgatttaaatctgttttttcaaaaagatgtacatttggatatagttcttgataacaagccattttatataaaagttctttcattgttattttactattttgcatgttttttccctcaatatggttttattttaaaaaaagaagcataaaaattcaatgaatatatctaaaaaagagaagaatatgtgatttataataaattatatatgtctttttgactatctttttatatctccttaaatgtccgcaaagccttattttataggctctacgggcattttgcttttgtggtaaacctcacatatctaggtctatcttcttatattttcgctatcaagcgtggttaaaatcgtggtaaatacttctatgcgattagacgctgaacctctgattttgcggtatctatggacgcatgagcgtaccagttcattgtgatactaatgtttgaatgtcccatgatatactgtaaatcttttgggttcatgttcttgcttgccagtcttgtgcagaatgtatggcgtagcgtatgcggtgtgatatgtggcaagggattgtccttgtggtgcttgttatatttctttaccatacggacaaataaggcgttgtaatcaatcgcaactttgggcttgcctttatgattgacaaataagaaattgctctgtccgtctatcacaaatggttctgcctttgggcgtttcttcataacccgttgaaatgcctgtattgtttctctacttaatggcacttgtcttattccgcttttcgtcttaggcgtttcaatataatagccctgttccttgctctttagtaactggtggtcgataattacaacttcattcttgaaatcaatatcagctactgtcagtccgcacagttccgagatacgaagtccagtctttaacagtatcagcacatcatcataatgcttgtgatacacattgtctgtcttgataaatgagagtaaggcttgttcctgttcctctgtcaatgcgactttctctttggtatcattttctaggacttcacttaacttaaaatcaaaagggttcttccttccacaatcgtcttgtatggcgatatagaatgacgcttttaacgagcgtttatggttgttaatggtgttataggaaaagcccttgtctttcatgcgtaacgcccattctttagcgtcagagggcttgattgtatcaatgctcctagcacctaatttgtcctctttcaataaccgcatgagttgttcccgttgtttttgtgtgcttttcttcacatttgccctctgtaagttctgtttggcatagagttggcaaagcgtcattttcttgcctgtgctgtcgataccgtcctcaatatcccgtcttatctgctgttccagttcacgaagtgagggtttttcccgtttttcctttggtgtcgggtctgtgggtgtcaatctccaagcatacacatattttgtgtttccaaatgcgtctacatatttatataagtatttcccgtctgttcgttggctctctccagtatgcaggatacgtcctttactatcccgtcttttttctttcatggtgtctgctcctttccttgttggaaagagccttgatatgacttgtgttcatcataacacatacaaggctcatttgcattagattgcgtccaatttgtcaataacctgttcaaactgtcggcgtttaatctgtatgcggttgccattcataatgagccagccagcgcccttgttttcctctgccaagcgtcttaacttgttttctccgatacggaaatactttgacgcttcttcaatggtaagggtatatttttcccatacgggaatatcctgtgcattactcataaaacaccccctcactttcgattacatctgctatatccgtacacatctgttctacaagcatttcctgtttttcggaaaggtgggtacattcatcaatcattttcatgtagtttgagcctgtcagcctgtcgatttcctctatcatcacgattgacggcatgacctgtctttccagccattgcagagtgcgttccatattgacaggtacggggttcatttcaaaaggtaaactgtcatgggaaatgaatatctcccacagcggataatcgggaaattgcacaaaatcagtaataaggtaaaacaccaacccatgagggttatatgtcaataacaattcctcaactgcctgtactgcctttttatcacgcagacgaatttcaaaacggttgataatatccgtatgtttctttttggttgcctgctccttttgtttttcatacaggcagaaatattttgtgcttgcctttgagccgatataaagggtacttgctaaattacgttttttttcgcttagttttccaccttgtacattttcatagtttttacagcgacaatccgcaccgccatttttgtatttttcagacaaaacgggaatatccagcagaccgcacatatcattgattgccaagtcaaaacgtcggataacaccgccacagtcaagacagcggtttaaaaatgaataccaatccctgttctgtgcctgtaagacatattccatgttgcgtgagcctgccccttttaattctaaaaatacacccatgtgttcatcatcagaagccatgaccttgatttccccgtaggcataatgctccttatagccataatacccatagtcataatggataaaatagtccgctttcatgccaagcacctttcggataacttctaatgcgtcagtcgttggaaaacggacagacagataatcaacgagcagataaaaaggcttatcacagacatagtaattcagacaacgcaggataatgttctgtgtttctttacttgcgttggcttttccgttctcaaagcggttgatactatatcttgatacatgggtaagacttgcaagttctccttgtgaaagaccgcttgcaagacgtttgttcttcatttcaagtgcaaattctaaattgttcattgtattcctccaatcccacaacagccttgaaatacctgtaaaccactattcaaaagaatgtgaaattactatcttcttaaaacttctcattactactcacaggtttggggttgtatggtttttgacttgtcttttgtgaaatagtgcccccctgttagataacgggggcacagtcaaggctcgcaggctcgccagccgacaaagcatttcttccccttgacacaaggtgtcatggcggtaagcctgagaggcttccgccaccgtgtcagaaatactttgtcagcaagtcctgttttgccttttctaacaagttccatttcaaccaatattcatatctacgggtttaatcagatggggatttctttttgaatgtttttgtatttcattctattgtacttattcactcacaatagcatagtaattcttatatgcttatttgtcaatatctttttttgtctttacaaatcatattaagcatgatagacttataacagtgaagatataacgagatatggagggttgtgcaatgaaaataagccatttaggaaataatatacagaccataagaaaatttaggggaatgaaacaacaggaacttgcggacaaaatcggtatcaatatgcagagcctttccaagattgaaagagggttgaactatcctgcttatgaaacgctggaaaagataatggaagtgctggacgtaacgccgaatgaattattatcgggagaatggaagtatgtcaatcagtctgaaaaagaagtctgtcagtttttaagaacagaagaacgtctaaatgcagaactgaaacacggacactatgataacttctttgacagcgaggaagaatggctggaatatgaattggaaaagttacgggaatacattacagactatatcaacgggaaaagcattgaagcgtccgacctttacccaatcaaagaatttatccagcatttgaagtttcaaaaattactagaccgctatgatgatttatacagtatggatatgtttggggaaagcatagagggacataaatataggacaccttatcaagtcgtgaaaatgataaatccgaactcaaaagaggatatggaactgttacgggaagtattaagaaataaccattttgatgatgaggacgagtaatctttttcctcttgcgagaagatacagcaaacaaaaagcccgatcaagagtgcaaagcaccaccaatggtggcaagctcttgacagggctttttcttttctgttgtgggtactcaagaggaaaaaaggaaaagtgtgatgtctcaatttttttatcttgcacgcataaaaagattgaaagaggtgtttgtttccagtataatgttttttgtatagaagcaaggattgaatttttttgaaagaaagggttgacagtcatgttcacacattgttacgcttgcgacagacagacagacaagtaaattctgcccttttttcaattctatcaataataaacagaacgcacagattatccagttataaggggggagtttgtgcgtttttctatgcaaagaatttatgaaaaataaggagtgaacaaactatgaagaaaaaacaagtccttgcagtaagttccgcattgatgattggaacaacaactgcacttacagggcttcctactcctgtcatggcacaggaaaacacagaagttgtgcaggaagccgttgtagaagaaaacaagacagagcaagttcctgtggaacagaaaacagaaaacgcagaagtacaagagaatataacagacaaggaacaggaagaaactgctgaaaatgcagaaactttaaaagaagaaagtacaaaacaggaaacacctgcaacaccagaaaaagaagtggttaccgaagataagaccgttgaagcaagcaaaaatacagaagtaaaagctggaagcattgctattgatgaaacacattttccagacaaagtatttagagaacaaatcattgcagaatttgataaagacggcgatagtgtgttatctgttgatgaaatatcaaaagcccaattcttaaacttacatggtatgaaaacgatatcttcattagagggtattcaatatctaacaaatttgcagtctttagatgtttctacgacttctgtttcagacttaagtccggttaaaaactcatctttaaaaagattagattgtcgttcttcaaaagtaggaagcgttgatttaacacgttatccgaatttggaagctttcctttgcgataatacatcaattaacagtcttgatgtatctaagaatgaaaaattgaatacgttatttgcagatagtacctctatttccaatttagatgtaacaaacaatcctaacttagaacaactatcttgtagcaatacaggattaatggaacttgatgtcacacataatccgcaattagtcactttagatataggagatacaaaagtaaaaacacttgatataagtaagaaccctaatttgaaacaactatcatgttatatgacaaatatagctgaattagatgtaacaaaaaacacaaaactgacacgccttttttgtcatgatacaactattaaaaaattagatttaagcaataatttagaacttgaaatgctacgttgcggtgaaatttttgaacaagggataagaggtcttgatataagtaaaaacacaaaaattaaaaaattaatttgcgatgatttatactggttaaatgtcggagagaataaagttcttgaaaataatcatgcttttgtaggcaacggttatattgatattaaagggaataaaatcgacttaaaaaaagatgttgaacaaggaatagatatttcaaaagtaaaagttactgcaaatggaactttagataaagatacaggaattataacggtagatgatgtaaaaaaaccagttacttatgagtatgattgcggtacttataaagacggaaacgttgttttaaaagtagaattatcgttaaactcacaaggagaagataatacagcaccaactatttctgcaaatgatgttacattgaatgtaggcgatactttcgacccattggcaaatgtaacagcaacagataaagaggacggaactatcactttgacaaaagataatattgttgcaaatgatgtagatacttctaaggctggtacttaccatgtgacttataaagtaacagataaaaacggagcttctgctaaaaaaacgattactgtaactgtgaaacaaaatacaggcgaccttaactctgctccaatcatttcagcaaatgatgttacattgaatgtaggcgatacgttcgatccattggcaaatgtgacagcaacagataaagaggacggaacgattattttaacaaaagataacattattgcaaatgatgtagatacttctaaggctggcacttatcatgtaactttccgtgtagtagataaaaatggtgcaattactgaaaaaacaattacagttaccgtaaaagaaaaagcaacaaataaacctgtaagtccacaacagccacagaaaccgagcaagccaactactccaacaaagcctagcggacaaaagaaccctgtaaaaacaggtgatatgacaaacgtaggattgtttacttctatgtttgctggttcaaccggtgtattagctgttttattcggtaaaaaacgtaaaagaaataagaacaattaacaaaatgtataataacaatcaatagcgactaatgattttcatgtaaaaggacaccaaactatacggtgtccttttcaaattcttacgtcatatcaaggctcattcaatcgtggtaaattcgtggtaaaatgagtgctttcctatatttcaaaatgcttgaaagtatagtgtttatgcggataatcaaaaatcagatataaaattttagataaataacatccttttcctttttattgaaaatattattttaaaacagaaataataacttcctcaaccttttttacatcaattggtttagcaatatgatcattcattccttttgaaattgccatttttctatcttcttcaaaagcattagcagttaaagcaacaattggaatatgagcctttccttcatcagataattctctaattgtttccgttgccttataaccatccatatgaggcatttgaacatccattaaaatcaaatcatagcctttagcaggcatttgttccattttagccacacattaaatcccatcttcaacacgttcaactattaatcccatatcttctaaaatcgttatcgctatttctgcattcaaatcattatcttcagccaataaaacgtatttcccttttgacactccccatgtctaaagacaggagattcttgctacctgccaacattgttctattgaatctttttctaaacaaaattttaaattctctcaatattttcaacctttgaacctcttaaacaggatccctgactctatttctgatcatttgaacgatattcaataggtgtcttatattctagtgaaccatgaattctaatattgttataccaatttacataatcaaacaattctctttctaattcttcaaaatcattaaatattctattaaatgcaaattctgtttttattatcttataggttgcttctgctactgcatgatcatatggacatcctttagcgctaagtgacctatctattttaaaagtatctagtacttcatctataatattatttttaaattcatttcctctgtctgtatgaaatatttcaattttatttaaatcatattttattgtagttattgcttttctaaccaaatcagcatccttatgttttcctgctgcatagcctacaatttccctgttatatagatctaacattaaacatatgtagttccattttcctgcaacattgacataagttaaatcacttacaattactttcattctttcttcttgattgaaatttcgttttaacttgttatctattttatcgttattgcatgtctgtttatgcactttatattgtttgactgtgtacgtattttccttcatgatacgtctaattcgtcgcttactggctataataccttttttctttaattcaactttgatttttctaaatccatagttattacgactatttttaaatatttctttaatatgttgtgttagtttttcttcttctgcgttatatttttttgcaggtttatttttagcgtaatataaagatgatcttgaaatattgagtaatttacacatcgcgctgattggatatttatacgaattggataaaataacatttattttcgtcccataatcagcgctgcttactttaaaatatcattttccttttttaatcgttgattttctttacgaagcttgattaattcattttcttcaggagttctgttatcttctgctttaaatgaacctgaattattgtatttattgatccatgatgataaagctgatggtgttaactcatactctcttacaagttcagcccttggttttccactattatacaattcaacaattttctttttaaattcatcagtgtaatttcttctttctcttgccattttggttacctcatttcatttttatttattataaacagttctctttagaattgtacaataaagtgtaacctatccacctgtaaagatgattacttatgttaaaagatataaatgcattgactgtaatgcttctttttctgatgtaaatcctattgcttatgctattgaatctttttctaaacaaaattttaaattctctcaatattttcaacctttaaacatcttgaacaagattcctgattctatttctgatcatttaaacaatgttgatttcatttatcatcttgatgaagcttccaaacatattgattggctcaatgacttctttgaaaacaatatcaatcccattaccaagaaacagctgtctcatttgaaatcttctaataataaagatatccaaatcccttatgctgatttaaaagttgatgaacctcctctttttaaaaatgattctgttcaacagctttcttttgaagatatcaatcgtaatggcactatcacacctgtaaaaagaagagaccctgattcttttaactttgatggtatttgtccttactgtggtgataaagctaaagattttatctctatcgttgaaaacaaaattaaatctaacaagctctcttctattgatgaaaccatcaattatttgattcttcatcaatctgatgaaatcgctaatttagaaactatttctactaaaaccttttacaactatgtacatcaagggagaacatctataaaacctatcgatcttcctcgtatggttagaaagaagacaaagaaaaactggaaaacctatattcctaaaagaaaaaaggaacttccattgcagaaagaccagattatatcaatgaaagaggtgaatttggtcattgggaaggtgatctggttactggtcccagagatggacaaaatggagcttatcttactttattagaaagaaaaactcgattttattatatgatttctatttcttccaaatcatcaaagaaggtatatatgcaaatcaacaagcttcacaagttttatgggaacagctttaaagatattttcaaatccattacttttgataacggtaatgagttttcaagatggaaagatatggaaataaagcccaacacaaaagaacaaagaactaaaatttatcttggtagaccctatcattcttgtgatagagcttcaaatgaaaactgcaacgctcttgtcaggtattttattaaaaagggaacagatattaatacaatcgataaaaaagcaagcattgatataaacaacaaaataaatcaaaagaaaaggaagatacttggatatcttcctgctgaaaaattatttcttgacgaattaacaaaaattaacgtaactgaaaatacgattttctataaaaattaattacttttttctcttatttccagtttctgcttgcaattcgggtttttataaaaaaaagattagtcgatttaaaatgtggcaagtatagaaaacctattttaaaaggaaaatacgctaaaacgacaatgacaacatagttttaaaataaattcccaaaaatttgcaataatttactaaaaaaatgagaaaaacatatatatactaagtgttaatatttatatatatattaagtattaatatatatataaatattaagcagggcagtttagtctaaaaataaaataaattatatttgttttacaaatatatagtagtctctactggtctgacttagcttagaatatggaaagggaggaaaaatatacaatgaagaaaatcttaaaacttgttatttgttgtgttttagtgttaggattgattacaactatttcggctaatactaataaaactagtgcacttggtgaaactagtaatattgaaagttttgaaacgaaatataactatgatacaattgatgtcaataaatcacctaattttcacgttaatgacacaacatcagatgcttcacgcattcgtacttcgccgcattttattaatactaataaatttacgacgagtaatgaaaaaaaatgcacaattaaataaatatggagcaatattgttgttatcagatttatggtgtgcttatgattggggagatgcaaatgttagctatgatcaagtattaaaaaatgagtgggcactatcaccccaaacaaatattaacaatattgtagttgatgtcaaaacaaaagatggaacgtttagcagacgaacattacagttcaatgatgcagattggaagatgtatttagaggttaaggatactaatggggacagagcagttttcacaccgaacaatagtaatggaacaattagaattaagaaaaatggaactaatacggatatcactactttaaagttagttcaaggtcgtgttactaagcaaatgaataagggaatcattgaatcaagtaaacataatttcgatatgtttaaaggaggttatggtagcccaagttacaatacaaaccaatggaaacctgaatacgctcaaaatttaaatcaatatactacttattttgttagaactgtaaattttggaggaaaaattggatcggttgatttgcttataaaagctactaatattattgatgtaaactgttctggttgtttaacatacgcgatgagcaagccaactattgtaaatcagcaagctattaaaatcaataaaagaagtataaattttgataaaaataaagattcaaaaaatgttcaattcagtattacaggtgacaatactgctaatgttaatttaactttaaatggcgaaggtagtgctaccgataatgttcaaattcctatgccaacagataaggatgaatttgaaattgatgtcaaagaagtttacggcaatggttttaaaactacaccagaaaatggctaccatgtgaaatttaaatctaaatatgcaatcaatggaattaatcatatcaaaatttggagttattcattagataatggaaatacatggagcgaatatgaagaaattcctaatttaaattttattaacgctaagcctaaagttacttatacaacagatgggcatggaacattaagtaaaaatgaagaaattgttgatatcaatggtagcccagaaggagttaaagatactccaaatgaagggtacaattttaaaaattatgttgtaaataaagacgtaaaattaagagatggtactgttattaaagcaggaaacgctattgaagaaaatcaaatttctcaaattgtagttgaagaagatattgaaattcaagcagttcatgaatcaaaaattgatatatcattagatgaccgttttacatgtaatcaaccagttgacaaagtttataatggtcaagaacaaaagtggactccaactattaaagataatgttacaggaaaagatttagttgaaggtgttgattatgatgttgtttatagtcaagatttaacaaatgtaggtgatgtaacagtatctatcaaaggtaaaggtatatatcaaggtgaaaagccactttcatataaaattacccctaaaaaagttaaattaacagcaaacagcgcagaaaaagaatatgatgggaacccaattagtgattctggatattctgtatctgacggtggatttgttaaaggagaagaatttgatattagagttactggtgagcaaacatttgttggtgaatcgagcaacacaattacagcagtaactcctaaaggtaatgctaaaaaagaaaactatacaattgagttggttcctggaattttaaaggttactgatggaactaaaaacaaaccaattgattctaacaaagttattaaaaaatcacatgacaattctaaaacttataggttgggagaagtcgttgaatttactattgaagctactaatatttatggtcaaaataaaaatatgattattgaagagcaagaaggggttactattactggtaatacaaggtttgaaaatgtcgaacctggaaaaactgtaaccactacagctcaacatacagttactgaagcagacatactaaaaggtactgtatatacaaataaagtaagtgtttcttttgaaaatggtaagaaatttgaaaatactgataaggtagctattgaaactaaaaattctaaattaacagtaaataaacgtactgtaagtacaccaaaagacgggaatgtgtacgctctaggtgaaaaaattgaatatgaaatttcagttacaaatagcggtaatctaactgttaaaaatatagaagaaatgatgaattaacaggagataaatggactgtaaaggaattagcgcctgggcaaacaagcgaaacttttagaacatcttatactgtaactgagaaagatgttttagcaggtactgtaaaaaacaaagcaacagctaaaggagaaagtcctgataaggacaacttagaaacaaaagttgatcctggaataagggaagaagctgttgaaacttctaaaccaagttttgtagttattaaagaagctcaagaaggttcttacaaattaggtgaaacagttgtttataacattaaagttattaacaacggtaatgtatcaatcaacgacatcaatgttagagatgatttaactggtgatacttggacaattgatactttaaaaccaggagaagaaaaagaattaactgctaagtatgttattactgaagataacatattagatggtgaaattgtaaatgttgctagtgctaaaggtcaagatccaaaagggaatgatatagaagaaactggttcatcaacaattactccagaagaaattaatgctcatatgattgttaataagaaaacagtaagcaatccaaaagacggtaaatcttataaatatggtgaagaaattaaatatgaaatcactgtaacaaatgacggaaatgttactttatacaatgttaatgttagtgataaattaacaggagataaatggactattaaagaattaactcctggagaaactagtaaagtattcaaaacatcttataaagtaactgaaaaagatgttctagcaggttcagttgttaatacagcaaccgcaacaagtgatgatatcttagataaaattactccagaagtcgttcctggtaaacaagaagaaaatgtagaagctgcaatttcaagtgttttagttgaaaaaaaagctaaagaaggtacatataaagtaggtaatactgtaacttatgaaattaaagttatcaacaatggtaatgttactgtttcgggaatcaaagttattgatgaattaacaggagataaatggactattgataacttaaagccaggagaagaaaaaatattcactactaaatatgtaataaaaaaagcagatgaagatagaggatatgtaaaaaatactgttaaagtagaaggattaggatctaatggaaaagatgtcagtgttaatggtgaatcaacaattaaagttgaaaaaactgaagttgttacaaaacctacaacaggtgatgatactcaattaattctatgggctactttagcaataacatgtggtggaattattatttatttaacttctaaaataagaagaaaagaagaaaaataatatttattgaattgattactacaatagaaatcattcaatagataaaacttagtagaaacagatctcatgaaacagaagaggtctgtttttactacatatattaaaaccacaagattttgaaaagcagtttcaaatatcatggcttgaaataaaacctaacaaatgatgtggggcaaatttgccccacgtttctttatacattagaaatcaatttcggaaatatctaagtctgatgatgtatcaacatcatcattttgtgcgacaggcagttgcttatatgccatgtttataggggcatgatattttctatttacaaatggttgctcaagatagttagctataaacttgaaatgtgtcaaggaatatagaaatcctgtaggtgaaagtcctacctcatgtgcactagtgctattcgagaagcttaatctagtgcaccactgtgaagtgatgtgtgaaggagatgaccaattgaattgtttgtaaagacgttgaaagaatgaaatgattcttactttaaggttatattgtaggccatcagcttctttagatggattgaaaatcacatctacaagataaatatctctaaattgtgctatagtgatattagggtatggttttttaaaattgacaatgtaatcaatttcattgtcggatgcacgattgttggctgccaaacctttatcactgtggttcaatgtagaatctatacctttttcttttaaaggacgaataagctgacgcttagaatggccagtaataatagctaatttgtcataagataaattatgatcatcatttaattttttagacaataaatcaatagcttcttttttgtccaataaaaaaacctccttcatataacatgatagaggataaattatagaaagaaaataatggtgacatttttgcgggattttacggtgacataattgctgaatcttaacagaaatataaatgttgttgttaaaatcataaagatatgctattttgatagataggagataatgaggaggggtgtgtatagaaagtgaaacaataacaaatcattgtcttgttaattgaataaatgataaataattgttgaataaagaaggactattaaaaatatagagaactcacctaagtagaaaaaatatctaagtcgaaaagaatttagttgaattagagaaaagttgggtttgagatgatctttacctttttatattaatgttaatgaagcctttatgtaaagcaacagacaatgaaatcgacaaagagtatttttttagatttatgggagagataaactcaagtttataagtttatttgctttcggtaaaggagatgaatgtatgagaaaaaaatcaaagaaagcaataagtagtattttagttttgtttgtgttgtttcaaatagtatgtcccgtttcttcctatgcaatagaaaatggtggacaagaaactcaagaaacgacgaatgaaagcttagtgatggatgaaaacactggtaaagatgaagataacagtgctcaggattcttcaaaagatgaagaaaatattgttgttatggctgctcaccaaagtgaagactataaatatctttctgatttagattatattacagaaaataattggtcttatgcaggatggggagaaatcaaaaaagacaagaatattgaaaatgggcaaatcagtttacttgttgatggaacaagggtctatttcagtaaaggtatgggagcgcatgcttcttcacaacttacctatgatgtttctggtttttcaggtacatatacccgatttgtttctaaaatgggagtcgatgcttctaaaaatggtctaggagaagtttggtttagaatttctgcttcaaaggatggaacaaattgggatgaactttataaatcaaatccagtaacttcaaaagacaatgccttagatgtagatttaaatattaaagattataaatatttaagattatatgcagataaaaatggctcaaatgcagtagatcatgctgtttatgcagattcgcgaattgtaaaagaaaactatgatctttcatcagaactttttgatgatattaaaaaggtatcttactatgatgaaattctttctaaaaatacagtagaagaaaactataataatcatttcgatacagtattaaaaagagaatttgttaatcgcatgggttattggaatttacaaaacagtatcaaagatgatgatactggtgaagctaaagaagctattaaatggatttttaatgaccaagaaaacttacaactatttattgaaactggaaatgtaggagattctttaaaatgtgttagtctattaaaagaattatatagtaagcacaaagatgatcttaatgatcaaacacaaggtgatgtttataaaaagatgatgattgccttagcaattgcttatagtacagatagaaacggttcaccgttgagtttcaatatgcaaccgaattcttatgatgctttaaaaagatatgaaattataaaaaacttatacgattcaggtctgtttgctagaaaagatgaatttagtacatacaacatggaacttattcgaatggtaatgaatgattctattagtaatgatgaaatcgattggttaagacattactcgcaatcacgtcatggaacggatctcaataaagctctaaacccttataattatatgcattatgtttcaccaaactatgctcaagataaactttatgatgcaaacaataaagaaacatatgatacgaagtatcaattaagtaaatataacattccttatggattaaatagtgatggaacaaagacatcaagaacatggatggttatggaagctggaggtatttgttggaatatttcaagattaggacaaaacttaaatcgtgtttatggaataccaacagtaggtatctatcaaccagctcatgaatcttattttacttattcacaaaatagtgatggtaaaggtatctggagtattggaaacaatatttttggttggggacaaagttcgtcaaaatggtatggtggaaatggaacacgtttattattaaattggaataataaatcatttacacgaccacatatgggattaaaggttgatctaggtaatggagtgaaatcggatgtaggaaataacggtggatatcaattattaggacaagctgctttaaataactatgaagcttatcaaaaatcgctttattataacttaattgctaattcttatgaaagtggaacacaaaaagaagaagtttataataaagcactagaagttttagatatcaatttagatagttttgaagcaatacttaatctttataaacaaaaaggtgataaagtaacaagtgcaaattggctagaattcgctaaaagagtgatttcaacatatacatactatccaatggctatgacagatttattaagagtgattaatccttatttgaatagagaagatgcactagaagttgatatgttaaaaacagaagctttgaataaagctttaaatgcgacagatgatgaagtgttacaatcaggagcatgtagagaaattgcccgtgaactcctaggcagtgacaaagtcgatttagcttcattctcttttgatggagaaaatgcgggtaagatcgttatgaattcaaaatatgatgattatgatttccaagtccaatatagtctggatgggggaaatacttgggaaacctcattagaacataaaatagttttatctaaaaaacaaatcgaaagtattactgctgataatgatatccaagttaaaatatcaggatcaaatcaagtgtttacgattgatattttaaaaggtgaaaatatttcttcaaaaacacttgcgatgaatgatgatgaagattcctttgttggaaaaacagaagttttagaatatagtatagacaatggaaaaacatggaaggcttttgatcgtgatacgagaattacaggaaatcaaacagtgcttgctcgatacagagcacatggggtgtatttaagtggagatagtacagaatataactttactgaaaataacgataaagagaaaaaatatgtttacgttaaagatatttcttacgtatcttctggaagttctcaaagtggatatgctgcaaaaaatatgatcgatgccagtccatttacaacatggcatacaacgtggggacaagttgctaaagataaaacctatgtcgtaagctttaatgaagtaaaatatttatcacaaattacctatgatcctgccgatggtgtcaatgggcgaatcaaatcagcaaaggtttatgtaagtttagatggtaaagaatggaccttagcgggagaaaaaacaaatatggcaaataacaccgccagaaaagaacttgttttagatgaatctcttccagcaaaatttgtgaaaatcgaagcaacggaaacttatggaaaccacgaaggaccaaataaatatgtaagtggaagaagattcaattattatgaagatacaacaaaaatatataaagatccaagtatcgaatattcagtaacttcacttactaataaagatgttgtagcgactttacaacttccttcaggatttaaagctgttggtgaaagtacatatacatttgataaaaatggtgaacatacattcacttataaagatttaaataataaagaaaaaacaatcaaagccaaagtttcatggatcgataaagaagttccaactgctacagtagaatatgatattacagaaaaaacagaatttgcggtgaaagcaactttaaaagatttttcaaaagaaaatgtaaaagtgcttaatggtgatgaaaatggtagtcatacttttacaaaaaatggcgaatttacttttatgattcaagatgaagcaggtaatattggttatgttaccgcaaaagtaacatggattacggctaaagatactgaggtggatgatgatttatatgttaaatcagacgattatgttgttaaagatgatgtaattaaaaatattgatgcaaatacttcattagaagaattaaaatcaaaattaaatacaaatgcgaaacaattcaaacttattaaaaatggtcaagaagttgatataatttcaacaggaacaattcttgttcttgataatgatagaagttatacattagttgtaactggagatattaatggtgatagttatcataatgaattagatctaactcttttaattaatcacttgttagatcgtactttgattcaaaatgaaatagaatcaatggcatcggatatgaatgatgatggtgaaattgatattgtcgatctttcaataatgaacaagaaaacacttaattagtggtaaaagaaggagaaaaagatgaaaagaaaaattatctcagttataacaacttttgtattaatactatcttctcatttttcaatgatttacgcattggataaacctcatttgaatttaaatgaaaaagaagattcagtagaagtaacactgaatcttcccaaagtagaaaatgggttagatgctttctctggtaaaattgattatgatcaaaataaattagaacttgttaaagtaaaacaggtatcaaaaaaattaaaaacaccagagtataatgaaaagaatggaaaatttattttattgatcaattctaaaaccattaatgaatcggttgatgcagtatgctttacatttaaagttaagaaaaatgttacaggggatacaacggtaaaggtaacaaaattaacaggatctacttcaaaaaatcaaaagattaatttagatgatgtacaaactgtttttacaacagataagaaagaaaacaattccaatacgggtaacggttctaatagttcaaatacatctaaagacaatggttcaaaaaatgatacgaataaatcaaatacaaccaataaaccaaatgattctcataaaaatagtgatgggaaaaacacaagtaaacaaaataaggttagttcaaatgatagtttaagtaaagaggagactaaaaaagatactgatactaataaaacaacatcttccgaagataaaacttcttcaaatgaagatgaaagaagcgttttacaagatgacagtaaacaaaaaaaggaaaaagaaaataaaaaaaatattaatggaaaaccgatagttgaaaaaaaagaactaatctatccaaaaatcttgatagtcgttgcacttttgatttcattgttactactatatctaagaaagaaaaaatagataaaagaaagggtagccaaataatttagaggaaaagctaaattatttaggggaccactttaagggagattaagaaaactctgttgaaagttaggggttctctaggtggctaacctaaaatactaaaataaaatttatgaaaaagagagcaaatacggaatgtaactgttggcaccttctattttgtcatagccgttagttccataataattctgcttatatgtacgattgagcctctcttcaatttgtggcgctctaaataatcgagtgctttagcgaaattcgctctatattattaggggggatattgatgtggaatcagtattccctctaaaatattcagtgcttttttaaataaaattatactactataagaagcaattgtttctaattacaataattcctcaaacattatgcttgaggaattatttagtaggaaataaatatcattggtaagatatcaatatcctatttttagttagaaattataacaaaaaaggatgttatgattttaaattatttcataacatcccaatttatcttattcaaaattaactgttaaattatcaaatgaaattcctgaaggatctccagttttttcatcaacatcagcagatgattttaattctaaagaaccatctttgatttttttatcaacagtatcatgatcttctttagagaagttctttaataatcctggataaacaataccacctgtatttttcaaagtaactgtttttccaccttggaatttatcttttttatatgcatttaaagcttcaatagtagcaccttttacatcttttaatgcagaagtaataacagtatcagagtcaccactttgatcagtatctacaccaatagtgtatttacctgcttcttgtccagcagcgaaaatcgagttacaaatttgtccaccacatgagaagatgacttcagttccacctgcataccatgatgaagctttagatttgatatctggtgattcagagaatgtaccagtatatgtatagttaacatcaacattaacattcatttctttagcagcatcactagcaccttgtaggtaaccaacaccatagttttctacagctggtaaagccataccacccatgaaacctaatttagtatatccttctttaacagcagcatatccagcaacatatccagattcttgttcagagaataaataacttactgtattatctccaacctttgtttctccactaccatctttttgtggttcaaagtcgatagtaacgaatttaacatcaggatatttttcttgagcttggtataaagccccagagaagttgaatcctggagttacaacaacttttgctccattatctacagcatcatcaattgtagataatagtccagcttgatcagtatcttttggtgcataatatttatatgaaatatcatttttttcaccaaattcttttacaccttcataagcagattgattgaatgatttatcagtaactgatccagagtcagtgatcattgcgatttcataagtatcatcgccaccacttgtacatccagtagcaccaaaaatcattcctaagcataaaatacttgcgaataattttttcatgttcttcttcctccatttatttatcctctaccattgtagcattaaaaaaaacatttgaaaacaattaacataataaaaaaacggtaaataccgtttttaaatttcttcttcattatatccacgtacatatacttcacgtggtttagatccaatttgtggacctataataccatccgcttctaattgatcaataattctggctgctttgttatagcctattctaaattgtctttgtaaaagtgatgtgctcgctttttgtgcttgaataacaaatgctctgcacatttcatactcttcatcttcttgttcttctttagaagcagctactgcagaaattggttttacatttgtgtatctttcatcatatgatgcttcttgttgtttcgttgtataataagtgattgcttccacttcactatcatcaacataagctccttgcacacgaatcggcgaattcgatcccattggtaaaaaaagcatatctccttttcctaaaagtttctctgcacctgtacaatcaagaatcgttctagaatcaatacttgaagaaacagcaaaagcaattcttgatggaatattagccttaataacacctgtaataatatccgttgatggtctttgtgtagctacaattaaatgaatcccagccgcacgtgctaattgagctatacgcataatacaatcttcaacatctttactagctaccatcattaaatctgcaacttcatcaaggattactacaatatatggaagtttttctaattgatgttccgcatcattttcttgatttttcttttcaacatattgattatacgtttcaatttttctaacatttgcccctgcaaataaatcatagcgtctttccatttccgaaacagtttctcttaaagtggccgctgcttttttaggatcagtaacgaccggtgctaataaatgaggaaccccattataattggataactcaacctttttaggatcaactaaaataagtttgacctcatccggtttcgcacgcattaatatgctgctaataatcgtattaacacatacagatttacctgaacctgttgccccagcaataagtaaatgaggcattttattaagctctgcataaatgacttgaccattaacatcctttcctaaaggaacaacaagtttattgtctttatatttatcaggaatgtttttaaatacctctttaaaagaaaccattgatgatactaaattaggtatttcaactccaaccgctggttttccagggataggcgcttcaatacgaatatctttagctgctaaagctaatttaatatcatcttgtaaagacattattttattaactcttgtccccgtttctaattttaattcatattttgtaattgaagggccaatagaaatattattaatagaagcatggactccaaattcatttaaaacagctgttaatctttcagcactttctacagcatgatttttattttcaccttgttttttattaaccacattatgtaaaagagataacggtggtaaatgataatttttatttatatgctctatgactggttcttcaatttgtgattgatcattttgaactaattcttcatccaccgatggaataggaggctctttatcaacaatttctatttcttgatgttcatcattaaaagtaaaagcttgtggcaaagtcacatcttctttcgctatttcttcaaatatagtcgttggggtttcatcatcttcgaaaatagcatcatcaaaaaaagttgtcttattttgttttttcttaaagaaatttccaaaataatttgaatgctgttttaaagaatcttttgttttattaaaattattttttgctcttttttgaatttcttttttgtgttcaaaataaaacttacttcctaataaaataattcctgttacaacaataaaaaccgctgcaatgattgctcccatataatcaaacaatgcacttaaaaagccatataaaactgcccccaataatcctcctctatttaaaggaacttgattaaaataagactgtatgacttttatccctgtaagtgatggcgtagcagaaataaataaagttaaacctataaagagcaaataaagacctaccgccttaggaccattaaatttaggaaaatccgccttaacaacaatatatcctaataaaagaatacaagtaagataaataatcccatttaaattcccaaatacatacataaaaacataattcaagtggtctccaatcactcctaattgcatagcagcaataattactaaaaaaatgaaaaataaacaaataattcttaattttaattcttcactcacttgttcttgcttactttttctttttcttgcggtcttagccatcatatcacctctttacatatcatatttaaaaaacaaaacaaaagcaagatattccttgcttttataattctataattactggtaaaatgacaggtcttttgccagtctctttgataatatatttgttcactttatctttaatattttgacgtacatctctaatatcttcttccgtcttatttttataagactctaactcagtttcagcgatattcataattccttttacaacattttctgaatcctttaagtaaataaaacctcttgtttgtacatctgtattggcaacaatttctcttgttttaccatcaattgtcataccaataataacaacaccatcattttgtaattgatttcggtcatcaataactttaacaccaacatcaccaattccaagaccatcaatcatcacatcttcaattgtaatagaatctcgataactttgtaattttccatctttaaaagtaatcatttctccattatcaacaatagcaatatgatcatcatttatattcatttttttagcaacatcacttgcagcaataaaatgttgatattctcctttgattggtacgaaatattttggatttaaaatttgaatcaatactttaatatcctcttcacttgcatgcatggattgcaattctttgtttttcaaaacatgaatatgtgtatcagttttataaagttcattgattgctctattagctattttttcagtccctggtaaaacaggtgaagctacaataaatgtatcactatcttgtaatttaagcttatcatctcctccatcgataatatctaaaatatcatgatagatacgacgaggactaccacttaataaaacaaccaatttatcattatctttatttttttgaatatcattattatcaccaatacaagctggatgaatatccaagattggttttttcttatttttagcaattctcattaaagaattggtattatcatatttatctcttccatagaaacaaatcttacgattatattttttagctagttgagcaatttcttgagttctaaaagcattttgtgcataacttgaaataataatacgtcctgaagcatcttcaaaaatactttctattttagcagttaacttatgattaggagaagtatagccatcattttttgaatatgatgattcacaaagtaaagctaaaactccttttttaccaatttccatcatcttttgaatattacatctaaatctttcaggcgctccaaaatcaataataaattcactactatagacaatataaccataatctgttaaaaatgctaaccctacacttccaggaatagaatgcgtaattgggaaaaagtccacttcaactccagcaactttaatcgttgcattcatatttactcttttgattttatatttatatgaaacatgagaatgtctcatatatctttgtaataattgatcaattaaatcagctgtaagatctgttgtataaataggaacattcacttcttgtaataaataaggaagtgctcccattacatcatcatgaccatgcgtaataaatatagctttaattttatctttattatcttttaaataatcaaaattaggaataataacgtccactcctaatttatctacttctggaaaacgataacctgcatcaataataaaccaattatcatctatttctaagcagtacatgcttttaccgttttcagcttgaccaccaattggcatcaattttataatactttttttcattatttcctccttaattatatcttcttacactcactttgctattattctaacaaattattaacaaaagaaaaagtatcatttactctttcttcattaaaaataaaggctgaatttgtttatcaaccaatgcattgatcatcgtttgaataattaaatctcgccgtgcaatcaaactatttggtttcttgattacatcatcttgatacattggcaccaaataaaaatgctttgtattaaaaatcttcatcatattcattccgcttgttgaaagtaagtcattactacataaaccaagaacgatattgtgttgatttctaagtgttgatttaacagccattgtcaccgcattatcattgattccatgtgccattttagctaatgtattggcactgcatggataaactaccattaaatccaagggtatttgtggcccaaaaatttctgcttcaacaactgaacaaataaccttcttttcaataattttttcaacttctataattaactgattcgccttaaaaaaccgtgtatcacaagaattcacttgatcacttataaaaacataaatatctacaggatatttttttagttcctttaaaaatctcaaacaattacttaacgaacaaaaagagcctgtaatcccaacccctattttcattccattaaacatgtctcatcactccgtgaatatattgaaacatcaataatgccgattcatatggaaaatacaaattaggtatatttcttagtgattgataatcttttccctcaactgtttgtgccaaatcataaatttgtttatattttaattttttataattgattttacaaacaggaatcgtattaataattaaatcatactttcctgataaagcatttaaatccaaatgatgatagatttgttttatttcatctaaatccttgttatttcgattacaaattgtaatatcataattactttttaaaatatttgcaagctgttttgctaaatctccatagcctaaaataagtatattattataatgtgctttatcttgtattatttttaaatagagtcccattgctgttaaagtattatttaaatgtttaaaaactttatctttattaataatatattttgtatttatattattaagagaaaacgtattgtcatgatctatcttttgatttttaacaacataaaaatcaaggttttgtgattgtttatcatttatttgataaccatgacttaaaaaaatatcttttaaaaattgtgttctttgatcatatacttcaataaaccctttcatatgccacctcattatactatatgaaagggtttgataaatgtgaaattagctcgctttatttttaatttgtgatgtcatcaaagctataatttcttctacttttggactaataacatttacagctgacatgatcatctctttttcgttttgataatcatgacataaaaacgcatactcacattttagatgaaataaacattgttccttttcattaacagtcgttagaaacattaaattgattgcattactatcgcaaattttgtaagaaacagacatgactgcccgaatatcttctaaattacgaataacactgtctttttcagcatttaagtgtacacttaataaatgaatttgtgatatactgttttccatatttattttacctccttcactatatatattgttatttttttaggttttttctttttatttttttagaaatgaggaattttatgcaaattattacacttatttattcaatcatcttattatttttttatcatccactttatcaaaactacacaagtttaatgaatacatcattttcttttttttattacatttggtgtgttttattaactctttctttatgcttaaccttttttaaagtaacttctttaaaaaaattcattatttttctttctctgttcttttttattggattaattttaccctatcataaaaattatccaatcttttcaactttacatgtttttattcctttatcttgcattatcattgcacttttattcttagcatatcttattaaaaataaacaaaaaagtgagccaattttagctcacaaaatttatttatggttttcctacggtctttcaatcattgccatgttcattattttcttttctcaaatcaatggtcttatcgaaattagcgtcttactatttatcaattttattctttatgtgcttcaacgttcataagatattcatattgcataccttgtcttaagtttgatgaatcgtaccctaaactttctaaaatagtatatccaaattctaaggcagccgctggtcctttacctgtaataatataatcatctttttgaacaatagcttcttgataattagctccagtaagttgtgtttcaaaacctggagaacaagtacagattttatcttttaaaatacctgctttagctaaaacaattggtcctgcacaaatagcagtaatcaatttatgttcctgattgaattgttgaacaatttcaataacacgtgcatcatctcttaaatttgttgctccaggtaaaccaccaggaataacaattccatcatattctttgatttgatcattaaagacgcaatccatttgaattgtaatttgatgagaacttgtcacctttaaatcatccatccctactaaatcaacatgaacatttgctcttcttaaaacatcaactggtgtcaatgcttcgatttcttcaaatccatctttacataatacagctatttttttcataaacactcctcttttcttttaaagatattttatcatgaaaaccaaaaaataaaagaatgaaatacattgtatgggatttcaaaatatattataatgttgcatagatgtaaaaatcagccttggaggttttatgaaaaaaattgttattggtataacaggaagtattgcagcatataaaacatgtgaacttatttcccgtttaaaaaagaaaaattataatattgaagttattatgacaaaaaatgcagctcaatttgtaacaccacttacctttggagcacttattcataaacctgttttaattgatgattttgatgaaacaggttatcaaattaaacacattaacattgttaaggatgctgattgttttattattgttccagcaactgcaaatattattgccaaagttgctcatggtttagcagacgatgttttatcttccgcctttttagcagcaacatgtccaaaaatcattgctcctgcaatgaatgtacacatgtatgaaaatactgcaactcaaaaaaatcttgatatttgtaaatcttatcatattaagattgtggaacctgaaattggtgaactcgcatgtggttatcaaggaagaggacatttaagtgatattgaagatttacttgatgctattgaatatgcgacatatcctcatccattagctggaaagcatgttcttattaccgctggtcctactcaagagccacttgatccagtgagatttatttcaaatcattcaagtggaaagatgggctatgcactagcaaaagttgctcgtcaattaggagctcatgtcacattgattagtggtccatcatctcaaagagctccttacgaagtagatgtaatcaaaattcaaagtgcacaaggtatgtttaaacaagtattaagttattttgattttcaagattatgttatcatgtctgctgctgttggtgactatcggcctttagaatatagcgatcaaaaaataaagaaaaaagctgacgaattttatttaaaattaggaaaaaacgaagatattttatcttatattggaaaacataaaacaaaacaaactatttgtggatttgctatggaaacagaaaacgttattgaaaatgctcaaaataagttttttaagaagaattgtgatttattagttgttaatgatttatttgaagatggtgctgggtttaaaactgatacaaataaagttgctttaattacaaaaaactttgttgattatttagatttaatgagcaaagaagatctagcgcatattattttagaaaaattaatgaaagttaaaggagaataacaatgctagtagttgtagatatgggaaacacaaatattacaatgggactttttaaagatgatcagcttattggcaattatcgtttaacgactaaattgcaaaggacatcagacgaatatggttttatgattcttgcttttttaagtgcctataatgtaaccgttgaagatataaaagatgttattatttctagtgtcgttcctaaaatcatgtattcttttacaaattctattcgtaaatatttccacaaagaacctattattgttggtccaggaattaaaacaggcatttctgtaaaatatgataaccctaaatctttaggaagtgatcgtattgttgatgctgttggtgcctactatagtcaccattgtgcttgtttagtaattgattttggcactgctacgacatttgatgttatttcttcaaaaggtgaatttatgggtggtgcaattgctcctggtattggtatttctgcagaaatgttatctaatcgtgctgctcaactacctgaagtagcaataaaaaaaccacaacatattattggtaaaaatactgttgaaggtatgcaatcaggggttgtttatggttatattggtttaacagagaaactgattgaagaaattaaaagccaatatcctgaaccattaaaagtcgtttctacaggtggtctaggtagaatgatctatcaagaaacaaatttgattgatgcctatgataaagatcttacattcaaaggtttaaaaattatatatgatatgcaaaaaagggattaaataaaatccctttttaattcgttttttaaataaaaatgtattgtttgttgtccatctacatacaaaataacaatttcttgaagattaattccatgaactttcataatttgttctaaccacttttggttatgatgaatcaattctaaattttcataaataatcgttccttgtaaaataagaattgttggtataaattctttttgaacttcttgatgtagatcacctaattttaaaggccttgacgatgtcttgggataaaaagtaaatttcccatttgtttctaaaataattttatctaactcattaagctcaaaataaccattcattctgcaattcatcaacaattcattcaaatcaatttttgctttatccaaactttttaaatatatcttatcattttcaaataaaacaacaggttttccttcaacaaaaaaacgaaaatttaaatacctttttgttaaaacagaaacaccccaagtaaaaacaccataaacaatcattccaatcaacggctttaaaatatcattaaaacttcccataaccatttcagcagcaatagaaccaattgtaattccaattatataatcatataaagataactctgttacttgcctatagcccattaatttcgttagtaaaaacaaaacaatcaaagaaattaagggcaaaacaaaatattcaagaaaattcattttaatcacccttttaagtatggacaaaataaaaaaaagaagtcaaaattatgacttcttatacaaaattctcattgagttacaaatagcaattaaagtaacacctacatcagcaaaaacacccatccacatatttgtaagtccaaacaaagtaagaactaaaactccaattttaattaataacgtaaaagtaacattttcttttaaaataaagtttgtataatgagaaacttgaatggctttagcaattgacgtaatatcgtcactcattaaaacaacatctgcagcttcaatagctacatcactaccaacgccacccatcgcaataccaatatcacttctagcaagaacaggcgcatcattaataccatcaccaacaaaagctacgacatgatcattacccattaatttttctaattgtgtaactttattttgtggtaataaatcactatatacttgatcaattcctattttagaagcaatatcatgagcaacagttgcatgatctcctgtaagcataaccgtatttaaaacatgtgccttctttaagtcttgaatacctggcattgtagattctttaataacatctgcaacaacgatatgtcctaaatattgtttttgacatgctatatgaacaattgttccaacagattgaggttgactcacttcaatacctaattcatgaaaatatttttcatttcctaattcatattgtttttgatcaataacaacagaaagaccttttccagcgatttctttaaaatcttctattcttgtactatcgatttctttattataagctttaacaatacttctagcaattggatgatttgacatatattcaccatatgcaccaatttctaataaatgatcatctgaaatttcaacaacttcaaattcacctttagtaagtgttcctgttttatcaaaaacaacagtatcaatatcttttaataattctaaatagtttccacccttaactaaaacacctaaagcactcgctttaccaataccagcatataaacctaaaggtactgaaataacaagtgcacatggacaagaaacaactaagaatgtacatgcacgataaagccaatcatagaaattttgatttggtaaaataatcatcggaacaattaataataaaacagcaagtcccacaacagttggtgtataaacttttgcaaaacgggtaataaatttttcaattttagcttttttacttgcagaattttcaacaagatcaataatacgacttacagtactatccgcataaggttttgttacttcaatataaataacatcatttaaattgacaactcctgataaaacctcatctcctacttcaacacttctagggactgattcacctgttaaacttgcagtatctaacatactgtttcctttaataactttaccatccaacggtactttttctccaactttaacaacaattgtatctcctacttgtacttcttcaggagttacttgaatcatttgatcatcttttacaattgtagcatattcacttttaatatccattaaagaagaaatagatgatcttgtcttattaacagcatatccttggaaaatttcaccaatagcataaaatagcataaccgcaattgcttcactgtaatcacctaaagcaatcgctccaaaagttgctaaacacattaagaaattttcatccaaaaagtcttttctaccaatatttttaattgcttttaaaatgactttataaccaattaataaataagcaaacaaatataagaaagtagcaaaaccacctgcaaagaaatgtgcccctataaaaataataacaccttcaaccaattccatattttcttttaaatcaaataattttggtttactatattttttttgattatcttcctttgataaaacaactccttcttcaacagagtcaacaacagcttgtaacttttccattaaagaatcatcgttttttactttaaccattaacttttgagtagaaaaattaacaactgcatcttcaatgtaagattgtttttttatctcagcttctactttacttgcacagtttgcacaatccaaaccaactatattaaatttgattgaattagccaattcacgatgatcttccacatgttcatgatgttgcccacatccacattcatcgtgatgatgttcatgttcatgatggtgtccacaactacattcatcgtgatgatgttcatgttcatgatggtgtccgcatccacattcatcgtgatgatgtgttttgtttgtagagaggttatcaattgttacttcatcttcaatggattgcataaaataaagcagctcattatcattaatttcttgattactttcaaaagtcatcatgcctgttgcaaaagaaattacacaatcattaatctcttcttttttatttaaagcatcttctaatttttgtgtgcaattagcacaatcaaggccattaaccttatatttatatttcatattatttatcctccatgatatgactataaccagcctcaaaaattagttttacatgctcatcatctaacgaataatacatcattttaccatctcttctattttttactaatttattggcttttaaaattctaagttgatgagaaatagctgactgcgtcatatctaaacaagcagctaaatcataaacacacatctcatgatcaaataatgcacaaataatgcgtattcttgttgaatcaccaaacactttgaataattcagcaacatcatataaagattcttcttcgggcattgctttctttacttgttcaacaatttcattattaacgattttatccattttttctcctttcatatgaatatatgttcacatgaatattatatgatatttatttacaaagtcaatatatatgataagattaaataaaaatgattggagaaattttatgaaaaaattactgattgtagtagactatcaaaaagattttgtaaatggcagtttgggatttaaagaagctgaatatttggatgagtatcttgcttctttaattgatcaatatcatcaaaataaagatgatgttatttttactttcgatacacatcaaaataattatttagaaactcaagaagggaagaatttgccaattgaacattgcattaaaaatagtgatggttggaaactatatggcaaggtaaatactgctaaaaaagaccatgatatttgtattgaaaaaacaacttttggttctcttgaattaggaaattacttaaaagataaaaactacaaaaatgttactctagcaggtgttgtttctaatatttgtgttttatctaatgctgtaattgttaaaagcgctctacctgaaacacctatctttattgatgtaaaaggtatttctagcaatgatttaacaatgcagacaaaagcaatttcaattttagaaaatttgcaattcaatattattaataaataaaatacaattaataatttcttattaaaataagttataaattattattgacacttcatctgatgaggcgtagaatttgcctaaagatatatataggaaaggaagtattaaaaaatgtcaaaaaaagatattgattggtcaaatatcggttttggatatatgccaacagaagcaagattcgtatcaaattataaagatggagcttgggatgaaggcgtgcttactgctgatgacaaagttgttattagcgaatgtgcaggtgttttacaatatgcacaaacgtgttttgaagggttaaaagcttatagaacaaaagatgggaaagttgtttgctttagacctgatttaaatgcaagtcgtatggctgactcttgcaaacgattagaaatgccagtttaccctgaagataaatgggtagaagccattgaaaaagttgttaaagctaatattgattatgtaccaccttatgggtcaggagctactttatatattcgtccatatatgttcggtagtaacccagttattggtgttaaaccagctaacgaatatcaatttagagtattcgtaactcctgtagggccttacttcaaaggaggagttaaacctattacaattcgtgtatcagacttcgatcgtgctgcacctcatggtacaggacatatcaaagctggtttaaactacgcaatgagtttacatgcaatcgttgatgcacataatcaaggattcgatgaaaacatgtacttagatgcagctactagaactaaagtagaagaaactggtggagcaaacttcattttcgtaacaaaagataataaaatcgttactccaaaatcaaacagtatcttaccttctatcactcgccgttctttaatgtatgttgctaaagaatacttaggattagaagttgaagaaagagaagtttattttgatgaagtaaaagatttcactgaatgtggtctttgcggtactgctgctgttatctcaccagtaggtaaaatcaatgatcatggtaaagaaatttgtttcccaagtggaatggatgaaatcggacctgttcttaaaaaactttatgaaactttaacaggtattcaaatgggtacaattgaagcacctgaaggttggatcaaagttattgaagaataacaattttaaagcttgtcattaactgacaagctttttctttgcttaaaagcaaaaaagcattgtattatcaatgcttttaacgattttccattttaatatattcttttttttcaccaacgtattttcctgctggacgaataatttttcctgaataaagtttgttttcaatattatgtgcaacccatccaacagaacgtccaataacaaacatcaaagtataaagatctttagaaagccctagcatgtcataaacgagaccactataaaaatcaatattggcacatacgtttattccctttcttgctttaatttcagcaaccgcaagttcttcaaaacgatggtatagttcatattctttcaaacgatttttttcgatagctaattgtttacattgtttagaaagaatttgacaacgtggatcgctcaatgtatagactgcatgtccaattccataaataagacctgattgatcattaaacttcttatctaaaatatccttaatgacctgttttaattgttcatccgttgcattaagtcctactttatcaataacaagttccatttgtttagcaaccgctaagttagcacctccatgcttaggaccttttaatgaaccaatagctcctgcaaaacaagaatatatgtctgttcctgttgaagacataacaacatttgtaaaagtcgagttgttccctccaccatgatcagcatgtaaaactaaacacatatctagaacactcgcttctatttttgtaaaagaacgatctattcttaacatttggaggatattttcagcaattgaatattcagtatttactggatgaataaacaaactatcactatcaaaataatgtactttagtacgataagcataacaaacaatttctggaatcttagcaattaaatccaagcctttatttagcgttgcttctggtgaaatatcatcagggttttcatcatatgtgtaaagcattaaaacttcttgttgaagtttattcatcatattttgcattggaaatcctagtatacgtgcttgtaaataattcaaaggtaaatcatatcttgaagctaattcttttttaaatgcatctaattcatctttattaggtaaatatccaaaaagaattaaaaaacaaacttcttcaaaaagaaaacgattttttggatcatgtccctttataaaatcagaaactttaacacccctataataaagttccccttctgtatcaatttttttaccattttcttttttatatcccacgacatctgatattcttgtaagtccaacaagaacacctgttccatcttcatttcttaaaccattttttacgttgtatttagaatataaagaattgtcaattttatttaatgatgtacttctttgaaatacataatcaataaattcactcatatttaagcccccttatcatagtgttaggaatatcataccacaaatttgtataattgtatacaattatttacttgtcttattttgttaaagattgtcaaatgacaaaaagtattctaaaatagaatacaaggtgatagttatgaaaatatttgatagagaattctcaggtctatctcaagaagacgttttaaaaaggcaacaacttgggaaaactcattttgtggaaagtaaaacaacaaaaacatataaagaaattatttttaataatatttttacatttttcaatttaattaatattctactatttgcatgtcttgtttttgttggatcttatcgtaataccctttttatctctgttatcttttttaatactttaacaggaagttatcaagaaataaaagcaaaaaggacattagatcagttaagtattttaacaaaacaacaaattgatgttttaagagataatcaattatctaaaatcaatgttgatgaaattgttcaagatgatctcatcattttaaatacaggaatgcaaatacctgttgattgtgaacttttagaaggtcatatagaagcaaatgaatcacttcttacaggtgaaagcgatgctattttaaaagtcaatggtgattcactcctttcaggaagttttgttacatcaggacgtgcaatttgtaaagtaattcatgtaggaaaagaaagttatattcataagcttaccgctcaagcaaaagaatttgaaggcaaaaaatcagagctatcaaaatcgattgaccaaattttaaaaattatctcagttattatcattcctttatcaattttactcttttttaaagaatattttattggtcattatccatttagtgatgcagttgtttcagttgtagctgctgttttaggaatgattccatctggacttgtattacttacaacaatcgctctatctttaagtgttctaagacttgctaaaaaaaatactcttgtccaaaatctattttgcattgaaactcttgctcgtgtggatactatttgtttagataaaacaggaacgcttactgaaggtaagcttaaagttgatgatgttatttgttttgatgatcattttaatattgatcaaattatcaaaaatatgaattattgtttagaagatggcaatatgacatctatagcacttcatcaatacttctctaaagaaaaaaattatcagcctttctttgttattcctttttcatcgcaaagaaaatacagtgctgtttcttttaatgaatttggaaccgtttatttaggagcaagtcaatttatttttgaaaatctagattctaagattgaaaagaaaattaaaacttatacctctcaaggttttcgtgttttgtgtattggatatactccaataattattaatgataatactttaataaaaaatttaaaatgtattggaattttaattttatctgatgttattcgtcaagacgctaaaacaacattagattattttaaaagacaagatgttgatattaaaattatttctggagatgatcctgttactgtttcagcaattgctagacgttgtcatcttttaaattatgaacattacatagatgtttcttctttatcggatgaacaaataaaagaggccattgaaaaatatactatttttggacgtgtttctccaaaacaaaaacaattgatggtcaatgctcttcaagaaaataaccatacggttgcaatgacaggtgatggtgttaatgatgtattagctttaaaagcagcagattgttcaattgctatggcttcaggaagtgatgcagctaaaagcgcttcacatattgttttattaaaaaataactttaatgccatgccacatatcgttaatgaaggaagacgtgtcattaataatattactgcttctgcatcaatgtatttaattaaaacaatcttttcagttgttttatcaattggaatgatcttatttggacatggttatccatttaaacctatccaactaactgttatttctgcttgttgtgtaggcatcccgactttctttttgacctatgaaccaaatttcaaaagagtgtctggtgattttttaaaaacagtctttaaaaacgccttcccttttgcctttatgattgctatttgctcaacaattatcgttaatggtggtcgtgtcttaggtttagaaaaagaaatgctttcaacaatttgtgttttacttacaagttggtgttattatagtggtttaagacatatttattcacccttaagtcattatcgtagctttgtaatccatataatgcaaattgttttatatatttctttaattgttggtcatcaatttttaggattaggaaatattgattatattggtgccattactttaatgtttttagttactttttcaaaagtcatttatttattaaattttgaattatttgattatagttatttattcttacaaagaaaacgaaataaacacaaataaaaaggacaaatgtcctttttatttacatacatttttcttcaacataactttgacatgttttttcaacaaataacatatcttcttttaaatctcctgtaaaatgtaaacgttccatatttctatgtatataatcattctctctgataaacaaataacttgatttaaaatttaagtcaaatacgaaagccatataagaaacccacatatctacttcattgtgcctattttcttttaaaatcaaagtatgattttcaatatctttcaaaatattttgagaaactctttgactataaaagtcagcatctgaaatactaaacaaagtttgtattgattctatattttttactcgaaaattatctaatttatcactatctctaataagaagaacttgttttaataaagagggttctaaattatttggtattttgtataaagaatgataagcaatcgccttttcgataatttcatcatattgatcatcatcaataaaatttctaatcatcccctctttaaataaaacctgcacccctaatttagcatgatcaatatttcgatcatcaaagctattaaaacgttttatttgttcaaaacgtcctatatcatgcaataaagcaattaaataggctaaatctctttcaacacctgtaatattttcatagaggcatagatattcagttgtacgtacgacttccaatgtatgaacaagttttaaatgaattttatcattcgttaaatcaaattgacgcacataattcataaaactctcttttgcttttaaaatatcaaacaccttgaccttactcctttctttattttatactataccataaagtgaggtaaaaatatgaatgatttattattaaaacaatacattggtttaattgaatgcaacaatgaaaaaatttcaattctagccaatacatctgcttttattatgcaaaattttcaagatatctcttgggcaggattttatttatttaaaaacactgaacttattttaggaccattccaaggtaaaattgcttgtactaacattcctctagataaaggagtttgtggtaaagcagcatctactcgaaaaactgttattgtagaaaatgttcatcaatttgcaggacatattgcctgcgatagcgaaagcaacagtgaaattgtaattccacttataaaaggaaatcaattatatggtgtattagatttagattctacatcatttagtagattttctaaagaagatcaaattatttttgaagaaatttcaaaaattttagttcaacatttataattatttacatatctttgatatgaggggaagccatgaaaagacatcttttattatgttgtttaataggaataatgagtatactgggttacttttattttcaaagaaagattatatttattgatcatccaacaattgaaatcaatagtccattttattataaaaaatatattaaaaaagttaaaaatggttctattaatgacgtcacttatagtgcaaatgatttaaacaatcaaactttaggacattatacagtgacatatttttttaaaggaaaaacatatcatttgaaaatagaagttattgatacaaaaaaaccaactattaaagaatctgaatctttaaaaattgaaaaagggaaatcttatgatttaaaaaaaggaattattattaaggataattctaatcaatacaatttaacaattgataccaatgattttaatcccaatcaaattggaaactacacaatttattataaagcaaatgacctttccaataaccaaacaactttcaaaagaaaagtaactgtcgttaaaaaaatagaaattggcacacatatagaatctaataaaaaaatagtgtatcttacgtttgatgatggtcccagtcaaaatactgatcgcattttaaaaatattaaaaaaatacaatgctaaagcaactttttttgttacaggatgtcatcaagaatataatcaatatattattgaagcttataaacaaggacatactattggtttgcatagttatttgcatgaatatcaagatatttattcctctaaggatgcttatttcaaggaccttaaaaaaataaaacaaatggttaagcaacttattggtattcaagtccactatattcgttttccaggaggaagttctaatcgtatttctaaaaactattgtcatggtatcatgtctcaattaacacgtgaagtcattaaacaaggttatcaatattatgactggaatggtgatacaacagatgcaagtggcgatcatatcccaactgcaacaatcattaaacaagctacaagtgaaacacatcaaaatattattcttttagctcatgatacagatgctaaagatacaactgtagctgctcttccttctatcatccaatattataaagaaaaaggttatcaatttttaggcattgatgatgaaagttactatgtacatcatgatatacaaaattagcagtcatttaactgctaattcttttttaaatcctctaataaataatttttcatttgtttattttttctttgaaattcttcaatttcatgaagatgtgtttctttaaccaataattcgaattctcttgcagaaatacgcatagcccctctagaagaaacaataatttgttctaaagcatctgaagtagctacataaacacgatatttttgtgataaatcatgtgttactttctctatgtagttatctgcagtttgcgcttcttttgtataaacaacataaatattatcatttttttcaattgagccaatattctttttaattttataagcatcaaaaacaacaatcagcaaacattttcgataaccttgataattattcaaaatatctattaaacgatgtctagcatggtctaaatttgttttagcaagttcatttaattcatcccatgaaaaaataatattatatccatctactaataaacattctggtaaaattgtctttttttcttcaacctgtttttctattttacgattcatttctttagaaagtcgtcttttaattggtccatatgttctaataaatatttcctctaactctttatcatcgactttataattttttgtaactggacgtggtttatttttttgatatacataaggtaaatgcatataattttctacttcatcataagggacataaaatcctgcaccctgtttacaaaagatagagcctgtaggaaataaagcatcttcttcactattatagtcaatttcttgaataattttttcttgatcatgacattcaaagtaaccaaccatttgatagaacagcttcccattaccttttgtaagcgaaagaaaatccttttgatacgtcattaaataacgaacaggtgcttttcctttaatgattgttaaatcctgttcataacttatttgataatcgctatgaaatgtatctaaatcataaataatcttacttgaaatatgattttctacaatcatctcaaattcataataaggttctaataaaagagattttgtcttttttaagccttgtcgaattgctcgataggttgcttctctaaaatctccgccttcagtatgttttaaatgagattttcctgtaacaagagtcaatttcatatctgtaataggcgatcctgtaagaacaccaagatgttgaatttcttgcatatgtgttaaaacaagattttgaaaattaagcggtaaagtatttctttgacattgattttcaaacacaagtcctttgcccctttctaaaggttctaataagatatgcacttcagcatagtgacgtaagggttcaaaatgacctactccttcaactttatccaaaatcgtttctaaataagtaattcttccttcatcataatgaattaaaaatccatagcgttccaaaataagattttgtaaagtatctaattgaatttctcccataattttaactgaaagaattcctaattgttgattatattcaaattgtaaacttggatcttctttaccaatacttagtatttgttcaatagctttacttttttcaatatcatcaggaagtaaaatttgataagacataaaaggctttaaaatattttgttgtgtctgtttttgatttccaaatgtaaaaccaataggtaactcatctaaccccaaacaagctactatatcacctgttgaagcactctgaacactttgatagccttgtcctgtataaattcttaattcatctactttactttcactaataacatctttaacatgcaaagtcccgcctgttacttttaaatgcgttaaatgtttttgtttatgaaatgtctttttaaaaacaatcccacttaaaatatctaaagcttctttttgacaagtatataaatctaaagcttccataaattcttctacaccttcatcttttaacgctgagccaaagaatacaggaaacatttgtcttaaagaaataactttttgaatatcttcttgtttcatttgttgattaagatacttttctaataattcatcatttaataaagaaatgttttcataaaagttttcatcaattgcaaaacaattttcatttaattctttttgaatattttgtaataattgctctttggttgagtacgtactatctatcttattaacaaaaataaaagtaggaatttgataagtttgcaataatttccaaattgtttttgtgtgcgcttgtataccatccttagccgaaataacaagaatagcataatctaacacttgtaacgttctttccatttcacaactaaaatcattatgcccaggtgtatctaaaaaagtcatttgactttctcgatacataaatgagatctcttttgaaaaaatagtaatacctctttttctttcttgtatatcataatctaaaaaagaatcttctttatcaactcttcccatttttttaataacacctgcatgaaaaagcattgcttcagataatgttgtttttccagcatcaacatgtgctaaaatcgcaaaagttacttttttcataaatttcaccttctttctactttatatgtagtaagtctcttacaacaacacttgcaatgatcaaacctgcacaacttggtacaaaagaaatactaccaggtgtttttttatgtgtctcaggatctacaggtgcatctgtttcaatgggcttttctgtagaataaacaacttttaaagcaggtatttttcttttcttaagttcccttctcataactctagcaagtggacaaatagaagttttataaatatctgttacttctaattttgtaggatctaatttatttcctgttcccattgaagaaataataggaatctttttttcttgagatatttctacaagtttgattttagcagtaacagtatctacagcatctacaatataatcaaattcatcaaatggaaaatggtttgctgtttctggtaaaaagaaatcatcatagattttaacattgcaacgaggattgatcgataaaatgcgttccttcataacttctacttttttttgatctattgtttgatgtgtcgcaataatttgacggttaagattcgaaatagaaaccgtatcatgatcaatgatatgaagtgtccctacaccagcacgtgcgagtgcttcaacgacaaaaccacccacaccaccaacaccaaaaatagcaaccgtactgttttgtaaggactctattccttctttttttattaataattctgttcttgaaaattcttccataataatcacctgtaacatcataccataaaataaaaaaggcttccgccttttttataaacctttttcagttaattcacgtgctacatcatctttaattgtaacacctgcagcttttaactcggcaatcttatctgcaaattgtggtaaatatttttcatgagcaatcaataattcatttaaaacattgaccattttttgtcctgataaaattatactactataagaagcaattgtttctaattacaataattcctcaaatgttatcgttgagaaattaattagtaggaaataaatatcattggtaagatatcaatatcctattttttagttagaatttataacaaaaaaggatgttatgattttaaattatttcgtaacatcccctttttttggattatttagctaatgattatcgagaaataatgttatataatagtatatggataatattcacattattttaaatatatgattaaataagagtaactgaaaggggataatcatgaaacaatttaaaattaatattaatgatttatttgaaaaaagtgaagttgaaataatgatggatgatgttgaaaaatcatcaattatttatgaaatgaataatatcaatcaaaaagtattaaacgaaatcagtacgtatgcaaataatagagaacgtatccaaaatttaacagatgaatttacagaaatcatgtatcatgagcgtatttcaaataatgatgttgaaagaattgattatatttttgatcaacttgttcatcatatagggcttgatgcacccgttttagcggcatgtacgaatacgatctttaatacaattaacgaatataaagaagaatatattcaagagtttataaggcttaatccacaattaaatgaagaaatgatttctgtggaattagacacatataaagatgcagcttatgagttaaataaaatatttgtagaaacagtaggaactataaaaaaatgtgatattgatgcaataaatgaagctgttgatttattctttgatcaagatgaaccaacagatttgattcaaatatttgttgctaatacgattcaaatattaaaccaaccagatttattagtagatgttttaggattgtctgtacttattaatgaaattattattaatcatcaattagatgattttaatcccaatttatggaaaatgaatcaacatcgtttctttagtatagattataaagattatttagatgaagatgaaaatcaagatgcttacaattaaatgtagagcatcttttttattggactatccatccattgaaagaaggaaaaaaagataaaataataatagaaatgaaacaaatatgagacaaattatcattaaacatataatacaattaaatcaagaaaattccttacatcaatataaaaaagagatactaaaatacttaaaagtcagcgattaaaagaaatagtagagattagtcaaagtgtgcttaaaggagactatgaaggattaagaaaaaatcgaatgatctgtgcagagaattttaagatggcagccatctttacgcatacagacattaaagaagaagacttactaggaggagatgaaatcaatatgtgtgtagcaatgaatcaattatttcaaagaatgagaaacgagggagaaagtattggaattgaaaaaggtagacaagaagaaaaacaaagtactttaaaagaactgcttaaagtgaaactaggaactttatcaagtcctttagaaaaacaactcacagaaacatcgctagaaaaattgaatgaacttacattaaatttctttaacatcaatagtgaagaagatgttttaaatttaatgaattaaaagatgagctataaagaatctaatcttgtcaatcaagaaattctttatagctttttgtatatattttattagataagacaaactataaatgaaaatatttgacagttaagttagcttgtgctaacataatatcgtgagttagttataactaactaaaggaggaaaaaatgaaagtcgtatatgcatcaagaacaggaaatgttgaaagtattatttctaaattaggaattgaagatgctttaaaaattgaagatggaagtgaaaccgtagaagaagattatatcttatttacttatactgatggtttcggagatgttccttacgaagtagatgaattcttacaaagtcaaagtgaacatctaaaaggtgttgttgtaagtggtgatactggatatggagaagcttattgtaaagcaggagatgtcattgctgaacaatataatgtaccatgcttatataaagtagaaaatgatggtagtgacgaagatatcgaagctatcaaaaaagtgattgcttaattatgccattgtctgctcacgaatttgaaagaagattaatcttttatgcttcaccaacacttacaaaacttaaagttgcatgtatttataatttaaatgatcttgatgatttagaagaatgtatccgatattataatgaacttttaaataaaaaagatatttatttaaaagtacttaaaataaaagaacgttctatgatatatgtttatcaaaaagaaaaattgaataaattatgcgcatgtaaacaaatccaaaatatctttaaacaatatgattacaattgtacatctttagatactcttatcctagatttacaaaaacgcctcaatgattatgattttcctcatgaaatcggtttgtttttaggatatcctatgacagatgttttaggttttattgaaggaaaagaatatttaagtgttggttattggaaagtttatagtcatgttaaaaattgtcagcatacatttgataaatatcataaatgtacacatgaattatgtaaaagatttaatcaaggagaaagcgttgagcaaatatgcagatatgtctaattggtaaagaattctttaccaatttttatttttgtttataatgtttttaggtgaaagttatgttagaaaaagaaaaagcaattgaaaaattaaatgaaaaagaaataaaagtatatcaatatattttagcgcattcactagaatttccttttatgacaattagagaactagcagataaagtacaagtttctacaactgttattttaaattatgtaaaaaaaatgggatataaaagttttaaagaatttaaattagcttatcgcttgcaagaaagaaaatcaagagaatctaaaagaatatatgatgataaacaagttataggtgctttaattcaattagacaatgaatactatcaagaaaaattacatcttgccaaggtgatgataggcaatcataataatttgatttttacaggtgttggaaattcaggattgataggagcatatggagcacgtattttttcaagtgctggaaaatatgccaatgttatcaatgatccttttatgcgtattaatgcttcaatggaagatacggttattatcgctttgtctatatccgggaaaacacctgaattacttcgtattgtagagtcgtgtaaaacattttgcgcctgtattatttctattacagccaatatgaaatcaccgcttgctttaatgagtaatatatctattccttactttttaaaaatagataatattgatcaaatagatctgacaagtcaaattcttgcagttgctattattgaaagattagcacgtaacgattaaaaaacaaatgtttttttaaaataacaaaaaacagaaatgtaacatagaatatagcgcttacaattttattgaatgaaaaatataagcgtgatattcttttttttgtatcaagaagatatcttgatcatttggccaaatataaatatttaatggaggaaattatatggaaaaaatgcaagcgttcatggaacgattctttgttccttttgctgcaaaaattaatagtcaaagacatgttgctgcagtaagagatgcttttactttatcattcccgcttacaatggcagggtcgatggtattattaataaactatgtatttttagatccaacaggatttgttgcaagtttattacatttaggagatttaattcctaatttagctgattatcaagcagtattgagttctgttattaatgggacaacaaatattttagcaattttaattgcttttctagtagcttatcaattagcacaagaaatgcaaggagatcaagttttatgtggaattacagctttagctgcttatttcattttatatccagcagcaagaaattttgctgataaatctggaagtggtttaatgactacatattttggagcacaaggtttatttgttgctttatttgttggcttatttgtcgctgaattattaacacgtttagggaataacaaaaaacttgttattaaaatgcctgaacaagtaccaccagcagtatctcaatcatttaatttattattaccaattatgattgttctagcggttacaggtgttcttaactttattttcaataatattacaagtgatggtattcaagtattgatttataacatgattcaagcaccacttacaagcttaggaagctcaatgggaacaattattgtttttgttgttgtacaacaattcttatgggttttaggaatccatggtccaaacactttaaatgcattacgttcagtgatctttacagaacaacaaaatatgaacttagcttatgtagctgcacatggaactgcatggggtgccccttatccaattaactggggatctattaatgatgcttttggtaatacaggaggttccggagcaactttaggtttaattattgcaacatttattgttggtaaaaagaataaggcacaatatcaaatttgtaaaatgtcacttgcaccaggtttatttaatatcaatgaaccaattatctttggtttaccattagttatgaatccaatgtatattgttccatttattttatcaccggtcgtatgtaacattattggatggttctgtgtatgtgtcattaaaatcattccaccagttgcttatagtgttgcatggacaacaccaggtttcttgattcctttcttaggttcaggagcaaataatatcatggctttagttattggttttgtctgtgttggtgtaagtactttaatttatttaccatttgttatcgcaagtacaaaagcagccctaaaagcagaaggagcagaaaatgcgtaaggattttttatggggtggagctgttgctgctcaccaagtagaaggtggctataatgaaaaaggaaaaggtctcaatgtttcagatatgatgacagttgggggtgttggtaaaaaaagacaaattacagatacgattttacctaatgaattttatcctaatcatgaagctattgatttttatcatcattataaagaagatattgctttgtttaaagaaatgggattcaaatgttttagaacatctatttcttgggcaagaatctttcctcaaggggatgaattagaacctaatgaagatggtttaaaattctatgatgagatgtttgatgaattattaaaaaatggtattcaacccgttattactttaagccattttgaaatgccttatggtttagtaaaaaaatatggtggttggagaaatagaaaactgatcgattgttttgtaagatttgcgaaagtatgttttgaaagatatcaacataaagtcaaatattggatgactttcaatgaaatcaataatcaagcaaactataaagcagatgtggcagtttttacaaactcaggtattttatttgaagaaggggaagatcgtgaagcaattgtttatcaagcagcactttatgaattaattgctagtgcaaaagctgtaaaaatagcacatgaaatcaatcctgatttaatgattggatgtatgatggccatgacaccaatctatccttattcatgtaatccagacgatatgttaaaagctgtaggagcgaatcataaacgtttctggtatttagacgttcatgctagaggaattattcctggttatatgaaatcattctttaaaagacaaggatatgatttagatttaactcaagaagatttagaagccttaaaacatggttgtgttgattatataggttttagttattacatgtcttttgcaacaaaaggtgatggtaatattaatcttgattatgatgaagaaaatgatttatgcgataatccttatattcaaaaaacacaatggggatggccaattgatgctaaaggtcttagatatacattaaattggttatatgaccgttatcaacttccaatgtttattgttgaaaatggttttggtgcaatcgatcaaaaagaagttgatggttcagttcatgatcaatatcgtattgattatctaaaagaacatattcaagaaatgaaaaaagctgtagatatagacggtgttgatttattaggatatactgtttggggttgtattgactgtgtaagtttttcaactggagaaatgaaaaaacgttacggatttatttatgttgataaaaataatgatggttcaggatcattaaaaagaagtaaaaaagattcttttgaatggtataaaaaagttattgaaaccaacggtgaagtgttataaaaggagaattatatgaacaattactttctacaactaaaaaaagatattcctaatgatataggatggattagaagaattttatcttatgcttttgattggtatattgggggaatgattgcctctttaccagtgattgttatttatatgatgttacatcaagatgcaacgtatatacctcaaaatttatccatctttcatgcaccttacaatatcattgctggaagtctatcatttattgttgctagtggatattatgttttagttccaatgtttgtttttaaaggacaaacattagggaaaaaaatctttcatttaaaaattattgcaaataattatgatgaagtaacaaataaacaattatttattcgacaatttataatgattttattagttgaaggaagtgtatttacttcaagtaatatgttacatcaattattacaagttgtaacaggtttaaatattccaaagtattatgcttattttggaatatttatgacacttatttcagtgattttaatgattgttttaaaatcaagaagaccgttacatgatctatttgctgatacacgagaagtatatcttgaaagcaatgattatacatattatcaaaagaaaagaaagaaagtaaaaagaaaatcaggtaagtagcctgattttcttttagaggaaagttatggaatatttagtattagatgtaggtggaagtgcaatcaaatatgctttaatgaatgatgaattagagtttcttgaaaaagggcaagtaccaacacctaaaacatcattagaagatttcaaaaaagaagttcaaaatctttatcaaaaatatcaagaacgtgtagatggaattgctatgtcacttcctggtttaattaataaaaaaacgaataaaatgcaaataccaggagcattactttataatcaagatgttgacattttaaaagagttgaaatcagttacaacagatcgtttaacaattgaaaatgatgctaaatgtgcagctttatgcgaggttgtttatggcagtttaaaagacagccaagtaggtgctgtttgtattattggtactggtatcggtggaggtgtaactattggagataaagtctttaccggtgttcatggctttgctggagaatttagttatttatcaatagattggaaaaagaatttaggctttgaaaataaatggggaactgattttggagcgtttacattggttgaaatgatagctaaagctaaaggattagtagaagaaattgatggtgtacaagcttttgaatattgtaatcaaggagataaagatgctttaaaagctttagaagaattttgtaatataacagcgacagggttatataatttacaagcggttattgatcctgataaaattgctattggtggaggtattagtaaacaaccaattttattagaatatcttcaaaaatcactggataagatttatcagtcaattgatgttccaattcctcaagtaaacattgttcgttgtaaatatgataatgattcaaatttaataggtgcacttgcaaactataaaaagatatataactgctaatcatacttgattagtagtttttttttagtaaaatgtatttggtgatgtaaatggaagtaaatgaagtaataacaaacttaaatcctttagaatatgatatttatttttatttaatacaaaataaaaacatggttatttcaatgaaattaaaagatctagcaaatcaattacatgtatcaacagctatgattacaagagtttgccaaaaattaggctttgaaggatttggagaatataaagcttatttaaaattagaagaacatgaacaagtaaataccaatacatttcaattagaacatatttttaattttttttatagtgttgataatgagatgttttatcaagaaattcaagaggcagtagctttaattaaagaagcaagagatgttattttttatggaattggtttatcaggcattcttgcacaatatggccatggtttgtttaatcgaaaaggaatacgatcgttatatatagaagattttagtatgcgacttgatttttatgaaaaagcgatcgcaattattttatcggtttcaggaaatacaacagaggtattaggaagaatacagaatttaaaaagttatggaacgaaggtcattttaatttctgaaaatagtcataataaagcggctcaaatggctgatttatgtatcaattaccatttacctaatgtaaaagataaatattatgctaattctgtaacccaagttcctgttttgtatattttagagtgtctagcaaatagtttatagttgacaaagttttctttaccaatttttattatactaatgaaaacagtactaaaaaatggtatgatagatgtgtattttaaggaggaaatagaatgggatttagagaagactttttatggggtggagcagttgctgcccatcaatgtgaaggtgcctggcaagaaggcggaaaaggaattagctgtagtgatgtagaaacagcaggagataacgttacaggtgcaccaagacgtttaacagatggtgttattgaaggtgaagattatcctaaccatgtaggtgttgatttttatcatcattataaagaagatgttgctttgtttgcagaaatgggatttaaagcatttagaacttctattgcatggactcgtattttccctagaggagatgaaaaagaaccaaatgaagaaggtttaaaattctatgatgatttatttgatgaatgtcataaatatggtattgaaccagttattacattatcacactttgaattaccttgggcattagctaaagaatatggtggatttagaaatcgtcaagccatcgatatgttcgttaaatttgcaaaagtatgttttgaaagatatcaacataaagttaaatattggatgactttcaatgaaatcaataaccaagctgatgtgacacaacataacttaattcaagaaggtgctgttttacttcaagaaggtgacgatgcagaatacttaatgtatttatcagcacatcatgaattagtagcttcagcgttagctgtaaaagctgcacatgaaatcaatcctgatttacaagtaggatgtatgattggtatgaatggtgtttatccagcttcaccaaaaccagaagatgtgatgaatgctttaggtgcaatgcatcaaaaatattggtatgtagaagtacatgctagaggtcattatcctcgtcatatcttaaagaaatttgaaagaaaaggatatgatttcattactgaagaagataagaaaatcttagctgaaggtaaagtggattatattggattctcatattacatgtcatttgcaacaaaatatcaaggacgtaatgaaaaaacatttgattatgtacctgaagatttcgtaagaaatacatacttaaaagcatcagattggggatggcaaattgacccacttggattacgttggtgtctaaactggttcaatgaccgttttgaacttccaatgatgattgttgaaaatggatttggtgcttacgataaaaaagaagcagatggtacagttgatgatcaataccgtatcgattacttaaaagaacatatccaagcaatgaaagatgctgttgaatatgatggtgttgatttacttggatatacaatgtggtctccaattgatattgtttccgcttcaactggtgaatatgataaacgttatggatttatctatgttaactataataataatcatgaaggtgatttttctagaagtaaaaagaaatcatttgattggtataaacatgttattgaaacaaacggagaagaattataagaatggggatgtcctcattctttttttatgatataattatcctatggagggataagaatagtatgaaaaagttaatgaagttaatgtgcgtatttgcacttgtatttgttgctggatgtggtgcttcttcatcaacagatgaacaaaaggaagttgtaacaaacttttttgattatgtaaaggaatgcgacattacaaaacttaaaaaggtagcgagtgaagatgttttatcaggaatggatcttgaaaaaatggaaaaagaattaagccaatatactgaagaagaatatggtaaagtttttgttgatgaaacaaataaattcaaaaaagctattttcaaagatttatttacagatatcaaaattaaagatatcaaagcagatggggataaaacaacagttaaagtgacaggaaaacaaaaagattactcacaagtatcttttgatcaaagtgaattaaacacaactgcacaacaatatgtagaagaacatcaagatgaacttgctaaagtctatcaagaagaaggtctatcagcatatcaaattaaagtatatgatggtattgcacctattctttatcaaagcatgacagaaacatataaaaacgcacctactgaaaaactaacagcaacatttactttagaaaagaaaaatgacaaatggatcattacaggtattgatgaataaaagataagcaatcataagattgcttattttgttttatggtaatatttgttataatgaattttggaaagtgaggtcgttatgagtcgttctaattcaattgttaaacaagcatcaattttagcacttgcaggaattttagttagaatcattgggcttttatatcgtagccctttaactgcgatgattttagacgaaggaaatgggtattattcaacagcttataatatttatgcgttagttttacttatttcatcgtatagtattcctacagctatttctaaattgatatcagagaagattgctttaaaagaatataaaaatgttaaaagaatattaaaatgtgtatttatctatgtttgtgccattgctgggagtgcagcaattttattatttatcttggcgccattcattgtggatgttaatgctgttcctgcactaagggtcttatgtccaacaatttttttatcgggcttattaggagtatttagaggatattttcaagcacataagacaacggtttatacatctgtttcacaaatcattgaacaaatctttaatgcagttgttgcattgctagctgcatatatttttattcaaccatatcttggtgtagatgcaacaaaagtaggatcatatggtgctgctggttctgcaattggaacaggggctggtgttttagttggtttgatctacatgatttttatgtatttaaaaaagaaaaatacttttgtagaagaaaaagatgaagaagcgagtgaacgagtagattcgtatcaagaaatttttagaatgatcatgcatattattgcacccatcattctagcaacttgtgtatataatttagtcactacgatcgatatgtatattttctattttgctcaatcatttcatcatattgataaaattacttatatttcaaattatggtgtttatgcaggaaaatatgttgttttacaaaatgtgccagttgctctagcttcagcgatgtctacagcttctattccttctatttcatctgcttgggcacttggaaatgttaaagaagcaaaagtacatattacatctgggctatcagtaacaatgttgattttaattccagcggcagtaggaatggcagtattatcttatccaatcatgggtgttttatttcctcaaaaagagacaattatgacagctacattattgcttgctttaggatctccagcgattatcttttatggtttatcaacacttacaaatgggattttacaagctttaggagaagtgaatgttccattaagaaatgcagcattttcacttgtctgtcacatcatcattattgcgttattattgtttattacacctttaggggtttatgttttagtgcttggtaactgtacatatgcgcttcaagtatgttatttaaatcaaaaagctttacgtcaaaaaataggctataaacaagaaataaaaagaacttatgtgattcctttattagcttcattggttatgggagcgattgttttaggtgtttattatggtttatttacacttactcatagagtctttttacctcttattttatctgttgttgtaggcgtatttgtttattttataatgattatgtatatttattgggaacatccagcttatttgtttgaaattccttatatgaaaacactttattataaaattaagagaataatgaaaaaataaacgatttttgaaatacaaaatcgtttttaaatccaattttttgatgtattttttgaaatatgacaaacttattgttttaatttatgttaaaatgataagcaatgggggttataatatgcattataaagcagtaaaaggaattttatctaatgataatacaatgaatttatataggggatgtcaacatggctgtatttattgtgattcaagaagcaagtgttatcattttgaacatgactttgaagatatagaagttaaagaaaatgcgctttctttattagaaaatggtttaaaacataaaagaaagaaatgtatgattcaaatgggatctatgtgtgatccatatatgcctttagaaaaagaattaaagcatgtacaaaaagctttagaacttattgaacaatatcattttggagtaacacttattacgaagtcagacttaattttaagagacctggaacttttaaagaaaattaaccaacaaacaaaatgtgttgttcaaatgacgcttacaacatttgatgaaaatttatgtcaaaagttagaaccaggtgtttgtacaactcaaagaagaatagaagtattaaaagaactccataaaaatgggattcccacaattgtttggttaacaccaatcttgccttttattaatgatagtcaagaaaatattttaaagattttagaagaatgtcatgaagcaggagttaaaggaattatttgttttggtatgggagttacgttaagagagggaagcagagaatattattataagcaactagatcggttattccctggtatgaaagaaaagtatcaaatgacgtataatgatcaatatacgcttaatagcccgcataatagggatttaatgaatttattctttaaaaaatgccaagaatatcaaatgatgtgtaattacttagaaatatttgaatatttacaagaatttgaagaaaaaacaccaataaaaaagaaagatattcatgactttgaacaactttctttattctaaaaagatggaaaaccatctttttattttacaattttttgataaacttcatctaaatcaacatcttgactatgatcattaaattcaataacaagttctttttcatcgtatcgaggtaaaatatgaacgtggaaatgatgaacggtttgacctgcaacttcatttgtatttgttaaaatattcaatcccttagcgtttagtttttcaacgatttgtttagctaatttttgagtgacttgcattacatgagccaatgtttgtgcgtcaacttcaagaatattttcaaaatgttttttaggaataacaagggtatgtccataagttgcttgtgataaatctaaaaaagcaatacatacatcatcttcataaatgatttttccaggaatttctttattaataattttacaaaaaatacagttactcattttcttttcctccatagctctattttaaaacaaaaaaagaataaggtcgagaccttattcaaaataatctttagaagatttttttattttctttttgattgatggttcataaacatcaaagttatactttcttaaataagaagtttcacattttgtagaaaaattagaaatagaagttaaactttctttaatttcatcttttaaatttgatttatctgtattgtaaacccaaacaattgcatatttagattcagatgttttaattgcttttgcataaataccatcttttgtaaatttatctaattttttaatgattttagaatcaacactacttgattcttttgtaactaaaccagcatctgttccactattttcattaaaataatttgtgaaagattcttcgcttgtacaatctttaataatttttaaagcttgtgattcagtatcaaccgtaaaatatttaagatattttactttatattctttaactaaacttttgaaattatcttcaacatatttttcttgaagaagttgaatttttgcattaggctctaaaatttgttttacaaaatcgttttcactttcatagccagcatctttagcgtaagtttctagatcacttgtaccagcatattgaaggtattgttgttttaattcttcaactttagaattaatagcatcttcatcagtgatttcttgatcagctacataattgatagcactgtttaaagtcatatttaacccatcattatctaagaaatattcataaagatcatctttagtaattgttacatcacctgttttaacaactgctgaatcaccatcttttacatgggttacataggaatcatcttttttgttaaagcttttataaagaccataaccacaaccaccaataagacaaatacatacgataataactaataatctatattggtaaagcttatcttttaatgaattcattaggcttcacctctttctgtttttctttcttctaaggctttattaacaacttcttgaacgatttttttaatatctttatctttataattgattttataagaattatagacaacatattgtaaataatcatcataagctaataaaggagaatcaatatcagttttctttaattctttctttaaagtttttttatcagtacttgttacttttacaaaataatatccattatcaccagtaataacatcagaaacttgtccttcacttaatgcttcaatagcattaaagacatctttaccataactattagcaataccagaagtatctttactatcaacgatacctaatgatccttttttacttgaagtagaatcattagagtaatcttgagcaatatctccaaatgatttatccgtattactgattaattctttaacttcatttaatttagaagtttcatcatctgtaggtgagcttgtatcagatacagaaattttaattaaacttacatattttggagcacattgttgatagtaatcattaaagacatcatcaaaatgatcatcaatataatctaataagaaattagcatattgaatttgtttgatcattttttgacgatattcagataaattcttatatcctgcagatgttaaagcttgatttaatgaatctttatagttatcaccataattagatttatatgctgatttaatttgtttaataattgtagcagcatcttctttcatatcatcgttgacagggaatttttgatcaactaagttttgtaatacagcattaaagactgttgaattattacttgaattatcaataatatctttatataaattatcagcaaagatattttttgttttatttcctttttctaaagatgcaacaacgtattttgaatcaactttttttgctgatgaagttgtacatccagtcaaaaggcaactacttacaagtaataaggcagcacatttttttaatttcataattttcctccttcttgtagacttaaaaagtatactattttttcccacttatttcaatattatgggcaaaaacacacggtcaaacatatttattacataatttatactaaaaggatataagggaggggtttatatgaagtgtgaaaattcttttacgcttgttttagtactttttattttattagtgattatttgtaatatgttataaaaaatgcttagcaatttgctaagcatttttaggttgaggattatgttgacgataaacacgataactgattttgatagtaacaagaataggcattgcgatgatcattccccatgcaccaaacaaagttgaaccagttaaaataccaaataatacccacataatcgataaatcgatttttgatgaatatatttttggttgaatgacataaggaacaacatttgattgaataaaaatcagtacaaataaaataataagttttgttgtccccatcgtaattgaagtgacaattccaagtaaattagcaacaattggacctacataagggattaccgaactgatagctgagaaaataccaagtaagatccagtttggatgaccaataaccaaatagacaaaagctgttgtaagaccttgaataagagcacttaaagcaaaagcttcaatatattcaattaaagaaatattgatttcctttaaataaacaggtaagttttcatcaaattttcctgcaaaatgattaattgcaattcttatactatcaaattttatagacatatagattgcaaggattgaataaatcaagccgtttccaatttttacaataacagaatttaaaacatcaaacgttgtattaataactgtcatatcttgtaaaagtttcgctgcttctgtttgaatataagttgttatttcagagatattgaagcctaaatgactttgtacaaagcgcgaaataaaaatcaaaccgtcttcaaaagcaggatagagatctgttacgctattaattacaagtggaattgctagtgataaaataagtattaaacaagcaatgattcctacataaacaataattaaagataatccacgattttttacatatttttgtacccattcaataagcggatttaaaacataagcgattgcaaatgctacaaagaatggttttataatcttccaaaaaatactaaaagcgccaccccatacttcttttgtaatatctaataaaagaacgatcaaaaataaaataagtaagtttaacagggtttgtgtaatttttttagatgatatgacttgaaataaagatttcagaaatttcacattatcactccttttgtttaaataatataccatattttggatataatataaattgttaatacaaaagattatcacattgattgttttttttttgacattttagtaaaatgttgtgggtagaaaggggcttgatttatgtcaactttaaaaatagaaaatttacatgtttgtattgataataaagaaatactaaaaggaattgatttaacaatcaatacaggagaaatacatgcattaatgggacctaatggtaatggtaaatcaacattgctatcagctatcatgggaaaccctaaataccaagtaacagagggaagtatttacttggatggacaaaatgttttagaaatgtcagtcgatgaaagatcgaaagcaggaatctttttaggaatgcaatatcctcaagaaattccaggagttgtcacttctgattttttaagagctgcactcaatgctcatcaagaaaaaccagtatctttatttaaatttattaaagaattagataaaaatattgctgatttaaaaatggacgaaaatttagcacatcgttatttaaatgaaggtttttctggtggagaaaagaaaagaaatgaaattttgcaaatgaaattattaaaaccaaaatttgcattattggatgaaattgattctggtttagatgttgatgctttaaaaattgtttctgaagctataaatgatatgaaatcagattcatttggttgtgtgatggtttcacactatgaaagattatttgaacttgtaccacctagtcatgttcatatattagtagatggaaaaattgtattaagtggaggacaagaattaatagatcgtattgataaagaaggttatcgttgggttaaagaactaggttttgattttgaaactgaagaagataaacaacctattgttttaggtagttgtggaaataaggttaaagctaaataatgagtcgattagtagatattgataattatcttgttttagaaaatggaacaatcaaagaaacatcttttaaacaagatattcaaattcaaaatcaaactttaatgattaatgaagatgcaaaagtacaaattatttataagacaacagaagaaggaacttatcaatttaatattgaaattaaagatcgtttacatgtagatcttgtagaaatgtatgaagcatcaaagtcttgttcttatacaaaaaatataaaaatcaatgaatcaagtgaagttttaagatatgttgaaaaaaatagtcatcaaaatattcaacttgatttagatgaaaatgttgatgtttataagtatgcaagagtgtcttgcgcttatgtagaattaacagattatacaactttatcaaaaataaaatatcgtttacttgaagaggaagcaagtgttaaacttcgtttagcttctttaagcaaagaaaaagaaaataaacattatgaaatgactttagaacatttagcaccacatacatatggtgatatggataactatggtattgttaaatcaaaagcaagtttaattattgatggtgtgggacgtatttataaaggtatgtctggatcagatacacatcaaacaaataaaattattgtttttgatgaagggtgcaaagcacaagctaatccgtatttatatattgatgaatatgatgttaaagcaagccatggagcaagtgttggaaagattgatgaagatcatctttattatttaatgtctagaggtctttctaaacaagatgctatgcatctagtcacttatggttatttcttacctgttttagaatttatcagtgtagaatctttaaaagaaagattttcagatgttttgaaagaaaaggtgggactataatgttagatgttttaaaaattagagaagattttccaatgcttaaaaagactatgcatggaaaacctcttatttatttagataatggggcaacaactttaaaacctcaatgtgtgattgatagtgtttgtgattatttaacaaattattctggaaatgcacatcgtggagattatgacttatcacatgaagtagatacaaaatttgaatatgtaagaagtattgttgctgattttattcattgtaaaccagaggaagttgtttatacttatggttcttcagatagtttgaatatggtagcttttggttatggagtgacacatttaaaagaaggagatgaagtattgattactcttgctgaacatgcaagcaatacgcttccttggtttgaggtggctaaacatacaggagctatcattaaatatattgatctagacgaagaaggaaaagtgactttagaaaatgtcaaaaaagcagtgactgaacatacaaaaattatttcacttgcgcaaattacaaatgttttaggacatttagcaccaattaaagaaatttgtaattttgctcatgaacacgatattattgtttgtgttgatggggctcaaagtgcacctcatcatgctgttgatgttcaagatttagatgttgatttctttgctttttcaggacataaaatgtgtggacctacaggagtaggtgtattatatggaaaatatcatttattggaagaaatgacaccaacacgttttggtggaggaagtaatgcaagatacaatagttgtggtttagtaaagcttaaaaatgcaccaacaaaatttgaaacgggaacacctaatattgaaggggtcattggtcttggtagtgccattgaatatttacaaaatattggtatgaaaaatattgaagaacatgaagcaatgcttagaaaatatgccgttgaaaagatgaaagaattagataacattgaaatttacaatgaaaatggtgttggagcaattgctttcaatattaaaaatgttttttctcaagatggtgcatctttatttaatacgtatggaattgccattcgtgctggtcaacactgtgcaaaaatattagatgaatatttacatgtttcacaaacattaagagcttcattctatttctacaatacaaaagaagaaatagatcagtttattgaagtatgtaagaaaggggatgactttttagatgccttctttggataatatgatgcttcgtcaaattattatggatcattatgaaaatccacgtaatcatgaattagttgaagacgatagctataaaaaagtcaatatggatagtgaaacttgtattgataatattgatatacaagcaaaaatagaaaatggagtgattgaagatattcgctttgatggagaagcgtgtgcgatttgtacatcaagtacttctattatgacagaattattaattggtaaaacaattgatgaagcaaggcttattattgaaaattatatgaatatgatttttgaaaaagattatgattctgaaatattagaagaagcgattgctttttataacactcataaacaggccaatagaattaaatgtgcaactcttggatggaaaggaattacacaattaattgatgaaagtgaaaaggaggaaactcatggaaaatgatgaaactatgattcctgataaagatgtgtctgtttttaaaacacctaaaggaattaatgaagatatcgttagagaaatctctgccattaaaggtgaacctgaatggatgttggaatatcgtttaaaagcactcgattgttttttgaaaaagccaatgcctacatggggtgtcgatttaagtagagtagattttgatgagtatacgtattatattagaccttctgataaacaaacaaataaatgggaagaagtccctgaaacgattaaagatacttttgataaactaggaattcctgaagcagaacaaaaatatttatcaggggtaacaactcaatatgaatcagaagtggtttatcataatatgttgaaagaagttcaagaaaaaggtgttattttcttagatattgatagtggtttaagagaatacccagaattatttaaaaagtattttgatacagttattccttataatgataataagttttcagctttaaatggagctgtttggtctgggggatcatttatttatgtaccaccaggagtaaaactagaaaaacctttacaatcttattttagaatcaattctgaacaaatgggacaatttgaaagaacattgattattgttgataaaggttctgatattcattatgtagaaggatgtacagcaccaaattattcaaaagattcattacatacaggagttgttgaaattgttgttttagaaggggctaaatgccgttatacaacaattcaaaactggtctaataatatcttaaacttagtgacacaaagagcgaaggtttataaaaatggacaaatggaatgggtcgatggaaatattggttctgctgttacaatgaaatatccaacttgtgttttaatggaagaaggagcgaaaggttcttgtattacaattgctgttgctggagaaaatcaaattatggattctggagctaaaatgattcatttagcaccaaatacttcaagtagtattgtttctaagtcaattgctaaaaacggtggtaaaacaaactatcgtgggttagtacaacataatccaaaggcaatcaacgctaaaagtaaagttgaatgtgatacattgatcttagatcaaatttcaacaagtgatacagtgccaacaaactatgctagaaataatgattctttaattgaacatgaagcaactgtttctaaaatttcagatgaacaacttttctatttaatgtctagaggtctttctaaaaaagatgcgacagaaatgattgttatgggatttattgaaccattttcaagagaattaccaatggaatatgctgttgagttaaatcaattgattaaaatggactttggtgaaaatggaattggataaaaaacaattacgtaaacaattgatacaaatgagattggcttttgatgattatcaaaaacaatctcatttcattatagaaaagttaaaaaaagatctacgtttcattaaaagtaaaaaaataggaatctatttatcttataaacatgaagtagatacttggaaattaattgaagaatttaaaactcaaaaagaattttatgttcccatagttcgaggtaaagaaatgtattttactttatatcaagataaaatgatgaaaaataaatatggtattgatgaaccgatagataaacaagaaattaataaagaatttcttgatttaatgattgttccacttgtaggttatgatgcaaattgttatcgtttgggctatggtggaggttattatgatcgatatcttaaagattttaatgcaccaacaataggactggcttattcatttcaatatattgagcattatcaatctgaagattttgatattccattagatgatattataactgataaaaaaatatgaaaaaaatgtaaaaatctgttgacgtaagggaatagagatgttattataagtgggcactagtcaaggaggcttagctcagttgggagagcatctgccttacaagcagagggtcagcggttctcctgttatttattgtttgcaatgcaagttttaaacattgccctacttcttttatttattaaatgcaaaaaggacaatctttcgattgtcctatggcttgaatacccacttatttaaatacatatatttctccaacaaaaaaagacagatcatatcgacctgcctataataaaatttaactttacttattgtttcttttaataaaccataacaatataattcctactaataaactaattgcgaatccaatcgccatcaattgataattaaaatatgaatatgttgattgatcaataatctttgtaacaggattcatacttgctattagccaactgaatacacatcctattagtacaacaaatactggaacttttttcataacaatcactcctcacttgtttttaacatatttccttcattgtttattttcattaaaatgataaatgtaatacatggtacaaaaagaataattaaattcacaatcatcaaaacacttaacgctctttctataattatacttgccaagacatgatattgtaagtagaaaatacccattactgaaacttgcgctaaaacaatagatagtaaacaataattaatcctttcttttaaaataagttttaaacattgttttttattgaatccattgacaagcaacaatgcgtattgataacgccttgtgacaacatcaaatattccgatgataaaacatgaaagtacaaagagtataaatatgatctttgaaaaattgtaaatcatttcaaaaccaaatgatgttgtttgacttagaattgaagaagatactggattgtaaactttaatttgttgatcatgttttttaataaaatctgtgactgcctggatattcttataagaatctatttttaagatatagacatttgattgatacgtggcatcaggtatacattgattgatgattttttgatagagattttgtgaaatataaataatattttcagttgatttcgtatagcgattaccaatatccttatcaacagtatctgcatttgaaagttcaaaaggaatttcaacaaattcaaattcattgttttttagcacctgcattgttccagtcaaatgaatatgaccttttattttttgataaagtgaataagaaatataaatcttgtccgtatttattttttgtttatcaattaaaaatacatggttgctgttttttttgactgttttcattttcttataatagggttgtatgaccactgtttctttaaaagatgaatcattgaccgtcatatgagctacattccattcaaaaaagggagaaatattttgaatcatattattttgtgataaatcttgtacaagtgttctagaaacaggtgttccagccatatcataagcatttccaccatccttataagaaattcttaattcattattgattgctttatttatcattctttctgtttctttttgataataggcttgaaaacacatcatataggccataatgatcatcaaaaaggaaatgatgatatttcttttataatggattttatttgatttttgtgcatgtaaataataattaagtggaaatgtttgaattgtttttcttgcaatcaaattcttattttctttaatgctatttttctttaatagaatttgttgactttcaatatgatagtgtttatctgcaatctctaacatatctaaatcatgagaagcaatgacaactgtcttatgatatttatagcataaatcataaatgatttttctcatacgtcttctgttttcatcatctaaatacgctgtcggttcatctaaaaaaatgatttctggatctttcatcatacagcataaaatcaatagcctttgtttttgtcctcctgataaaacttttacttctccatttaaatcaatatttaaatcaagttcatctaacaaattcatcattttatctttcttaaattcaacttgaccaagttgactaaagaattcaatattttgaatgactgatagatcattaaaaagtcgacagtcttgaaaaacaaatgcgatttttcttctaaatgattcttcatctaaatcagacattttttcattttcataaatatattccttatttgcataatctgtaagtcgtgcaagttcaaataatagagtcgatttacccgaaccactctctcctgtaattaatgtgatttttcctgaaccaattttaatttcttgatcagtaaataaatctttatccctaaaagataaattaatatgtttcatttcaatcatagtttcaccttcttaacaaaatacttactgtagaataaatacaagatgtaaataatgatagaaacagctatttgaatactaaagaaaagtaataaactgatgattaaactttgatcattgactgcaaaaaatcccatcttttttgcgataaagaagcccggtataccgaatatgattgtcaataataattgaacaaagccattttcattaatcaacgaatgaacattcttatcatttagtccataaagctttaatagttttacttcatttttacgatcatcaagtgcattgatttgtaccattgcataaagtacaatggcgacaagaaccaccataaccatgtagatatatcttccttttctttcttctttatagacatccgttgtatcaatgactgaattatattgatcatatgttacaagatttttagaaatctttgttatttctttctctactgtttttaaattacttatacgatctacttctacaacatagttcttactgtgataaggtgtaattgttgcatttaattctttagcgtctaataaactatctggtgtctgattattgtattgattcaataaactataaaatgatttttctggcattaaaatagtatatcctgcactcaaaaactcattatagtaatcatcgacagaaatgatatggtctacttctaaatcaagttttacttttttagtaaggacttgcgacatctcggcctttagccctgattcattcatttctccttgataactgtattgttggacaggtatatagacctctacagaaatcttgaaattcttttcattcttatctattcctagcttattagccaatgactgactgatagcatttcctttaagctttttaccatttgatttgatattttgaaaagaataataaggagctaccagtggactgccacttttaaaataatcaaaatttactttatcctcctcacaatagacacttgtcgttgtaacattttgcatctgattgatcgtatcaaaaacatcgaaaggataaacacctttaacatgtttgattgctttcatttgtgcgagttcatcatcactaatatcaagattatcttcttgattagctatataataaccatcatttcctaaaaaagcatcattcacttttcctgtatagacttctgctttatttgctctttctataccgtttgcaagatgattttcctgtaaaatactgtcacttatattggtagaaatagaaactgtcataataaatcccagtaacatcaccaatataaattgaaaccattgtctttgatttttatagaaaaaatacttttttattctttgatgttttgtattttctatttttaaatcctgttgaacttcttttatttcctgatgacagtaaagctgcttattttctatttcataaacaatatccaaatgttcaatcaaaaaatcatcatgtgtcgtaataataatatatttattgtctttttttagcttttgtaaaatatttaaaataatttctttattttcttgatctaaagatgctgttggttcatcaatgataacgattgatgcatctttatacatcgccaatgctattaaaaatctttttctttgtcctatggataaagaagaaggaaagtaggatagatctatattatctaatcctactaaatgaagcacttctaacattttatcttgatcaaactcttgttttcttaattgacttataaattcaaaatgttcacgtattttcatattttcgaagaatgtaccaaattgatcaatatagctgacacaattcaataaataatcttccttgtttttttcagtgattgtttgcttatctatagaaagtgtttgattactgtattgatagattaacgcttttaagaatgttgtttttccacatccactttttcctatgatacctgttatttttcctggacatgttttaaaattggcattcttaaatattatttggttatcaaatctgatatctaaatgcttcatttcaatcatagtatttcgcctctttctttatattatttaaaatctaattgttgaagtttttgtttgttttgcatttcctaattgtccagtaattttcacttttgcaatttttcctgaatctaaattacttactttttgtgttccacctgtaactaaatactttgttgaaacagtacttgttgctttagaatttgtacaagttgctttatgttcatttatacaaataactattcctgatgtatcactagttgtataaacaacaacatttcttgtttgtgtagctgcacttacacatcctaaagaaaacataaaaataaatgctaaacttaaaattgatgtaatgacttttttgtttttcataataactttcctccgttttactatgattatttccttctgattacattgtaacaagctttaaaaaaataataatacttttaggacgtttgaccattttatgaggataattgacataaaaaatacctgtcatcgactgacaggtattaatagtgaaatgtttatattttgattttcatgaataatttttatacttccctgatatctttttagaattaattttaatgtatcgtatttcacacgatcaatattttcaattccctgactaataaatattgcaatttcaaatacacattcatcttgaatagcttttatttctaactcattattttgaatacaattcattgcaatatcaaaaagataactaatgataatatttaaatgttcatcatcaataaaagaaatatcttgaattgaaacaatcattgttggtgtaatatgttctagttttaattgttctaatttcatgtttacaaatgcatcaaataatttatttcctgaagtaattatcatttcttcttgatcaagagatgctaccttttgatcaatcatttgatttactgtttcaaattctttccttttaacatattctttcatttgtaaatattcatattttaaatcatgttttaatttatttaattcattatttttcttttcaataaatgcataattttgttgatcgttcttaaaataatttacagcttgattgagtaactgttgttcatgataaagttttgtatatctaaaaaatagataataagaaaaaatgattgttagtactaaagttattagaataattagatttcgatttacgcccaacacatctaaaaaatcataataaaggatgtgatatacacataacgtgcttatcgaaataagcattaataatccccaatacatattttgattatctataggataaaaatgttttatatatatcatcaaagcaataataatcacgaaaacaataaatgaaatagcttcataaaatggtaataaaagcactatatcttttataaccaatgaaaatgaaagataaaataaaatttccgttatattcctatctagaaaataaaaaagaaaaaaacatataacttctaaaaacaaaacatcttgtaacaataaggttgatgcaatagcgtttattaaactatttgataacagacaaacaattaaatatttcttaaaaaattcttttggaacatccaaaagataaatcagcgcaatttcaatacaacaaaaatataaaaaagtaatcattgtaagtatctcctatatgcatgatatttttctacaatatcttttgattgtctagaaacattgaatgtttgtttattagaaagtgtcacactttgactattgattttcgttacatatttaaaattaataattgtataagaatttattttataaaaagcaatattcttacataatgtttctgaacatctttttaaagttatatactgttggtactcatgatctattgtaaaaaaagtacacatatttctatgagattgaatataacaaatatctacataacggatatattgattatttttttcatccaccaaatattgtttattactttctgcttcatctttttctattttagtaagtaatcttttaaaatcatcttcataaaatgctttccttataaaaaaataaagatgtatatcaaagcaatcataaacaagtgcttcattattagaaataaatataatttttgttgttttattgtttactttttttgctaaagaaattccatcatcttgcgctaaaataatatcaataaataaaaaatcataattttctatatcaattgtttgaaaatcatcattataaatatctatatcatttccacaaaaataattactattctctatttttttttttaatatattactaaatgcaagatcatcatcaataattcctattttcataaatgcttactccttttttttaaaatcaagtaaataattactttttttctatatttgaaaaaagaaattcgcaataaacgaattcttccataacaataaaggataaagaatgagagatttttataaaaattgttggtaatattttgaattttcagtattctacaaaagaaaaggctgtatgaaattaattgtttaatttcgtaacagccctttttttgttatgaaaaaacaaaaattcttttctatatttataaattcatgtataattgtatcgaaaagggggaagcttaatgtcatatgcaatagaaatgcttaacataatgaaagagtttcctggtatcaaagcaaatgataatgttaccttgcaagttgaacaaggtgaaatacatgcattgttaggagaaaatggtgccggaaaatcgacgctgatgtctattttgtttggtttatatcaaccagatgaaggacaaataaaaattaatggagaacctgttgaaattaatgatcccaacgatgccaataaatataacattggtatggttcatcaacatttcaaacttgtacataactttacagtacttgaaaatattattttgggtattgaagaaacaaagcatacttttattcaaaaaggtgcggcaagaaaaaaagttattgaattatctcaaaagtataaattaaatgttgatccagatgctttaatttcggatattactgtaggaatgcaacaaagggttgaaattttgaaaatgttatttagagataataatgttttgatttttgatgaacctactgcggtattaacacctcaagaaatcgatgaactaatgatgattatgaaagatttagcaaaagaaggtaaatctatcatttttattactcataaattaaatgaaattaaagcggtagctaatcgttgtacaatattaagaaaaggtaaatatattggtacagttgatgtagcttcaacatctgctgaaaaattatcagaattaatggttggccgaaaagttaactttattgtagaaaaagatgaacctcaaattggtgatacagttcttgaggtaaaagatctatgttataaaccagctcattcgtctaagaatgttttaaataacgtttcattcaatgtacgtcgaggagaaatcgtttgtattgcgggaattgatggaaatggacaaacagaacttgtttatgcattatcaggtcttattaaacataacagtgggcaaattctattaaatggagaagatttatctcatgaaagtattcgttcacgttctttaaaaggaatggctcatattccagaagatcgtcataaacatggtttagtattagattataatctagccgaaaactttatcttaaaaagttattttgatccaaaatatcaaaataaaggttttattaaatttgataagatgtatgaaacagctaataagttaattgaacaatatgatgttcgttctggtgaaggtgcaaaatctattacgagaggaatgtcaggaggaaatcaacaaaaagcaatcattgctagagaggttgaatctaattcggacttattaattgctgtacaaccaacacgtggattagacgttggtgctattgaatttattcataaacaacttgttaaacaaagagatgaaaataaagctgtcttacttgtttcattagaattagatgaagttatgaatgtttcagatcgtattttagtaatgtatgaaggtgaaatcgttgctaatttagatccaaaacaaattgatgaaaaagaattaggactttatatgtcaggaagtaaacgaggtgaaggatatgaaaaataatgagtcaaaacaaaatctgatagcttctttacttgctatattaattggattgcttataggatttatcgttattttaatagcaaatccatctcaagcttttagagcaatgggtattatgatgtctgggggattttataaaggattaagaagtacagggcaagttctttattctgcaattccaattatgatgactgggttatctgttgcatttgcatttaaatgcggtaactttaatatcgggacaactggtcaatatacagttggtggctttgtggcattatttttagccaatacgctttatcaaactgtacctgattcattattatggatcatttgtttaattgctgcaggacttgctggagcaatttgggcattgattcccggaattttaaaagcgtatagaaatgttaatattgttatttcgggtatcatgtttaactatattggtatgtatcttgttattgagggtgttaaagcttttatttatgattcagctggtgctcgttcccaaacatctaagattgctgttcctaaaatgggattaaatcatattttcccaggctcagatgttaatggtggtattattattgctattgcattatgcatcgttgcttatattattttaaataaaacaacatttggttacgaattaaaagcatgcggttataatccagaagcaagtcgttatgctggaatgtctgaaaagaaaattgttattttatcaatggttattgcaggatttttctcaggtattggtggtggacttgtttatatcggaggaacaggtagagcctttacaactgctgaagtcacacttccagaaggatttaatggaattccagttgcattgttaggaatgaacagtccacttggatgtattttagcagcattatttgtttcatatattaatgttggtggaaactatatgcaagcatgtaatattccagttgaaattattgatgtcatttcagcggttattatttactttagttcatttgctttaatgatccgtttatatttacaaaatcatgaaaagaaaaaacataaaaaagaagttgctgttgaagggggtcaagaataatggatattattttaaatgtcttaaatcaaacattagtctttacagtgcctcttttagtagttgctttaggtgggatgtttagtgaacgaagtggtgttgttaatatcgcgttagaaggaatcatgattggtggagcattcgtgggggtttatttcatttatttaatgcaatcagcaaacccaacaatgaatccgcaattattattgattttagcattaattgtagctggtatttttggggctctattaagtttacttcatgcttttgcagcaattaacttaaaagccgatcaaacaatttccggaactgcaattaatatgttagctcctggattgggtttattcttagctaaattgattttcaatggaaattcaagtgtacctttttcaaatacatttagaattcatgaaattcctgtcttatcacaaattccaattttaggacctatcttatttaaaggtgcttatattacaacttatcttggaattgttattttgattttatcggttattttcttaaataaaacaaaagcaggattaagattacgtgcttgtggtgaaaatcctcaagctgctgatgctgcaggtgtaagtgtttataaatatcgttatatgggtgttctattatctggttttctaggtggtataggtggacttatttatatcatcccaatttcaactgtatttaatagtgatgttggtggttatggattcttagctcttgcaatcttgatttttggtaactggcaaccatatcgtattgctgctgcatcattattctttggaattatgaagacattagcatatacttatacagcaattccatttttatcagcattaggtttcccaagtgttgtttataaacttattccttatgtagcaacattgattttattagcgtttacttctaaaaattctgctgctcctaaggcttcggggattccttatgataaatcaaaacgttaaaatatttgaaagtattgtttcttaagaaataatacttttttatttttttgattatttgtgtataatagatgagaatgaaaggaaatgattatggaaaaagtttataaaatgccagggtatgatttacatttgctccctacaaataaatttaaaaatattacaatttcattaaaattacaaaatacactagatgaaaaaacggttgctaaaagaacattactatcttttatgttgactacgggtacagaaaaatatccatcaacacaagaactttctaaatatttagaaagcatgtatggcatgaaattaggagctaatgttgttactaaaggtaagagtcatattattaatattaattcaatctgtattaatcaagaatatttaccttacaaagaagatcttattcaacagcaaatccaattgttaaatgatattttctttaaacctaatgcctcaaaaacagcttttgatcaaacaatgtttgaaagaaagaaaaaagaattggttgaacgtcttattaataatcaagatgataaattttattatagtttagaaaaaatgtttgaatatatgggaaaggggacatgtttaggaatttcttctcatggaaatattgaagatataaaaaaaattgaaaatgaagaattattttcgtattttaaggaatgtataaaaaatgaccaaaaacatatttatgtagtcggaaatgtagatgaatctattgttcatgtctttgaaaattgtttatcttttgaaaagaataattcaatttttgaaagtgtatattcatttgaaaaaaatagaaaagatttattagaaatcatagaaaagcaagatgttacacaagctaagcttaatatgggatatcgtatatcagtaaattacaatcaccaaaatcattatgcttttgtagtatttaatgcgatttttggtggaatgagtcaatctaaattatttaaagttgttagagagaaaaattcattatgttattatatttcttcaagttatgatgcttttaatggagtgatggtcattacagctggcatagaaggaaaagattatcatcaaaccgttcaattaattaaagaacaattaaaagaaatgcaagatggttgctttgatcaagatgatattgatactgcaaaattaatgattaaaaattctatgaaaaaaacaaacgatgagccattaagtcaagttgccgttcaatacaatagagatattacggaaaaaaaagaaacaaatgaacaatatttagaaaaaattgaaaatgttacttatcaagatattgtagatgtttgtcaaaatattgaacttgatacaatatttttgttgaaggggagaaatgagtaatggaaaaaatatattatcaaactttaaaagaaacgttattccatgaaaaattggaaaatggtttagaagtatatttgttacctaaaattggttttgaaaaaacatatggtttattttcaacaagatttggatcgattgatacaacttttgtacccttaggacaaaaagaaatgataaaagtcgaagacggaattgctcattttttagaacataaaatgtttgatatggaaaatggggatgctgctgatgagtttgctaaacttggggcaagttcaaatgcatttacatcatcaagtcgtacggcctatttattttcaacgacaacaaatgaaaatgattgtgttgaacttttactagattttgtacaaagtctaaatattacagacgaaagcgtagaaaaagaaaaaggaattatttgtcaagaaataaaaatgtatgatgatgacccagattggcgtgtttattttggagctattgccaacttgtatcataaacatcctgttaagattgatattgctggaacttgtgaaactgttaataatacgtataaagatatgttggaactttgttatcaaactttttatcatccacataatatgatgctttttgttgtaggtaatattaatcctgaagaattaataggtgtcattaaagaaaatcaaaataaaaagcatttcttatctgaaaatgtaattcaaagattaaaaatagaagaaccaccatcagtagctgttaaagaacaaattgatacaatgcaagttgaaatgaataaattgattgtttctattaaaattaatgaaattcttgatgatcctcaagataaaattaaaagagaattagctttaaatttattatttgatttatgtttttctaaaagttcttcgttatataacgaatggttagaaaaagggtatattaatgaaacatttagtgcaagttttacgcaagaaagagattatgcttttattttaatgggtggagatcaagatgattatgaattattgcaaaagacaatttttaattttatagatcatgttcaagatttagaaatagcagaagatgactttgacagaattaaaaggaaaacaattggaaacttcatcaatagttacaataatccagaaagtattgcgaatacttttagccgttattattttgaaggaatttgttcatttgatttagtagattatgtaagtaaaatgacattggcagatataaatgaagtaaaaagatactttagtaaggaatatgcttcaagctatattgttaaaaaagataaataaaggggtatatttaaaaataatttatggtataatgtaatgcgactagagagtgtaaataaatttcctacacattagatacgggaacctgatctaaataatggtgttgaaagcctatctttgaataggaatcctaaaattatttaaaggtgcccacctgtacgtaacagggataatctaaaagctctctagttttttatttaaaaggagaaatcaaaatggcagcaatagatcaaaaacttatagatagaataaatgttttagctaaaaagaaaaaagaaggtacaattactcctgaagaattaaaagaacaggataaattgagaaaagaatatattaagctttttagagaaggatttaaatctcaattaaaagcaattaaagttgtagatgaaaaaggaaatgatataacaccgcttaaattaaaacaagaaaaattaaaaaattaaggaattctagtagaagatatttaatttttatagaaaatgtgtataatatgtcttgacttatttaaaaataggagaaaatgtaaatggatatttcaaatttatcaatcgcaacaattagaagtttaggaatcgatacaatcaataaagcaaattctggacatccaggaatggttcttggatcagcacctgctttatatacattgtttaataaagaactaaacatttataacaaagaagctgaatggattaatagagatcgtttcgttttagcaagtggacatgcttctgcacttttatatagcatgttacatttgacagggtttgatgttacaatcgatgatctaaagaattttagacaattgaattctcgtacacctgggcatccagaaattgaaatgacacatggtgttgatgcttcaagtggaccattaggacaaggtattccaatggcagctggaatggcaatggctgaaaaatttttagcaagtcaatataacaaagaaaactttgatattattgatcattatacatatgttttatgtggtgatggcgatatgcaagaaggggttacttatgaagcggcatctcttgcaggtcatttatcattaggtaaattaattgttttatatgatgcaaataaggttactttggatggacctttatcaatgtcatttagtgaaaatgtaaaaaaacgttatgaagcttgtaattggcaagttttagaagttaaagatggaaatgacattaatgaaattcataaagctattaaaaaaggtaaaaaagaacaattcaagccaactttaattattgtaaatacagttattggatttggttcagcaaatcaaggaacaaataaagttcatggtgcaccattaggtaaagaagatggtaaaaacgctaaattatcttatggttttgatcatgatgaattctatgtacctgaagaagtatatgaagattttaaaaagaaaacaattaaaagaggaaaatctaaatttaataaatggaataaattattcaatgagtataaagaacaatatccaacagaagcaaaacaattagaagatgctattgctggtaaatattctttaaacattgatgaacttttaaagaattatcctgtaggacataatgatgctacaagaaatacttcattagaagttattcaagaagttgctaaacaaaatccaactttcttatcgggaactgcagacttagctagttcaacaaaaacaaaaattaaagatgaagatgactttagtgttgaaaattataatggacgtaatttagtatttggaattcgtgagtttgcaatggttgctattatgaatggtatgacattgcataaaggtgtaaaagtttcatctggtggtttcttagtattctctgattatttcaaagcagcagtaagaatggcttgtttaatgaaattaccaattattttaccattatctcatgattctattgcagttggtgaagatggaccaactcatcaaccaattgaacagtttgctatgttaagatcaattccaaatatgcatgttattcgtccaggagatgccgtagaaatggcagcagcatggaaattagcgattgaatcaactgaaaaccctacagcacttattcttacaagacaaaatgtagaaacaatggaaaatagttctgttgaaggtgtaagcaagggtgcttatgttattggtaaagaagaaaatcatttagatgctatcattattgcatctggatcagaagttaacttagctatgaaagctaaaaaagtactttttgaaaaaggtattgatgtacgtgttgtatctatgccatgtcaagaattctttgaccaacaagatgaacaatacaaagaagctgttttaccaaatgcaatgcgtaaacgtttatcagtagaaatggctagttcatttggatggcataaatatgttggtttagatggtataacaatgtctattgatgaatttggtaaaagtgctccagcacaagatgttatccaatcttatggatttactgttgatggagtcgtagaaaatattgaaaaattattaaaataaagggagtactccctttttttacattcttcccttgattgttatgataccttagtaataggtgattgagatgaaatatgttatatatgaatacgaagaaggtataaaacaattatttgaaaagtatccaaatttaaaacaatattttgataatcttacgttagataatgattttatgaataaatttataaattgcgtctataacagtgttgattatatgaatgaacttatttataaagaattgcacaatagaaaagaatatcatcgagttgggaaaatgcatatatttgaaaatgaacttacacatgaaataagtcgtttatatgttgaaaattataaaattattattgaatcgaaagataaaacaaacatattctttgatattctctatcataatttaaaaagttatgttataatagatgagaatttgtaagggaggtattatcaatgttatatgcaattcttggattaatcgttggattaattgctgggttctttgcgtctcgttatttctttaaaaaacaattacaaaaaaatccacctatcaatgaaaaaatgattcgtgctatgtatatggaaatgggaagaaaaccaagtgaggctcaaattaaaagaatcatggcttcagttaaatcacaatataaataaggggatacccttatttttgtttatatgaaaatatatattactagacattccttaactgcatggaacgaagaaaaaagactacaaggatggaaagactcaccgcttactaagcaagggaaagaagatgctttaaaattaggtgaatatatgaaaacaatacatattgatcaagtatattcttcgcctttattaagagcaaaatctacagcgagacttatttttaaaaatgaaaatattattgaagatagtcgtttaaaggaaatgaacttcggagattatgaaggagaatatattcaagatttaaaaaagaaacatgattatttttgtttgtggcatcaaccgcaattgtcattttctttgccaaatggagaaacatatgaagaagttgtttttcgtttaaatgattttattttagaaaaatataacgaaaatcctcaacaaacaatttttataacaattcatggtatgttatttacaatattacatggaatttttttagatttacctgttgaacgattaaatgaagttaatcaagaaattgtaagaggatgttcgctttcgttgtttgaatttgatggaaaaaaacataaaatagattttattgggaaagattgttttttaacacctttaaaagaaaaaattagttataaataaaaaagattagtttaactatcataaactaatcttttttacatccattgaatttttgattcagtctgatttttaatacgtttgatattatctttatgtctataaactaataagataacagctacaagcatgcataattttgctgttatggacaccgctagaaacggtgtaatacataaaacaatcaaagcagtagagattgaagataaagatacatattttgaaatttttaaaacaagtaaaaatacaacaatagcaacaactgcatataatggttcaatacataaaaaataacctagacttgttgaaacagcttttcctcctcgaaattcagcaaagataggataacaatgtccaaaaatacatgctaatccagcgagatatttaatatcaggatttaaattgaattttaaagataaataactacttaaataaaatataataactgctttaagagcatctagtacaattacagaaatacctgctttttttcctaagactctgccagcatttgttcctcctaaattgcccgagccactttctctaacatccgtattataaaatacttttccaataacaagggcaaaggggatagaaccgtataaataacctaatagaatcaataatatttcatacatttttatcaccaagctaaattatacagttatcctataaaaatgcaattaaactttgaaaaaaaacaagagtattgatataatagttcaagtataacaaaaggagtgattatatggcaaaaaagaatacatatgatgagtcaaatatacagattctagaaggattagaagcagttagaaaaagacctggtatgtatattggatctacagacagtagaggattacatcatttagtttgggaaattgttgataatgcaatagatgaagctctttctggatatggtaatttaatagaagttactatttgtaaagataatagtattatggtacaagatcatggacgtggaatgccaacaggcatgcatgcttcaggaaggccaacaacagaagttattttgacaattcttcatgcagggggtaaattctctgaagatggtggttataagacttcgggaggacttcatggagtaggtgcttctgttgttaatgcactttctcattggttagaagtgactgtttgtagagatggaaaaatttttaagcaacgttttgaagatggcggagaaacaataggaaaattaacagttattggaaaaacaaaagaaacgggaacattgattcattttttaccaaatgatcaaattttttcaacaatagaatttaattataaaacaattagtgaaagactaatggaaagtgcttttttattaaaaggcatcaaaattgttttaaaagatgaaagaactggaaaaatggatgaattccattttgaaaatggattagaagcatttattgattatttaaatactaataaagatgtacttcatccaacaatttctattgaaggtgaacaaaatgggatggaagtagatattgctttacaatttacttctggatatcaagaaacgacattatcatttgttaaccttgtaagaacgggtgatggtggaacacatgaaacaggttttaaatctggacttacaaaaacattcaatgattatgcgagaaaatatggtctattaaaagaaaaagataaaaatttagaaggaaatgatgtacgagaagggctttcagcgattatttccattaaagttcctgaacattatttacaatttgaagggcaaacaaaatcaaaattaggaacaccagaagctagaaatattgtagatagtatcgtatatgaaaaattatcttatttcttagaagaaaataaagaaattgcagataatcttgttaaaaaaatgattaaagctgctcaagtaagggatgcagcaagaaaagcaagagaagcagcaagaaaaggaaaaggtgcaagacaagaaagaatattaagtgggaaattagctcctgctcaaactaaaaataaaaagaaaaatgaactttatttagtcgaaggggattctgccggaggtagtgctaaacaaggacgagatagaaaatatcaagcaattttacctttaagaggaaaagttttaaatagtgaaaaagtatccttacaagatattttgaaaaatgaagaacttgcgacattaatcaatactattggtgctggatttggtgcagattttaaagttgaagatagtcattatgataaagttattattatgaccgatgcagatacggatggggcccatatccaaatattattattaactttcttctatcgctatatgaaagatttgatcacagcagggaaagtttatattgctcttccacctctttataaagtatctaaaaaaagtggaaaaaaagaagaggttatttattgttgggaagattatgaacttgaagatgctaaaaagaaaattggcagaggatacaatgttcaacgttataaaggtttaggggaaatgaatgcttctcaattatgggaaacgaccatggatcccgaaacaagaaccttgattcaagtttcaattgatgatgctgctgtagttgaacgtaatgtgactgttttaatgggtgataaagttgagccaagacgtgaatggattgaacaaaatgtacaatttacattagaagataattatcaaatttaggaggtttttatgtctgataaaaaaattgtaatgaatttagaagcaatcatgggtgatcgctttggaaaatattcaaaatatattattcaagaacgtgcacttcctgatgtacgtgatggattaaaacctgttcaacgtagaattctttattcaatgaataaagaaggaaatacggctagtaaaccttatcgtaagtcggcaaaaacggtagggaatgttattggtaattatcatcctcatggtgataggtcagtttatgatgcaatggttcgtctttcgcaagaatggaaaatcagagcaccattaattgatatgcaaggaaataatggatcaattgataatgatcctgctgcagctatgcgttatacagaggctagactttcaccaattgcaagtgaattattaagagacttagataaagatactgtattaatgtctttaaactttgatgatacagagtatgaaccaacggttttaccagctgcatatcctaatcttttagtcaatggatctactggaatatcagctggatatgcaacagatattccaccacataatttacaagaagttattgatgcaacaattcatcgaattaaatatcctcattgtcatttagataaattaatggaatttatcaaaggacctgattttcctacaggcgctattgttgaaggattagatggtattaaaaaggcctttgaaaaaggaagaggaaaagttattgttcgagcaaaaactgaaattattgaagaaaaaaacatgaatcaaattgtggttactgaaattccttatgaagtcaataaagctgaattagtaagaaaaattgatgagattcgttttaataagaatattgatggtattttagaagtaagagatgaatcagacagagaaggtttgagaattgttattgatttgaaaaagactgtaaatgttcaaaatactctcaattatttttataaaaataccgatttacaaaaaaactataactataatatggtagccattaaggataaaagacctgttttaatgggaattgaagaaattctagatggttatattgatcaccaaattgatgttgtaacacgagcaagtttatatgatttaaataaagcaaatgaacgtttgcatattgttgatgggttaattaaagcaatttctattttagatgatgttgtcaaaacaattcgtgcatcaaaagataaaagcgatgcaaaaaacaatttaataaaacaatatgcattttctgaaaagcaagcagaagcaattgtgatgctacaactttatcgattgactaatactgatattgtttctttacaagaagaaaaagcagaacttgaaaaacgtgttcaaagattgaatgaaatattagaaagtgatgatgttttacgacaagtcatcattaaacgtcttaaagaaatcaaacaaaaatatcctatgcctcgtttaacacaaattaaagaagaagttagtgaaattaaaattgatgaaaaagctatgattatttctgaagatatttatgtatctgttacgagagatggttatattaaacgtatttcacaaagatcaatgaaagcaagtacgaatattccatttggtaaaaaagaagatgatattcttatttctttacatcatgcaaatactttaaatcatgtattattatttactaataaaggaaattatttatttgtaccagttcataaaatagaagaatttaaatggaaagatttaggtaaacatgtaagttatcttgtaaaagtaggtgcagatgaaaaaattatttcttcaattcttgttcaagattttaatttacctctttatgttttaatggcaacaaaaaatggtcaaatcaaaagaacgcttataaaagattttgaagtttctagatattcaaaagcaatcacatgcatgaaagtaaaagaacaagatactatgatttgtgctttacttactgataaccaacaaggaatatttattgtttctaaagctggctatggtggattatatagtgaacaagaagtatcgattgttggtttaaaagctgcaggtataaaagctcttaatttaaaaaatgattcaatagcagcggttgatgtgtttgatcctttagaaaattattcagtattgattcttagtgaagacggtcaaatgaaacgtttaaaattgaatgatataccagcatgtaaacgtacaactaaaggaacaacattgtataaaaatttaaaaacgaaaacaatttatgtaaagaatgcatttgtactttcatctaaagaaagtgcttctgtctatacttcaaaatctaaagagtatacatttaagccaacagatttcaataacgcttcattagaatcaagattttcatcttttactaagttagaaaaagacgaaactattttatggagtcaaataaatcgagtaatcacaacaaatgattatgatgtaaaaaaagaaaatcaaaatttacaaagtggtgttattaaattaaaagaaagtacagaaaaaactttattagatgattttgatattcaagaagttcctattaaaaaagaaacatctaattcaaaaaagaaaaatacaattaaatatgaaaagattacgttagaagatattttaaatgatgacgaattttaaaagaaggatgattgattatccttcttttttttgtaaataacattttaataatttaattaatgctcttttttctattcgagaaatataagaacgtgaaatgtgatactctttagcaatttctttttgggtcatttttttagatgaatttagaccatagcgttttgttaaaatatctttttcttttgaagttaatacatcaaaacattgaatgagcttttgaagattatcagcatcatatatttgatctaaaataggtttttccttattatcaattaaatcttctaaaacaacttcactgccatctttatcaactccaattacttcatttaaagaaacttcttgatttattttttttgttgatcttaaatgcattagaatttcattttctatacattttgaagcataagttgctaatttggtttttttatcaatactgtaactatcgatggctttaataagtccaatagtgccaattgaaatgagatcttcttgcaaatctctattgttattatatttttttgcaatatgggcaacaagcctaagattcttttcaataagtagatctctggcggctttatcgccattacattttttttgtaagtaaaattgttcttctttgaaagtgagtggtaaatcaaaagttttagacttgatataagatataaagtaagcattattcaataatgaaagtaataaagaaaatatgttgatcacctcattataattaatgctatttttgacaaaaaatgataaataaaattaatatttcttttgcttaacatttctttaaaaatcaagtataatagggtacaattgttatgtgataaagagaggtaatttatggaagagttaagatgttatggctgtggagctattattcaaagtgaagatgaaaaaaagattggttttgttcctaaaaatgcactagatcgaagtcaagtattatgtaaaagatgttttcgtttaaaaaactatcatcaattacaagcaacaaatttatcagatgatgattttcttgaaattttgaataaaattggagaaaaggattgtttagttgtttatcttgttgatttatttgatttcaatggaagtttaattcaaggattggttcgtcatattaattataatgatgtcattgttgttggtaataagagggatattttacctcgttcaatcaaagatacgaaaattattcattggttgagaagacaacttaaattagagggaattaaaccgttagatgtgttacttacaagtggaaaaaagaattatcatttagatgaattaatgcaaatgatcgatcaatatagaaaaggtagagatgtttatgttgtaggagttactaatgttggtaaatcatctttaatcaattctttattaaaagcctatagtgatgttcaagataatttaattacaactagtgaatttcctggtacaacattggatcttattgaaattccattagatgaaaattcatccatttatgatagtccaggtattgtcaatagacatcaaatagcacatcttgttgatgaaaatacattaaaagatattttaccacaaagtgaattacgacctgttaattatcagttgaattgtaaacaaactttatattttggtggattagcacgtttagattttttaaatggctcaaaaacatcgatgacatgttattttcatagaagattgcaaattcaccgtacaaaattagaaaatgcggatgctctttataatcgacataaaacattaaaacctgaagttgaagaattaaaagatattcaatcatttaaaacatatcaatttagattacctgaaaataaagtcgatgttgttatttcaggattaggatttgtgacaattcattgtccaaatgcattaatagaagtgaaagctcccgaacaagttggagtctttataagagaagcgttaatttaaaggaggatatattatgttaactggaaaacaaaaaagatttttaagacatgaagcgcatcatttaaacgctatttttcaaattgggaaagatggtttacatgaaaatcaaattattggaattgatgaagctttagaatcaagagaacttattaaagtaaaaattttagaaagttgtcaacaagataaaaatgaaatcgcacaagaattatctttaaaaactgatgctgaagttgttcaaatattagggcgtacaatcattttataccgtgaaagcgaaaaggaaatttatcgtttaccatgaaaataggaatttttggaggttcttttgatcctattcatttaggtcatacaagaatcattaatgaagcaattatatctcttcaacttgataagatgttaattgtacctaccaaacacaatccttggaaagaagacagtgttgcaaataatcaacaacgtatagaaatgattcaaattgcacttaaagataattcaaaatgtgaagtttgtacattagaaattgatcgacaagataatgaaaaaaattatacgatagatacaattaaagaattaaaaaaaatatataaaaatgatcagctctattttatgatgggaatggatcaggcaagccaatttgataaatggaaatctgctaaagaaattagtgaacttgttcaattagtagcttttaatcgaaaaggatatcaaaaaaatgatgttttaaatgattatcattttgaatttattcaagctgattcaacggctgaatcaagcactcaatttaaagcgggaaataaagaaatcgttgatcgaaatgtttatacatatgcatttcaaaatggcttatatttagaaaattttgtttcaggatatatgagtgaaaaaagatttaagcatacatgttctgttgcaaaacttgctagagaatttgctgttgcaaatggaattgatggtaaaaaagcatatattgcaggaatgttgcatgatattgccaaagaaatggataaaaaacaagaagatgatttgatggaaaagtattttagtaaatatgttgataaaccaagagcaatttatcatcaatggttatcaacatatttagcacaaaaagattttatgattaaagatgctgaaatattacaagcaattcgtcatcacacaacagcttcaacaaacatgtccttgttagatatgtgtgtatattgtgcagataaacttgatcctttaagaggatatgattcttcaaaacaaattgcattatgtaaagaagatatcatagaaggttttaaaggagaactaaagaatttttataaattttcgaagaagaaaaacagacctattgatgaatgtttttttgatgtttatcaagtatattgtaaaggagatttaaatggataaattaaaaacaattgtaaaagtattagatgaaaaattagcagaggatattgttgttattgatatgtcaattgacagtcctatttgtgattattttgtaattgcaagtgcaagtaacgaaagattacttcttgcattaaaagatcatattgaagatgcttgtgataaagaaagatactatgtaaaaaatattgaaggtagaaaaaattgtaaatggattttaatggattacggtgatattgttgttcatttatttgatccagaagaaagaaaaaattatggaattgaaaaactatggtctgataagccatttgttcaagtagaggatattttataatgtcgtacgaagcatttgcctattattatgatagtttaatggatcaaggtttttataatgattatattcaatttattaatgagcatgtaaaagattatcaaactgtattagagcttggatgtggtacaggagaaattgcaatacgtttggctcatttagggaaacaagtttgtgctacagatatttcaaaagatatgttagaggttgctaaatacaaatgtattgattttaaagcggatgttatgttatcacgtattgatatgtgtgattttgcagttgatagtcaattagatcttattctttgtttatgtgattctttaaattatgttattgatttaaaaaatgtaaaacaagcatttgaaaatacgtataatgctttaaaaaaaggtggatcatttatttttgatattgattctatgtataaaatggaaacaattttaaaagattatgatgaagaaaatgatgaagatgatttttattttcattggcatgttgatcgtatcagtaaaggatatgtaaaacatagtgtagaaattattgataaagtagaaaatgatcgagtttatgaagaacattatcaaaaaacgtatgatgttgagacctatattgaattattagaaaaaattggttttaaaaacattaagttatatagtgatttttctaaatacggtactgaatgtgaaagagttatatttgtatgtcaaaaggggtgattttatgataggtattattggagcaatggaagaagaagtaaaggctttgttagataaaacagaagatattcatgaaaataaaattttagattgtgttttttacgaaggaaaaatagataataaacaagtcgttatcttacaaggtggaataggaaaagtaaattctgctatttgtgtaacattattactcacaaattatgatattgaatatgttattaatattggttcagctggtggtttaaaggattatcaaaatgttggtgatgttgtaatttctagtcatgtatcatatcatgatgttgatttaacagcttttgggcgtcctatgggtgaattaccagaacttcctgtattcattcctgcagatgaaaatttggttaataaagcaaaagatattcttcataaaatgaatattcatgaaaatgttggattaattgtttctggagatcaatttattgctcaagaaggacaagtttctaaaataaaaaaagattttccaaatgcattatgttcagaaatggaagcttctgcagtaggacatacttgttataaatttggagttccttttattataacaagatctttatcagatgtttatggtcatggtgaatcttctatgcaatttgatgaatatttaaaaattgctagtgaaaattcggctaaattatgtgttgaattagtaaaagcctaaggagggttttcatgaaaaaaagagaagatatagaattattagctcctgcagggagctttgaagcattagtcgctgctgttcaaaatggcgctaatgctatttatttaggtggccaaaaatttggggcacgagcgtttgctcataattttgattatgctgcattaaaagaggctgtagattattgtcatttaagaaatgttaaattatatgttactgtaaatactctttataataatgcagaaatcgatgaaatttttgattatttaaaatatctttaccatattggtgtagatgctcttattattcaagatatggggcttttttctcttattaaaaatcattttcctgatatagagatacatatgtcaacacaagcaagtgttagaaatattgaaggagtcaaatattttgctaaacaaaatatagatcgtgttgtacttgcaagagaaatgaacattcgtgaaattgaagaaatatgtcataattgttcaattgatattgaagtgtttgttcatggtgcattatgcatgtcatattctggtcaatgtttaatgtcatcaatgattgctaaaagaagtggaaataaaggcgaatgtggtcaaccatgtagattgccgtattctttattagaagataataaaataatcaaaaaacaaaaatacttattatcaccaatggatctatgtacaattgaaaaagtacctaaacttattgatgcgggtattaaatcatttaaaatagaaggacgtatgaaaagacctgaatatgttggtgaagtcgtaaaagcatatcgtcaagctatagattattattttgaccaaaaaaattacacgcctaatattttacagatgaaaaaagtatttaatagaggatttacacagggatttctatttcaagattatcttaatctagcacaagatatacctggaaaccaaggcatcaaaattggtaaaatgattaattattctaaaaaaagaaaaatgctggatattaagttatcagataccctttatcaaaatgatcgtatttattttcctaaaaatgattttacacgtacaattactaaattatataaaaataatcgattagttaatactgcatatcaaggtgatcttgtttctattgaaatggatcagttattggattttcaagatatttataaggttgttgatgcaaaaattgttgaagaaaatagtaaatatataaaaaatgaacatattaaattaccaattcaaatgaaagtttttgggttaattggtttaccattacaattaacagtgatttataaaaataaaaaaattagtgttaaaagcgatcaatgcattgaaaaagcacaaaacgtacctttaacaaatgaaagaataaaagaacaattatctaaattaggaaatacaactttttatttagaaaaatgttcaatacgttttccaaatgatggaattatttccattaaagaattaaataatttaagaagagtggctattgatgaacttgaaaaagaaatgttagataagtcttttagaaagatgaatgatttagaacaatttaattgcctttctaaaaaaagagaagatcataagaaaatagcaattcaagtatctgatatttctcaacttgaacagcttgatttgcatggtgttgagcaagtatttgttcctttttaccaatatcaagcgcaatgcgataaatatataccttatgtgccatttttatatgatgaacaagattttattgaatttttaaatagtgtttattatcaaaagtgtcaatcaattcaagtgaatgattttggtgcattgaatcttgttagtgataaaaatatagtcttaggatatcatatgaatattacaaataataaagcaattcaaaaatttaatttaccatttgttgtttcttatgaagcatctaaaaatgatatacaatcttttaaaacaaatcaggacatttattttacagcttactcacaaattattaatatgaatttaaaacattgtattatttcaaatcattatttttctagaaaacaaaaaggatgttatttgtgcaaacaacatcaatattgtttaaaagatagaaaagaaatgaattttaaaatagtaacagatcaatactgtaataattatgttttacatacacatcgtttttactttgataaaatcaatgatctaaatgtggattatattttattgaattttttagatgaaacatctcaagaaattcaaataattgttaatgattatcttaatattacaaaacatttattatctaaaaataagaataattatgatatttttcaagggtattttacaaaataaaaaataatttttattaaatgttttttttaaaaaataataattaaaaaaatataattgaatgtctttaatgaaaatgctaaaatttttatatgggaggattattgtatggcgattgatactgaattagcaaaaagattacgttcatatcgtaattttaaacatttaacacaaaaagatgttgctgcgcatttaaatgttcctcattctgcaatttccgatatagaaaatggtaaaagagacattactgttagcgagttaaaagtgttttcaaatttatatggtagaagtgtagaagaaattatgagcgggaaaaaatatgactattataatattgccaatatcgctcgtttacttactgaacttcctgatgatgatttaaaagaaatcatgtttattattgaatataaaagaaaaagaaatgaagaacgtcatttgaaataatattatttttgacaagcaaaacgtttaaattcattcaaaatatcttgatctttatcaattaaagattggggtatttttttttgtgttcttgagtcaaaaaaatcaacatgaagtttatcatcaacagatacaatagcatagcttccacattgagattgccctctattaaacataatactaccaggattaataaatattttattcttatatatttcataatgtgggacatgtgtatgtccatgaaaacaaatatgaatatccgctttgttcatgtactcaactaaataatcatatcctgcataaacattaaatttatggccatgtgtaattaatatattgcctaatgctgttggcaatgttgtagttaaagggaaaaaaccttgatcatgatttccatctacaatagcagcaaattcttttataaatggagaattttcatcaaaacaactatctccacaatgtatttttagatcacattttacattttctaaaactttttttaattcatcatcatagccatggctatcgcttaccaaaagtatcttcataaaaaacctccattatatcaatataaattattatagtctaattttaataaaaaatctatttcaaatctattttctgaaatggaaaaaaaagagcggaaagggtttacatttaaagggataattgataaaatatatacaggttataaatgagaaggagtgttaaaaatgaaacaaattttattagtttgttcagctggtatgtctactagtttattagtaactaaaatggaaggtgctgctaaagatgctggatatgatgcaaaaattttcgcattaccattttctgatgcaccaagagttttagaagacgttgatgttatcttacttggcccacaagttagattccaaaaatctgctattgaaaaattagctgctggacgtaaaaaaggaccaattcctgttgaagtaattgatatgagagattatggaacaatgaatggtaaagctgtttttgaaatggctaaaaaattaattggtgattaatcacataaaatagtaaaaattggggttaaccctttaaaaaattagttaaggaaggtatttattattatgaaaaaaattatgttagtttgtgctgctggtatgtctactagtttattagtaactaaaatggaaaaagcagctgcagcaatgggtgatgaagttgaaatcttcgctttaccaatttctgaaggagaaaaacgtgttggtgatgtagattgtattttacttggcccacaagttagattccaaaaaaatactattgaaaaagctatggaagctgctggtgtaagcaaaccatgtgacgtaatcgatatgaaagattatggaatgatgaatggtgaagctgtttataaaaaagctaaagctatgatgggtgaataattcactagagacgactgtttaacagtcgttttttattttagtcttttttaattttttttcatatgctataatattccaaaagtataaggaggataattatggaaaagggtattattactgttgttgggaaggatcaagttggaattattgctaaagtttgtacttatttagctgataacaaacttaatattttagatatttctcaaactattattcaaggatatttcaatatgatgatgattattgaattacaaaatgcaacaaaagattttggtgctatttgtgatgaacttaatgaattaggaaatgaaataggtgttaatatcaagttacaacatgaaaatatttttaataaaatgcatcgaatttaaaggagattagaatgattaacttatttgaagttgcagaaacaaataaaatgattgaacaagaaaatttagatgtacgtacaattactatagggatcagtttattagattgtatggatcatgatattgatgttttatgcaaaaatatatataacaaaataacaactgtagcaaaagatttagttaaaacgggtgaagaaattgaaaagaaatatggtattccaattgttaataaacgtatttctgttacacctattggttttgtaggttctaatgcatgtaaatcaacaaaggattttgttaaaattgctaagactttagatcgatgtgctgccgaacttaaagttaattttattgggggatatagcgctgttgtttctaaaggaatgacacctgctgaaagacttttaatagaatctattccagaagcaatgaaagtaacaaacaatgtttgtagttcagtaaatgttggttctactaaaactggaattaatatggatgctgttaaattaatgggtgaaattattaaagaaactgctgatttaacaaaagaaaatgactcaattggatgtgctaaacttgttgttttatgtaatgcacctgatgataacccatttatggctggagcatttcatggtgtaagtgaagctgattgtattattaatgttggtgtaagtggtccaggagttgtgaaaaacgcaatagaaaaatgtaaaggtgaagattttggcaaattatgcgaaacaatcaaaaaaactgcttttaaaattactcgtgtgggtcaacttgttgctcaagaagcttcaaaaatgttaaatatcccatttggaattattgacttatctcttgcacctacaccagctgttggtgatagtattgctgattgcttagaaggtatgggattaaagagtgtaggggcacctggaactactgcagcattagcaatacttaatgatcaagtaaaaaaaggaggcgtaatggcatcatcttatgttgggggactaagtggtgcatttattcctgtaagtgaagatcaaggaatgattaatgcggtagaaaatggagcattaacacttgaaaaattagaagcaatgacatgtgtatgtagtgtcggattagatatgattgctattcctggtaaaacatcatcagctactatttctggtattattgctgatgaaatggctattggtatgatcaatcaaaaaacaacagctgtaagaatcattccagtaagtggaaaagatgtaggtgaaacggttgaatttggaggattattaggttatgctcctattatgcctgttaatgaatttgattgttcagaatttataaatcgtggtggaagaataccagcaccaattcatagttttaaaaattagaggaaactctaattttttaatatataaaaaatattgacgataataaatttgcattatacaatatttacgtcacgggggtattatatggattatatggatagagaattacacgaagaatgtggtgtttttgggataattggtcatcaagatgcatcacaaatatgttattatggattacatagcttacaacatagaggtcaagaagctgctggtatctgttgtgaaaacaatggtaaaatgatttttcataaaggcgaaggacttgttacagaagtatttaaccaagataaattaaaagagttacaaggtaattcagctattggacatgttagatattctactgctggtggaggtggaattgctaatgttcaaccatttgtatttagaactatgcaaggatctatgagtatatgtcacaatggaaacttagttaatgcaaatattctaaaacaagaattagaagaacaaggaagcattttctcctcaacttctgatactgaagtattagggcatcttattaaaagacaaagtggacatatgattgatagaatatgtacttctttagataaattagatggtgcatttgcatttttaatcatggttgataatagaatttatgctgcaagggacaaatatggattacgacctttatcaattggaattttaccaaatggtgcttatgtgtttgcatcagaaacatgcgcattagatgtcgttggagcaaaatttgtaagagatgttgaaccaggtgaaattgttagggtaaaagatggaaaattattaagtaagatttatacaaaagatccattacaagataaaatatgtgctatggagtatatttatttttcaagacctgatagtaatttagatggtataaacgttcatacaacaagaaaattagcaggtaagcaattatattatgaaaatcctatcgatgcagacgttgttattggtgttccagattcatcgatttcagcagcaattggatattcagaagcatcaggaattccttatgaaatgggattggtaaaaaataaatatgtgggtagaacatttatacaaccaactcaagaaatgagagaacaaggtgtacgaatgaagctgtctgcagtatcggcaattgtcagtggaaaaaaagtagttatgattgatgattcaattgtacgaggaacaacttcgaaaagaatcgtaagacatttaaaagatgctggtgcaacagaagtacatgttagaattgcttctccagctattaaatttccatgtttttatggtgtagatacatctacaatagaagaattaatttctaataaaatgaatgttgaagaattatgtaaatatattgaagcggatagccttgcgtttattagtgaagaaggattaaaaaaatctattcatttttcaaaagaacatacatgtgggttatgtatgtcgtgctttaatggaaattatgtaactaatctatatgattcatttgataaagcaaataaatttgaaaaataatttattttgatattattcaacaattattgatcatatttattgaaatatttcaatttttactgtatcctttaaatgttggtagtagaatcatcttaaaattaaagatatcctaaaagagcaatatttatttttaatattgctttttattttaacaacattatatacaaataaataaaatatatttgcactcgttgaaataattttttatattactataatacttgttgttttactgcttagcattctagatgttaaaaatagaaatcatttagtataagattaaaatgcacgaattgaagttgttaatttacaaattattttgtatgaaatcgaacagggtaagttatttatgaaaataaatttaatagttttttgttataaatgataatatttgaaatcaaattacaaaatttgatttcaagtagattaaattgcttaaaaaatataaacttattatagtagataaaagataaaggagaatttcaaatgaaaaaaatcatgttagtttgttcggctggaatgtcgacaagtttattagtaacaaaaatggaacaagcagcagaaaaagcaggagatgaagtagaaatctttgctcttccaatgtctgatggaattaacagactttcaactgtggattgtgttttgcttggcccacaagttagattcaatttaggaaaaattaaagaagaagctgccaaagtcaatccaggacttccagtagatgttattgatatgaaagattatggaatgatgaatggtgaaaaagtatacaattatgctaaaaaactaatggatgaataaattttaataaaaagacttttataatttttaagatctattatttatagaaggaaaataatttgcatcttgcatttattttccttttaaattttaactattttcccaggaggcatcgaaacagaagttatgaatagccaaaaaaatattaggtaatttggtatgggaagaattaaggctataattaatgtaaaaataagctataaaataaggtggcatttagccacctaaagagttatttttatatacacagtacttcgcataatgtatattatataacttttataatatataaatagttttttattattttaactatttatatacttgtattatataataataaaatatgtgcataacatgataagtattacggaaataaacataacaaatatgaatataggtttattattacttttaagatttttatataaagctagaaatgaaacgataaataataatatagatataagataaaatgaatataaaataatattactgtgcatttgaattgcaaatataaataataaaactcctaataaatccgcaaataatgaataaagaaggatttttctattttccatttttctatccctattttaataattctaatatagatgaacctataccgttatatttaacattgaagttatcgcaaattgtagaaccgataattccaaaagaattactatcatttaatactttcatttcattaaattgttttgaataaattataagtggtacttgttcacgtgtatgatctgttcctctatatgttggatcatttccatgatcagcagtaaccattaataaatcatcattttttaattcgtttattaattctcctaattgtacatcgaattcttcaattgcttttccataaccagcagcgtttcttctatgcccatagaccgcatcgaaatcaactaagttaataaacgctaaaccattaaaattgtcacttgctaattcaatagttttattcataccatcttcattacttactgttttaatttttcttgtaatcccttgatcaacaaatatatctggtattttccctacacctataacatctaatcccgcatcttttaaagaatcaagcgcagttttagaaaatggggctaatgcataatcatgtctattagatgtacgagtaaaatgtcctttttttgttcctatatatggtctagcgataactctaccaaccttccatttatcatccatagctatttctctagcaatttgacatgcatgatataattcttctaatgggataatatcttcatttgcagcaatttgaaaaacagaatcggcagaagtatagactatccaatcccccgttttgatttgatgttctccatacatatctagaatttttgtaccactacatgcaatatttcctacacattttctaccagtttttttctcaaataggtcaataaattctttaggaaaaccggtatctgtaaatgtaataaaaggtttttctgttttaagccccatcatttcccaatgtccagtcattgtatccttaccattcgatgcttcatttaattttaaaatataagcttgtggattttgtgttttggtaacacctttaaaatcacctaaattaccaaatcctaaattttgcaatgttggtatatttaaaccatcacatattgaacaaatatgaccaacggtatttgctccaaaatcattatatttttttgcgtcttttgcatttccaattcccattgaatcacaaacaatgagaaaaattctattaaatttcatgaatactatctcctttttttatttttgctcttaaatgatatttattataatcatcaataattttattatttgaaacatgagtataaatagtggttgttgaaatatcactatgccctagtaattcttgaatagaacgtaaatcagcaccattttcatacaagtgagttgcaaatgtatgtcgaatagtatggggcgacactttctttttgatatttgtatttatacatgcttcttttaggattttataaaaatactcactagatattttatttaaatgattattaaaaaacaagtaatcattatctttaaaatctaatttaggatatctaaaatcataaatataacatgataaaattttacatacatagtcatttaaaggcaaaagcctttctttatccccttttccaattacatttaaatatttcatttttaaattaagttgtgataattttaaattacacaattcagaaactcttatacctgtcgcatataatagctctagcatagctctcgttctagcatttttaaaattatccatttcaatactatcaagtaatgtttttatttcttccacatttaaaacctgtggaagtcttttcgtattttttggtaaatcaaaagtctccataagatttttttcaacaatttcttctttcatcaaaaatttataaaatgagcgtagtgaaaccatttttcgtgataaagaagatgctgctaaagatgtaaattgttgtaaatattttctgattatatctttatcaatttgattgattaaaacaacttgattttgtttttgaatatagtttataaaatgttcaagatctcgcatataattttttaatgtattatctgatacctttttttctattaataaatattgtttatattcgttaagtgcatcatatatgttcatattaccaccatatttattatatcacgaatgattattgaagaacaattttatataaggtaaatttttaacagtgcagatatgaatattaaaaaacatataataattaagtaatttaaaatataattaaataaatattttaaactgaagttatctttttgtatgaaagttaatttgaaactttgtatagaaagataagttgacataaaagacatcacatacgtaattaaaatttcaataatcatttgaggtaatacaataataaaaatattatgaaacgaaagaagtgattgataatatttaaaaataaaagaaataatacataaaattctataaatgattccaattgatataacgggagcaccaataaaacttgttgctgaaaccatgatgattattatgtacaaaaacgtacataatagatacgaatttagttgatgtgttttaaagaatatgagatcaaccgaaattttataaagagaatatttatttaatgaaaaaaatataattgaaataattgttgaataaagaaaatttaagaataaatattgatgcaaatacatatttttcttttgaataaaaaaagacatcatatctcctcctatagcataggatatgatgtcttcttttttttatgattattcttttctgtacttattttttgatttatttaataaagcagaagccgttgtcaaatgatatttattctcactattaattttattgattacagcctctgttgtttttattttatttttctcaatatttttgtcaaatagacttacttgttttttataactgcttcgattgataacattatttaacgaaactccaataagtctaagaggttttccactataatttttatcaaataagtattttgcagtagaaagtattatctcatattcattgatataatcaattaaaggagtttgtcgagtaactgactcaaatcgagaatacttaatcgtaatactgatcgaattgccaatcaaatttcttttttttgctctaaatgaaactttagaacataatatacgtaaagtttcataaatagtctctatatcatttgtatcgtattgtaaggttgttgaattacctacagattttaattcgtttttttcagtattaactttagaaatatctattccattggcttttctatataatagaagtgcatttttcccaataatctgacgtaatttattatagttatcataattagctacatctccaatagttaaaatacccatttctttgagtttaggtgcagtttttttaccgattccaaacatttcagaaacatcaaggggccaaagtaattgtttataattagatttatttaaaatggtaatacccattggttttttcatatcactagccattttagccataaatttattaggagcaattccaatagaacattttaattttaatgtatttaaaacatcattttgaatgatttttgcaagtttgtaaggatgaatattatgttcgataatgtaattagaaaaatcaacataacattcatcaatacttgctatttctaacaaaggactatatgttgaaatcaattcaaaaaattgacttgataaacgtctatataaatcaaaatttacgggttttatgattaaatttttacataattgtttagcttgaaataatggcattgcagaatggattccatattttcttgcttcatatgaagcagtagaaacaatcgcacgcctattatttccagatattactaaaggttttccttccaaagaagaatcatttgccatttcagcacttgcataaaatgcatttaaatctatatgaaatataatttgcatatagcagctcactcccttagcaacattgtaacatattttaattataaatagtgccctttatttgctaatgctgttttatgtgctaatctcaatttatcggcaatcattgcaataaattcagaatttgttggtttagatttggaagcagatactgtgtatccaaagatatcatcaatggcctcagtatttcctctattccatgcaacttcgattgcatgtcggatagctctttctactcttgaagaagttgtattataatttcttgcaatttctggatatagtactttcgttacttgacctaaaatatcaatattatcatatgttttcataattgctgttcttaaatacatatatccttttatatgagcaggaatacccacttcatgtaaaatttctgtgatttcattttcgattttaactttttgaattttttcagtttcattaacatgagtctcattgatttttatctcatctgaaaaaacacgtttaataacatccataaaataattaaaatcaaaaggaattttaaaacaatagcttacatttaatttttctagtgcattacttatcaatggactagtaaaacttgtaatacatacaactttttgataagcatttttgttgacttcattcactttctctaatactccgacaccatcaatatcagtgagcatcagatcaataactaataaatcacaattgtttgttttaaaaaaagtaattgcatcgcctgcactattagcagtacctacaatttgataattggaaaatttttcaaattgttgtgctataccttctaacagttcatgattttccacaataataaagattttctttttttccataattacctcccatccactaccaacaaccatattatataaagtattctaatttatgtttagattttagataaaaaataacataaatttataaatttaataactaatatttagcatttttaaaaatatatctacatttttcttgaatattttttattatttgtcgaattttagaaaaataagaaataaaaattattacatgttttgttaaaaataagataaaattagtattatttttttataaaagccatgtcaaaaacatggcttttattcattatctatcatccattgtatatacatgccatacccttccaatatttctgatttacttgcatgtgtaacacaacctattaatttgttattttgaatgatcggagaaccactcataccttgaataataccatgacattgttctatgattttttgatctgtaacaataaattttattcctttttccataggtttatcttgttttaatagattagtaatttttatcttacatttttctacattattttcatttaaaaccgtaagaaaataggcgtctcctaatttaacttcatctatggtagcagttttataaacatttttatttggaagattattaattttcccataaacgccaaaattattatttttttctatctcacctatagattgattatcaatattaccaattttttgacctatattgtatgactcggttttctttataccttttatggaagcagaatacagtgaaccatcacttatatcaagatcatcatcaaccatattgtgccctaaacaagcaaattttcctgtatttaattgataataggtaacagttcctattcctttagcacaatcttttacatataaccctgtactaaattcagcattatttttataaattttcatagttttatgataaatattcgatgccctttttattgtgaattctaaattacttgtattgcaattttttataatatttgttaaatcatcaattgttttaacatttttcttatcaacactggtaataatatcattaatttcaaaataattagatggatcaataatttcattgtcaacttttattttatagaaaccagtaatgcaaacaccatcataatttaatattattccaacagattctcctccaattaaaacatcaattgcattaataggtactatcattaatataatagatagacaacaggtatagaaggatattttaagctttttaaaaagcatagatacctcctgtagctttttttgctacaacatattttggtatctatgctctaattttatacacttatttctttcaatttttttgcatggtctatagattgttgtgtaatttctttaccagaaatcattttggccaattcataaacactttctttttcattaagcaatcttacatgtactttacttgtattatccatttgctctttttcaataaacaaatggttattagcaaaacatgcgacttgagctaaatgtgtaatacaaataacttgttgtttttttgagatttttttcataacgtgcccaatgctttcagcaactttaccgctgactcctgtatctgcttcatcaaagatgattgtaccgccatcttttgaattttgtgaaacagctttaattgctagcataatacgtgataattctccacccgaagcaattttttgaagtggttgaagtggttgaccactatttgttgaaacaacaattttaacattatctattccgttatcattaaaatcattaatttgaaaatcaaatttaaattgaacttgttgaagatacatttgatttaaaatatattttacttctttttctaattctaatgctttattttttcttaaaatagaaatttttttagcatagtaaattaattgattctctgtttctttaagttttaaattgatattttcaatcatttgatctctatttttgaataattttattttttctattaaactatttttaaaatcaataatagcatcaattgtttggccatatttacgtttaagcttgtttaatttgaaaaaggtatcttgcacttcattataacgttcttcactaaagtatgattgagaaaattgatcataaatatcttgatttataccatctactgtataataaagatcatatagttgatcataattgtgcttaatatcatcaatttcgagatatgaaagttcgtttaaactttgtttgaagagatccattattccttttgaagaatccattaatgctttatagtttttaatatgttgagaatttttttcataatttaatagattatttctctcttttaaaaactcttcttcatcaaaattttctaaatctaattcttctatttcttctaattgagctaaataaaaatctaattgttcatcagttaattcttcctttgttaaagaaaggtatttttgatttagatttttatacgtttgataaagagtaagatattctttttttaaatcaattaattcatttccaataaaattatctaatagctttaaatgataggattcattaaataattgatgtgtttcaaattgagaatgtatgtctacaatttgtgacattattttttttaataataattgactagaattacgataattaattttgattgctgatttaccatcgtgattaattttttttgaaataacaagatgctcatcaatgggaaaattattatccaataaaattttatctatttctttattagaagaaaaaacaccttcaataaatgcataatcagccccattttttacaaatgatggttgactacgttgacctatcaattgaccaatagcatcaatgataattgatttccctgcacctgtttctccagttaacactgtcattcctgattgaaagtctatttgaacttgatcaatgattgcaaaattttctatatataaactttctatcatagtatcacccatcctttaccctttaaaacaaatatgtgcttcatttacaacattttcaatatcaataggattatttactccaccaactttaaaatgagctaaaaactcaatattaccttctccaccggtaattggggaaaaagacaatgcttgtaagctcaaatgacattcatttgcatacgtaatgacattttcgataacctttaaatgtgttttagggtcttttacaattccctttttcccaacttcatcttttcctgcttcaaattgaggcttgatcaacgctacaatatcatcattttcatttaatatatctttaagagggataaaaatatgtttcaaagaaataaaagaaacatcaatcgttgcaatattaggtatcccattttcaaacaaatcacgggtagcatatctaaaattcgttttttctttaacaataactcgtggatcatttcttaatttccaaacaagttgattcgtacctacatctacagcataaacacattgtgcaccattttgaagagcacaatctgtaaatcctcctgttgaagaaccaatatcaaccataacacgattttgcattgaaatatcaaatatttttagtgctttttctaattttaaaccgcctctagaaacatagggcataaccgttccctttacaaaaagctccatatctacagggacttttgtaccaggtttatcaataatttcatgatcattatgaactattccagccataatagcacgttttgctttttcacgcgagtcaaagaatccttgttctactagtaatacatcaattctctttttttccattcattaattcctcacatttatttataacagtatctaaatcaattttttcatcatcatatatttcttgtacagatccttgctttgaataatgatctgcaagtgcaatatgttcaaaagttcttaaaatatgtttttcattacaataagtcaataatatcgaacctaatgatcctgtttttaaaatagtttcatatacaagaatcggtttattattttcagtaaatattttatgtaccatatcttcatctataggcttaataaatctcgcatttataattctaatatttaaatgtttacttttgattattgtttttatcttttcaacattatcaccataacaaattaaagtcattttatagtcatctttacaagattcaatagtccaggtacctaattctaattgattattataatcaacttttatatcatcaatacttcctctaggtattctaataaaataaggtttattaaaattatgaaatgctgtatttacaaattgacgaagttctctagcatctttaggagcaaaaagaacgatgttaggaataggtgataaaatacttacatcaaataccccatgatgcgttgggccatcttctcctacaatacctgcacgatcaatactgcaaagacatggtaaatccattctagcaatatcatgattaatttgatcataagctctttgtaaaaaagaagagtagacagaaataaaaggttttttttgagaaatagataaacctgctgtaaaagtaagagcatgctcttcagcaattcctacatcaaaacatctttctgggaatactttaaataaattattcattgcagatcctttaatcattgcaggagtaattgaaacaatatccttatcaattttcatccattgtaaaacctgatcagatataatttccgaccatgatttttttgaaggatttccagaagaaagcacacggccactttttacattaaatggtggagttccatgccatttaccttcttgatcattttcagcaaatgaataaccttttcctttttcagtaacaacatgtacaacgacactctttttattcttttgtgcaagttgcaatactcttatcaattcaacaatattatgtccatccaccggacctaaataatcaataccaaagtcttcaaaaatagtatcatttataaaacctctttttacaaagtctttaatatattttgtagctttataaacaccttctcctaatttcccatgttgtaaaatcgaacgatagtcatctttcattttattatatgtattagacatacgcacattatttagaaagttgttcataccaccaatgcttttagagattgacatttgattatcatttaaaattaaaattactttattattaattgaaccaagatgatttaaagcttctaaagattcgccgcctacaatagctccatcgcctactacaggaacaacgctaaaactttctttatttaagtctcttgtaattgccattgctacagctgccgaaagagctgtagaagaatgaccagcctcccaaacatcatgtttactttcacaacgtttttgaaagcctgataaaccattgaattttcttaaatgtgtaaaatcttttgcacgtcctgttaaaattttatgaacataacattgatgtcctacatcaaaaaatattttatcttcaggtgagttaaacacataatgcaaagcaatagttaattcaacaattcctaaattacttgataaatgtccacctgtttgagaaacagattcaataataaattggcgaatatcctttgctaagtcattcaattccttttctgttaattcttttaaaaaagaaggacctttaatttttgttaaatccatttatctcactcttttccataatttttcaataatttccaaaatcaatccatgatttagtgttaaagaatacacaagttgctgagcttcattaaatagcaaatcaacttctttttgagaattttcaattcctaaaagtgtaacataagtttctttatgatttgcttcgtcacttcctgtatttttacccaatgttttggcatcagatgtcacatctaaaatatcgtcttgaatttgaaatgctaagccaattttataacctatttgttttaaaatttctaaatcgtttggtgaggcaattaaagcccccatttgaaaggcacaagataataattttcctgttttataatggtgaattttatctaatgtttcttttgaaagctttttatcttcattttcaatatcatattcttgtcctaaaatcatcccatttataccacttgatgtatataaacaagaaacaagtgaaagttttaatgaatcatctagattggtttgtaaaatgatgtttactgcttcattaagaagaccatctcctgctaaaattgctgttgcttcaccaaattgtttatgacatgttggttttccacgtcttaaatcatcattgtccattccaggtaaatcatcatggatcaatgaataagtgtgtatcatttctaatgcacaagcaatatcaatatactttctataatcaagaccatatgctctaatcacttgtaaaacaattaatggtctaattcgctttccccctgcttttaaagaataatacatagcttccttaaccttactatcaggatattgagataaaatattttcaagtctttgattaatttcatttataacattattcattattttctacctctacatcaaaatcttctaattgaccatcaataagtattttagaaactttattttctacatttcctaatttttttgaacaatattgagaaagctgtacgccttcttgaaaaagttcaacactatcatctaaagatgtttcgttattttctaataaatcgacaatttcttctaatcgttttattgcctgttcgaatgtcattttttccatatacattactccttataaatcgttgctttaacgtaaccgtcttttaaatagatagaaacattatcttcattatttaaatcatctatacttgaaacatattgattttctttttttactaaagcatagcccctttctaacgtttgtaaaggacttaatgcatttaatttagaaatcaacatacttaagttatttcgattggctttaagtttgttatgaaaatttatttttaataaattttcacatgtttgaatcttttgttgataatgacttacaaatactttattttgagattgtaattgtaaattaagttttgtataaataaccatattattatttaaacgtttttccatgaaattagaaattttatcttgtaaataagaaacatattgtaagtgatcaccatatagtttttcaggatttttaaataaataaaagtgtgttaagcgatttattcttgtattcaatgtttcaattttatacttcatatttgattttaaaagaccatctaacattgataaatgcttatacatatcttctatattaggtgtggcttcaatagctgcgtaggtaggtgttaacgctcttaaatcacatacataatcacatattgtaaaatctgtttcatgccctattccacaaataataggtgtttttaattcaaaaattgttcttgctaatgcttcttcattaaaattccataaattctctaacgagccaccacctcgtgccaaaataatggtattaaagtgaagttcatctacgaatttcaaagttgaaataattttaaaatatgcgtctttcccctgtacaggtataggaaaaatgataactctacacacaggaaaacgtttttttaaagtacgcattacatccattaatgcagcactaggatatgctgataaaacagcaattttgctagggtaagaaggaatattttttttatatttttcatcaaacaaaccttcttgtagtaatgattttttcaaattctcaaattttaaaaataatgaacctagtccatcaggttcaatatttttaactattaattgattatatcctgtaactgcataaacagaaacagttgcttctattaaaactgaatcaccattttttacatcaaaatttaattgttcagcaaatcctttatacataatcgcactaatatgtgatttaccatcttttagtgtaaaatacaaatgaccagaactcatatttcttttaaaattagatatttcacccttgatgaagacatgctgtaattgcatatcaacatctatttttcgctttaaatagttatttaaagcagaaactgttatatattttttatccaatggcacctaaaactccattaataaatttataagcatcttcatcacagtatttttttgctaattcaactgcttgattaattgaaatttctttagaaacttcatttcgttcataaatagctacataaagaattgctttttccatcatagaaagacgatcaattgaccatgattttttcaaatttttttcaataagaggcacatattcatcaatacgttcaatcgtattgaaaacaatttctttacaaagttcaatttctctttcatccattcttggtttataacattcgtttaaataattcataatttcttcttctgttgaatttgttaaaagatattggtaaactgcaataacagctttttctctaattaatttttttcttactttttccatacacatttccttccaaaatatattcatattctatcatagtttcttacgaaattaaataaataaacacaataaaaaaggaattgctagacaatccctagaatttaattttattgacattaacattcactttaacatttctaaagccaatatatctatcaatagcatttacaacttcgttttgaatttcactaacaacttttccaacattaagcccataatcaatgacaatgtcaataccgatgattacttgattatgatcattgatttcaatatttacagaatttttcccaccatcaaaatcaatcccgtttattttactcacttcatgattagtaattgcttgaaaaacagataattcaatatattgttcacctaaattatttttcttttctactgtatagtattccataaaattactcctttatatctctataccttattttatctaaaaatcattgattattcaagttagaagtatcattagtcttctacaaatttaacttcaatgatatatccattatatttattatgaataagcttgatgattttattagcatctttcgaagttgcatcttttaattttacaactactttcatgtgtccaccatcaatctcacaaaaacattctttataccctttatcagttaataactgacagatatctttttcattttttataattgcttttgttttttcattagaagtaagtgctgttgaaatttctttttcagatgcttttgaagaggcaattaccgtattattgtcattaattttattttcatgatttttattaagttcactttgtaaaatttctattctgcttaatgatttttttgagactgtgtcatcttgatcaattggtggtactaataaataataaattgataaaacaagaatcaatgtaaataatgataaaaatgttatagcttgtttattcatgaacatcccctcattacctactatatgcaatcccgttttagaatatgaaaaaacactaggttttgtcctagtgctaagctctgcctgaatattttccttcagcagttgaaataacgaccatttctccttcattaataaataaagggactttgatttggaatccagtttctaaaacagcattttttgttgctccagttgctgtatctcctttaaccgcttgttctgcttcggtaatttgtaaagtaactttatcaggtaattgtacacctaatacttcaccttcaaaacttctaatcgttgctgtatcactttcttttaagaaattcttttcccattctaaattttcagctggaatttcaatttgttcatatgtttctccatccataaatacaaatgcatctcctgtattatacaagtattgcatttcttttttatcgatttgtgctctttttactttatcatttccaccgaatgtcatttcagtagtagatccagtacgtaagtttttcattttaactttaacatttgctgctgctctggcagttttattatgagaataatctaatactacaaataaatttccatccatttgaaaagtaacacctggttttaaatcactaacgttaatcataataatctcctttttaataatatccttgttgattgtaacaaaaaattattatgaatggaatagtttttttgtttttacaatcgatattcttactatttatattttttgaaaaaaatcaactttaaaaaaagaaatttaagaataaattgtctatataataataggaggatttttatggaggaactatttgaacagattatttatcaagctattaaaaaaaatgtaagtgatattcatttacaatgtacagagaaaggagtgattaaatttaggatttgtggggaactacttacttatgaaacctatgaaaaaacaaatattattcaattaatgaattatattcgtttcatttctaaaattgatttaaattattaccgtaaacctcaaacaggacattatgtgtatgttttaaataataaaaaatataacttaagaatttcctcacttattggaaaagatatggattccattgttattcgtatcctaaataatcatcaaaaattatcattagaaaatattagtaaagatattcatgtttatcaatttttaaaacagattgtccaaaaggatagcggattatttgtaataagtggtgcaactggctctgggaaatctacaacattatatgctattttagatacaattaataagatgtataaaaaaaatattattacactagaggatcctattgaaatcaataaagattattgtttgcaaattgaaattgatgacagaaaaggtatcagctatcatgaatcgttaaaacaaatattaagacatgacccagatgtcataatggtcggtgaagtacgtgatgaaaagacagctcaattagcacttacatgtgctttaactggacatcttgtactaacaactattcatgcaagtaattgtataaatacgattaaaagattagaaaacttaaacatttcatctcttgatttagaagacgttcttcttggtatcatgacacaaaaaatgcgttttaacgataaaaaagaagtatttattttaagtgaatacattgatcaaaaaaatttgttaaaatattttgatcgaaagaaaatagattactatgatttttcaaaagctgcatgcacattaaaaaatgtaggtgttttaaatgaaaaataaattacttagttttattgatctacttatttttttctttaatcaaggatattcattacaagaaacgcttgatttttgcagtttgcttaactatgaaaaagaagtaaaggaaataaagaactatttaaatcaaggtctttctcttgacgaaatttttataatgcttccctttcctactctatttaaagaatattattcattttttaaaaatgaattcacattagaaactgcattaaaaaagtcaattgaaatttgcaaaaaaagagatgagtataaaaatatttttttaaaaaaattggcatatccaattatattgcttattttcttatttgttttttctatttttactgttttttacttattaccgcaggttgaaattttatttaacgattttgatattcaaaaatcatttattattcaatgtctatttgtattattacatgcaattcctatttttttaacactaattactataataaatattattttaatgatatttatctatcaaagcattgcaaaacaaaaattcaatcagatagattttttgattaatcacacacattttattaaaaaattgatttgtaagtattattcgttaaagtttgcaatttattataatgaattactcatacagcactatgatacaacatccattattgaaactttatatgataaaataactgatagtgatattaaaatgattgtttatgaactttatcgtttaattgtaaatggtcatgattttaatttagcagttaatgattttccttacttttcagatgattttaaaaaatttatatctattattcaaaatagtcatgaaaaccaaagtttagaaaattatatccaacttacatttatgcaattaaaccaatttgtttctaaatttataaaaatcatagttccattgatttatggttttgttgctacatttgtaattgttgtgtatgtttcaataataattcctatgatgaatgttgtctcaaatttataaaaaggaggattataaggattatgaattctaataaaaaaggttttacactcattgaaatgattttttgtatttctgtaatactagttattttactgcttgttattccaaatgttacaagtaaaaatcgtttagtaaaagaaaaaagttgtgatgcgcaaattgaagttgttaactcacaaatcattttgtacgaaatcgagcatggagaattaccaactagtatgtctcaattaacttctggcagccatccttatttaaaggaaaaacaagctgtttgtccttcaggacttgccataagaataagtgatggtgaagcctatgtttcaaaataaaggatttactttgattgaaatgttgttagtaatatctattatattaacattgtcagtactttcattcccttttatgaatacaaaaacaatttatataacggatgaatgtgtaaaaaaacaaataggaatgattattaatcaggctaaaagtaaggcaataattagtcatgaaaaagttagtttaattgtatcaaaacaagaaatatcttttattgatcatcaaaaaaaatacagagtagttttacctaataattattttttcaataatattaaagaaatatatttcaataaagatggcaatataaatcaagcaaatcatattggtctcattgcacccaaaaagaaatatacccttatttttcatcttggagctggtgattatgagtttaaataaaaaaggttttactttgattgaaagtctttttgcttttagtatctttactactgttattattctattagtgtctttatatgtaacaaattcaaaaacaaacatcaaagtcaatcaagaatacgaaacttatcagtcaaagaaacaacaaatagaatatacacttaatttagatgaaggaatagagacatgtctaaaaaaggctttacattagtagaagtattattgagtttatctatcacattacttattgttttaaactgttcattactagtgaaagttttaaaaatttctaatcaatcaaaatatatcgatacatcgctagaaaatgcaatattttcacttagtaatgaacttataacggctaaaaatatagaatatggtgatagtttaagttttctcgatgaaaatgatgattctcataaaataatactacaaaataaacgactcgttattacacctggacatcatattttatatcatgacattgattctgtatattttgaaaatacgaatggatttatcaaaataaatttaatgagtaataataaagaatatcaatttattgtaggtagtgattatgaaaaaaaagaagaataacggaaatgttctacaaatcacccttattttattgctcatgctttctcttaatatattttcattatgtcatttgacaattctaaatagtcaaggttttcaatctatgaaacaaacgaatgatataagactacttaaaaatatacttattgcaaattataaatacgaaaatcaaaatagtattttattaagtaattatttagcacttgaaaattacacaatttcgtatactgttgatgatatgggagattattttttaatagaaacaagattaaaaaatgatcgatataaactcaatatcacattttatcttgaattggataaagaaaaaaatgttataaaaaaagtagaataaattgttattctactgaagatatggattatttaatttttcttgtattaaagttgtcaattcaccgtgtccaggatatatttcataatcatcttttatttctttgattttttttatactatttcttgtgtctgttgaagatgatgttggaaaatcaaatctaccaattccatttttaaacaaaacatctcctgaaaaaataacatggtaattttttaagatgataaagcatgaaccaattgtatgtcctggcaaatgtaaaaattcaaaatgaaagtcaccaatatctatattcttatcaacagctgttactttagatttaatttttaattcaccgtaatagttagataaatttaattgatcattgtaaatcatttcataatcatcttgatgaatataaacagggcaattatatttttctactaattcatctatagctccaatatgatcaaagtgaccatgtgttaataagatagcagttaattgtaaattattttgtgttaaataatttataagtagctcagccttatcccctggatcaattagaatcgaatgattattattttctatcaaataacaatttgttgacattattccaagtacaaattttttaataattaatctttccataaaatattctccaataaaaaaataagcctaagcttattttttttctttgtgtacagtttttttattgcatctagggcaatatttatttacttccattctatctggatgatttcttttatttttagtgttgatataattttcttctccacattctgtacattttaaaatgatattatctctcatgattacacctccgcatcactaaaactttcttaaatataataacatattaattaatgaaatactagcatttttttaatttaaaccatatttttctacatatttatcaacaacttgatgtgcaataattggtgcagatgaatcagcacccgatgaagaacgatcttctctaaatgcaatactagcaaatgcaactaatggtttactatcttctgttgctgaaatataaccaatttgtagatggtttgggtggtcaacatttgaattaccatcatatttttcagctgttcctgtcttacaataaacagcatatggcttttctgaccaatacgtatgtgatgttccatctgttcttgtaacacatgcgcgcattccagcttttatttgtttaaatgcatctgcctgtgaagaaacatcatcttgaatatttgttttaaatttatatgttgtatatctatttccttctccatcacttttaaatgattcaataaggaaatgaggttgaacttttttacccatattagcaagggtacatgtatattgtgccaattgaattggagtatatgtgtcatattgtccgatacatgcatctaataaatgcccaggggcagtatctcttcctttatatccgtcactttcatttggaacatccaatccagttttaacacctaaacctaattcaccaaaatcccttctgatagtagagagcgttttgacaaaacgattgagatcaacatttaaagcgccatgaggtacatattcaacaccagctaacttcatagcaattctaaacatataaacatttgatgaccaagcaagcgcatctatttcattaatatttcccattgttttccatgatttttttgcttttgtagaacctttaaaccaaagcggctcatctacaaaataagtattaggaacaatgatattttctttaaatcctgtatataatgtacccgcttttgaagtagaaccaatttctaccgcttctaaaaagttacctgtagaaatatctttgacctcaccagtttctttgttaatttctttagctgacataactaaaatttctccattattaggattcatcattacaaaatacattttattgaaataagtattaaagctattacatgtcgttaattcattagtaataagttcatcagcaaaagattgtaactctaaatcaatagataagcgaatgttatctcctttttcaccattaacattatttgtgataataggatcaccattactattatatttaacagaatatgatgaatttgatgcttttaaaatatcttcatattgtttttctaaaccacttgtaccgactcgtgaattaccagtatacccttttgcaagtaattctgtttttaattccgtgggcaatccttgtcttttagttgttaattttccaaccaacgcgccaagttgaccatccaccattgattgacgagaccacccactacttatttgaataccttttaaaatatttgtattttctcctataacactagcttcttcgactgtaatcccttctactaaagttacagaacctgttttacatcgtttcattaaatattcaaaacgtgtttgttctatttcatcctgtgtcatattttgatatatatattccatagataatttagaaacaatcaaattggtttttgccttagaataatcagcatcatcaggattttctatttttaatttttttaactctttgtcacttaacaaagattctgctaatctttcatgagcaataataaaataatcttttatatttctttcagtaatgttattaacgttatttttagaaaagtcaattgtaattttttcacttaaaaattttgcaatatacgtaatttctttatctgtaattttcttaggtgcataataatcaacacaaataacattttgattacccatgatttttgtataattacgatcatagatttctccacgcggtgcatcatttgtatatgttgtacttccataagtttccagtttaacttctaatgtatcagcttgagttaattgtacataagccaatctaacaattaaaataaaaattaaaacaagtgtcacagcaattaattcaattaatcttttagatacaattatatcagatttactattttgatatttcttttcttcattaaatccatgaaatcttacagtagcagtttttttgttaaaaaactttggcatatttttcctccttccttgaacaattatattatactttagattattagtaaatttgaattaatcgataatataaatttatttaacatatttaacatatttaaaatagcagcgattgctgctatttactcatcatcaactgataatattgccatgaaagcttcttgtggaatttcaacacttccaactgccttcattctctttttaccttccttttgtttttctagaagtttctttttacgcgaaatatctccaccataacatttagcaaggacgtttttacgcattgccttaattgtagttcttgcaatgatcttaccttgtaatgctgcttgtacaggaacttcaaacatttgttttggaatgatttcttttaatttttcacaaattacttttcctcttgaataagcaaaatctttatgaacaatagatgataaagcatctacaacatcaccatttaataaaatatccattttttgtaatttactttctcgatatcctattaattcataatcaaatgaggcgtatccctttgtactagatttcaatttatcaaagaaatcataaacaatttctgataaaggaatattataaataatattacgacgtgtttcatcaatataatctatatcaacatattctcctcgttttgattgacatagttccatgatagatccaatatactcatttggagtcataattgaagcttttacataaggttcttcaatataatttattacttgtggagatggcatcattgcaggattgtcaatttcaaccattgttttatctgttaaaaatactttataaataacagatggtgcagtagcaataagttctaaatcaaactctctttctaatctctcttgaataacatccatgtgtaataatcctaaaaaaccgcatctaaaaccaaatcctaatgcttgcgatgtttctggttcaaagacaagagacgaatcactaagttgtattttttccaatgcttctcgtaaatttttatacttagaattatcaactggatataatccacaataaaccataggatttaactttctataccctggcaattgctcatgactttcattttctaaagttgttattgtatcccctacatgaacattttgaatagatttaatagaagctgatatccatccaacttccccacaaactaatttatcttttttaacttccgcaggagttcttacacctaattcagttacttcgtaagtagctcctgtagccataaatttaattgtatctccaacctttatagatccttctttaattctaacgaatacaacaacacctctatagctatcataaaatgaatcaaaaataagtgcttgagtaggatggttaatattcccacttggtgcaggaacctctttaacaatcatctctaacacatcttcaacgtttaagccacttttagccgagatacgaggtgcatggtctgcaggtaatccaataacatcttcgatttcttgaataacatgttcagggtttgcactaggtaaatctaccttatttataactggtaaaatttccaaatcattatctaaagccaaatagacatttgccaatgtttgtgcttccacaccttgtgctgcatctacaactaacactgctccttcacatgcagctaatgaacgagatacttcataagtaaaatcgacatggccaggagtatcaataaggtgtaaaagataggtatttccatcttttgctttgtattgaagttgaacagcatttaatttgattgtaatgcctctttcacgttctaactccatgctgtctaatagttgagccttcatctctctatttgaaaccgcaccggtcatttctaaaatacgatccgctaaagtacttttcccatgatcaatatgcgctatgattgaaaaatttcttattttatcttgattaattgtcatttattttcaccgactttcaataatagattttatcaaaaaacaatataaatgacaatttatttatttaaaaatatttgtttaaaatttcaatgagttctccatatataatcacttctttaaaatcataattaaccattgtaaatttattagctattaaacgccctctaacagcaatgatcattccaatttgagcaacatcagacatcatgtcttctagtcccttccacaaagcaatagaaaaaacatcaaatttttcttttcctatctcctcaggaaatggtcttttaacctcaatgtcaataaaagccatattttcaacatgatatacattttttactatttttcctactaaagaaattgaatttaacataaacagtcctccttagtattatcatagttcttataaaaaaataatcatgctaaatcgactaaaaggtctatttaaacgactaaaaaataaataaaaaacattaatatttatatcctaaaatatatttattaatgttttattactctatactttattgattagggtcattattttcaataacaacaaaggcaactgcataatgattttcatgagaaatagaaacatgacaaggctcatctttaatatagggtttaccatttttatcatttaaacagcatatctccttaaatgatttataacctgctgcttttacaaatgcctctttgactgcaaatctaccgcccacaaattctctttttgctttatcgttaccttttgataaatacaaagaaaattcatctacatgtaaaattttctttgcaagttgatccaaatgatttaatcttcttaaatcacaaatatctacaccaattcctttaatcatcactaatccttaaatttcttttcatacagactcatcaattcatctaaagacatattgtcatcaatttcatcaattaaagaattttgttcctctgattttttttgaccaaaatcaagtttaaactcccctgttcgttcctcaataattttaagttgatcttgttcttcttcaacaattttagcaatatttcttaaattatcttcaactgttggaagcttttcttcttcaacgatttcgggttctattgttttttcagcatcagtatttgtttcatcttgaaaatcttttgaatcttcaacagcagtaagaacagcttcactatctgtttcttctttttcttcaaaattaccataatacggagatattacttgaacaagtgaattatcttttttctttggtttttttactgaatttttcttaactattctaactgtttcttttttttcttcatgcattccaaacattggagaaatgatatccatcatttcataatttttcttaacttcgggttcttctttctttgctacttttttttcaacctttttaacatttttggaagtagtttcttttggtatttgttgaccttcactttttttagtaacttcttcttttttaaattcttcgtcataaataagtggtttagaaaacttttcatttcttctttgttcaacaattgggtctacagtttcaaaaatatcatcatcgtttgattttttaaaaaaatgtttaaacataataactccttccttcaatacactttattttattgattgtataaatgtttctatttcttcttgcgtttttcttaatttacttacaaagcgacctgtctcttgtccattttcatagctgacaaaagaaggtattcctaaaatatctaaatcttgacataaatcaataaaatgatctctattaatactataaaatgtaaaatttggatatttttttacaacattacctataaaaggtttgacaaacatacaatcaggacaccaagaagctgtaaataagatgattgattttgtttgaatagccttttcatattcttctaatgagtttatttcaattaattgatccatttttttactccttacaatcactaattatcattttataaataggtccatttactgaaaattttctttcatattctgtcataatattatcatttgcttctggagaattatgtaaatctaaagaaacataatctaaatgataattgttttctgttactgactgtaatgaatattcaaataaacctcgattatctgttttaaattcaataacaccatcttttttcaataatcgacgataaacatctaaaaacgctgaagacgttaaacgtctttttgcatgtcttttttttggccaaggatcactaaagtttaaaaataaatgatcaatttcaccattttcaaaaacattttctaattcaattgcatcaaaatgcatcaattttaaattaggcaatggttgatttttattaattttattaattgctgctgctaagacacttggaaatttttcaatccctatgtaattgttttctggatgttttaaagcattttgataaataaaatcgcctttccccattccaatttctatatataatggctgatttatttcaaatatatcatgataatgacctttatgttcttcaggttttaagataactaaatcagcattctcttccataatttcataagcttttgggttgtttcttaatctcacaaaaaatcctccttattttttatacaaatagtatcacaaatcattcattaagtcgactaattcatcttcggataattctctaaattttccaatttgtaaagaagtatctaattttaaattcttcatctgtaacctttttaaataagttacttttttaccgacgctttctaccatttttttcacttgatgaaactttccttcaaaaatttcaattaatacttcagatgtattatcttcagtttttataatggataaatttgaactttgacatctataatgatcaatagtaattccttctttaaactttaaaatatcattttcatccattattccttcgacacatgcatagtacaatttagaatgatgtcgactaggtgctaataacttatgtgcaaaatctccatcatttgttagtaataataaaccctccgtatccaaatctaaccttcctactggaaataaatcatactgttcatacccataaatcaaatcaacaactgtaggatgaacattatcttttgtagcagaaacataaccagcaggtttattaagcataatatagacatatggtttatatgtaataagctcaccatcaaagataattttatctgtttcataatctactttaaaatcatccttttttataatacttccattaacagtaacaaaaccttttctaatataattttttacttcttttctagttccaataccataatgagctaataatttatcaagtcgcattaccatgtaaaataatatacctttctatttgtttatcctctgtgttatatgttaaatagagcttaacatcaaatttattttttgatgttgttcctgataaattgatgcctttataataaccattcttcttatcaatataattaggctttaatgaaaaagtatccttttctaataaaccaatactcggaatatttttatcctttttatcaataaatgcgattgctttaatatttttcatttcaataacaggattattaatgataatatcataccgtatttttttatttgatattttattagtaattaattgaattgaacaatcatcacagctttcatcaaatgaagtagacatctttaaacgattataataactaacatattcattatattgtttttttgaataagatgttgtatttttttgacttgaacaacctaataaaataaataaagataaaaaaataattaatctatttttcatataatcaccttttatattataacatagagacaataaaaaaaaattaaaataggaaataatcctattttaatttaaaagttccgcactctgtttcttgctcatcacatggtgaactacaattacattttgaaactttaatctcattggctaaacatttattattagaatcatgatatgcacatgtcgtaactgaacatcttacatcttttgccatatgtttcacctccgttaattattttgaccaataatataaaatctatgcaaaaataaaagtccttttatttaggacctttatcatcatattcaattaaacaactaaaagagtattctaattcagatgaaaaacacattgcaacacaataatgcatctgtattatatgatatcccagtttaagaaaatcattaatttcatcttgtaagtctaattcatgagtacattctataagtttaactttcataaacaaagtataatctacaaaagttaaaaaaattgtcattattggttaatttctacagcaaattcaacttcaaaatttttaccaacaggtaattcaacacaactttctttttctttaaattcaccattaaaatcagtatagtcagcatgtccaacccatggttcaatagcaattaatccaccaacatgttttgcggcccaaagtccaacatgatcaaaaccattcatatgaaaaacaattgatttatcatgatttaatgatttaagagcaatattttctgatttaaactttttaataacaattgcatctgtattaaaaagctcttgtctaacaaaaaatcttttttcattatcaaagaaaggtttttcaactcttgacatacctcttttttcaacatcaattatttttcgattgcatgtttcgttttctgaaaattccaaataataatcattgcttgattcgttttccataaatggacaagcaaaagcaggatgtcctccaacttggaaataaataggttgatgatccgtattttttactttaatatgacatgttaatttattttcaacaagtctatatgtgacatttaattcaaataagaaaggatattgttttataatttcatcattagattttaatgagaatattacttcagtatcactaacttggtttgtttcaaattcattgtgtcttgcaaaaccatgttgtgtcatatgatactctttaccattaatcacacatgtatcattttttaacgctccaacaattggaaataaaataggtgcactgtttgcccattgagatgcatctcttctccacatataattcaattgatctttttttcctttaattgaaataatttctgctccttttggatgtaaagaaacagttaataaatcattagataattctaccataataatcctcctatcagtattttcattatatcataaaataaattctaaaaaaaagaaaaagattatttctaatctttttcatgtaatgaattaataatactttcaattttatttccatattctaaagaagtatctaaaacaaaatgtaattcaggacactttcttacttttaattttttagcaagtaaattacgaatgaatcctttagatctttctaatgcttccattcctttttcttgattataattttttcctaaaaaagtaacatacactttagaaatagataaatcatttgttgtttcaacagcggtaattgtacacatacgtaaatctctatcacgtacttcattttgtaaaatcaaagaaacttctcttaaaatttgagtatttattctatctgtttttaatgacataagactcaactcctatttcttttctacttcttccataacataaccttcaatgatatcgccttctttaatatcattatagttttcaatgtttaaaccacattcaaaaccagcattgacttctttaacatcatctttaaaacgtctaagtgaagcaagttttccttcgtatacaacaataccatcacgaatcaaacgaataccacagtttcttttaattgaaccatcggtaacataacatcctgcgatatttcctattttacttgctttaataacttgtctaatttctgcttgaccagtaattacttcatggtattctggtgctaacatacctttcattgcagtttcaatttcttcaaccattttataaataacattatgaagacgaatttcaacattttcttcttctgccttatttctaacttttgcatctggtcttacattaaaaccataaataattgcttgagaggcacttgctaaaataacatcagattcagaaattgcaccaacagttgaacgaataacgttaacacgcacaccatctacatcgattttttctaatgaagcttttacagcttctgcagttccttgtacatccgctttaacaataatatttaaatcaataatttgaccttctttaatttgagaatacaaatcatcaagagataaagcagctccagaattacgatctttttcaattttagctttcatacgtgtttcaccaacactacgtgcttgtttttcagtttcgaaaaccataaatttatcaccggcaacaggaacttcatttaaacctgtaatttctactggtgtacctggtaatgcttctttaataacacgtcctttatcgtctaacatttgtcttactctaccataagcagcaccaacaacgattggatcacttgcacgtaaagttccgttttcaaccaataatgttgcaacagctcctctacctttatcaagtttaccctcaacaacactaccatatgcataacgattaggatttgcttttaaatcagctaattcagcaacaaccgttaatgtttctaataactcttcaataccaattttctttttagcagagatttcacaataaacagtatctccaccccattcttcaggtaataatccttcttcagccatttcagctttgattctttcaggatcagcaccttctttatcaatcttattaattgcaacaacgataggaactcctgcagcttttgcatggtcaatagcttcttttgtttgaggcatcacaccgtcatcagcagcaacaacgataataacaatatcagtcacttgtgctccacgtgctctcattgctgtaaaagcttcatgacctggtgtatctaaaaatgtaacttttttaccgtttacttctacttgataagcaccaatatgttgagtaataccaccaaattcaccatcaacgactgcagattttctaatagtatctagtaatgttgtttttccatgatcaacatgtcccataattgttacaactggacatcttggttgtaaatcagcttcatcatccacaacttcaatattttcaaaattaacttcatctactggaacatgtttttcacattcacaaccatattctaaacaaattaattcaacttgttcatcatttaatgatgaattgattgttaccatagttcctaataaaaataatacttttataacattagcaggtgtttgtcctagcttttcagctagttcaccaactgtaattccttcttcataggaaatcacaccatcttttattactgatgtttctttctttgcaggaaagtttgattgtaattgtttcttcttttgagaaccttttttctttttaaattgttttgccataaaatcaacctcctatcaattcttttatttttttcgcaaacccttgatttataatacctaatgcaacgcgattattttttccaactgcttttgaaatggtttcaatattttcatcaacaatgaaataatcaacatgataaaaatgacatttatcagtaatttttttcttagtattagcactagcatcatttgcaataacaacaagttttgtttcatttgcagcgatactttttatcaaagtttctcctgaaacaattccctttgcaacattagcaagccctaataaatttaaatattttttattcatcacaatatttttttaactcctcaaaaatttcatcaggaatttctacttgtaaagaacgagataaaacttttttctttttagcaatttcgattgcttctaagcttctttttaaataagcacctcgtccattcattttaccagtagcatctacaaatacttgaccttctttatttcttacaacacgaattaactcttttttaggtaattgttcatttgttgcaagacattttctaagtggaatttttctcattctatctcatcctaatcttcatcataatatttgtcatattcgtcatagtcgatatcttcatcatatttactgtattcatcatcttcataatcatcaaaatcttcataatcttctacatcagattctgaagtgacttcttcaacttcattttcgatattttctttttcttcaacaatagtttctttttcttcttggttatctagcatttcttgagcaaattcatcttggaatgtttcatcaacaggtaattcttctttttgttgaatttgttccattaaccctaattcagttgcttcagataatgatttaatatcaattttccatccagtaagtcttactgctaaacgagcattttgaccacgtttaccaatagctaatgataattgatcatcaggtacaataactaacgcactgtgtttttcttcatcaacagaaacagttaacacatctgaaggtgataatgcatgtgaaatataaacaactgggtcacttgaccattcaacgatatcaatcatttcaccatgtaattcatcaacaacgtttttaactcttgaacccttaggtccaacgcaagaaccaataggatctaatccttcaactgcagtgtatacagcaattttacttctttcaccaggttcacgagaaacagatttaatttcaactgtaccatcataaacttcaggaacttctaattcaaataatcttcttacaaattgtggttctgttctgcttacaacgatatgtgttcctttagttccacgatcaacgtcacttacatatactttgacatgttgtccttcatgtaatgtttctccagggatttgttgatttagtcctaaaaatgctccagtttttccaatattgataatagcaaatttaggttcaacacgatcaacaatacctgtaatgatatcatcttttttatcagcaaattcattatataatgtttctttttcagtttcgcgtattttttgtctgaaaagttgttttgtttgaattgctgctaaacgaccaatatgatctacatctgcttcagtttctacaatatcacccacttgataatttgggttgatatcatgtgcttcatctaaagatacttctaaatcttcatcttctaaatcatcaacaactgttctaatttcaaataatctaatttttccagttttttcattaatttctacacgtacatttgcttctggaaccatataattttttttataagcttttgcaattgattcctttaacatttctaaaaacacgtctttttcaatacctttttcttcacataaagcatttaaggcgctcataaattttctgttactagccacttttatttcctcctaaaattttacagctaatcgtataaattgaatgttctcataattgacaacaatttttttctttatattttttacaagatattcaaattctaattcttgattatcaacagattttaaatatccttcaacttcatataatccggctttaggatttttaaattttgcataaacatattcaccaacagatttttgaacttgttcaaaagtttttaatggtttttcaattccaggtgaagagacttctaaaatgtattcatctttaattggatcagtttcgtcaagtttatcactaattaactcacttaccgcaacacatgtatccatatctagatacccttcatttttttcgatataaatacgtaaatacatttcattattatcttttacatattcaatatcatctaaataacaatcattttgttcgatcaaaggtaagaccatttctttaatactttccaataactccattttttcaccccattcaataataaagagtgggttcccccactcgtttctctttatgaaactataagtaatatagcacatttttcatttataatcaagtcactagaaaagtgataattgattttcttcttgcataccatcaaaaacacccatttttgttagttgtttaatatgcgaattgttcaatttagtccttttaatcacgtcttctttagataagaaagaaccatgtttacgtgcctcaataacagtattagctaccgattcacctaatgaatcaactgaactaaacggtggaagtaagccacttggatcatctggatctaaaatgaatttattggcatcagacttttctaagtttaaaggactaaaatggaatcctcgatcaatcatttctaaggcaatttcaaacacatcccacaatccttcatccttatttgaagattgtctgttttcccttaacatttcaatttcttttcttcttgaaagaatagcatctttaccagcaactaatgtttcaatatcaaaaaaatcacatcttgtggaaaaatatactgcataatattctcttggataatataatttccaccaagctacacgaatagctgataaaacataggctaccgcatgggctttagggaacatgtatttaattttcttacatgaatcaatataccattgaggaacattgtattctttcattaattcttcgtatttcttttctgggaaaactgcaggtgattttcctttacgaacacattccatgatgtcaaaagcatctttattaggaaggcctttttcaatcaaataaaccataatatcatcacgacatccaataacttcttttaaggtacatgttccatttttaatcaacgtctctgcattacctaaataaacatctgttccatgtgaaagccctgaaatgattactaaatcattaaaagtttgtggttttgtctgatctaacatactacgtacaaaggttgtaccaaattcaggtaatcctaaagcaccgctcttgcaattgatataggataaatcaacacctaaagcatcactcgttgtaaaaagtgacataacttttgtatcgtttgttggaattgttttaggatcaacacctgttaaatcttgtaacatacgaataacggttggatcaacatgtcctaaaatatcgaatttcaaaacgttatcatgaatagcatggaaatcaaagtgagtcgtacgccattcagcagataaatcatccgctggatattggtaaggcgtgaaatcaaaaacatcataatctctaggaataacaataattccccctggatgttggccagtcgtacgtttaacgccaccacaccctcgagcaattctttcaagttcagcactacgtacttcattatcaattcctaatgtttcagcatatccttttgcataaccataagctgttttttcagcaactgtagaaattgttcccgctctaaagacatgatcttctccaaaaatagttttagtaaatgcatgagcatttgcttgatacgctcccgagaaatttaagtcgatatcaggtactttatccgcattgaaacctaagaaagtttcgaacgggatattatgtccttcacctttcattggtttaccacatacagggcaaatcttatcaggtaaatcataaccatcagcagcaacaccttcttctaaaaattcactatgactacaatgaagacatagataatgtggtggtaacggatttacttctgtaattcctgacattgttgcaacgaatgaagatcctaccgaacctctggaacctactagataaccatcatcatttgatttttttactagtaagtgggaaatataataaataaccccaaacccatgtttaatgatattacttaattctttttctaatcttttttccacaatttcaggtagtttttcaccataaagtcgatgtgctgtatcataacaaatctttgttaaattttcatctgcattatcaattgttggtgtaaataatttatcatgaattggtcgaatttcttcaaccatatctgcgattttgtttgtatttgttacaacatattcatatacttcatccgctggtaaataatcataacattttaacatttcatctgttgttcttaaatattgagatggtgtaaatgcacgtggattttttcggtcacataaaggatgagcacgatgtccaatcccaattttgggttgtgatataaaaacatctcgataaattttatccttttcatctaaaaaatggacatctccagtagctacaataagtttatttaatttttttgctgctgtaataagacgttttattgaaataattaaattttcttcagattcaatttgtccacgatcaattaaatgatagtaatcttgaaaaggttgtatttccacataatcataaaattctaacaattgttccaacttttcatccgaagaattcaaagctgcttcaaaaacatctgaacgataacagctagtcccatatagcaatcctttacggtaatattccaatctttcttttggaatacgagaaccatcatggaaataagttgtatttgcttcagaaacaattttaaacatattttttaaaccttctttgtttaaagcaagtgctgtcatatgatatgggaaaacgattttataagcatcgtctttttgtaatttatttaaatcaagtaaattataacttccactttgcataatagaatgtaacatcgttgtaaatacagcacctaaaacttcagcatcataatcagctctatgtgctacatcatcgtcataatttacacgataaacacgacatacatttcctaaacgataagatttcattggtttcataatagctcttgctaatgccaaagaatcaataaccggattagttataggtttttgatttaacctctttaaactttcatttaaaaaaccaatgtcaaatttagcattgtgagccactaaaatagcatcaccaaagaattctaatatttgtggtaaaaactctttaattgttggtgcatcagcaaccatttcatttgtaatatttgtaagttgagaaacacgtgttccaatctttttaccaggatttacaaaactttgtaagcgatcaatcacttcaccatttttaattttaactgcaccaaattctgtaatcccatcatggataacagaaaaaccagttgtttccaagtcaaatgatacatatgtggcatcttcaatagacatatctttttcattaaaaacaatattaaaataaggttctatcatatttaattcaacaccatagatcatcttaatgcccgcttttaaactagctgcttgagcttcaggaaatgattgaacgtttccatgatcagtaactgcaattgctttgtgtccccatttggccacttgattaatataatccgaaacattgcctattccgtccattgctgacatcttagaatgtgtatgaagttcaactcttttaacttccacagtgtcttgccttcttgctggttctttaataacttctatttgacgagccatcataactgtttctctcgcataattatctaaacgaatttctcctgttgctttgatccacactttacctttatctagtactttaatatcctctaaagtattagttgtattgttttcaaagcgttttaccataattgaatccgtatagtcagtgatccataatgtttgaatatgttttcctgctcgtgttttgattaattcagttttaaagacatacccttgaatcgtacaattattttccatcgtttgactgttaatttcagataactttaaaaaagttgcatcaccctttgcttttcgataattatttttataatctacagttggttttactggttccgatttttttatttcggacatatctattttcattggttcatagctatccatttcttgtaataaatgatttaattcatcattatcttgtttaacataaaaactaaaatctttctctattccaatttccacaaaatactttttaattgttgattttaattgttggaattgttccaattgtatttcatttaacaaaccaatcgatatagtttgtttaatttcaatatcttcgattttcaacgaagaaaataatggtgaaatttgttttagtttttcaataatataccctaaataaagtgaaacatcttttgactcaaaattaaaatcatcataacaaattacaaattcagccaggtaaggaaagtcaaggccatgatcaagtaagagttgatactctgtaaatggaatcaaatccttactcaatatataaaatgtataatggttatcatgatgtacaataacttttttcaatgaagcatgtaataaaacattaacatcttcgattatattcaattgttttaatagtattattaatttattcatattacacctcaaaaatcttacctattataacacaaaaaaaggcatacgccctttttttagaaaaattttccaatatcatttatagttacaaaaatcattaggccaaaaacaagaattagtcctgccatttgtaaagcatatttcatttttgttggaatttctcgacgaataattttttcaactaatgcaaataatacttgactaccatctagtcctggaataggaagtaaattaaacattccaatatttgttgatagtaaagcagtcaatgacaacaatgtactaattgaaccagattgtgtaacttgtgcagtcactgtataaattcctactggaccagaaagttgtgaaacagtatgtgttaaatctgtaataagttttcctaatgttgtaaaaatcaataatgcatattctataaattgattaattccttgtcttatagcctcaataaaagtcaattttttagtagccgctgttattccaatgacataagacttggattcactattgtactttccttcaactgttttttcaatattttgattccctcttttaagggaaatttgcattgtaactgtatctgtatctaattgtaaattttcattagataagacagattgaatatctgaaaatgacgcaatgatatgttcttcaccattaattgtgattttattaatggtgtctccagcttgaactccagcattataagcaccattgtttttaacaacacttccaatttcagaagtatttgtttgtacttcaacaaacgaataaataccaattaataaaacaagggcaagtacaaaattcataaaaacaccagctaacataataatgcattttttccatgttttaattccttttagagttctttcataaggaacatctttcattaattcgctgtcttcttgatcagcttcacctgccattgcaacataaccaccaataggaagtgcacgaatttgataatctgtttctccttttttcttagaaaaaagtttaggacccattccaatagaaaattcagcacaataaacaccaaataatttagcagttagaaaatgtcctaattcatggattaatacaatagctcctagtattacaaaaaagacaagaatatttataatcgtctgcatgtttcatttatctcctttaaaacaaaatctctcgcccattgatcaatatctaataattgatcaatagttggatctttaaccaactcatgagcattcatagctttttcaactaattcctctatttgtaaaaattcaatttttccttctctaaacaaaagattagccatttcatttgcaccatttaaaacacatggtaagcttccacctgtttttccagcgcgatatgctaaagaaagcgcatgaaatctattgaaatctggctttttaaaagtaagcgaaccaagttgtgttaaatctaatgatttaccattaattaatttttttctttgtggataagttaacgcatactgaatagctaaacgcatatcaggtgttcccatttgcccaatgacagaagtatcttcaaactctacagcagaatgtaaaatactttctggatgaatcaagacttcaatttgatcataatctacatcaaacaaccattttgcttccatgacctctaatcccttattaaataaagtagcactatcaatcgtaattttagcccccattgaccagttaggatgattcaacgcttctttaacagaaacacctacaagttcttctcttgttttatctctaaaacttccgccacttgctgttaataaaatacgtttaattttattcatttcatttccttgaagcgattggaaaatcgctgaatgttcactatctactggtaataattttacaccatgttctttaactaattttgtaataatatgtcctgcaaccacaagtgtttctttattagctaaagcaatatcttttttagattcaatagcatgaattgttggtaacaaacctgcaaaccctacaattgcatttaatacaatatcaacttgatcaattgttgcaatttcatctaaaccagcactaccaaaaacaaaacgaatatgtggatatttttcttgaagatagttacaatccttttcatcgataacacaaacaacttgtggattaattttttgaattgttgtttcaagtaatacaatatttttgcccgcagacattgcaacaacattaaactcatcttgatgatgcaagcaaacatcaacagtttgttgaccaatagaacctgtaacacctaaaatcgtaatatttttcattatctataaccccacaatcattaaaaagaaactaaaaatcaatacattaaaagttaaactatcaatacgatctaaaattccgccatgtcctggtaataattttgaataatctttaacttcaaaatatcttttaatggcactaaaaatcaaatctcctatttgacttgtcattgtcattacaataattgctggtacaataatccaatgatgtgccaatattcctgcaaaatatgcaaaaaccaatcctaaaacacttcctagaacaattccaccaattgacccttcaattgtttttttaggagataatcttggaatcaacttatgtttaccaaaagccataccagcaaaataagctcctgtatcactaccaaaagttacaattgctaataacaataaatattcccaaccatagtcaactctcaaaacaagtaacgcatgtaatccagaacaaacaagaacacccatcgtaaaaacataagcacttctttcaatattacatttatcatcaaaaatcatacatgctaaaataaccgctaaataaaccaaaatagaatagctagaaataagtaaatgatttctgtttaataaaaatcctgtaacaaaaaataaaccaacaatgatatacatatacattccaatacgtggtctagaacaaatatgtaacatttcatatacactaagacccattgcaacccctataacaattttataaaaaatacccccaaaaatgactgctggaactacaattgcaatcaagcacagtgcagtaataattctttctttcactattttaaacctccatatctacgatccctattttgataaagccaaattgctttatgtaattctttttcatcaaaatctggccaacaaacaggagtaaaaataaactctgcataagcaagttgccataacataaaattagataatctttgttctccacttgttcttaccattaaatcaacatcaggtaaattcgcagacattaatgttgaaccaaaataattttcatcaatatcctcaatatcaagtttcccatcttttacatcttgtgctatttttttagttgaacaaacgatttcatctctactaccataaataaaagcaaagcaaagttttagtccagtattaccctttgttctttctatagcagtattgataatatctcttgttgcctttggagctttttctaaatgcccaatcatacaaatttgaacattattttcaattaattcttttaaataaagttcaaaaaattttttgggtaatttaaatataaattgtacttcttcttcaggacgagaaaaattttctgtagaaaaagcataaactgtcattgctttaacaccaagtctattagcctctaaagcaatcttacgaattgtctttgtcccttcgttatggccataagttcttggcatcattctctttttagcccagcgtccattgccatccataataaaagcaatatgtgctggtatattattcatgtctaattcatagttttcaatttgatcattcatagaataatcctccttaaagtcatgattgattataacataaaaccataaaataaaaaagcgcctaataagacgcttcaataattatacagtcataatatctttttcttttactttaccaatttcatcaacttctttgacaaatttatcagttaatttttgaacacgattttgaccgtctttaatttcatcttcactaccatcgcattttttaatttcatcattagcatcacgacgaatatttcttatagcaactttagcatgttcagcaaatttccaaacattttttgcatattctttacgtctttcttctgttaatgctggtacagtaatacgaataatttctccatcattttgaggagttaaacctaaatcagcttcataaattccatgttcgatatcttttaaagcagatttatcataaggtttaattactaattgtctaccttctacaacagaaacaccagccatttgattaattggtgttggtgatccgtaatagttgaccattacacggtctaacattgcaggagtagctcttccagttctaactgtcgctaaatctctttggtaagcttcgattgctttttgcattctatcacttgcatcatctaaaatcatatttatcatattattttcctccagagatagttgttcctattttttgtccatcacaagctttggcaatattaccatcttcttgcatattaaatacacataaatcaatatcgttatctttacataatgtaatagctgtttgatccattacttttaaatcttttgctaaaacatcactatatgaaatctcatcaaattttactgcagattcatctaatttaggatcagcagaataaacaccatcgaccccatttttagccattaaaataacatcagcattgatttcagcagctcttaatgcagctgttgtatcagttgtaaaatatgggcttccagttccagctccaaaaataacgattctacctttttctaaatgtctaacagcacgtcttctaatgtatggttctgcaatttgtctcatttcaattgctgaaagtaaacgtgtttgaattcctagttgctctaaagcattttgaacagctaaaccattcattactgttgctaacattcccatataatcagcagaagaacgttccatacccatttgtgcaccagtaacaccacgccaaatattaccaccaccacaaacgatggcaatttcaacacccaaatctttagcttctttgatttgtcttgcaatatcggctacagtattagcgtttataccaaaatgatcatcaccggctaatgcttcaccacttaattttaataaaactcttttatatttcataaaatgttctccttttttaaaaaaaggacacacttgtagtgtccttaaaaattattgtttcatttgtgcagctacttcttcagcaaagttttcttctttcttttcgataccttcaccaacttggaaacgagccatttctaacactttagcttttcctaagtatttagcaactgattcttttggtgttttaatgaattcttgatctaataaacaccattcagagaatactttatttaattttccacgtttgataccttctaatactttttcaggtttgttagctaatttaggatcattagccataatttctgtttgaactgcatcttctctatctttttcaacttgtggaatttcatcttgtgagatatattttggattaatagcagcaacatgcatagcaatgtcttttgctttttcttcatcaccgtcagctaatttaacgattgataccatttttccacccatatgtgaataagcaccaaatacttcatcatcatttttagtgaaagttttaattcttcttaaagataatttttcaccaatttttccagatgcttctgcaattgtagtttctatagtttttccatcaacttcaattgcttttgcagcttctaaatcagcagggttatttgcagcaactgcttcacatacattatttactaatgcaacgaattcagcgttttttgctacgaagtcagtttcagagttaacttcaaccatagcagctacatttccgttaatagcgaaagcagataacccttcagcagcgattctatcagcttttttagcagattttgcgattcctttttctcttaaccagtcgaatgatgcttcgatgtcaccatcacatgcttctaatgcttttttacaatccatcattccagcaccagttttttcacgtaattcttttactaattttgcactaattgccattttcttttcctccatgaattttattttattaaaaagggaaagctttgctttcccatcacaacatatttatgatttccagccttgagattattcttgagttggtctagattctcttctttgagctggtctaccagctttatttcttggccctcttctgttgttgttttctacagaagatacagcatcattcatagtaacttctttttcatcttcatctttaacataagcaacagttaatggttcacttttagcttcacaaattgcatctgccatagcagcaacaattaatttaacagctctaatagcatcatcatttgctgggattacataatcaacttcatcaggatcacagttagtatcaacaataccaaatacagggattcctaagattcttgcttcagcaacagcgttgtgttcagctttaggatctacaacgaataaagcacttggtaatcttctcatttctttaataccacctaagttcttttctaacttagcagcttctttttttagtaagataacttcttttttaggcaataaatcgaaagtaccatctttttccattttttctaattcaactaatcttctaattcttttttggattgttttgaagttagttaaagttccacctaaccaacgtgagttaacatagaaacttccagaacggattgcttcttctttaacagcttcttgagcttgttttttagttcctacaaataaaacttttccacctttttcggcaatttcattcattgctttataagcttcatcgatttttttagatgatttttgtaaatcaataatgtaaattccgtttcttgatgtaaaaatgtatggagccattttaggattccatctttttgtttgatgtccgaaatgaacacctacttctaataattttttcattgaaattactgacatgtgtaatttcctccttttcgtttttttcctccattatttcaaacatttaccaccattaggcactagataaatgaattcataatgtgtgtattttttaatacctgaaacataatagcataagatttaaaacaaaacaacccttttttatgctttatttcgaggatgtgcctttaaataaacatttttcaaatgttcttttgtaacatgagtataaatttgtgttgtcgaaaggttttcatggcccaataattcctgtacagttcttatatctgctcccgcattcaataaatgcgtggcaaaggagtgtctgaaagtatgtggatgtattttcttggttgcatcatattctctaccaatacgctttacaatatcctgtattcctctattggtcagttgttctcctcttttattaacaaaaacatatggatgatcttctgaatttacaagttttccccttacttcttctatatattttaataaccattcactagcaaattcatggaaaggaacataacggtctttgttccctttaccatgaatcaataaaactcgattgtgaaaatctatacaatccaaggttaaatttactacttcagaacaccttaacccagaagcatacatgatttctagcatcgctttattacgaattcctaaatcatcttgtgtatcaataccatccaataaatccaccatttcttcaggaaacaaaaaatcaggattacgctttgtggttttaatattttcaacaagaatcattggattattttcagccaattcttcttttactagatatttataaaatgatcttaaacaactgattcgattattaattgaattctttgacaattttttttcatttaaataagttaaatatcctcttatatttgtatacttgacatcgttaaagtgagaaatactttcactttttaaaaaatcaataaattcatttaaacttcgttgataagattcaactgtattgattgagtaatgtttttgaaattgaagatattttataaattcttctttatcttgattataattcattgataaattgatccattacttctattgctctgttagcataagcttcttttcttagtttctttttaacacgtacaggtaaatctggcagaattccaaaattagctttcattggttggaaattactttcatcacaatgcgtaatataatatgcaagtgctcccatgattgtttcctgtggaaaaataacaggtttttgtttatttaaataacgaaccatgttcattccggcaacgattccactttgagctgattcaacatatccttcaactcctgtcatttgtccagcaaaataaattccagaatgattttttaaactgtaatcttgatttaaaaattttggagaacaaataaacgaatttcgatgcatgacaccgtatcttacaaatgttgcattttctaatcccggaattaaatgaataattcttctttgttcaggccatgtaagatgtgtttgaaaaccaacaatattatataaactagcttgtacgttatcttgtcttaactgtacgactgcatatggttttgtgccatcaggttttgttaacccaaccggtttcataggtccaaacaataaagtttgttttcctcttcttgccatttcctcaaaaggcatacatccctcaaaaaatttttcttcaaaatcttttggtttaacaacctctgctttcattaattcatcataaaatacagtaaattgctcctcattcattggacaatttatatattcattttctcctttgtcatatcttgatttataataagcaatattaaaatcaatactatctttttcaacaattggagccgcagcatcaaaaaaataaaaatactcttctcctaataattctttgattttcgtagacaaagcatcacttgttaaaggtccacttgcaataattgttggtgcttgggaaatttctgtaacttcttcatgaatcacttcgatatttggatgatttgttataaactcagtaacatctgcagaaaacttttcacgatccactgcaagtgctccaccagcaggaacactattttttctagcaaatcgaataataacactatctagtttttccatttcattttttaatacacctacggcattattgaaattatctcctcttaacgaattagaacaaacaagttcagcaaatgatgatgtatgatgtgccggtgtcattttaacaggtctcatttcatataactttactttaatattattttttgctaattgataagccgcctcaactccagcaagaccagctccaattacattgactattttttcactttccatattttctcctttttaaaaaagtagaacaaatgttctacttaataattgttttacattttggataatttgaacaagctttaaattctccccaacgtccctttttaataaccactggagaaccacagttaggacaaacttcatctgtcataacaggttctgctttctttttagaattcttaatatatttacattgtggataatttgaacatgcttcaaatttaccatatcttccggttttaaaaaccattgggcttccacacttaggacagttttctcctgtaaattcaggttcaactttttcctttttgatgtatttacattcaggataattttcacaagctataaatttaccataacgcccatgtctttcaacaagatcatgtccacattcaggacatttctctcctgtttttttaggtgaaatgacttccattttttcatttgcttcatccaataaaggttggaattttttaataaatgtatctatagcatcaaaataatcatcttgtccttctgcaatatcatctagttctttttccatttgtgcagtatattcgacattaataatatcattaaaaaattgtgttagtcgatcacttgttaaaattccactttcagtaggtttaaatgttttatcaacaagttccacataccctctagtttgaatcgtatcaataatcatcgcataagtacttggtctaccaattccaagttcttccatttctttaattagttttgcttcactataacgagcaggtggttttgtaaaatgttgtgttttttcaatattttgactttctaaaatttcttgttcaattaattcaggtaaaatttcatctttttgtttttcatatgggctatataaacgtaaataaccatcaaattttaatactgaaccacttgcgttaaaataatagttattattttctaatactacacttgttgcatcaaaacgagatggtgccattaatgacgccaatgctctggcataaattaaagaatacaatttaaattcatccgcacttaaatactctttaacagactcaggtgtacgcattgcacttgttggacgaattccttcgtgagcatcttgtacattttctttctttttacttacttttacttttccaacataattttgaccatatttttctttaatatattctgtagcactttctacaaataaatctgacaatcttgtcgaatctgtacgcatataagtaataagccctactgtttcatcttctaaagcaattccttcatatagcttttgagcaatcatcattgtctttcttgctttaaagcctaatttagaagacgcttcttgttgtaatgttgaagtaataaatggtggttttgattctcttttcttacttgatttttttacactatcaataacaaattctttagaaagtgcattaaagatttctaaagcttcttgttcatttgaaatttttaacttctttgttccttttttattaagttcacctgtaaattcaatttcatctttttcaaattgtgctttgattttccagtattcttctggaacaaaggcttcgatttcacgttctttttcaacaattaatcttaaagcaaccgattgaactcgaccagctgatttagatttaatttttctttgtaataatttagataatttaaatccaataattctatccaatactcttcttgtttcttgagattttacaagattttgatcaattttacgaggatgattcaatgcatcaacaactgcatcttttgttacctcattgaaaacaatacgattatcatcatccatatctaaacctaaaacatctgctaaatgccatgaaattgcttccccttcacggtcagggtcggtagcaaggtaaactgttttcgcctctttaacagctgctttcaattccttaacgacatcttttttatccttagaaataacatattttggcttataatgatcttcttgatcaatccctagcccttctttaccagatgttgataaatctctaatatgccctttagaagaagtcacatgatattccttccctaaataattttctattgtttttgatttagaaggagattccacaatgactaatttatcatacataatataacccccttatcgcaaaaactattattattgttttttttcactttgtcaactccatttcattaatcttcaataatatcatttacagtcaatactaacttggccccttgttgaatcaataaattacaccccattggatccccaattcttgatggaatacaatagatatcttttccttgatctaatgcatatcctacagtaatcattgttcctgaacgtttttcagcttctgtaacaactacagattcacttaagccagcaattaaccgattcctacttggaaaatccttagcctgtggtacataatcacctggtttttcactaataataagatgattactttttaattgagcatataaatcttgatttctttttggataacaataattaattccacttcccaatactgcaactgttttccctttgttttttaatgcacttctatgagcgagagtatcaattcctaatgccataccacttacaatcgtatattcattttttactaaatcacatacaattttatccgtaatatttgatccatattcactaggaacacgtttaccaataacacctatgcatttaccatttaaaatattcaaatttccatgataaaacaatacaaatggtggacaagatatttcttttaaagcatctggataatcacttgaaataatcgttgtatattttgaatttactttagcaactgcttccctcctttcttcttgggaaactttctcttttgcttgcaatgcttttaaaatactttgaaaatcaccttgatacttcaaagcaaaaaatagtaagatttcttccatatttatcacctcactatttatatagacatttaaatttgttttttcttcttttttttataaaaaaagaactaaatatctaaatttaaagatatttgttctttcattacttcttgtactggtttaaaagatttcctatgaatagggcatggaccatattttctaagtgcctctttatgtgccttggttacatagcccttatgtttttcaaaaccatattgtggatatttttttgcataatctatcatcaaatgatctcttgttaccttagctaatatacttgctgctgcaatagatatagaaagggtatctcctttaataatagataaatgttcaatatcgtgtaaaggcatcgcatctgttaaagcaaacattttttctctctttaaaatttgacaacatttttccattcctttttgacttgcgctatatacatttaattgatcaacatcttcaacagaaataacttcaatgtgataggctaatgcattttctataattatttgatacatcgcttctcttttttttgctgttaattgttttgaatcaaaaatacgttcatcataaaatcctttaggaaaaatgactcctgcaacaactaattcgccagccattggtcctcttccagcttcatcaagaccaataatataatcataacctaaatcataatatctattttcatattctaataaattactcatttggaagctcccatgttatttttgtaataacaccatcaaataaatcagtaaaaaacatatccatgacacgctcataatcagtaatccctcttactggttttatttttttattaaatgcgatatcatcataacatttttcaacccaatcactttgtaaatcaacagctatttgataacgattttccaaagttccagggtaatttttaactaaatattcaactgcataaataaataaatcttcccttggtaatatttgctgtttaatagagccaataagagcaatatttctagcaatatcctcactttcgaatttaggccataaaacacccggtgtatcaaataattcaaaatctttatctaccttaataatttgttgagctttcgttacacctggtttattccccgtaacagttgcttttctttttgctaagcgattgatgaaagtagattttccaacattaggaatacctaaaaccattgctcgcattgcacgaggtttcaatcccttctttgcttctcgtgccattttatctttcaaaatttctttgcaaacttgtatgatctttttatattcattaaattgcttaagattaacacttatagcataataacctttacttttgtaaaaatctagccatttttgtgttagtttatcatctgctaaatcttcttttgtcattacaattaatcttggcttattattaacaacactattaaataatggatttttacttgaatatggagctctagcatccaccaattcaacaacaatatctattaattttattttatcagcgatttctctttttgccttagccatatggccaggaaaccattgtatttgtgccatattagttcattcctttcatatgattaaaaggaaatagtataattcctttttttgataaaacattttcaattttaaaacatcctaattctcttgaatcaagtgaatttactctattatcacctaaaacgaaaatttcattttcaccaactgaaatttcaaaatcatcagtaaaataagaaatattatatcgactctttacatcttttatatgtgatttattaagataattttctttaatatactttccattaacatacaaacaatcatttttgtaaacaattttttctccaggtaaccctataacccttttaataattacattgtctaattgtttacagtctaatgtgacaatatcaaatcttttaatttgttttgaattcaaatcaagccgagacataaaggcaagatctccgtcatgtaatgttggatacattgaagaaccatcaactttgatcggcataattatgcctttaaaaacaaaaacaattgctaaacaaacaacaataaattctaatattgccatcattgtttttttactatatttcatagacatcacctatctttatcttatagacctgttctattatacaacaattaatggtagaaaaaaagaaatggttacccatttcttattttctaatttctttgattctagcagctttaccagataaaccacgtaagtaatttaatttagctctacgtactttaccaactttagcaacttcgattctatcgatgattggtgaatgaactgggaaagttctttctacaccaacttggtaagaaatttttctaactgtgaaagtttcagcaattcctttaccttgtcttgcgatacaaaccccttcaaataattggatacggtatttattaccttctttaatttttacataaacttttaaagtgtctccagctttgaaaacagggatatcagattttaattgttttttagtaatttgttctactaatgttaaattcatctttcttctccttttcatttatagtcttgtatgttcattcgattaaccagcggaacatatgcagtcacattgacctatgctattataacattgttcaaaataatatcaactcttttttttaatttttgtcaacatatttgccgattcttcatcaaattcataattttctaataaatctggtctctttaaataggttttctttagagattggtattttctccatttacgaatattttcatgatgaccagagaccaatacgtcaggcactctattcccatcatattctattggtcttgtatattgtgggtattctaataatccatctgcaaatgaatcatcttcatggctttcttgacgaatagctccttcaagtaatcttattaccgcatcacaagtaaccatacttcctagttcaccaccagttagtacataatcaccaatagacaattctaaatcaacataatcacgaatcctttcatcaaatccttcataatgcccacaaataataataagatgcttttctaatgaaagcttttgtgctacttgatgctttaaagtaatcccttgaggagacattaaaataacaagtgaatcatccgttgttaatgtttttaagcaatcaatgattggttgacacatcaacaccattccctgtcctcctccataaggataatcatctacatgtttatgcttatcttgagtgaattctctaaaattatgaatcttaatatcaacaacttctttatctatagctcttttgataattgaggtatttaaaaaaccttcaaacatttctggaaatagtgataaaatatcaatcttcatcatacattcccttaatcaaatgaacaaatatttttttattttcaatatcttcattttcaataaatgcatcaacatatggaatagcaatctttttatttgctgtttgtacagttaaaacatcatgtgcaccattaaaataaacagattctacttttccaatttcttgatcattattaatgatctgacaaccaattaaatcatcgtaaaaatattcatcatcatctaattcaacatcttcttttaaaccataaacattataaccaatatatttttctactagattaatatcttgtaatccctcaaaactgattaaataatttcctttatgaactcttacagttttaataataaaagggtctacaatttcatttaagtaaagcttatgtcccacaacaaatctttgatcattgaaatcactaaaagaacgtattttaagttctcctttaagtgcatgcgttccaacaatttttccaatttttaatttttccatacaacctccaaaaaaaatagatgtgttttacacatctattcatatgattcgaatttaatatctaattttttatcagaaagacgtcctgcaacagacattaattgacgaatagaattagccataacacctttacgaccgattaattttgcaatgtcattttttgctgaataaacatgtaaaacaacaatattctcatctaaagaaggcatttgtcttacttctaaatgttctttatcctcaactaattcaatcgctatatcttttagtgtttttacataatccataattatttaccttgttttgaatcagcaaattttttcatgataccttgtttagataataagtttctaactgtatcagatggttgagcaccattgtttaaccattttaagatttcttcttcttttaagttaacttgagctggattagtacatggattatatgtacctaataattcaataaatctaccatctcttggtgatcttgaatcagctgctacgattctatagaaaggtctttttttagcacccattcttgtcattcttaattttactgccatttatatttcctccttgttttcttattgcttgtataatttaacatagatagaaacaggtgtcaagcatttttacttgacacctttcattattttttctttttctttttatgacgtacttttttacgatttggaccacctacaaagtgacctcctcccatttttggaagtcctgttgccatatccatatttgacatttgtttcatcatttgtttagattgttcaaattgttttaataatctattaatagctgctaaatctttaccacatcctttagcaatacgttgttttctagataatgtaataatacttggatcacgacgttcttctaaagtcatagaataaataatagactctgtttctttcattctcttatctgttgtttcatcgtttaaattaggcatagatggcataccaggaatcattttcaaaattcctgaaagtggacctaacttctttaattgatgcatttgatcaagcatatcatccaatccaaaacgtccagattgcatttttttcatagctttcattgtttctttttcatcatagacatcttgaactttttcaactaaagagaccacatcacccattcctaagatacgatctgccatacgatctgggtagaataaatcaatagcatctaatttttcacctgtaccaataaatttaattggaacattcgtaatatgtctaatagaaagtgctcccccaccacgagaatcaccatctaatttagtaagcacagctcctgtaatacttaatttttcattaaatgaagcagctacattgacaatatcttgacctgtcaatgaatctacaacaagtaaaatttcatcaggttttgcaatttctttaacatttgctagttcttgcattaaaggttcgtcaatgtgcaaacgtcctgccgtatcaataataataacatcattattatttaaagctgcataattcatagcacctttaacaatattttccgcactttcagatgttcctttttcataaacaggcacatctaattgctttcctaatgttaccaattgatcaacggctgctggacgataaatatctcctgcaaccaataatggttttttagcatattttgtcttaattaatttagcaattttcccagaagttgttgtttttccagaaccttgtaaccctaccatcataataactgttggctttttactaaaatcaacttctgaaacctcatcacctaataaatgtactaattcatcatgtacaattttaactaaaacttgtccaggttttaatgaacctacgacatctgcaccaattgctttttcttttgttgatgcaatgaactcttttacaacttgatagttgacatcagcttcaagtaaagcaagtcgaatttctgtcaacatctcttccatattactttcagtcaactgaccttgtccagataccttttttaaagttgactgcaatctttcagataacgaatcaaacgccatatatacctcctataaatctcttaacatttgtaaatgttcatcaatatttttatgttcttcttttatatctttttctaaatcatctataatttcaagtcttttttgatgtttttctaataaatttaatttttcttcataattttctaaatgtaaacaagctttttttaaattgtcaaaaactgcatttttagaaacatttttaatcaaagatatctctgacaaagacaaatcctcatgataatacaaatctaaatactctctttgtttttcagttaataaatcttcatataaatccatcaaaagatttactctttgctttttttctaaactattttccattatgcttcctcaactaaccccttacataatccataaatatattgttctaagtcaaattcttgtaaatcatcaacttgttcacctaacccaataaattttacaggaatatttagttgatctttaatagataaaacaattccacctttagcagtaccatccatttttgtaagaacaatccctgtaatatcagtaatcttagaaaattcaatagcttgtgaaacaccattttgtcctgtcgttgcatctacaacaagaagtgtttcatgtggtccttcaggaacaacacgcttaataatacgattcattttttccaattcgttcattaaattcactttattttgtaaacgacctgctgtatcacaaattaaaacatccgctcctgtttctttagctttatttaaagcatcaaaaacaacggccgaaggatctcctccttcttttcctttaacgatatccacaccaactctttctgcccaaactgccaattgatcaattgctcctgctctaaatgtatcacccgcagcaacaacgacttttttaccttcatcatgaacaatacgatgagcaagtttcccaatcgttgttgtttttccagcaccattgacaccaaccattaaaataacagttaacccttctgctgagtaattgattttagttgacataacactttcattagcataaataacgaacattttatcaacaataatatcattaatttctcttggatcagttatatttctgattcttacttctgttttaatttcagatacaatcttcatgaccatcgaaacaccaacatcagccataattaaaatattttctaattcttcaaaatactcatcattgatttctctaaatcgggcagctaattcattaatacgatctgaaaatgtttcagaagatttatctaaaccaacaacatatttttcattttgcttagttgactttccaactaatttttcttttatttgtgtaaaaaatcccatctaaatacctcccttacgattttcattagaaaaatctattgcctcttcaagtttgacacttacaagttttgtaacacctttttgttgcatcgtcgcaccatataacaaatcacattcttccatcgttccctcacgatgtgttactacaataaattgtgtttgtttagaaaattctcttaagaattttgcaaatctttcaacattagccatatccaatgctgcttcaacttcatctaagatacacattggcacaggtcttacttttaaaatagcaaataaacatgaaattgcaatcaacgctttttctccaccagaaaataatgtaatattcgacacagcttttcctggtggttgtacatctatatcaattcccgtttctaaaatattatctggatcagtatatttgatttgtgctcttcccccaccaaacaattctctaaaaacattattaaattctttattgatcttttcaaatgttgttgaaaatttctcaatcataatttgatccatttcatcaattgcctgtactattttatcctgagcttgtattaagtcaagtcgttgactattcatattttcgtaacgcgatgaaacttctttatattcttcgatagcatcaatattaacatgaccaagtgctactatttcatttctaagtgtagcaacctctcctctagcaaattcaatatctacttcatcatgataattttcacttgcatactcataagtcatggaatattcattagataatcgacttaaataattatttaatgatccttcatatttagtagataaaatagctttttcattaatttgtccttgaatgtctttaagcatccttcttaaatctttcaattttgattctaattgctcattttcattaacataggacattcttaattctctttttgattttattttttctgttaattcatctcgatgcttgatggcttcatttaattgtaaaacaagttgattatcaattttaccacttttaaactcatccaattcaacgctttgatgcgataaactttcatattcacctttagcaactacaagttcttccttttttccttgaacaacaacttctaacttagcatatgacatttgtttttgtagaagtgtatgtgccaattctttagcatcgttttcaagtttaagtaattcattcttttcacgtacaagtttttgttctaattcatctaatttttctttaactttttctagttctcttttttgaagaatggatgattgttgacgattaactgttccacctgtaagtgaaccaccaacattgacaatatttccatccaaagtaacaactttatatcgagcatatgttgcctttgatatttcataagcatgatcaatatcatcagctaaaataacatttcccaattgattcaaaataacattatctatatttttagaacttgaaacaaaatcacttaatacacctaaataaccttctaaagctggacataaaatagcatgttcttctcttaaagaacgtggttccatatccgctaaaggtaaaaaagtagcacgtcctgccttattatcttttaaaaacttaattgctaatctagcttgtaaattatctttcgtaacaataaattgcaaagcacttcctaaagcaacagaaaccgctaaatcatacttcgaatcattttctagtaaatctccaaaaacaccaataatatccggattatcatgagcaagttccataatagccttgacaccatgatgataattggatttattttctactaaatccactaatatttcttgtctatttttatttttcgtaatttcttgattaagatcattaatagattgatgtttatgattgattttggatgttaaaaccgtttgttcttgagataaatcttcaagggatttttctgttgtttttaatcgttcaacacggtcattatattcttcaatcaaatccgtcaaaatagcttttaagttatctaatttcttctttatatcatcactgttttgagactgtaaagcatgttttcttttttgatcaacctctattttacttgtttctagtcttgaaacttcagacatcgattctaataattgactttgtagagaatttatttcattatctaaaacaaacattttcttttttatctcatcatcagcactttctttcaaaaaaatttctgcatctaatgaactgtgtcgttcattaaggtcttttaattgtaaagatagcgtatctagttgatgttttaattccgaaacttcatgaacaagtacatttacttcaattgaagtaagtttttccttcaacgttaaaaatacttctgctttttctttttgtttttttaatggtgctatttgtttttctaattcataaacaatatcttttatacgatttaaattatccgttgttctctctaattttctaatagcctcaatttttctttttttatatttagaaactcctgcagcttcttcaaaaatagctcgtctttcttcaggacgactatcagcaaaattagaaatatttccttgagaaataatagaaagcgaatctcttccaagtcccgtatctaaaagcagatctgtaatatcttttaaacgacattgttgccgatttaaaagatattcagcctcatttccttgtcgataaagacgtctagtaatttcaacttcattatagtcataattgagcatacgatcactattatcaaatattaaagtaacttcagctaaattttgtgcccggcgatcttgagaaccagcaaaaataacatctgccatattacttccacgtaaagattttacagattgttcacctaatacccatctaactgcatccgaaatattagattttccacatccattaggccctacaattcctgttattcccggctgaaattctatattaactttatctgcaaatgatttaaatccatgtaattctattttttttaaatacatagatgctcctttctagcctatttgaaaactattttaccattttcaaacgattcaataatcgcaagcgattctactctataacctaaatcaactaatttttgatgtcctttttgaaatcctttttcaataataataccgcatccaacaatatgtgcttttgcttgattacacatatcgactaatccaagcattgcatttccatcagctaagaaatcatctacaagtatcacattttcattttcatttaaatatttctttttaacgcaagcaatatatcttgttcctttagtatatgaatatacttcacttgtatataaatcatcattaactgttttagatgttccttttttagcaaaaacaacaggaatatcatttaattcatagctaagtgctaatcccagtgcaattcctgatgcttcaattgttaaaatcttatcgattttttcccccataaatcttcttttaatttctttagcaattgatctataagtttttggatcaatttgatgattaataaaactatctacttttaaaatatctggttcaataatttctccatcacttaaaatcttttcttttaattctaacatactaattaccttaccttttcaatctttcaattaatttttgtttttcaattggcagtcttacaataaaatttgtacccacatctacttgagataaaatatctatcttcccatgatgtaaatcaacaatagattttacaattgccaagccgagtccatttccttcaacgtttcttgctttatcttctctataaaatctttcaaaaatatgagaaacgacttctttagacattccaatacccgtgtcttctatagacacttctatatctttagaattttttttcatcgtaattgtaatgagtccaccttcatttgtatactttatagaatttgaaataatattggtccaaacttgttctaaacgttgttcgtctccttctataaatatttcttttttaggcatctcaaagacaatttctatatttttttccattgcttgattttcttgagtagaaataactcgattcatttgttcaactaatgaataatttgttaactctaattcaatctcttctctatcaagcaaggtcaattgtaacatattttttgctagagaagataatcttttactattatataaaataatattcgcatattttactctttgttcttttggcaagtcttcttcttttaaaatattggcaaatccttgaatagacgtcaatggtgtttgaaattcatgagaaatatctgaaataaacttttgccttgtttcatcttgttttgcaagttgcctcgccatttgattaaatccttgatttaatttagaaatttcatcttgtccaacattatcaacacgaacattataattcccattgctcagttctttgattgcatttgttaaacgtgttaaaggtttaacaataatatcggcaattactaaaaatacaatacttcctgttaaaaaaacacaccccaaaatcaaaattgctgaattagcaattgcacttttttgaccactggtatctttttgaacatagatataatactcttgtccattgatcatattctttgtaccatacgctaacacttcattatgatgcttaaaggaaagctcattgtttgtacttttaaacattgccattatctgttcaggtgttggattatattttttgtttccataagcaacatagccttcactgcttgaataacatgttatggccatttcactactttttgcatataaatcaataatatcatccctattttcaatattaatatttgaaatcactttagaaacataatcatttgttgtaatcaaatcttcttctactgtggattcaatttgttggtcatttaatcttaaagatacaaaacctgctactgaaaaggaagctacgattgtaataaaaaagccaaaaatcaattttgaataaatagatttcatctactctacctcaactttgtatcctaatcctctaactgttacaacattaaaacctggtaaatgcccgatattttctctaattcttttaatatggacatctactgtacgatcaaacccatcgtaatccataccccaaatcttttcaatcaactgttcccttgaaaaaatttggttaggatgtttagcaagttcaaataataattcaaattgttttagtggcaaatgaatacattcatctttatatctgatttcatatttatccccatccaattcaacttcatttaaacgtacaatatgcgatgtattaatatcatatcttttcataattgcttttactctagccattaattcattaggatcaaaaggtttaacaacatagtcatcaacccctgaagaaaagccacgtaacttatccttgctttcccctttggcagtaagcataatacaaggaacatctttaaactctttcatactttcaacaagttcaaagccatccattttaggcatcatgacatcgataattcctaaatcaatatattcattttcaaaaatggtcaatgcttcttcaccattggccgcttcaataacttcatagccttctttatttaaataaaatttaagcaattctctaatatcttgttcatcatcaacaactaaaacccttggtttcatcttatacacctcaattcaattcaaaattatatcataaaacaataaaataatacaatctactaggatttactttctaagaagtttgtcgataaagatacacaaaaaaaatttttattgtataatatatcaagattaaaggagatgtaaaaatgatattagaaaaaatagaccaagatttattagctttagctaaacaatcagataatgatttaaaagacatttatgcccaagtagatgaactttgccttgttaattcaaataaagttttatctgcttttatagaaaatcaagtttcttatagtgattttaccgatattaatggttatggtaactatgatgaaggaagagataaactagaaagaatttttgcttctattttaggatgtgaagatgctttagtaagacctcaaatcatgtcaggaacaaatgcattatatttaactctttctgctttattaaaacatggtgataccatgatttctataagtggtgaaccttatgattctttacaagaaatgattggtataagtggtgattcgaatcaatcattaaaagcctatggtgtaaattacgaacaaatcgatttaattgataatgaatttgatgaagaaagtattgttgaaagacttcaacaaaaaaatgtaaaacttgttgaaattcaacgttctcgtgggtatagtcaacgtttatcacttacaatcgataaaatagaatcaattattcataaaattagagaagttaatcaagaagtcatcattatggttgataactgttatggtgaacttgtagaaacaaaagaacctggagatattggcgctgacattgttgtaggatcattaatgaaaaacttaggtggtggaattgctccaacaggtggttatgttgccggtaaaaaagatttagtttacgaagtcgcacaaagacttactgcccctggtattggtaaagacttaggcgctaactttaatcttaacaatgctttctttaaaggggtgttcatggctcctaatgctgtaaaaaatgctttaaaaacagctattttttcttcatacatgttagaaaaattaggatatgaacatgtatcaccacgttataacgaaaaaagaacagaccttatccaaacattagatttacatagtaaggaaaaattagtgaatttcactcaaggaatccaatcatcaagtccaattgattcctttgtacgtgttcttcctgccccaatgcctggttatccttttgatgaagttatggctagtggaagttttactcaaggaagtactattgaattaagcgcggatgcccctgtaaaagaaccttatactttatatatgcaaggtggtttatcaattgaatatgggaaactttccatcttacttgctttaacacaaatgaaaaacaaataaaaagaagactcaattgttgattcaacagttgagtcttttttacatactccctatttgtccgccatcaattcgaataatcgaattatttataaaatcagcttcatcactaatcaaaaacttcactaaataagccacttcttcaggtttgccatagcgtttaaccataattttttcttgttcttcttttaaaaattcttcatcatagccatcaagttcattttctgtaccaataaatcctggtgcaatacaatttacatgaatatagggtccaaactcaaacgccaaattgtgtgttaaagaaataagcgccgctttagaagcatcataatcaatacacataggataatatgtattcatcccatttgtcgaggaaatattgataatacgtccatagtcttgtttaagcatatgtgctgaaacacttttactacaattataagcccccacaacattaacatctaaagtctttctaaattcatctgccgtttttaaatgaaacaaattagataaatcaattcctgcattattgattaaaatatcaacaccacctaatcgtttatcaatttcttgaatcattttttcaacttgatcttctttagaaacatctgcttttaaagccaaacaacgtacatgatattgttgaataatatgttcttttaaacattctgcttcttgatttgacgttaaataattaataacaatatcatattgattcttcgctaactctaaagcaatggctctaccaatacctttggccccacctgtaattaatacaactttacccatgataaaaaagagctttattaagctcttcctgcgtattttccatcagctgaaaaaacaacgattttttcaccttgttcaataaattgaggaactctaagagttaaacctgtttcagttttagcgtcttttgtttggttagatggtgcccctttgatagctggatctgtttctacaatagttaattctactttttcagaaacagaaacgtttaataataatccttcaaagaatactaaataaacttcagttccttcaacaataaagtatttattataaccaacttgttcttcagataattcatatgtatcatatgtttccatatccatgaagtaaaaagtattgtctgcttcataagaaaattgagctgcttttttagaaatattagcttgatcaaatttagttgaagcattgaagttcttttcttgaatagctcctgttttcaagtttctcattttagtttttaaaatagctgctcctttaccaggtttaacatgttggaaatccaacacttggcaaggatcaccatcaataattaaagttaatcctgttctaaaatctcctgcactaattgccatatactatctctcctattaataattttttacacgtcctattgtagcagtttcaatcaatattctcaagtactcctgaaaaactcctcgtgctttgaaaatattttattttaaattattttttaaaataaagatactttttctttattttggtgttctttgatatatctactccatttaatatatccataagttgtatttgtaaaataacccagttttaaagcaagtaaaacatattgtcctgacattatgttaataactgcttctaaaaatgcacatatataccaagcaatccattgttctcttaatctaaagaaaataaagagaccgttggcgattccaactgctgatgcacaagcgtcaatataaataatagctgtttctaatgttttattgttataaaaatcagtagcgatatctaaaccactaataaaataacctacaacaactgtccaaacaataataccaataataactaaaacttcttgatatccttttaattttcttaccattgtaagttcatcttcttcatcatcgcgatgtttagaccagttaatataactaataatatcaataggtaaccagaaaaataaagttgttaccattgttgcgaaacgatacattaaaacaacagaagaaacaatttctacaatttctaccaagacagaaaccaagaaattataccttgattgtttagatatcagtagttcacataaaatatttaagaatgtatctaataaataaagaatcataatgataataccgtttacgccattggcactatcttctgggaataacacagataaaatcgtagctaacaccataattgaaataaaccatgatttttcatatgttgtaaattgtttagagaataacatcataagcgcaacagataacattaaaataaatgttgcactcgctaaattgaaaacagataatgtttcttctgccatcatttctttataagtatgacttgcttcttgatgacttacatctttatgatcaaaataaagattttgtccattttctgttttgaattcatatgctttgattgaatttttatttaatttaacataatcttcataatcataagataccacaagtttttgatcaccttttcgataaatgacatcacaaactttgttatccgaatcataatcttcttcatctttatctctatccatcgtgacagattgaacatattgcagatctcctacgtctttatgaatttgcatcaaaccataaaaaactgaaccaattgaagtaaaaacaagtaaacataaaacaattatttcaaatgttcttagctttttattagattcgatattttttttgaaaaattgaatcattatttaaacctctcccttattttaaaatgccttatcattataataaatatttgtaaaaaatacactctttttttctatttattataattatttcataaaattgcaaaaaataggaataactcgtattcctattttaaattatttagctttaaattgactaataaccacactttgatgttcattcgaaataaattgaatttcaacttcatcgccagcttgtacaagcggtaacgaattagaaagggacagatccgcaatataaatatgatcatcaccctctagtttaaaataatagacactgttgccttctttaacagcactattaattgaagaaattttgccagttaaagtattttcttcaaattcttcatgacttttaccattttgagataaaacctcataataagctttttcagcctcagatacactacttcctgttgctacaatttgataatttttaacactgacaaaagcatacatcttaacaagattactactatcttttaaagaaaggaaataagtaggctctcctcctgcattgactaaaattggaaatgttgctttatattttaagttttgtacctttccttctgccgaagacattgccgaatattcttctgctccagaaatatgataatatttgccttcttttgtacgtaaattaattaatgcaaatccaacattacttgcatctttagaaacacttgtaagacctgtgtacaaataaacatcatcatcaataacaatataattatatccatctgttggttgtaacacacctttttgtgagaaaacagaattaatataaccatgtgtatattttccataattttctaactgttgaataactaaatctgctggataaacacgatctacccaattaggaacatttttaatatcataatatttatgcttaccatcaacagcgtttactaaaactgctcctacaatatcttttccaccaaagggacctattttatattcaaatacaggagcaatccaataaggaataccttcatcgttaatttcaaaagctaattcttcaaacattttcgtaggataattcatccttaaatgacgattaatatttctaccaaaatgttcagattttgaatatttcatgccttctttcaattcaacaacttcagattcttgacttaccatattcactttaacataagctggtaagccttcttttcgatttgttatccatttaattaaatcactatattctaatggtgtaattcgataaggagtatcttgataattaatttgttcataagattcatctacttcaaactgtgaaacataatctatcatttgtcccatttttcgatcacctagtttaatagcactttcacgatctacaacaggaattgattgataagaaatcgtctcattatctttataaaaatcagcttttttatttaattgtaattgattttgatatgtttttgcatgaaaaataggcaaactatataccgaaccaacacctatataaacaaataaggcaacgaccacaaacattaaatatttagatgttttatcaaatgtacctaataatatcgcatgtaaaataacaaagataacaattaaaaaaataaaatggaaaataaatgtttgagattgataatgaattggtagtaataaaacatactctcctataatacctaaaagacaaacgacaatcaatggaattaaatagctccattttttagttgtttgtattttagatgaagaaaaatgtctttttatttcatcaatgatactttgtataaaattattcatttattctctccttgatatcatttaataataaaggtaattcatctaaagataaaagtgttgcccccgaagcaaacgcatgtccgccacctcgatatttattcgcaatttcattaacaggaatatgtctcgatctcattgaaacacgccaattatgatcttttgtattttctgttatagctaaccatactttatattcatcaactgaacttaataaattaacaaaatcagagcctctttctcttgaaatatttaaatgttttaaatcttcatcttttaaaacatagtaagcaacaccctcatcttcaatataatgatttaggataaaagcattcacttttaaatctttcacatgtttcatatacattctttcataaagtgcttgcatatcaaaatcataattatataaatacattgccgcttcaaaagtacgctcatcagtagctgaatacataaatctatttgtatcccctataattcccatataaagagccgcagctccaaagcttgaaagttttacacgtttattttttaaaaacaaagccactatttgactacatgaagaagctgtactatcttctaaatttaaatttccataagaatcaacaacaatatggtgatcaatttttataatttctttacataaactaatatcaccatcaattctttcttgattagctgtatctaaaacaattcctaaagttggtttttcaaaattcggttcattgatttctccattaaattgatatttagccactaaatcagaagaaaaatcacctgcaaaatagacttctttattttcaaaagtattttgaattaaatcatacattccaaattgactcccaaaagcatcataatccggattaacatgacgatataaacaaatacattcatattcttctattttatttaaaatcttttctatcataattttcaccctattttataataacataccttagacaaagaaaaaacctgtttgcacaggtttataaatctaacaaacgaactgtatctcttgcaatcatgacttcttcatttgttggaatgaccatcactttaatttgagaatactgatgtgaaatcacacgattttcatcacttctaatgctgttgagctcttcatctaagaaaacaccaaatgctcttgagacattgtcaataattaaacgtcttaaataagcagcgttttcaccaactcccgctgtaaagcaaatagcgtcacaaccacctaattcagcgtaatattgtccaatatattttgaaacaatacgtgcatataataaaccagttaataaagcacgttcatttccttcgttaaataaggcattttcaatatctctagaatcagaagaaatgcctgaaattcctaacattccagattttttattatagatttctaaaacttcatctgctgttttatttaattttttacataaataaggcataactgaaggatcaacatctccagaacgtgttcccatcattacacctgcaagtggtgtaaatcccatagatgtatcaatacatttaccatcttgaacagctgaaacacttgctccatttcctaaatgacaaacgataattcttgattctttaggatttcctaacatttcaatagcttgttgagaaacatatttatgacttgtcccatgtgctccatattttcttacttttaaatctgtataatattcaagtggtaaaggatataaatatctttctttatctaatgtttgatggaatgccgtatcaaaaacaaaaacatgtcctacatgatcaggcaaagcctctttaaatgctttataaccaatgatatttgctggattatgtaaaggagctaactctgctaaatctgcaactttttttactgcttcttcgtcaacgactacagaatcatcaaaatcttctcctccatgtacaacacgatgtcccactgcatctatttcttccaaactttcaacaatatgatgatcaacaagagcatttaataataagtcaactgccacttgatgatcaggaattggtgtttgtgtttgtattttttctccatttactttaattacaaaatttccaacttcttgtccaattctttcaactaatcccgaagtgataacttcttcacttggcatattgatcaattggaattttaaagaggaacttcctgcgtttaccgccattacttttaccataatttacctcctagcaatataattatattgtacataatttagtacacaaaaacaatatttctaagtgaaattatcaaaaaaatgtaagctctttcaacactcataaaaaaagaatagtcctcttttattaagaaaactattctcatattactatttgttattatatgaagaacgagacatttgttcttgtcccattttaactaatcttttagtaatttctccaccaacagagccattcgctctagcagttgtatcaggacctaaattaacaccaaattcatttgcaatttcatatttcatttggtcgatcgcattttgagctcctggtacaactaatctattgctattattactttgtgccatgttgtgtcacctcctgacacttttattttgcatcaggaataaaaaactatacgctttttttaaaaaatatcttcatcatttttatagtttgcatcaacaacaattgtttcaacattttctacacattcattaacatatgtttcataatcaaaagttgcttcaaaagcttcagccttataactttttggttttgtagcaggtgctttaggtgtgaaaattgtacaacaatcttcatgtggtctaatagaaatatcataagtatctattttttgagcaatatcaataatttctaatttatcaagacataacacaggtcttaatactggaattgaaataacttgattgattacattcatactatctaaggtttgtgaagccacttgtccaatactttcaccgttaacaagtgctaaacaatgattttttatagcaagtttttctccaatacgatacatcattctacgcataactgtcatggcataactttcatcacaatgatcataaactgcaagttgtaattttgtaaaattaacaacatgaactgtaatttgaccatgtgtataatgtcttaatttatctactaaatcaaaaactttttctctagcaaattcatttgtgtatggtggcgctgcaaagtgaacacattcaatatcgacaccacgttttaaagttaaatatcctgctacaggagaatcaattccacccgataacattaacaatgcctttccaccaataccaacaggatatccacctgcacctttgataacatttgtcataacgtaaatagcgtcatgtctaatttcaactgtaaccaacatttctggatgatgaacatctacttttaactgtctatctacatgatgaaaaacatgtcctgcaatttctctattaatgtcttgtgactttttaggaaatgttttatcactacgttttgtgttaattttaaacgttgtttttgaatcttcgttgatcattttagcaattgcatctttaacaacatctaaatcttttttaaatttataagcatttgaaaaagaatgaataccaaaaactgtttttaatttttcattgactaacaaatgatttgcaccatttagataaatgtataaacgatcatattgtaattgatattgtaattgtggaaattcaaaaagaatttcttttgtgttttttaataatttttgtgtaaataattttctatttttaccttttgttgtaagttctccaaaacgaacgacaatataatttgcttccatatcttacctctgtttttttattgaatctaatacttctttcaaacaataaataaatttatcaatttcttcttcttttgtcaaatcacttatacttactctcaaagcactttttgcaacttcatcaggcaaatgcaattgttgcatcaccctagaaacatcacttgttttagaactacacgcactccttgtagaaataagaatatctttttcctccaaagcatgcaaaataacttctggtttataaccaatacatgaaaaattaacaatatgacttgacactttatctccagtgttaataataacatctggaattgtctgtaattcttttattaaatatttatttaatttcgaaacatatttttctttttgatcaaaattttctaatgctaatcttaaagttttagcaagaacaatatacgtgcaagcattactagttcctccacgtaaaccaaactcttgctgtcctccattaataagtggtactaaagtagtagattttcttttaaaaagcaatccgctcccctttaaaccatttattttatgtgcagaaaacgatgcacagtcgataccttttaaatctatctttatcttacctaaagcttgcaccatatcaacatggaacttaacaagcggatgatctttgagtacattttttatttcctcaatgggttgaatagatccaacttcattattaatacacatgacactcactaaaatcgtatcatttcgaatacttttctttaaatcatcaatatgaatatgtcccgtatgatcaacaggtaaataagttacttcaaatccaaatacttcttctaattctttacatgtttcatacactgaagaatgttctatcgaagttgtgataatatgtttccctctattttgatattgaaaagcaattcctttaatagccatattgtttgcttcacttccacaacttgtaaaaatcatttcttcttcatcaacatctaacattttagcaagtaaacctctcgatttttctaataagcgattcacttcaattccttgactataaatactatcagcattataaaaatatttttctaacagttgtgtatatgtttttaaaacatccttattataaggtgttgtcgcagcataatctagatataccatatttccctccatattttatttttattcaattttcgataacatatgaccctcatgaaaaaagtcctattcagccttaggactttttttattaaccaacatttcataagaatccggttttattttttcaataatatcaacagctgtggataaagctttagtatattccccatttctataaagtaattccgcttttgtaagctctgtattaacttctaaaaatgaagaacgatatctatttccaaaaacaattgcatcctctaccatttcagcagtaacaatcaaattatgcacattatcatacaatttataaataacatctcttgcagcatctacttgaagtgataaactctttaaatcaattggtctttttctaataaaatttaagatggaatctgctttttgataagagtcatcaatataatcttgataagattcactaatcattggtaaatgtttatttctaatttcagatttaatttctaataaaacaatattaatattgtctaactcatccaaagctctcttttcttgaatacgtaatgtttctgctaattcaatatgtttaatcaaagaatcattatatggtttactttgttcaacaattcttgaaaaatcatcaatcatttctatataagaaaaatctttagtttcaataatctttgtaatttccgctaaatcatcaacaattgattgaaattgattataatcatcttctattgtaatcgtataatcacctaaaatatagtttttttctaactcatgaatactttctttagcttctaaaagtccactttctatcttattaacgaatttataacattcatttcgtttttcttcgtagagtgcatatgcattcttttctttttcaaaatcagaatacaatagatttaactcatccgtcatgacttctatattttgtccaacgttttccaattttaaattctttatatttttttctgtctcgtgtaaatcattatcaatcttagaaatacggatcgtagcattcattctttcaacagcaaaatctttttcttgcatatcttgcataattgactttagttcatttaagcgttttggtaaatattgacgaacaacagaaatatatgtaggtaaatcacttaactgttgatccaaagcatcgatatattttgaaatatcttctgtatatgtcttagcttcttcaaattgttgattattcatataattttctaattcaacaaagcgttcatcaatatcatgaaatacatcttgtactttaggaacgtagtcttcaactttaaaacgaatctgtgcatagttatcatttgtagcacgatatttttctttaactttgataatttctaatctttgaatattttcaatttctgtaataacttctatatcttttaaaagttgttttgattcctttgcataatgaatcactttttcctctaaagagttcatctttttttgaacacctcgtaattttcgataataaagtgcttcatcaatatcattaacaagcggaatgatttcatcattttgaagatctgttaattcagcaaattttgcatcataagtttcatatttttcttgcaattctggcatatttttagcaattccttttaccctccctagccgatattgaataggtaaggatttaattgcattcattttattttctaaatcaacaatttcattacgataatgttttaattttaacaagcgatatgtcaaaataaccaatatcaaaactaaaatacttaccgaaataataataattgttttcattcctaatacttttataatttcattcaaatatttcatgttaacaacctcttttaatcacatttctacatataagtatatcatgaagtcatatacttgtctaaatctaattttctttctttgagataaaataaaacgaagttgtaaaaatcactataaatccaattaaaacaaaaaaatcaaatttttcttttaataaaatcaaagagaaaaaataggtaaaagcaggactaaatgccataaaaaaacttgtttttaaaggacctattgaatgaattgataaaaaataaacacattgaatataagcatatccaattccagaagttaaaataaataaccataaagaaaaagtgtttactgttttaaataaatcattcttttgaaacaacaaaataacaataaattcaaaaaaagctattaataacatatataagttataaatgaatggattatgtgtaatatcttttaatcgataattaccaaaattgtaaataaacaatgccgttattaaaaaaaagattccctttcctatattaaaaagtcgaaaatgagtggctaataaaaatcctaaaaaactcatcatgaatgagatcagaattttccaattccatttgcacaaagaaacagatacaataaacatcataactggtgctaaacaattaatcgttgctgtcatcgtcccttctacatattgcataccataatatgtcaacaaaaaattaataacattaattaaatttgtttgcactattaatttttttatagatactttttcaaaagaaatttttttataataaatataaaacagcagcgctaatacagaaaaaagtatctttatcattgctaaaaaaagaggatgaaaagaatcataatttaattttgtaacaatcacatttaatccccatattaaatttgctagaaataaatgaatataaagcaattttcttcacctcttatattttagacaaaagaaaaacatattaatccagaaattgatcaatatgttttttatctttttgtaattgttcttttaaatgatttaaagatttaaatttcttttcatctcttaccctaaacacaaaatccacatccacatcttcaccataaatatcttgatcaaaatcaaaaatattgacttctaaagataagttatcaataagccctactgtaggattataaccaatattagccattcctttatattgctttcctttaatagttatatagaccccataaacacctttttttaaaacaacatagtgtccataatcaatattggccgtaggaaaaccaatctttctcccattttgcaaaccataaataacctgtccagagacacgataaaatcgtgtcaataaatgatttgctttttcaataattccttcattcaacaacttttttatgtacgatgaagatacttttaatgcatcttcactgtactcttctatgacagtgacatcaaatgatttattttcttgtaaaacatgtacatcacccattcctttttttccaaaatgaaaatcaaaaccacatacaacatgttttatttgatgatttataatataattttgtaaaaaagtattgggttttaaatttgcaacagtttgatcaaaatcaataatataaaaatagtcaaattgccattgttttaaaatatttattttttcagataatgacatcaaataatgataatcattattttctaaaatttgtttaggatgtacagaaaatgtcattattgctttttttagtcccttttctttagcaatatgttcaacctcttttaaaagttgttgatgtcctaaatgaacaccatcaaaaaaacctagtgcacaaacagaatcatgaacttgcatgggagtatcaactgacaaatgaatgatttccatcaccatagacctctaacatttttcaaatagccttgtcccgtactttcgtaaatagctaataaatgattttgattatcataaatcgctacttggccagtcaaatcacttttaatttgtttaccatgataaactggcgttggatcatctaattttaattgaggaaagccacacaaagcgtcatctattgaatgtaaagaataatcatcattttctaactgttctaaagtaatacaatcagtaattaaaaagcgccctgcctgtcttctttctagatgagacatatgtcctggataccctagttttttagcaatatcaacacataaagaacgaatataggttcctttagaacatttaacatcgaaaacaatctcattatttgaaaaatcaattaattcaatcatcataatctctatatcacgttctttaatttctacttcttcaccatttcttgcatactcataaagctttttaccatttactttaattgctgaataaattggcggtttttgcttagattttcctaaaaatgaatttaaaacatcaataacttgtgcttttgatatttgtccaacttctttttcttctaatatttttccactggcatcatatgtatctgtacttttccctagcgataaagttgccctgtatacttttgtatcactcatcaaaaattgaattgcttttgttgctttattgacacatacaacaagtacacccgttgcatcaggatctaatgttccacaatgtcctactttttttgtatgtaatttttttcttactattcctacaatatcatggcttgtatagcctgcaggtttatttattaataatattccatccatttataatcacctcgtatattttaacaaaatcctttctttttgaaaagaaaggattttcaatcacttatttaaatattgaaattatccaattaataataaagatcataatattaataaaaacaacagttgctccaacaggagttgaaaacaatattgataatataattcctacaaatgctccaataactgataaaattgcagaataaataacgactcctttaaaactatttattattttcattgctgacaaagctggaaaaataagtaaagctgtaattaataatgaacctactaaattcatcgcaagaacaataataacggctgttaaaacagcaataatcaaattatataattctacttttttacccgttgccttcataaattcttcatcaaaagtaactgcaaagattcggttataaaataaaacataaaacaacacaacaagcaatgacataacaatacaaacgattacttcaaaatgtgtcaaagttaaaattgttgttgacccaaaaagcgttgaacaaacatctccagaaacattagctgaagttgaaaaaatgttcattactaaataaccgatagctaaagcccctacagatagcatagcaatagccgaatctccttttattttagtattttgccccgtccttaaaagaaaaatagctgcaataactgtaacaatcatgataaataaagtttgtgatgtaaactgtaaaaccgtcgccacagccattgccccaaaggcaacatgtgaaagaccatccccaataaatgaaaaacgttttaaaacaagtgttactcctaataacgaagaacataaagcaattaaaactccaacaattaaagcatactgtacaaaaggataagaaaaataatattgtaatgttgcaataaaattagtcattataaatctcctttccatacctttcaataaacatttctttctccataaaaatgggaacttttttctttaaatataaaacatgtgttgcatattttaatacagataagtcatgagaaaccatgacaatagtcattccttgttcatttaatgattttaataagccataaaattcttgtgtaacctgaggatccaaaccagttactggttcatctaataatataattttatctgaagcacataaagctcttgctaataaaacacgttgttgttgtccaccagataactggcgataacttttattttgtaaatgcgtaattcccaatttttccatttcttgttttgcatgttttttttctttttttgtataaaaagggcgatattttaattgtgacaacatacctgataaaacaacttcatagacagttgctggaaaatctttttgaacaactgtttgttgaggaagataccctatttctgatttttttaaattttcagaaaataaaatcttacctgcttttttttcttttaaatctaaaattgtcttgatcaaggtacttttccctgccccattttctcctataatacataaatagtcatttttattaatttcaaaatttatatttgaacaaacaatttcactatcatatcccaatgataaatcttctatctttatatatgacataatatctccttattttataatgcctttttaaggacttttaaattatatttcattgcctttaaataactataaccatccttgattttctgatcatcaactgactgtaaagaatctaaatacataattttttgatttttcttttgtgtattatctttaactgtttgtgcaatttttaaatttgtttgatcaataacaaaaatactttttaaatccaattgatctattttatttgctagaaaagtaatcgtataaaaacttgcttcgatatctgcagaacatccaggaaaagccgcataataattaagatcataatcatccagtaaatatctaaatggaaaacgatctgcaaaaagtaatgttttagtagtggcattttctaccacttgttcatattgatgatttaaatcatcaatatcatttaaatagcgtatcgtattttcttcatatgtttttttgtggacatcatctaatttttgcacttcatttgatagatagcgaaccacttcatgtgcattaataagtgaaagccaaacatgttcatcatattcactttcatcttcattttcgtcgtgatcttctttcattccttccacatgttcttcttccttgattctctcttttaaaacatccatcatatcaacaactaacatatttttattttttgcttcttttaacgcatcacttacccattggtcggattctccaccaacatatacaaataagtcagcagatgatacctttgctaaatcttgaattgttggctgataactatgtaaatcagctccatctttaataagtaaagtaagttcaaatgttgaattattctccccaataatttcttgtaaccaattatattgggcatacgttgtacaaacaatactttttttatctgtttctttatctaagggtaaacatcccatcagcaaaaaacagcataataacataaatgtgtattttaataatttgttcattttaactccttttccatcatacatgttttgcataaaccaccaatagtagaaatatcacagtctaaaaagaatttataatctttttctagcattgcgatgatagaatccatcgattctttttttatatgaataattttcccacattctttacattgtaaatgaagatgttcatgacattgactaaactgttgattgagacgatacatccaaacatcattattccccgatttatatttaattaattgtcctgcatcaacaaactgttctaaattcctataaacagttgagatatttactttcatttcatttgctacgatataatcgtaaacatcatgtgctcgaaagcatttatcacaacacgttttcaagtaattttcaatcaattgaaaagttttcgttttataacgcatattaccacctcttatttgcaattcatttgcattttcctagattctagcattcctcttttattatgtcaataaatatgcaattcatttgcaaattaaaaaaccatctttcgatggtttctaatcatgtataaataccatgtctctcatagaaacaagattgtaaatatttttaacatcttctaattgtaaattaatacatccatgagaacctcttgttttatataattcaggcgaccatttatcccaatcacttcgattcatataatgatatcctgttccagtccatgtaatacgaacccaatatttagttggtgttgtataatccgcacctgttaaagtatattcgagttttttatcttttatataccagcatcctgttttagtagaacgtgttacatcacttggaagtcctgttacacattttgcactataaacaacttgtccattttggaagacataaaccatttgctctgaaatatccacttcgctatatgtttgagtattataatcttctgttggattttcaaagttcattttgtaagctttatttttataaataggttctaacttcttaagtagttttttcttgtttgtattacttttattttttacatatgcatctacatcactttgcgtattattttctgtcaacgctttataaacttgatcaacagtttgactataatcaatttgccatccataatctccaccagatacttctaataattcaccagtatgtgacttgaattttcttgtttttcctactgttttgtatttcaaacagaatttttcaacccattgtgccattttttcttgatcaattgaaacagaagcgtcatcaccaataactatccaatctttaatttctttaggggaaattgtttcatagtgtttttcacccatatcaaaacgaacccaacgacataagtaattattatactggcttagctcatttagtacctctttatcagtttgtacatattttggttttaaataaacatttgccttatctaaattgactcttgtctttaattgttgaatagacttttcaacataactataaaacttatcttgatctaattgatttccttgtttttctttaataactttaccacttttagcagtcttatcatattccacatgtgcatctactggtgctgtaattttataattatctcctgttattaaaaatgattgagaaagattatttttaaaggcctctttattataagaaacatcaaaatttacatcaaaatcttcacctgaaattattttataaaacgaaaataatccatgtgtctttttaaagcaatcttctacttgtttttcataattagcattcaaatcaatatccgcgcctcttaattcatattttgcattatttctgcctttaataacaagaacatgatttttcaaatccgtttgaacagcatttttagcttctgacaaagtcatatttgaaacatctattccacctattgaggtatttggataaaatttatcattatacaaaataataatgataaaaagaagcatgataatggctataaggagactcaaacatattttagcttgttttgttatttttattttctttaaatccataaaattcacctacttgcacatattctataactttatttatagactgtcaaaaaaaatatcctaatcctctaggatatttttaacaatcagatacatccatatccaatcccaattcacgtggtaaaaaacgtggacatacattttctgatgatgtaataacagaagctgctaattttgttccaatttcaactgcatcagaaagttcttttccataagtaagtcctattgttaaccctgcacaaaaagcatcaccagcacctgttgtatctctaacagttacttttttagcaggacagattcctttatttcctaaatggtcggcataaatacttcctttgcttcccattgtaacaaccattgatttaatagctcctgcagaaactttttgataaatgattttacataaatcttttggactttttttactataattttcagcaaagaaaatacctgcctctaattcattgcataccaaacaatcaaattgttgtaataagtctcttctttcaactgcaagtgtcatattcgaaataacaccaaatacttttttgttatatttttttgaataatctaaaacagcttttataatttcaggatcaatatcagcttctaaaacaattgaatcacaatctttgaatatttcatcgcccttttcattaattaaatccaaaattggcattaaatttggacgttgagaaatagaacctgccaaatcaccatcattatcaaatacagctagccatgttcccattccctcaggaattttttgaacatattctgtattaactttatgtctttgtaatttacgaataacatcttctcccaaagcactatcatcaacaattgataaaaatgttggacgtaattcaatgtttgctatatcttctaccacatttctacttacaccaccatgaatatatttaatatgtcctgcatttcttccagttggaatatatgcatctagtggaaatcctttaatatctacaaaaactgctccaattactacaatacccatattatctactctctttcttgttcatcttttataatataacaaaaaataaaaaacaagaaaagaatctttcttgtttttattgattattttctttcatgacacccactaatggatgtggtttataacattcttctaaatatttcatttcctcaactgttaattttaaatcacaagccttacaagctgtatcaatatgacttaatttagttgcaccaacaacgggtgaagttactttagacatcaaccaagctaaagaaatttctgacattgaacaatttctttttttggcaagttcttcaactctttgaatgataacaagatcttctttttctctttcatcatattttcctttagcataggtatcttcttttaatcttttagatgtttcccctggatgtcttgaaagtcttcccgaagcaagtgaactataaggtgtcatagaaacacccattaaatcacaataaggtttcatttctctttcttcttctctaaagattagattgtaatgtccttgaattgattggaaggttgcccatccattgtttttagcaatttcattagctctagcaatttgccaagcaaaacagttagaaacaccaatggctcttactttttttgatttaacaagatcatttaagatttccattgtttctttaatgggtgttacattgtcccatcgatgaagaatataaagatctacataatccatttgtaatctttttagactattatttaaacatgtttcaatatgttctcgagcactgactccttggtcaatttgtacttggctacgtggcataaatttagtcgcaataacaacatcttctctttttgaaaattctttaattgcacgtcctaaatattcttctgatgttccaccttgataacccattgctgtatcaaaaaagttgattccttgatcaagggcatgtttaatgatttttttagattcttcataaggaagtgtccaagaatgcattcctgcttgtggatcaccaaatcccatacatcctaaacatacttttgaaactttaatatctgtcttacctaaattaacgtattccatatttcctcctagatttgatgtctaatcacatcttttaatgtaaatgttccattatcaaattcataaataaaaatacaacaatttccaaatcctttttttaattcttccattggatcttgaaaagctcttaaaaagttaaaacaagcccctctgtgactcacggctaaaacactatgatggtcttctttattcataatttctgttaaagtttttaccatacggtctcttgtcgtattagaggattctcctttatattgtaaatagaatgtttcacaatctttaggtgttaaatgagaatttaatctttcactttctccttctaactccccataataattttcttttaaacctttagtacgtacataaggcatatctgtcacaagttctaatgtatcacaacatctttcactcgtacttgaataagcatgatcaaaagtaatatcgtgatctttaaaccattttcccgcaactttcgcttgtttgattcctaattctgtaagtggcgaatcacaccacccttgaatcttatgttgtaaattgaataatgtttgtccatgtcgcattaaataaagtgtctttttcatacatttcccttctttcacttttattgtaacatgcttataaaaaagagtaatttataattaaattactctgtcaacaaattgacaaaaaagattatttgtcaattttataaggatttgttgtacaatcacttccttgaaataaatcatccattcccagtcctcgcatttgggtaatcatttttgccatttcttccacagggactttcatatcagatagaatccatgataaagtcattgcacttgaagcattcgcatgataaatagtggcgaatcttaacgcatcaggcattagtttttcaccataaagttgttgatgccattttaaatcaaattcctcacaatgtttaggaatgtattcctttaaacaattttgtccatccattaagcaagcctgttttaaaaaggtttgatattgtttcatatgttcaaaagattcgataagtgactcatagaaatcaagatttgtatttggtccattaaaatgattgataattttatgattgtaaatatattgaattaaatcatttttatctaggaaatgattataaaatgtttgtctactaactcctgttgtttccaagagatctttaacttttacttgagataagtcttttttgtggcataagtctaacaaaccatttgcaagtatttctttaatatcaattgccataaaaatactcctttcttagtttgaaaacattatatcttaaaatcctctttttaaataacttcaaattttgtccaagcatttgatttataacgataatagaaaataattgcacgaattgtccaatcgccgcacattgcatgagcaattccaataacacctaaatgaagtcctaaagcaaaaataatagataagacaagtcttccacccactgttgaagcaattgaaacaatcatcgtaaatttgacatctcctgtagctcttaatccttgagataatggtccagaaagtgggaagacaacggtgttggcaatattatgaataataacaagaataataatcaaatgttttgtttcatctgcaagattataaaattgtaggataaatggtgtaattgctaaaacaagcacattccatacaatcgaaaaaacaagcgaccatttaataagttttgaaaaatagaattttgcttgatttacatcttttgcacccatgcattgtccaataacggtaataaagactggtcccattgctgaacccacaagtgccgctaatgaccaaatactttgtgcaaccccgttggctgcaatttgataggttccaaacatcgccacaattgaacttaaagccactttaacaagttggaaaattccattttcgaccccattaggaattgctatatttaaaatacgtttgagcatcttaccatcgaatttaaagatatcttttgaatcatagtaagcttccaattttttattaaaacataaaatagtgataataattgctgaaaaaacacgagaaataagtgaaggatacgcaacccctgcaactcctgcctttaaaacatagacaccgataatatttccaataacattgatgatattagcaacaaaagaaatatacatcgttacttttgttttagccatcgaacgatataacgctgctcctgcattatatattgactaacaacgattgccccacctgaagcaagtgctgtaaataaatagataaaaattgtattgaattgattgacaagtgatactccggaaactgctgcttccccacaactacttacgacaaaagtatcgacaattcctacaagcataaccagtaattgttcaaaaaacaaagtaacgatcatgcttcttaattctttattagaaaacatttttcatttctccccttgtcttcattataaaaaaagaagcataaaatgttaaatgcttcttttatagtttatatcatgcttaacaagcatcataaatcccagatctttatttcttgatacggatttgtctttgctaaaacaatcttaataacttttccatgaaaaggttcaaaataatgatttaatattttaaatgcttgattagtttgttgttcatttaactttctgcttatagaaacatggggtacaaagtgatacggtaaatagcgattcttttgtgaaatggaaacattttcatcaaaagtatgatgtacttttaaaatcaactgatttaaaaactcattataaacaggtaataaatagagcgttgatttttgaaaacaccctattgaaacaaaataaagttcttgcttctttccttttgtaaaaagctcatttgccaattcaataaatttatcttcctttatttctttataagtcgcaacagtgagatgaaaaggaatatgatgtttttctaaataattttgatgaagttctttttcaatctgtttacttagaaaagataatttttgatttgttttttcatcaaaatacaaagataaatgatacatcttatttttcaatatattccttttctaagttaaatcctcttccttgaacttcatgaacatttgagataatcataaacgcatcttcatcaatagattttacaagtctttcaacttgaacaagttctcttgtcgaaataacattaattaaaacttctgtattttctaataagtagcctgtttgtccatgaagcattgttactccacgatcaacgttcgttaaaatagcctttctaatttcttcatatttcgaagaaataattttaacttcgattttttgagcacccattactaaaatcttatcaataaccattgtataaataaaaattaatacaatcccatacagacattgtctaatatcagaaaaaccaaattgtactaacacaattagtgtatcaaaaacatacattgaaatagaaacaggaattttaaataatttatttaaaataaggggtggaatatccatacctcctgttgaagcccctgctttaataacaatagcaatagcaaccccaactaaaacacctgcaaaaagtgtgttaattaaaatatcatcggttaaataaaaaccttgaaaagaaaattcaaacacacctaaaataaatggataatagaaagttgaaataagtgtttgtaaagcaaatttctttcctaaaataagtgcaccaataataaaaacaataaaattaaaaataaaagtaaatattgaaataggtaaatgaaaataatgatttaaaaataaagaaatacctgttgtccctccacttaataaatgccctggaacaataaataaaataaccgcaagtgcaagtaacgtatttccaagtaatatactgataatatcttttttatttgttttcataaattcctccataaaaaaaccacactgtttttttccctaacaatgtggatcaaagcattcgcttaatacatttgtattatagcatatacaaaattcttgtctagaattttgtataaaaataaaaacaataaatcaagatttgtataaataaaatcaacggcatacctatataaaatttcacatgtttcgttttatgatgaaaacaatacatacctaaatagcttcctaaacttccacccatcaaagccacaaaaagcaaagtattttcagaaatacgatatttttgtttttttgcttttgctttatcaagacccattatcaaaaagcctaatacatttattattactaaataaatcattaacaatctcctaatgaatactgacatattgtttctttgattacataataattcatttgtgtaacaactaaatcatctagcgtacaatgaaacaaataacttaaagcacataaatgttctaaattaggtaatgactttccttttagccatttataaacactttgtttacaagaaagtcctagataagtctgaatatcttgaacacaatagccaccttgattcatatacttttgtatttgtttgcctgttttttcaaaattgatataaggatacattacttttctcctttataatttttttattaatcttcgaatatgacattcaaaaataacatacataccaaaataaatagcttctgaacatacagcaatcgaaaacatcaacataaccaacgccgctaacggaccataaacgttgctataatcaacaatagaaaaataaatagataaaatacctataatcaattcaatcaataatgttgcaacgactgttcctttaattgtatctaaaaattctacattttgatcaggaataattttatataataaaaataaaataacaaaaataatgataaataagaataaaactcttgttataaaattatgttgatcaataaagataatcttaaaaatcggaaaaataatcaataaagaaatcactgcaagtattaaaataaagataagaatggtttttaaaaaagtaattccttgatcaatgaaaaatggatattctttatcattaggaaacatatttttagaaatacgatgtaactgataaaaacctctacttacaacaaagatagacgctattaaagttgttatagttgttattgataaagaacgtggttttatcagttgaataaccatttttgtcacatccggtcttaaataatatgataaaatttcttgtgctgttttaagatctaaaggaaaaaacggtgtaaaaaaagctaataatgtacatattgggataattgaaagtatcatataataagcaaaagacaaagcagatgcaggtggtactttatagcggtaatctaaataatatccgtatataaaattaaaaatacttcttaatttttccataaccgtccctccttattagatagtataccatattctttatgaaaaaaagctcctaagagcttttatccattatattttaatacaaaataatttttctttcctcgacgaataactgttttgctttgtccaaaagcatcttcttttttaacagtaaattctaaatctttaatacgttcaccattgattaaaacagatcccccattaacaaattctctcgcttctcttttacttttagcagctccaactaaaattaaaacgtctaaaatattcatttcattttcttcagtttcaactgttggtacaccttcaaaagcaacatcaacttgttctaaagttaaattttgaatttgaccagagaataatgtttgtgaaacttgaactgcttcttcataagcttctttaccatgtaagaatgtaataacttctctagctaaagctttatgtgcttctcttaaatgaggttgtgttttatttttttcttctaattccataatttcttctggtgttaagaaagttaagaattttaagtaatcaataactttatcatcttctgaattaataaagaattgatacatttcataaggagaagttttttctcgatctaaccaaatcgctttaccatttgttttaccaaattttgttccatcacttttagttaaaagtggcattgtaaaaccataggcttcttttccagttttctttctaattaattcaataccagcagtaatatttccccattggtcttgcccagcaacttgtaattgacaatttttattttcatgtaaccagtagaaatccattgcttgcatgatcatataagaaaattcagtataagtaatacctaaatctaatcttctttttacaatgtctttattcaacatataattgacattgaaatatttaccataatctcttaaaaagtcaataaagtttaaatcttttgaccaatcatagttattaaccacttcaaaaccaaaaatcttttgagcttgtgcttttaaacagtcaaagttatgttgaacttgttcctttgtaatcattggtctttctgtatcaggtttaggatcaccaattaatcctgttgctcctccaactaataaaattggattatgcccggcatcttttaatcttttactaattaaaaatgatgaaaaatgcccaatgtgcaaactatctcctgttggatcagttccaatatagaaagttaatcctccattatttaatttttcttcaatttctggagaactgacatctttaattaatcctctccaaactaattcatcataaatcttcataatttcctccttaaaataaaaaactcattcccataggaacgagttgatcgcggtaccatcctaaattcatgtcaaagacatacactcaagtagataacggcttgcaccgtctaagctttgcacttagaagctccagagtgtattcatattatctcttggcttgtttccaccaaccacaagctctctataacaattaaataatattacttatctccttcattgctgtaaatacatcatattaaatttcatattcaaagtcaagtgaatataaaaataaaccactttcgtggtttattgaatagttgatttacgataaatatttgtatagcctacgcacacttcttttgtttctaattcttcttgatttaaaattttagtaagtaaacgtacagccaacgcacccatatcataaattggaagatgaatcgttgatagtgatggtctacaaataagtgagtagcttgtatccatcatagccataacttccatatcatctggaatgtttatgttattatcgattgctgcattaacaactgcaaccccttctttatcataacttgcaaaaactaaatcatgtttatgatttctaaaatgttcaacaaattgtgtatagctttcttcatagtgagtagaagtattaataacctgtgttgactcatcaaatggtaattgatgatcttgataagcttttttcattccttcaatcaaatcaactgtacgaataagattttgttgaggacttacaaaaataatatcatttttacctttttctaaataattattaacaatatcatatgtaatcttttgtgcatcaacataaacagaacctatcgattcatcacttacttgcattccaataacaactgctggaatactatgttttttaacaagttcaatttgttgatcaatattatcgttattaaataatataactccatcggctcttgtgcgaatgactttttccataacgtcgtccattggaccatttccaatatcatctgttgtataaatcgtaatattgtaatccaatgttctaccagcatcaccaataccaccaatcatatcttttacatgagcaaataatgattgtgggaagataattgcaatagttgtagttttgtttgtcgcaagacctcgagcaatttgattaggtttgaagtttagttcatcaataaccttcattaccttttctttagttttttcacgaacaactgatgatccattaataacacgagatacagttgcaagagaaacacctgcttctcttgcaacatcataaatcgttgcttttttcattagtcttttaaatcatcgatgatgacatttaaatcatcttcaatgtcattaatttcatcttctaaatcagaaaaatcatcaaattcttgttcgctcattttttctttaacttcattaattttatcattcacttggacaataacattatcaacttgatcttttaacttagaatattggtcgctatcttgtaattttgttacaacatcatcaaatttatcttttaattcatttaatttcgctaaagaactatctttaaagtcatcaacatcaaattcatcaactgtttttttaatactatcaattgtttcactaattaatttttgatagtcttcaactgtcatttctttagcactatcaagagtttcttttcctttaccttttaattcttctcttaactcgcttcctttttttggtgccaataacatcccaacaagagcaccaattcctaaagttgttaaaaatcttcctaatttcatattatctcacctttctattttttcttaataaagctcatcatcattttcaatggattaaactttggtctttgaggatcaaagaactttgcaactgtttctacaggcgcatttaataagtctaatttgtaattgacatcatctaagactttatcaactcttttcaatgtatcttgtgccatttcaacagtatcccctgtttgtttaatcgctgttgatgtacgaataaacaacacccctaaagcaactaaacaaaatgcacctgctaaaattaaaacacagtaacaaatgtccattgttgtcataaacatccctctactttcattaataattgtaccataatttactctttttatataggttttttggcttcaatcaacatttcttcaaatttataaatatctttactactcataaataagaatacacagttatcatattgcattaattctttaacacctgcttcatcttcagtaatgactttagcacgtgcactattttttgaaatatcatagatatcaatatcaataccgtcttcatgttttgcattttctgggaatggacagaaatatgggtaatccgctttatccatttcttgagcaaattctttagcaaaacgcgctccccttgaaaaacgatctggttggaaaatggcaacgattttcttaccagggtatctcactcttgttgcttcaataacatatctgattgcagttggatgatgtgcataatcgtcaacaaaaacattgtttccttgagtttttacagtataacgacgttttgttcctttgaatgtttgaagtttacttaaaatatagtcataagacatatcttctaaataaccaagagtaataatagctaatgaattatataacatatgcattccaaataatggtatgttaaaatgtccaaataattcttgatgaatataaacatcaaatgataatccttgtggcgtttctaaaacattaacagcgcgaacatcattattttcacctaaaccaaatcttaaaacatgtttttcaaaatgaattttcttaatgttagggtcatctccccaaacaataactgttttcttaacttgtttagcaaattgttcaaaagattgaatatatctttcaagatttccaaaataatcaacatggtctaattcaatgttattaataatggcataatctggatgataatgtaagaaatgatcttgaaattcacatgtttctgaaataaaatatttacttcctacttgtccatgtccagttccatcaccaattaaaacagatgttttatcaaaatcttcaaataaatggtaagccatacctgttgttgttgtttttccatgtgttcctgcaacagcaatagaaacataatgttccataaaatcagctaagaaatcataatatcttgtacactttacatttgggttttctaaagctgctttgacttcttcattggattcatcaaaagcattaccaataattacgtgataaccatcctttatattatctttattgaatgaataaattggaatatttctttttctcaattcatcttcaataaatatatatttatcaatatcacttccagcaacttcgttccctaattcatataaaattgttgctagtggagccattcctgaccctttaattcctataaaataatacatacttgtcacctcgttaactattctatcacaaattgatttctttttctttgttaagagtatattttttaaaaaaaacgagcaaagcccgttttgaaacattctatgtaagtttaaacccctaaactaatacgaatacatttattaatacgttccatttctaatggcgttaattcccctatttttctaatcaaccgtgatttatcaatggtcctcatttgttcaagcaaggcaattgaattttcttttaaatcatctcttgatttaataaatgtatgggtaggaatatttttctttttagatgatgtcaaaggtgaaataataatagttgtactaaatcgattcccactatcattttgaataacaacaacaggtcgaattccagattgttcacttcctacacctacactcaaatcagcataaaacaaatctcctctttttacttccatataattcatcctttcttttgatattattatataatttcttgttgacaaaatttgtctatttaaagaggttttaaaaatattttttcactttaaaagtttactcatttttttcttttttatacaaaaaaacgagcacaagctcgtttttaaataatataaatatcttttgtaaatgaatttaaaacctgacatctatcttttgtcaccataactagatcttctacacgtactccgaaatttccttctaaataaatacctggttcaattgaaaaaatcattccttcctcaacttccatttcatttaccgaagagacatctccatattcatgaacatctcgaccaataaaatgtcctaaacgatgtgtaaaatattttccatagccttcatcactgatgacttttcttgcacacttatcaatatctgataatttaactcctggtttgatcattgcttctgcagcttcatttgctttttttacaatttcataaactttaatttcttcttccaaaataccttcataaaagaatgtacgtgtcatatcagaacaataccctttataaacacatcccatgtcaatcagtacacaatcaccttttctaagtggtgtatcatcattttcatgatgtggatcagcagcgtttttaccaaatgcaacaatcgcaccataacaagtagaatgatgattgaaaaataattcatctaattttttagcaagttgtttttctgtcacaccttcttgaatgaatggaatgatttcttccataacagcatcattgattttacttgattcaatcattaaaacttgttcttgtaaatcttttttcatgcgaacgagatcaacacatggtgaagcattgatatattttgcatctgggagttttttcataagatctaacaagaaatgtgaggcccaatttttatcaattccaattcttcctggaaaatgcatttcatcaacaattgtttgaatagcatcttgtccatctttatgccaaacaatgttaacatctaaatcatgctctaaatagaataaatcattcatgaacaaggtatgattcccatgttttgaaatcataaaaacaaacattctttcatgcggatcattatagtatcctgtacaataagcaattgattgaggatcacttattaaaaagtaatccaatcttgcttcttccattaaatcaagtatttcttgtatacgatcgttattcatcttttaaaactccaatacctaattcttttaattgatcttcttctacactgtttggtgctttagacattggacatgttgcactagcatttttagggaaagcaataacgtctctaatagaatcactttcagtaagtaacatggcaagacgatctaatcctaaagcaaatcctccatgtggtggtgtcccatattttaatgcatcaacaaaccaaccaaatttatttcttacttgttcatctgttaaacttaaagctttgaaagctctttgttgtaagtcttgttcgtaaatacgttgagaacctccaccaagctcaaaaccatttaagacaatatcataggcatcagcaagacaatttgctggatctgtatctattttatctaaatctgattctttaggtcttgtaaatgggtgatgcattgcataatatctttgagtttcatcatcatattcaaacattggaaaatcaacaacccataataatcctaattcttttgaatcatataaagtcaattcttttcctaaatgattacgtaaagcagctaaagcatcacaaacaaccatatattttgtatccgatacaaataataataagtcgttatcttcaccattcattgcttcaattaatctttgcatttgttcttcgctaaagaatttagcaattggtccttcacctacaccattatttacttttaaccaagcaagaccttttgctttataagtttttgcaagttcagttaattgatcaattttctttcttgaataatcacttgcatgatttttaacattgatacctttaacatatccattattttctaaagctgatttaaataccataaaatcaacatctttaacaacttcatttaaattaacaagtttcatatcaaaacggatatctggtttatcaataccataagtttccatcgcttcatgccaagtcatacgtggaagtggtaacttaacatcaacaccttttacatctttaatgactttagctaccatattttcaccaacttcgatgatttcatctgttgtcataaatgacatttcaacatcgacttgagtaaattctggttgacgatccgctcttaaatcttcatctctgaaacaacgagcaatttggtaatatttttcaaaaccagcaaccattaataattgtttaaataattgaggcgattgtggtaaagcatagaaatcaccatgatgtacacgtgaaggtactaagaaatctcttgctccttcaggagttgatctgtttaaataaggtgtttcaatatccacaaaatcatgactatctaagtattctctaatacttcttgtaattttatgtcttgttagaattttattttgcataacaggtcttcttaaatcaagataacgatattgcattcttgtttcttctaaagcatctgtatcatctgcaacaataattggtgtcgtattggctgtattgatgattttgatttctgatgcatcgacttcaatatcccctgtaggcatatttggatttttgctagaacgttctacaacagttcctttaacatataaaatatattcatttttaatatcttttgaaatgttttccatttcttcattgataataatttgtgtaattccataacggtctcttaaatcaataaatacaagagctcctaaatttctctttttagcaacccatccttttagttcaactgtttgtccaacattttctaaacgaagttcaccgttattatgtgttctattcatgttcatgtcccccacttaaatgattttcaatatgtgccaaaatattttctaatggcacaacttcttgttctttatcatgattacatttaatattaaccacttcattttttacttcttcttcccctaaaataatagagaaatgtgcattaaaacgatctgctgatttaaattgtccttttaagccacgagatacatgatccatttcacatgtaaagccatttgctcttaacatcgcaataatttgcatagcaagatcttttgcttcttcgcctaaaggcataatataacaatctaaaccaccttcgtcttcatcttcttcatcatctaaagcaagaagaagtctttccataccaaaggcaaaaccaacacctggtgttgctggtccaccaatttcttcaattaaaccattgtagcgtccgccaccaccaacagtagctcccgcacctaattttggatcatcagaaataatttcaaaaactgtatgagaataataatccaatcctctaactaagtttgtatcaataacataatcaatttctaaatcatctaataaagaacatactttatcaaaatgatttttagcactttcgcttaaataatcaattgttttcggtgctgttttcatagctggatgtttcgcatccactttgcaatctaaaatacgtaaaggattcttttcaaaacgtgctttacaatctccacataattcatctaaatgatccctaaaatgatcttttaaagcttcacgataagcatctcttgattcattatcacctaaagagttgatatgaagtgtgacattttgaagtcctaatgcttcaacaacagtcactgccataagcatacattcaacatctacataaggtgattcaacacctaacatttctaccccaaattggtggaattgtctttgtcgaccattttgaggtctttcatatctaaacattggtcccatataataaactttttgtagtttttctggtaaaccatacattttattttctacataagctcttgcaataccagaagttccttctggtctaagggaaatatatcttccttttttatcttggaaagtatacatttctttagaaacgacatcacttgtatcccccacagctctgttaaataattcagcatgttcaaaaattggtgttctcatttctttaacattataattagcagcaattgttcttaacaattgttctaatttaatccatttttcactttgtccaggtaaaatatctaccgtacctcttggtgcactatatcccattatttttcctccttaaaaatataaaaacgcccctctaaggacgtttcaacgcggtaccaccttaattcgtattttcatacgcactttcatcttaacgcgattaacgattactcttttcaagtaattcctcacaagtgtcccatagcttccatacaaagattttcaccagccatcttctctctaactatttccactatttaatcttgctcaatggattacaaagattatataaaataatgactaaaaaatcaattcctatttctagcatctatagtataccacgttttttaatcatttatgtctcaaatttgtctcatttttgttccatttttgaaagacgatactcttctacaataaattgtgacagatcttcttttaaactatggttatcataataaacaagacgtgttttcttctttctagcaatatcattcaattttaaaagataactttcaacaggttttattttttcattttgactataaacaacaagaagctgatagaaatgttctaccagctttttaccaacttgatcattatataaaatataaattgcttgacgatcaatcattataaatcaatatcacataagttagaagcatatccaatatagcttgcaggtgtcatatctagtaaagtttgacgatcttcatctgataaaacatctaatcctttcgcaaattccataattgcttcttgtgaaatatttttacctcttgtaagttcttttaattgatcataggcatcagaaataccatattttctaagcattgtttgaattggttcagcaagaacttcccatttttcatttaagtcagccgcaagtttatctttattaacaacacatttagctaaaccatttgttgtttcactaattgcttgtaaagaatatccaaaagctaaaccaatatttctttgacttgaactatctgataaatctctttgcatacgtgatttaggtaatttatttgataaaccaacacaaatattattagacatatcaacatttgcttctgagttttcaaaacgaattggatttactttatgaggcattgtactacttcctacttctccttttacaggaatttgtttgaagtattccattgaaatgtataaccacatatcaacatcaaaatccactaacacattattgaaatgacgaataccatctaaaatatgacatgtataatcatggctttcaatttgtgttgttaaaggattgtaagttaaccctaaatattcttctacaaattttttattaagaatttgccaatctaattgagggaatgctgttaaaatagcactatagttacctgttgctccattaaatttagctttaattttaatattttcaatattttcaatgcttgaagtaaaacgataagcataaactttaaattccttaccaattgtagttggtgtagcaggttgaccatgagtatgagctaacatcgcatcatttttatgttcaacagcccattgattgataactgctgtaaattcttttgctttctttaaccaaacatcatttaaaccatgtttgatcatacaagcataagatgtattattaatatcttctgaagtacatccaatatgaacaaaactgattaaataatcataacccatatcttttaattgatttccaatgaaatattctactgctttaacatcatgccttgtaacagcttcaatatctttgattgctttaaaagaatcataattgaaatcttttgaaatagcttcgatttgtcctaagttatctttgtcaaatgtagaaagaacatcactttctacattttcaattaagaattttaaccattgaatttcaacaaaaacacgatatttcactaaagcatattcagaaaaatattcacctaaagcatctttaatacctgcataacgtccatctaaaggacttaatgtaaaacattcaaattgttgtttatccattctatttaccacctctaaaataatttacaccagcttcaaataatttttgatccatttcaccataaacatttttaaaacggttttcgccttgacgttcactatgtcccatcttaccaagaacacgaccatcacgagaaacaataccttcaatagcatacattgaaccatttggattgtatggtgtttgcattgtaactttacgattaggatcaacatattgagagaatacttgtccattagcgaataattcatcaataacttctttaggagcaacaaaacgtccttctccatgagaaataggaataacatgaacatctcccacattaacattagcaagccatggtgatttaacagaaccaatacgtgtatctacaaattgagataagtgacgaccaatcgtattgaatgtaagagtagcgtcattttcagacatatctctaatttcaccatatggaagtaatcctaatttaataagtgcttggaatccattacaaataccaatcattaaaccatctctattatctaataaatcactaattgctgcttttaatcttggatttcttaaaactgttgcaataaatttacctgaaccttcaggttcatcaccagcagagaatcctcctggtagcatcacaatattagcacgtttgatggcattttccaattcatcaatcgatgtttttaacatttcttctgttttatttctaattaagacaagttcaaccttagcccctgctttttcaaaagcacgttttgaatcatattcgcagtttgttcctgggaacactggaataacaactaatggtgtttcaatatattgttttgcttttaaagttgatcttgttttacattccgcaactttaatatcttgtgtaggtgctttttctcttgttggataaacactttctaatggtgctttattgattgcataagcttcttgaatagaaattgtatccattccataagagaatttttcactatcatttaaagtagccactactctataatctaaacctactagatctttttctgatttcacttcaacaataatatttccataattcttttcaacataagaagcaagtgaataatctgtattgaaagcagctcctaaaccattaccaaaggacattttacaaacagcttcaatcacaccaccatctttaactgtatatgcagaataaattttcttttgtttcattaaatcttggatagcattatattgtttttgtaaatgatcaaaatcaaagactttaaattgatcttttttaatttgaacttctgctaaaatatgtcccgcttcttttgcttctggtgtcataacatcatgaacatcacttgctgtaatggcaaaagaaacaagtgttggtggaaccgaaatattttcaaatgttcctgacattgaatctttaccaccaattgatggaagttttaattcttgttgaacacgattagctccaagtaaagcagctaatggtttaccccaacgttttggatcatctaataatttttcaaaatattcttggaatgaaaaacgaattgtatgatagtttccacccatggcaacgatcttagcaacactttcaacaacggcatacatcgctccatgatatggtgaccatttagaaatcttaggattatacccataagccattaaagaagcagttgttgtttcttttcctaaaacaggaattaaagcagccataccttctgtttctgtgtgatatgtacgtccaccataaggagataaaactgtaccatttccaatagatgagtcaaatctttcaacaagacctttttgtgaagcaacagataatcttgataatacttcttttgttgtaccaacaaaatcatttctttcttcttcatcaaaaggtgtactttcaaagtttggtaactcaacttcaatattttgataacgttttgcccctgcagcatctaagaaatcacgagaaatattaacaatatctttacccatgtgcttcattactaaacgatttgtatctgtaacagttgccacttgaacaacttctaagttttcttttgcacattcttctttaatgaaatcaacatcatagtcattgacaacaatagccatacgttcttgtgattcactaatagcaagttctgtacctgttaaaccatcatattttttcaaaacagcatctaaatcaatatcaagccctggagcaagttcaccaacggcaacacaaaccccaccagctccaaagtcattacatctaacaactttttctgagactgctttatttctaaataatctttgaatttttctttcttctacaggatttcctttttgaacttcagcacctgctgtttcaatagattttacgtcatgtgattttgaagaaccggtagcaccaccgataccatcacgtcctgtgcgtcccccaattaataagacgatttgtccgttttgtggttctaaacgttttacttgttcttttggtgcagcagccacaacagctcctacttccatacgtttagcgatataaccttcatcgtaaatttcatgaacataacctgttgttaacccgatttggttaccataacttgaaaaaccatgagcagcttcttgacaaatttttctttgtggtaatttacctggtgttgtttctgccaatgtttttcttggatcacctgctccagtaatacgcattgattggtaaacataagcacgtcctgaaagtgggtcacgaatagctccacctaaacatgttgcagctcccccaaatggttcgatttctgtaggatggttatgtgtttcatttttaaacattaataaccattgttcatctccttgatttgtatgaacagtgatttcaatagaacatgcattaatttcttcagaaacttccatatcatcaagatatccttttttacgaagttctttcattgaaatagttgcaagatccattaaagtaagaggtcttgttgtatttaccccataaactgcatgtctacttgttttatagctttcaatatctttttctaagatttctttaaaagcaccattttgaatatcgatatctgtaataactgtcgcaaatgttgtatgacgacaatgatcagaccaatatgtatctaacactttgatttctgtttcagtaggatctctatgttcttcatttttaaagtaatcttgagttacttttaaatcatcaagattcatagccattccattatcttttaagaattgatttaatcctatttcatctaaatcattaaatcctattaaagttggcacaggtttaatatcaggtgtttcatcatttaaatgttctggtttttctaaagaagcaattctttgatcaactgggttaattaaataatgtttgatttgatttaaaacatcttcatttttatcaatgtctactacaataagtttggcacatcttacttttgttgaagatgttcctgttagaatttggaaacattgttcgcatgaatcagcacgttgatcatattgacctggtaaaaattcaattgcgaaaacagattctttttcactcattggaaatgtttcatcataaacatgatccaccattggttcagcaagaattgtattaattccttgttgtaagatttcttcactaattccttgtacatcataacgatgaacaatacgaagtgaatgaatcgttaaacctaattgttcaacgaggttggtttgaatttcatgcgcttctgttgcgtattcttttcttttttctacataaattcttcttacatttgtcatagagttctctcctatctaagtccaatatcatgacgatagtacataccatcgaatgtaataattgtagcagtttcatagactttcgcaagtgcttcttgtaaatttgctcctcttgcacacacatttaaaacacgtccaccatttgtgacaagtttaccatcttttaaagctgttcccgcatggaaaacaacaatatcatcacttactttgtcaatatttttaatttcaattcctttttcatatttacctggataacctccacttgcaagtacaagacaagccacgtggtcatctgaccatttgacatctacttgatctaaagtataagtcgcacaagcatccatgatttcataaagatcactttctaaacgaagaaggattgattgtgtttcaggatcaccaaaacggacattaaattcaagaacttttgcttgattattttcaatcattaaaccaatgaaaacaactccacgatagtccatttgatcttctttaagtccttgcataaatgggtcaagaatatctttttttaagacttcatccataccttctggtaaaaatggatttggagaaacagttcccataccacctgtattaggtcctttatttccatcaaagatttgtttatgatcttttgctgaaaccattggtacaattgttttaccgtctgtaaaacaaagtaaagaacattcaaatcctgttaagaattcttctaatacaactttacttccggcaccatctaaagcaccatcaaccatcatttcttttaaagtagaaatggcatcttctttattttcaacaataacaacaccttttccagcagctaaaccatctgctttgattactaacggaaaatcaaagtgatcaacttctttacaagctttttcaaagtctgtgacttcaacatattttgctgtaggaatatgatgtctaatcataaaatctttagagaaagctttgcttccttctaaagttgctgcttttttttgagggccaaaagctttataacctgctttttcaatatcatcagcaagaccattacataaaggaacttctggaccaataacagttaaatcgatttgattcttttgaataaaatcaacaataaattcattatcttctactgaacctggtacacacgtacctaaacttgcaatcccagggtttcctggaattgcataaagttcagatacttttggactttgttttaatttataagcaatcgcatgttcacgaccaccactaccgattacaagaactttcatataagcctcctagtgtctaaagtgtctatatccgctaaataccatagggatatttttttcattacataaatcaattgaatcttgatctctaattgaaccacctggttgaataattgcttgaacacctgcatctgcagccacttgaacacagtcattgaatgggaagaaagcatctgaagcaagtactgaaccattgaaatctttatctggattattatgaatagcattttctaaagcccatactcttgatgtttgtcctccaccaatagcaagtgttacaccatttttaacaatacaaatcgcatttgattttacatatttaacaactttcataccaaattccatatctgtaagttgttcttttgtaggttgaacatttgttacaactttcatttcatcaatcatttttgtatttaattcttgaactaatacttttccttcaagatatttaatatcatatttagcaccacgtgcatctaaatttttaagttttaaaatacgtaagtttttctttttctttaagatttctaaagcatcatcatcaaaatctggtgcagctacgatttctaagaaaatcttatgcatttgttcagctgttgctttatcaattttatagttaacagcaacgattccaccaaaaatcgattgaggatctgcttcataggccttcatataagaatcataacctgtatttccaatagcaacaccacaaggagttgaatgtttgatggctgctgtaacgatttgattaccaaattctctaacaagtgcaactgctccatataaatcgtttacattgttaaatgaaatttctttaccatgaagttgttcataatctaataaagatttttgaacataactatcttcatatttatttgctgcttgttgagagttttcgccataacgtaaatgttctactttctttaatgaaagatttaatgtatctgggaattgatctccaacttgatctgcaaagtatcttgaaatcattgcatcataagcacctgtcatagagaatgctttataagcaagattcattctgaaatcaaaatcagttgtatcatttttaatcgcatctaaaacattgtcataatcttttggatccgtaacaattaaaacatctttaaaatttttagctgctgaacgaatcattgatggtccaccaatatcaatattttcaatcatatctggtaaatctttaccagcttttaaagctttttcaaattcatataagttgacacatactaaatcaattggatgaataccatgttttttaattgtttcaacatgactaggtaaatcacgacgatataaaagtcctccatgaaccattggatgaagtgttttaacacgtccatctaacatttcaggaaatcctgtcacatcatcaattgcaatacaagaaaccccattttcttgtaaaactttcattgtacctcctgtcgatacaatttcaaagcctaattctactaatcctttagcaaaatcaacaaccccatctttatttgtaactgaaattaaagctcttttcatttaaattacctttgcctttccatcaattatttttatcttattatcacaatatagccctacaacttctggtagtaatttatgttcaatctctaacacccttttttgaatatcctcagctgtgtctaaatccgatatatcacaagcaacttgtttaataatcggtcccccatcgacaatatttgaaacaaagtgcacggttgcccccgaaacctttgcaccacgttgtaatacagcttcatgaacatgcattccatacattcctggtccacaaaaagaaggaataagagaaggatgaatgttcataattttatttggatatgcatcgattaactcatccgttaaaattgctagataaccagccaatacaataaaatcaacatttctttcttttaacatctttacaatcaaagcatcatctttttttactactgctgtttcaataccagcatctttcgctctttgtaagccataagccttttgacgatttgaaatcacaagtgcaatctcaccattgatttttcccgcttgtttagcatcaatgattgattgtaaatctgttcccccaccagagacaaagactgcaaattttagcataaatccacgcccttatctccttctacgatatttccaacaacgtagcatttatctcctgcttcttcaatagctttcattgttgcatcaacatcttttggattaactgcaattaccataccaagacccatattgaatgtattatacatcatatgttcttcaatatttccatttttttgaattaaatcaaataaagctggtactggataactatcttttttaatgattgctcttacattttcaggaagcattctaggtacattttcaaagaaacctcctcctgtaatatgagagcatcctttaattctaacacccgcattttttacattttttaaagcttttacataaatacgtgttggttcaattaaagcttctcctaaagtttttcctaattcatcatagtatgtatctaatgattcttttgtcatttcaaacacttttctaacaagtgaaaaaccatttgaatgaacaccacttgaagcaataccaataagtgtatctcctgctttaattgttgaaccatcaataatatcttttttatcaacaacacccacagcaaatcctgctaaatcataatcatcttcaggcattaaaccaggatgttcagcagtttcaccaccaactaaagcacattcagattgtaaacacccttctgcaacaccacttacaatggaagcaattttttcaggatagtttttaccacaagcaatataatctaagaagaaaagtggttctcctccagaacaagcaatatcattgacacacatcgcaacggcatcaataccaattgtatcgtgtttatccatcacaaaagcaagttttacttttgttccacaaccatctgttcctgataataaaaccggttcttccatatttttaataccacttaaatcaaaagcaccagcaaaaccaccaagtcctcctaaaacttcaggacgcattgtttttttaacatgttctttcattaattctactgatttataacctgcttcaatatcgactccagcttttttgtaatccatttttattctccttaattatttattttgcatccttgctagaactgctttataagtttcaattaaatctccaatatcttgtctaaatacatctttatcatatttttggtttgtatcaacatcccataaacgacatgaatctggtgaaatttcatcagctaataagattgttccatctgcagttttaccaaattcaattttaaaatcaacaagttttaaattcattgataagaagaattcttttaataattcattgatttttaatgttgtttctttgatgtatgctaattcttctctagttgcaagttttaaagcaacagcgtgatcatcattaattaatggatcaccatattcatcatttttataactcatttcaaagattggttcatctaaaacaacaccttcaggcgcccctaatcttttacagaaagatccagttgtaatatttctaataataacttctaatgggaagatatctacttttttaactaagatatctctttcatttaattttttaatcatgtgtgttttgattccagcttcttctaacatatcaaagataatacaagagattgtattatttaaaacacctttaccttcaaacttatcatgtttaacaccatttcctgctgttgcatcatctttataatgaattaaatattcatcttccttttcagttttgtaaacttgttttgcttttccttcatacaataattctgccatttttcttttcctcctatttgtatttttctatgacttcatcgttagctttcattgcgtcagcttccatttgttttctttctttaagtagcccttctttgatttcactatgtttaatagccataatttgaagtgctaaataagctgcatttttacttccattaatagcaacggttgctactggaatacccgaaggcatttgaacaatggataataaagcatccattccgtctaaattacttcctgcaattggaacaccaataactggtaaaactgtttgactagccaccacacctggaagggctgctgccattcctgcagctgtaataataacttctgttccatctgtttctgtttctttaatgaaactagaaagtcctaaatgcgctctatgagcagataaacaacgaacattcacttcaacaccataattttttaaaattgaaatagctggttcaactttaggtaaatcagaagttgaacccataataatagcaactttcatctttctctcctttttagaataatcctataatttttccatcttcatcaatatccatattgacagcggctggacgttttggaagtcctggcatacgcataatatcaccagaaatagccaccaagaatcctgctccagcagatggaataatatcattgattttaacagtaaatcctgttggtcgaccaagcaaggaagcttggtcagataatgagtattgtgttttagcaacacaaattggtaattgacttaatccttgttctgtatattttttaattttattttttgctttctttgtaaattcaacaccatctccaccatagatttctttaacgattgtttcaatcttttcttcaattgataaatctaaatcataaagtggatgataattagcttcttttgtttctaaaatatttaataacttttcagcaagttcgattccaccatcagcacctttttcccaaactttactaatagctacttcaacaccaagtttcttgcaacattcatttaataattgaagttccgcttctgtgtctgttggaaaagcattaatagcaacgatacaaggtaaatcgaattttgcaatgttttcaatatgcttttctaagtttcctaaaccagcttttaaagctcctaaattttcatttcctaaatcttttttagcaacaccaccatgcatttttaaagctcgaacagttgcaacaataacaactgcttcaggatttaaatttgcttgacgacatttaatatctaagaatttttcagctcctaaatcagcaccaaatccagcttcagtaatcgcataatctcctaacttgatagcaagttgagtagccataacagagttacatccatgggcaatatttgcaaatggccccccatgaacaaatactggtgtgtgatctaaagtttgaactaaatttggtttaatcgcatcttttaataaaagtgttaccgctcctgttgcttcaatatcatcaacagtaactggttttccatcataagtataagcgacaatcatttttgcagctctttgttttaaatcttctaaagaagtcgctaaacaaagaattgccataacttcactagcaacggtaatatcaaatccatcttcacgaggaaccccgtttactttaccaccaagtccacaaacagtatgacgtagtgcacgatcgtttaaatcgaccacacgtttccaaacgatttgtcttacatcgatattaagtggattcccttgatgaatggaattatcaagcatcgctgcaattaagttgtttgcagcagtgattgcatgaatatctcctgtaaaatgaaggttgatatcttccattggaacaacttgcgcatatcctccaccagcagctccacctttgattccaaaacatggaccaagcgatggctcacgcattgcaactacagatttctttcctaatttgttaagtgcttgtgataatccaatcattgttgtggttttcccttcacctgcaggtgttggattaattgctgttactaagatcaattttccatcttcgttttgatctaattttttaatggcttcaagggaaatctttgctttatattttccatataattctaaatcatcctcatccaaaccaactttttgagcaatttcaacaatcggtttcatctctgcactttgtgcaatttctacatcagttaacattgtcgttcatcctttctttttttctttttgattgattcttttaaccactttcattatattacaagacaatatatgaaactagttattttacctatcaaccaaaaaaagagcccactcatccagactattcttagcccagacggtcgactcttttacacgattatactccctgtggtttattccacttccgtcagtcgtataacttaactgcataatatcaaaaaatgactctttaatcaataccaaaatgttttttattttgcctaaaaatcaattttccaacaatctatcattctttttaatcatttaataatttttcaaaacttttattttatatttttacaatttttctaatcgtattagctgttctaattgttatttttttactaacatttgtatttgctgttttgggccaccagtttgttttctgataatcttttcgactaaatgaccaaaaaataacatctttataattttgaattttttccaatccttctttagcttcaccaatttcctcaaaaacttctttaaaagtgattggaggaatcataaatattaaattatcataaatcattttatcatcactgccccaccaaattggtgcatgttctaaaatatcttttagcttttcttgttctaaaacaaaaacaggtattttaaaatcatagtttttctttaacatttcttcaatttgttttgtaatcttttcaatattttctcgacttgaaaaaataacatttccactatttaaataagttttaacattttcaaacatcaaactttctatttctttttttaactccgccatcactactttatttttaccactaatattaattcccctaagcaaagcaccatatcttttcatctaaaaagccacctcatttcttacaactttattttaacatacttaaaaaagactacaaacgtagcctccatcatttcatttctaataaaactttaggtaattctttaattgaatgtattatcatatcaggattctttgcttttccaaaaccataacttgcataaatgaaaggaatacctgcaaatcttgacgcttcttcatcaccttctgtatcacctacatagaaagcttgctcaataacatttcttttcataatcaattttatattatgtcctttatctaatcctgttcttcctgacatttcataatctttaaaataagattttaattggtgtgcatgtaaaaaagcctctacataaccatcttgacaattgctaacaatataaagattataatccaaagataatattttaagagtttcttccaaaccctcatataaaatagcacccttttgagataaataattgatttcttcattgccaaaatcagctatgatctgttgccgtctttcttctgttaggtttggaaataacgtttttcctatttcattcatggttttccccatcatctttgaaacggtttattgagtaatcattaaagagatatcttcatatttatttaatacacgattccaaatagcacaaacacaacccgttgaatcccatagtgtgccatctaaatcaaaaataatagactttttcatattttattcctttcaattttattcttgataataatcatctggatctccatatttttgaacaacatcttttaattctttttcatttaaatttcttttaagtaagacattttcttcatattgataatgtggatagcgaaaacgtattctcgcaaaagtattatctacatagagagcaatatgttgatcatattgttctaccttttcatcaaaatcaaaactatacattataaaacttttacctatgtctaaaacaattcctgttgtcaatacaacagaaataagtgttataactttctttttccaacccattaaaaaggcttttaatttcttttgtaatttataagcaaatacaatcaataaaatttgccaaataaaacatattataaaggctattctaattgctgtggaaggaatatatgaccatccttcacccaaaagcttttcaccattaaagaaaagaatcgttataaaaataaataaaacaatcaataataatataattacttgttttctatttagttttctcatcacttcacctactctattttttacaaatttcttttaatatttctatatagtcatcagtctttttaatagaatacattaaaatacattaaatgtccatcgccttctttaaaaatagagtttgattgaggataggccttttttacacccctataacaagtcttatacgctttttcttcttttccataaaagaaatacattttgttttgagtttctttatcaaataagggaaaatcaaatgtataacaacattctgtttcatttttaacactttcttttgaaagaaactgagcagtaactgccatgggttcaatcattggtctaagattttctatatttcctcttgctatcttttttatcaatttcatatttaagatttgatcaacatcttttttcttcatcattttaagtatttggttaaatttaaaatacatgaattttttatatagataaggaagtttaatacatggtgtcccatctaaaaaacaatactcaacgctaatgtttgttttttctaattgtttaaataattcaatagcaatttctgcgcccattgattgtccataaatcatcttaatagtatgtacattttgtttttgaatatattctatgagttctttagcttcattctgtcttgttgtaaatgtactgttttcatagtgaccgttatattcaggtaaaatcaaacaataatcatcttttaatttttcatataaatattttaatccactgcttggataaaatgaacccgttaacatcataatcaaaggattatttaaatttcctataatttcaaatttcattatatttcccctctatttcaaatacttaaatattatcaatgtgctcaaaaaaagaaaacacctctttatatttttcttgtaaaccaggtttattaaatctattttcaatgatttgatatgcttctttaaatttacattcattaacgtatgcacttgcaatatataaatattgataatcatcccatacaattcgtttgtcattgctttcataaagtgttaaataatctttatcacgcgttaaattatcaagtaaaggcattgtatattcttcaaaaaatgaaagaatttcattttctaaaggctcataatgttgcgagtttttaagaagaaaatctttagattttgaatatacttgtataggttgtctaatggtgaatttattaatccaattttggggaattaaatgatttgcgaatgcttgtgccgtattatttatttttggaaaataaatttgtatatgaggatagatatgtgctattactcctcgataataagatggatttgaaaaaaatactatttcaattttttgaacagtctctcctatcttgtgaacataaatcagcccattttttcttctcttaaaaccatttttttcaaagtaaaaatctaaatttgaaaaaagtaaacaaatcaccttttttatatcacctcgtaacatattcatttttttctattcccttctacatcatttttcaatcatattacctactataaaataattctttacagtcatttcaactaccgcatacttttttaatcaaaccatattttatatatcacttagtataacaatatcttacctaaaaactattcaaattttaaatcgtatatttgaggactatcaatacctatcgtacaaaaacgatattgatttttatacaaataggcatctttccctattaaataaccatttttagtacaggcaacatatttttcacacgatttttttaacatagtataaagttctttagattctatattttcataccatattgtacttatctccgttggaaatagcgctttatcttcgtaaataccacctatatttataacaacagaagactcatttaattcttggtctaagaaaaaaatactattatcttgacacatattgttttttcttttcaaaggaatcacatccttatgacacacaagccatcgattgttagtatgattgccctttgtgctaatacctaaaaaagcaccatttgttatattagcagtttctatcaagtcatatatgcgtccacatttgaaataatgaattttaatattatgctgaaaatctaaaaaaattctaatcaaatcttctttagttgcaaatattctaaaacttctagacaacattttaccaccacacatttctaattttcaaaaacagtttcataaatctgacttacaatactttgaatatctttttcatctgttatgcttatttcatttaatataggggcaaagtctttttctcgccaccaacttttcatttctttttcaccaaattcatctcgacacgcccttgtttgatgacgtttgagcgtttcttcaaaagacatatcaaaataataagcataaatattttgattatacaattcaattgctagttcaaataatgaattataccaattagcacgtaaaataccttccaatataacaatttcattatgttcatttccatacttcaaaagttcttttaaaagcggtaatgcctttgtattttcgccatcatccacattcaacatttctcttcgaataacatcttgagaaataagcatcgtatttttaccaaataatttttgcaattctttagctattgttgtctttccacttccagaatttcctctaagtataataagttttgtcattgtttcattccatccattttttataaatagttaccaaatccaaatcataattaaagcactaagaacacccacaatagcaaatataggaatcattggtatacatacttttacatgaaaccatttttgatgatattctttatccatatgttctgtacctggaagtctaatttttttaatatttacgaataagacccaatcaagaaaaaaagtatcccaagcaaataatgcaattgcatatgtataagttaacaacaatccttgaataaatatttttgctcccgctagatgtaacatccacgcaaataaaaacataaaaacaataagcacaacaactttcttaatgatcatcatcgttgttaatttttctttttctgcttctttattttgacttttataatagatctcttgtatttctggtggataatcactaataaacgttactggattaattaaaagtaaacaaatcactaaaaacataattaaaagttctactactattactgtcacattcataataaatcactccattcattaacttatataacatttttttagcttagattaccgatataccacttcaaattcttccaagacacagtcacaattctcatcaaagctttgtcctgccgccttataatctaaagcaaacgtgcgaaaatgaacctctctccatttttctaaactacgatcatcttcaccttctttataggcatgtgcagcacttacctttgaaaaaggaacaatagatacttttgtatctcgaataatacatgccgcttcatcattatcaaaaagaataacactataagtacctctttgaggtaattcttcttcatttatttcataagataattttgtactcgatgtcgccttttttgtatctgcaattattagatttgcaagttcatcagcaaaaatgccaccattaaaaaatttccataaatcatgtcttgtatttatatccatatttgttaaaagacaatactcttgccacatcttttctcctgtcataaattggttcctttcttttaaatttatttttacaacaagcttaaactacttgatttttaattgttcaaaatgataacgtgttttgccaacacttttctttccatattcaattgcctcttgtggacaataacaaatacaagccatacagtgtgtacaattctttccccaaaccggttttccatcaataagttgaatattattcaatggacatttcttaacacattgattgcaaccaatacatgtattatttactttaaaagcatctgctttaacaaagaaatgataaaaaagagaattaacagatccactcataaagcaatcataaagattatgacgtggtttcaaaaaagattttccttctttaatatatttaatagtttcctttatatcgatttctgctttttctacgatttcttttgcctcttctaattgtggagcattaaacatggcaatatagttttctggcataaggatctgttttgttcccatataattcaagtgtttttcatttgcaagaatagaattatactttgaggcatttccaatttcactaccacaattcataacaaaccaaatacgttttgctccaacgaattctgttttataaaaccaattggaaacaattcttggtatacgccaagcataagtcggaaccacaagaataatagtatttcctgtttctattgacgaataattatttgttttaattttttcatttaaatctattatattttcgtgtaattcatccgcaattctttgtgctatatagtaactatttcctgttcctgaataacaaaaaatcatttacctatcccttctgcataatgatttttgatttaaaatatttttcttgaaattcaacttgcttttttatttcttcttttgtatatgacatatttcgaggaacaacaacccatttttcttccacatcatcatatctatgaataatagcaattattttcccaacaaacccttttacaggaacgtcaacacctaaaatataagcatcttgttcttcttcatcttccgccatgatgccttcaacaaaaccataatttataggataatatgtttctttatattgaggatgttggctaccaagtggtcgatcaacaataacttttacgatatcttcaatcatattatttttccctctttatatatgtgcaatcactcttaaacgacgataatctgcaatccattcattttctttccaaagtttatcctttgttaaatcttctacttctttaatgattttactttggatatcttttgacatttcttccaattcagaagcaaagaattgtctcatccaattttctaatcctttttcatggtcttttaagggtgttggtcgatcataatcataaattttatcaataataaatcctttcttttttaataaatccgcaaaatgttttgttgttggaaaattaaattttggtttgtattcatatcccaaatcttgacaaacctttataaaagcattttcaatcgttgcaatattaccactcgcaccaaattcacaaaccaataatcctttaggttttagtactttatggatattatctaataaattttcatgatcttttatccaatgaaatacagcatttgaaaaaacaacatcaaattgactttcaaatggtaacgctagtgcatcacataccctaaactctatattggaatactgttcttgagcctttttaatcatactttcagattgatccacaccaatgactgtttttgctaaattattaagttgaacagtaagtgttcctgttccacaccctaaatctaaaatactttgtttttcattttgtggaatatattctaaaagtccctttccatattctgctacaaaatcatgtttattatcatacattgttgcattccattcactcataaatttatctccaatttatttatatttgctatatctaaaatcacaataagaatccccttccgcaatcgtttttgttcttactaatttcatatgcattatatcggccaatacataatccatttgacataaataaactgcaagttgtggacatccttcatctttacatagtttacatataccacactcatgataatcatatcctaaatcatattcatcattacctggtaaaatatcaacgacccaatcattttcataaatgtgtttataactttcttttgaccattgtaatcttcctgccatttttttaggatctaaatagctattagcttctcccattactttatgaaataatttagaggcataaagtccatcacgaaacatttcatagttttcttctgcagattttcctgtacttcgattcattgcgataaaatagcttcccataatatatgaacttaataatcttgaatttccaatatcttttgcccgttgaataattttatgatgttcttcatctatttttcttactacatcttttggaaagtctctttttttcaattccgcttttaccacatgatgataaaaatgatagattatttttacgttaactgattcttttatctttttcattccttccaattctttattcaatagaacttttaatataaatctattttagcacaaacaaaaaaagaaaaactaagaaatcttaatgtcccttatgtttttcttttttcttttgttgtttcaaagcaaacaaacgcattttatctagttctttttgttttttattttgtaatatgtgctcttgtttgctttgagcatgtcgtaattttaatgcctgttgagattttgttccaactccttgtaattggacttgttttctaacatcacgttgtttttttttataacttttctgtttttcaattacaacattttcaacagctggactaaagtttaattgattatacttttttaaaataaaatcccttatttcataatctttaggttctttataaaatgttattttggatgcagttaattttccatcttcattacattctataatgcctacccaaaaaggattttcaaaaaatacagttaatctacaacttgtcttatccatagttaccctcctttatataaataaacaaagaatggacaacccggaggggcaggttacttacctattaaaatagacggctgggctacctaccagctctagtacaatttgtacattgcgtttttatctttgcaatcctattttatcatattttaattatttctctactacacaataacaaacaccttcaggtgcttttataggatcatctttataataagcattataattagatatgtatttttctgtcattgtttgatgattttcatgttgaatgattgtaagatggcattgattgagtatctctttaagttcagcaaagctatattttgctttcattgattcatttgctctttttgccaacatttcattgatttttgcttctttactttcttgaatacttggataatcaaaaacaagacgactaccctttaagagatatttagataattgttttaacatctttttaaattcatcttttgtaagataataacttagtcctaacatactactgattgagagttggtcttcttgataatcactttgtaataaagtattaatccagttttcttgacttaaatcaattgataagaattgaatattttcaatatcaacatctttacatctttgtcttttatcttcaattacttcttttttatcaatttcaaaaacatgcatttgattttgataataatatgcaaacgaatcataccccgatgcaaaatctaaatactgcttacatcccttttctttcatctcttcaatcgcttctttacaaaaagcacttcttagtaaaacagaaggtgatagttgatgatctacaatccactttaatgcttcttccttacttcctttaaaattaggattaaaaaatgaaatgccttgtgacatacttaacctaatcatttcatattctttttttgtaattaattttgttgaaagaggatcatcaaaaattttaatatccttacttttttgatgatacgctcttgcaaacaaacttactaatgctgtcatattttgttccataaaattacctccatatatttaatacaagacttttacagaaatgactaatcttgaaaaaatgcccattttatggtaatataaaggtagaaaaaagaaagaaatgagaaaaaatttcccatttctttttatttgaactttttaaaaccattaaaccaagctcgctcatcaaatgacttcttttttatttttataacatttttttcttttggaataccaattggtaaaaagcataccaattcataatcatctggtacatttagtatgtgtgccatttttttaccgatttgatcctcatcggtaatgtgcccttcataccaacagctttcatatcctaaagcaatgattgctagtaacatattttcaattgctgctgaataatcctgtatggcaaaacatttatcacgatatgcatagatacgttgagtgagcacacaaatggcagcgggtgcactttgtcctattggcggatctataacattgagtaattgttttaaaatatgtggatcatcaatcgcaataaaacttgttgtttgtttattacatccagaaggagcgtcgattcctgcttgcattattttgataaggtcctctctttttactggaactgcttgatattctcctcgaaaactatgtctactatgaattaattctagaaaagtattcatttttaccctcttaataactatatttcttaatcttttccttgactctacttgcttgttcatcttgtaaaatatatggttgataatcatttcttcctcttgatgaagttaaagaacatggaatgatttgtacttgatatcctgtttgtgttgttcctttaaaagaataagagagttgataaatcattgtgtctgtatcacttggattacgattaccaccaaaacagaaattacctaacgaataaacaataggttttccattgtaggtttctgttccttgaacaacatgaggatgtgaaccaatgacagcatccgctccagcatcaatggtaaacttagccagtgatctttgatcttcattggcttgatattgtctttcaataccccaatgataataaacaaaaacaagttgacattgttcctcattttttaaatgattgattgcttcttgtattttttgatgaccactttcattattcatagataccgaaagtgaacgataaccaaggaatccacacttgatgcctttgacttcttttatgtagtaatcatcataaccaaaatgaccaatagaagcttcatctaaatatttttttgtatcttgaagacctgcttcataataatcttcactatgattatttgcgagggtaactgcttctactgatgaagaagtcaatatttttgtatattcaggagctccactaaaaggaaattctttttcaagatgattactggctgtagtaagtggtccttctagattaacaactgtcaaatcatctttttcaaaaacatcttttactttttttaaaaaatatgttggatcattcccttgtcttttatattcttgattaaacgatccatcataagcttgtccggcatagtttccaagtgtacaatctccagcaaaagaaatagtaaaattcacttcagcttcttctttctttttctcttctttttgtactgttttttcttgtacctttttaggtgtttctttttttgtaggttgatttacattattaaaaagaaaaacacctaaagaaataacaagtacagctattatcataacgaatgctacttttttcttatttaatttatgattcataaaattcacctcaacttattttaacatattctaaaatatgttaaaatgcttctattggaggaataactatgattcaagaaattattgaaaataaattagattatgccactttattatgcgaaagtgatccgaatattaatcttgttgaaaattatttaagagatggaagattatttgcttactttgaaaaacaaacacctcttgcttttattgcagcaaaagaaatcaatgacactactgttgaaataaagaatttacttacattagaaaagtatcgaggacatggttatggaaaagcacttattcaacatattgaaaagctttatcaaaacaaactaacttttttaattggaactgccaatagttctatgacaaatatgcttatttatacaaagcttggttatcattatagtcataaaattgaaaactttttcattgattattatcctcaagaaatctatgaaaacaacatgcaggcaaccgatcttctttactttagcaaaacacgtgcaaactaaaaggattccttacgaatccttttttgtatactcttttaagatatcaatataaagttgtccaaaacggctcaatatagctttattatgcgtaatatatcctatttccataaaatcatccacatctaaaggaaccgcaatgatatctttcccattaagctgttcattaatgactccactacaaattgtataaccattaagacctattaataaattaaaaagtgttgctcggtcacatactttaatttctttttgactttctaaagtacttaagatttcttcagaaaagtaaaaagaattatgttctccttgttcataagataaacgtggatattcttttaaatcctctaaagatactttatttttgtttgcaagaggattgtcttttccaataaaaacatggggctttgcaataaataaacgatgaaatgttaagtcattttctttcaatgttttctttaaaacaacttcattaaatgaattaagataaagaaccccaatttcacttttaagtttcgcaacatcttcaataatttcataagtttgtgtttctcgaatcctgaaatcatattccttcccaccatattctttaatcaaagaaacaaaagcttctacggcaaaagaataatgttgcgttgaaatacaaaattcatgtttaacattatgatcttgtaagtatttttcttcaatcaaatttgtttgttcaattacttgtctggcatagcctaaaaattcttctccttgccttgataaaataacccctttattagtacgaataaaaattgtaatcccaagttccttttctaattccttaatagcacttgtcaaagagggttgagagatatataaacgttttgcagcactagaaagtgttcctagttgagcaacggtaattacgtatcttaattgagctaatgtcatttttttcactcctttttgtagcattataccatagttattttctttttcatattttaaaaataatttaggaatattctatgttataataaggaaagtatttaaggaggggattgaatggaaaaagatttaacacatggaaatacattaaaactgattatttcattttgtattccattaattggtggtgctattttccaacaactttataacgttgtcgatacgatgattgttggacgttttgtaggggtagatgctttggcagcagtaggatcaacaggttctttaaactttctaattattggttttgttttaggacttgctgctggatttggtattcctattgctcaagcttttggtgctagagaagaaaaaagaatgttacaaactattatgaatgctttctatttatgcattttcttttcgattgttttaactgttttaactcattttacaacagaaacattgcttacttggatgcaaacaccaaccaatatttttaaacaatcttatgactatatatcaattattttttatggtttaacctgtaccattgcttataactttttagcaagtgtttcacgtgctttaggggatagtaaaacacctcttattttcttaattatatcatcggtacttaatgttgttttagatttatcaatgattattaattttcatatgggtgttcgaggtgctgcccttgccacagtgatttctcaaggaatttcagctgttttatgttttatttatatggctaaaaaatatcctaatttaagatttgatcatcatgcacgttctataagttttccaattatcaaaaaacttattaatattgccgtcccaatggctttacaatattcaattacggctgttggtgctgttatcttgcaaagtgctgttaatactttaggttcagcaaaagttgctgctattgctgctgcccaaaaattatcgatgttctttacgcaaccaatggatatgatgggttctacaatggctaccttctctggacaaaatttaggtgccggaaagatagagcgtatttttaaaggaattaaagaatctatgctccttgtcattggttatggtatcgttgcttgtatctttatgattttctttggaaaatacctttcattattatttgttgctggtaatgaaacaggcgttattaatgatgctcaacaattcttgatttgcaatagtattttctattttgttttaggtattctatttgtttcaagaaacaccattcaaggtttaggaaaatccgcacttacgatgcttgccgggggtgctgaattagtggcaagagcttttgttgcctttgccctcgttggtaagtttggttataatgccatttgttttgctaatccaattgcttggtttgcagcaatcattattttaattccaacacttgttattttaatgaaaaaattaaagaaagaacatagttaaaaaactggtacgaatttactcgtatcagcttttttatatgttctttgaatttaaacgattatgaatgttttgcattttcaaatcaatttcagcaattgatttagcacattcttgaagttcttttttaacatcgtcagaaacattattatctgttttatattttaacttatgttcaagtgatgcccaaaaatccatggctattgtacgtaattgaacttctacatgaattggtttaggtccttcagataaaaagataggaacttctaaaacaagatgtaatgacatataaccactttctttaggattttgaatataatctttcatttcaataagttgaatatcatcttgatttgtaagtagctgtgctactttataaacatcatctacataattacagattactctaattcccgcaatatcatgaatattttcttctaatgaacgttctgtaactggaatatctttactgattgctttttttaaaatactttctggtgatttaagcctagattctatatgatgaattggattatgatcatgttttactttaaattcagcatcaagaatttcaagttttgtacgtacttctttaatccctgcttcatagatttgttgcattctcaatagttctgtaacattttcataaagtgttgtttttgtaagattattaacaacattttgtttaattttttgacttgttttcattataacacctcatctttattaaaccttaaaaagatgaacttgtcattaacaaaagaaaaatctttaaagatttaatcactaaggtcttctccattagaagcaataacttttttataccaatagaatgaatcttttctataacgatctaatgtttttaaatcaaattcatcacgatcaacataaataaatccataacgtttaaccataccttcatgagtagaaattaaatcaatagcagaccatggacaatatcccaccatttcagctccatcagtaattgctaattgaatttgttcaatatgttttcttaaatattcaatacgatatggatcatgaactttaccatcttctgttaatttatcataagctccaagtccattttcagtaacgatcattggcaaacgatatctagagtacatttctcgaattgtagctctaaatccaaatggatcaatttcccaaccaaaatcagtatgtggtaaatttggattggctgcacctaaataaacaccctcttccatacgtgttttttgttgatcatgtccaaatgtttcttcttgactttcatcacaccaagcaacagttgctgttgaataataattgaaaccaataaaatcaggatgtccattctttaagatttccatgtctccctcttcaatatgtggtgtagcatctcttttttccataaaagcccatgctaaatggttgtattcaccataaactgccatatctaaataaagccagtttctaatcgcatttaagttttgagcagctaattgatcttctggtttacaacttgctggataagcaagagaaatatttggtgctggtccaatttttccaccttcaaccatttcatgacataaagccatggcttttgcttgtgctactaacatatgatgattttgttggtaaagagatttatatttttctggtcctgtaagggttgttgtgccaataatatctcctgataaaattaaaacgttttgttcattgattgtaagccagtatttaacacgatcaccaaagttttcaaacatcactttagcaaaattaacaaaccaatcaatagattctcgtttttcccatccacctctttcttctaaggcttgtggcatatcgaaatggaacattgtcactaatggaataatattatattttaaacattcattaataacattattgtagaaatcaattccttcttgatttacttcacctgttccttgaggtaaaattcttgaccatgaaacagaaaaacgataaactttaaagcccatttcagccattaaagcaatatcttctttataacgatgataaaaatctgcacatacagttaaatcagatgtcccttctggtacttttttgacatcttgaaccgaaggaccctttccgtgtgataagttagctccttctacttgataagcagatgtacttgctccccaaagaaagtctttaggaaatggttttaattttttatgtaacattctttcttcctcctaacattactttaattatactcttaaagtaaaaaaacatccatatggatgtttagtcaatcaattcatcagccttgtaatctctaaatttatgataaacaggcccggcataagcaaccattaattcatcataaactttacttgataatttttctccaacataaagcatttcatatttaacatctttttctacatatttaaagcccatttcttgaagtccatttcttaaataaaagtttttacgatgaacacgttgtttgtagttatcatatttttcatctacttcttcaatacataacataatggtatgaggatatctttttttcaatatttgtaagacactacttccatagccatgacctctttgcatatcatcaatagcaagatacaaaatataggataaattttgataggtaatgacatacgttaacccaacccatttatcttgatcatagattgataaaaattctcctttacctttattgtgtttttctataagagctttccatggtgctctttcatcttcaggaaaagcactgtaataaagttgacttacttgttcaatatcattttcacttattttctttaattctaattccataatatctcctatttgtagtatttatcaaaatatgcttttaatgattttttgattgaaatgtgatccaatttcattgaaaaaacaaaacgttctttttctttaaattcatttcttaactcaccgatatgttttctaaacgcttcatattggacaataatatcgttttctttcgcaaatttttggatattgtttaaaatatttaaagaatatccaacatcaattaaaaagacaccataaaataaacctacaaaaaatgaaaaccataaattaccagcaagccattcaattgaatgaatgatattaggatgaattaaaaaataataaatcgcacttaataaataccaaaagaaagtaaacttaggacaaatgattccttgaatattaaatttttcatcactataatcccaaagctttacatgcattcctttgataaaaataagtcctgcaaaatattcaattaaagtaaccgataaagccattagtaaaaaaagtaccgtctttcttaaatacacttcatgaataaatgaaacatcaatatgtgccaataaataaacgacacacaaactaaacccataaagtggtaaataaggtcctactaaaaaaccaggattgatccatttccttgaaggatttgctttggaaaaaaagcgacggaaaataagttctaaaagccatccagctaaacttcctataaaaaatataaacgctaaaatcaaccattctttcataaaatcacctatttcattttattaaataatatagtaattagaatacttgaaacaacctaaaaaatcaagttaaaaaaataaggcttccgccttataatgtacaaatcatgactgtcattgttccatcaaaatcaacttctttttgatattctacaaaagaaaaggctgtatgaaattaattgtttaatttcgtaacagcccctttaatatctattataattttaagccaacttctaaaccttctttagttgctggaatagcgccacctgcttgtttagcaccaccaatgacatagacttccttacaatattttttagcaatttcttctaatggattatatgatttataaccaaaagcagagatgacttgtacagctggaatcgaaactgtatttccacttgcatcttctccaataacagcagtttctgtaatttctttaactttaaattgtgtttttactttaatacctgctttttggatcatttctaatagacatacttttgtcatgatcatcatatcatttaaaatatcaggttgcatttctaacaatgtcacatcatgatttttttcagctagatagtgagctgtttcaccaccaacttctcctccaccacaaacaacaataggaccgttagaaatatcatatttaccaagtagcatatcttctgcagtaaatacatttttaccatcaatacctttaattggtggaaccattggtttagcccctgttgcaagaataatagcatctggtttaatttcttgaatcatttcttcacttacttcactatttaaatgtacaggaacattaagagcttctaaattagcacgataagaagaagttgtagtagataattcaccttttccaattggatatgcagctgatctaaattgaccacctaaatgactacttgcttcatataaagaaacatcatgacctttaatggctgctgttcgagcagctactaaacctgctggtcctccaccaatgaccattacttttttaggttgagtcgtttttgttaaatctgtttcatattcacgccctactcttggattaactaaacaagtgacacatcctcctgttaataatggaccttcacatccttgaaggcatccaatacaataattaatttgatcaaattttccttctttagcttttactggtaaataaggatctgctaaagaacctctagccattcctacaaaatcacatttatccatttctagtaaaatatcagccattcccggttcattaatacgattagctaaaataacaggaattttaacgacctttttaacattagcagcagcttccatatttaatgcatgtttagtaaacattggtgcaataatttgatcaattggtgctgcagcataaactccatttgaaacatgaattgcatcaaaaccaacttcttctaaatgtcttgcaagttgatatgtttcagcttctgtacgtcctccttgaacatattcattagctgaaatacgtacttgaattggaaaatctccaacttcttttctcatagcagcaataatttcatcaacaattcttactctattatcaaaacatccaccatattgatctactcttttattgacataagatgataaaaattcagctaataaataaccatgagcacaatgtaattcaattccatcaaaaccagattctttacatcttcttgctgcttgaccaaaatcttcaacaagtgtatgaatttcttcaacagtcatttctcttgctaaatccatacaaataggatcttttgttcctgaaggtgctaatggttgaacattaccattaaccgcatgtgaactttgtcttcctggatgatacatttgacagaagatcttagaaccatgttcatgtacacgacgtgttaattctttatttaaagcaacatgttcatctttataaaatcctggaatatattgatatccctttccatgaggtgtaacactataatcttcagtaataatcattccccatccaccttttgctttttcttcaatatatgccatatatctatctgttaaaaagccatcttcatcacaataatttgtaaccattgcaggtacgaccaatctatttgggatcgtacaatttcctactttcataggtgtaaataattttgttatcattcctttttcctccttgtaaccacttatagtatacgccttgaaagcattacaaggtcaaatgcttgtgaaataatacacaaataagtaaaatagcttaaaaaacacaaaaaaacattgaaatgatttcaatgttttaaagcaattggtatttgtatttccataatcctttgaaaattttctccttcataacccctacctacaataattcctctaggagttcctactatttgatattcatctttgatttcatttaatatattttctaattgatttctattaaaacaacctatttcacccatatcaatcattgtacatagacataattgcttctttaaatactttccatctttaaaagaaagctgcagtgattctatgtatctctcttccattccataccaccaagtttctttctctttttcaaataagaccatagattccacataaaccattctttccttggaaaaaagcaaatttctattttcaatagatatttgtaatttatcatagtcatcaccttttccattagttagaaacacaagttgatatgcaggaatatttttgacccaatactttcctaaattaaatttacatgtttcgattctttctgctaattctttaacacgttctttcaataaaatttttttaataatatcttgatctatttcttgataatattgatacaaatgttgtgcatagttttctaaataatgttcatttaataattcagagatatctttgattccaaaatgaattgattgatagcgaataatttccattaataaaaaaacatccatgactgaatatgtacgataattattatcttctttccttgatggttttaaaataccttgtttttcataataacgaatcatttcttttgaaatattcaatattttagatacttcacctattttatattccatacgcaattcctctttccatttatattattgtatcataaaaaaatattcaataagtaataattgcttattgaataatctattgttttaaaaatggtggtactaatgagattcgaactcatgatcttacgttccggagactaacaaccaccaattttttttgtttaatttttttctccaatcccttaaaatctatatacaccaacacttttgaagatttcttggtctcttataatttttctaattttatctattttttgctgtttttatgtctttgttagaaaactgttagaaaacatcaaattttctcgtttaaaacatttcttcaaaagccttgattttactatattttctaattcatcctcgattagattcgaactcatttctgcccgccattgttaggaaaaccactatttttaataaatttatagtaatataagctaaatttcaatgaaaaaaatggacctgtagtccatttataaagataacattttcttcaattgttctcttaatgcatcattattttttagtatatccaacaattctgatgcatattttaaatcttttatgagtttaaaaatgaatttaattctatctataaaacaatagatcttatcttttttcatttttttatcctccttaaattatattcttacagctgttaataaacttataacataataaattagcaataaatatcacattacttaaaatgcatctttttttcttaaacgttttatatttattatttttttataaagtagtcgttgtaaatcaccagtaatttacattaattaaaaagacttattatttcacgcaattcatacaaaagttttaaatatatttagttagttattcaaatttatctagaataatagttataatcaatttcataatatttaataaaaaaacagatagttaagtaattcaaaccacatagacaccacacattaaaatcaataatttactcaagtttaataataaaattaaataaatgattattttgattttctatacattattatgttaaatgtaagaatgtgattattttggcttagctaaccaataattccgatttatcttgatcatcaattccgattaggttgaccaactatataatacaagctcctttttgctttaaaattatgttgtagataagcatcgtatctacaatatattttgcaggataggaattttttatttttaaacaaaagaagaaaaatataaagagatttttaggtatttgtcactgggaatatctagaaatgaaatttcaaaattattaaagacatcaagaaatacgattagaaaggttgaaaatactgctaaatctttaaatctaacttggaatgatgctagtacaatgtcaaacgaagaatttgccaataagctatttcctaaatcaaatgatgataatgataatcttcaacccaaacctgattgtgaaatgatgtatcttgaattacaaaaaactggtgtaaatagaatgttattatgggaagaatattcaaaagaagtaaaggctattggaaaaataccacttcaatattctcaattctgtaattattttaatcagtatatggaaaaacaaagcaacgatgcattagctgacgctatattagatagagttgtttcaaaatcacaaacgattaaaatcatggacgataaatcaatgagaagcagataaaaaataaattctgactgaataaaaaaagttgggattttttatatggtcaagcttatcggaatagttgatcaatctcatgggaatttgttgaaatatagtcgttggtcaacctaatcagaatgaatgatcaactagagtggaataatcaagaatgtgaataatactattaaaatccacttaaatatgttggtactctaaataaatattaataatttcaatacaccatcatagtaaaaataattatttcatataaaaattttaatttctaaaactactatgattattgattatgttttattttttttcctctatctaacctttgagtatctgcttcaaatattttataagtaagctttaaaatataaaaaaatagggtaaaaattaccctactgtttaatattaattattattctttactattaaattagcaatataaaatatagaaataagcattacagaataaaaagaagctgcacctattatgttatttaaaaagctaagaataatttcagccacgaaaatcattaatgctatatttttgattttatttcttttattatttaatatactatataaagttaatataaatattggtatattccaataaaatagaatatttttaaaattcagtttataaaaaataattgtaattgtaatgattaaactaaataacaacaaacaagtcgacacttttttacaatgatagcctcctataattattcttaccggtatatacaaagtcattaataaaattataaattgttcttcatttaataattttcctattaataaaattataataaatgtaaataaattataaaataatataaaaagtccataattaaacaataattttctttcttctatactctttggtaataatttttccatttaaaattcacctcgatttgtaatagaaatagataatctaatattatagctattatcatcaaaatagatgttagtttttgtgttatatttttttgataaactatctacagccgtatttaatttaatatttttatccttatttccttttatacaaatattgattaccaaaaaagaattaatttctaacatacttaaatctgtatcttcattattcaatataattgcatcaattaaggtattcaaacagtcaataaattctaaattatcataaaattcatttttttctatcgcgatagataatttcaaatcagtattattatcaaaacatttagataattttaaagaaactaagcaatcaaaaatatcatttcctgaatttattacatattggtttttattcaataacgatttatatttttctatagtttctttgattttagataaatcctttttctctaacaaccattctatttgccataatatataaaacattctatgatttaaaatatctgtttctttttttatatgttcaatagtcttatatttttgctttttaaaagcatattcttgtaatttttttgcattttgtattttttcattataattcttattacaaacaagaataactaaataaaatagaatatttgaaaaaacacatagaaataataaggattttataatcatttgattaattttcccaaaatttaatgaataaagacataatccaatggttataatcatcgaaaattctgtagcaataataatccaccattcttttaatttcaatgttataacgtatttatctaaaacaatataaataaatagcgataaaattaattgtaatattttagataaaatacatgctatataatatattgtactatttaagaatatctctgatatatctatagagaatatataagtaacaatttctacggaaatactggtacataaaattataattatattataaataatgggtataaataaaattttaaaatttaaagtttttgtttcaattattaagccaaatatagtaaccaaaagaacggctatcgttaaaaaaacaccatcatacgaataatagctactaatattagtaatagcgtaatttatcataccaataattgcagtataccttatttttttatttaaattaaaagtatatgcaataaatccagaaaataaaaagacttcaataaaatttataaaaagtgtaaaatatgtcattttattaaatattcttgatacctttcataaaataaatctctatattttctgccaattggtatccttgtgttatcaaataacaaaatttcatttttatttattccctttaaataatctaaattaataatatatgatttatgtatttgtataaaatttaaacttgataactttatcaaaaaagctgttaaactagaactatcataataaacatccttttttgaatggatagttaattgatgctccctcgattcaatataaataatcgagtctacgggtatatgaacacgtgttgctctagaatctaaggatattaatgtatttttcttaaaataattatctaacatctcaaaaaaataaatcaaatccttcttataatttgcctttcttaaaaaataaaatggttttacaacaaatgttttgaaaacaaggttacttctagatgatataaacacaatcattacattgttatccaattctcgtaattgtttagcaattatcaaaccattattagttattaaatcaatatctaaaaaaactatatgataattatcaaacaaatcaacttgatcgaattcatcatttataaccgtgattatggctttatcgttagttttttgaaaaaaattcttaatatcatcttttagtgtattagtaaattttttatcatcatcaataatcaatattttcacaatgatttcctccctcattaaaagaaaaaggaacctttaactcaatttgaagttcttacttacctttgaacaggaatatataagagaaaacaaaatataataatttctgaaatctctcaaaagaaccaataaattaaagattccatttataaaataatatattatctttatatcattttatcacattttttattaaatttttcttttttaaacatctttttttaattttagtttaacaggacattttggattgtataacccatattgtgatggtgtcatcgatccaataacagcaattgcaaatactaatgtttttaaaattttcttcatttctattcttccctccgtttacaattacattttattttctctttgaaattattttttttttttaactttaaacgtatcttattttcttataaagtatttgaggttcgtaatcaccgaacactttgataataaaattctattaggtgatattatgagctttggagaaaaattgaaaaaaataagattagatagaaatttaactttaagtgaagttagtaaagcaataaatataggtaaatcttctctgtctgaatatgaaaatgatatttctagaccatcactagataaattttttagtattattgaattttatcatgtgaatgaaaattatttttatggagaaaatcatatatttctagatctttctactttatcaaatgaaaccaaggaaaaaatttatgcaattcttgcacatgatgatatttataaaaaataacataaaaatagtgacctttattatccatggggtcactattttttatttgatattaaatttatcataaataaattctaccattatatgctattgcttattcattaatttattcaaaccattttccatattccttagtattttccttttttcatttatagaacatgagtagtaacattcattaatcattttaaaatttatttttctttgcaataattgaattatgtaattaaaatcataaaagttattttctactaactccagtttatcaaatataattttatttatatttttataggattcgtctctaactttacataaattatcttcattataaacacatggtttacaaatatcatcttcacttattgtaaaagcaataaattttatatctcgataaataatactatttgcaacaaaataataatcattttgtttttttaaatcaggatgaaataattcaatattctctccatatttttttataatacaaaataagtgatatggtgttatttttatattcatatcatcacctcttttttataaaaatgataaattcaattcatttattactaatcagtagtcatatttaaataataatttaattgctttattcttaagtaggtagtcttctggacaaagcaatacaatttattttattcaatataattattttttcttgattagtcattattttttcattatataccaaattcattgcacttcttaaatactcatttgcttctaaattattttttgtagtaatcgctttttctaaaaattgttcaatttgagaattcatttttttctcctctatacttaaatttataattaaagaacttaaatgatgtgctgtagctgctacaattaattattaccataataatacaattcattaaatattatttcatcaacgacattattttttcatgacttttgatagtttaaaattatcttttatataattttcaattgaaaattgtattcgaacaatattatttttagatgtatatgaatatttttgacgacattgtatcaacataaacgatatagacctgatgtatcaatttattaacttataagtattgttactgttatatttaatagaaaaataaatattttttattaaaacatcatcaatttaaaattgcatccgcagtgtttgatagtttaattaaaaatcaataaaaaaattatataagttaatatcaaatgtaccaaaaataatatcactcacgttatcaacataatttgttgcgttacacataattgaattatttatatatattatcattaagtaatcattattatttcttttctacatgattctcctaataatttaagcacccaaacgataatcatttataggatttttttctgttagtatttctatctgtttaaaatatgtaacatgagtataaatttgagttgtagatatcgaactatgtcctagaatactttgtatatacctaatatcaacatctttttccaataatgttgttgcgaatgtatgtctaaacatgtgcggtgtaatatgttctgttagcttcaattcagattcaatgttcttcagaaaaattcgcatagattgatcagaaatttgttttccaaatctatttaaaaaaaataatcattttctgcaacatattcatttaattgtttatattccttacataagtcaacaacagtttcattgccaatatataaaattctttcttttgatccttttccaaaaaatttaagagttttttcattaaaatttatatctgctacctttatattacataattctgatatacgtattccagttgaaaaaagtaatccaataattgcaatatttctaattgatattattgtttgaaaatctgttttagcagatgatactctatcaaataaatattgaataattttctctatattttctttttgaattgtttttggtaacacatgtggttcttttatttttgttcttactttgttaaatggtgaatattcaataatttcttcatattctaaataggaataaaaagcctttacacttgctaattttctcttcacggttttatgtttagaatattttttattcataaaatgtatatactcatttatctcttttacctcatcctctagattcttgacaaatattttcataacaataaaataaaatgtaagatttttacaaaagtataaaagactagaaatctaatttctagtccttattggtacataacatatatttgtaataattttttgtattaatactttgcaatgcaattattttaggaaatacaatcaattaaacaatctaaaagatctaaatattcaaaaagtttatctaattcctcattacaaaaaactaacgctcctatttaattatacaaaatcttcgatatgctttctggacagtcatcactttgatgtaccaattgcaatgtaactgttgcagattccaattggttctttattcctttttttaacacatctattatatctgtaatttcatctatatttttcatggtttgtttcctcttacaagaacaaaataacatatactgacaaattttataaaaaaggaacaaattggtctttaaatgaatcattaaaaaaagagcactttcgtgctcgttgaacaaccctgttagactattagagcgaaagaaactgctcaattaaaataccacgttagacatacagatatgcaaaagttcatcaaaaagaagttgattttgatggaacaatgacagtcatgatttgtacattataatgagatgttatcattgtagtcatgaaataaaagattctgcttttgcttataagggtagacaagaatgtaaagaatgtcatagtatttatcaaatccattttccttcaggagtaggatttattcctattgtgattgcctttataccggctttatatatggtaacaattttaagatatgcatttattgttggacttgcggtctttgttatcttttattgggccattgatattattatgaataatattttaatttatttaggtaaatatgaaattgaagaaattgaataaaacttgtatttaaaaaaataaagagtatcattaaatatgtaaatagaaacaggggagcttgtaggcaggctgagaggaagtcatcaaacttcgaccctttaacctgatatggataatgccatcgtaggaagtcaacatttcgatttttttacaggagcatgtctcctgttttttatttaaaaagaagtatccacatatgtggcggattgaaggggagcgccttgaatcttgtattaagcgaagggaagctgtgttccagcgtgagaggataccacaaagtatcgaccgaactaccataaagttatttcataaacgaagtttatgtttttgatgatgggtaagtttggtcatcttcatatttatgaaataacttgtaaaaaacaaggagagaaaatatgttagaagaaatgttaaaaaatgttagagaaaaaagtccactcattcacaatattacaaattatgttacagtcaatgattgtgctaatgtcgttcttgcatgtggagcatcaccaattatggcagatgatcaaaaagaagttgctgaaattacttcgatttgtacaggacttaatattaatattggaacacttaatacgcgaacgattgaatcaatggtcattgctgggaaaaaagctaacgaacttcatcatccagttgtattagatcctgtaggagttggggcatctacgttaagaactcaaacagctttaaaattattaaaagaaattcagttttcagttattcgtggaaatatttcagaaatcaaaactttagctttaggaagtggtacaacgaagggtgttgatgctaatcttgcagataaagtgacagcagaaaatatccatgaagttgtcagttttgctcaagagttttctaaaaaaacaggggcagttatcgctattacaggagctattgacttagtatgcaatgaaaatattgcttatgcaatttataatggtcatgaaatgatgtcttcgattacaggaacaggatgtcaattatcagcacttacggcttcgtttatttccgcaaatcctgattatttacttgaatcaacagttgctgcagtatgtaccatgggtcttgctggagaaatcgcacatgaaagattaacaccattagatggtaatgcaagttatcgaaattatattattgatgctatttataatatgactcctaagcaattacaagaaggatctcaatataaaaaaatctaactagatatgtgattactctaaaataatgaaaagaggaagattatgaaaacaacagataagatgttagaagcaacaaaagaactatggaaatcttataatgaacatccttttgttaaaggaatacaagatggttcattaactaaagataaatttaaatattatattatgcaagattatctttatttaaaagaatacgctaaagtttttgcgattggagttgctaaagcaaaaactttagaaacagcgaatctttttgctaaatatattgctgtaatgaatggtgaattagatgttcatagtggttatatgggaaaatttaatgtaagacaagaagaaatagatgatatgaaaccatcacttgataatttatcttatacctcttatatgctacgtgttgcctatgaagaaggagaagtagaaatcttggcagctatattatcttgtgcttatagttatgaagttattgcgaaaaagattgttgaaaataatccaaattcaatcaatgatgaattttatgggaattggatcaaaggctatgcttctaatgaatatgctagtggtaatattattttaatagaaacaatgaatcaacttactaaagattatacagaaaaacaaattcaacatcttattgatatctttgtagcatgttcaagatatgaacttgcattttggcaaatgtcatgggataaaagttgttagtaaataaaaaaatgaaagagacaaaacatctttcattttttcattataaagaaaaagaaggagaattattctccttcataattttcaacgttatggtagattttatctacatcgtcacaagcatttaaaagattcattaatctttcaaataattccatatcttcaccttcaagagatacatattcttgaggtgttgtagcgatttcttctacatcaaattcagcattaggacaagctgcttcaatagcatctttcattttatataaatcagttggtgcaccagttaattcaattgaaccatcttcatgagtttcaatttcttgacaatcagcttcaccttccattaaagcttctaaagtttgttcttcatctaatcctttaaaagttaaaatagaatatgtatcatataaataagatactgaaccttcatttcctaatttagctttagattttgtaaatgcaggacgtacttgagaaatagtacgattaatattatcagttaagcatttaacaataacagttgaaccacttggaccatatccttcaaatgttttttcttgataatcttcagtagctccactttttactttatcaactgcacgtttaataacgtcagcaggaacttgttcttttttagctttagcaataattcttcttaatgctaagttaccatctggatcagtaccaccagctttagcagctaaatagatttcttttccataacgagaatataattttgcttttgctgcagcagtttttgccatagcaactttacgcacttcatgtgctctacccataaaaaagcctccttaattgtatgtaatctcaatacttggttattatagcgaatacatcgaggtttttcaaggtttaatataaatgacaaacgagttttgttcatgtataatgaaaaagcaaatgagggataaagatggaaacaattgttattattggagcaggtgcaagtggacttgcatgtatgaatgaattagtaaaaacaaataaatataatattattgtcttggaacaatctaataaagcagctagaaaaatacttgctagcggtaatggaagatgtaatgtttcaaatttgaatatggatattaagtactataatcatcaagaccctttaatagaaaaattaattaaagaatttgatgtcgtcaatttttttaaacaactttctttaaaactacgttatgaaaagaaccttgtttatccatattcactttcaagtttatctgttaaaaatgctttaatgaaaaatatggataatgtatcgtatatcgataattgtgaggttctagcaataaaaaaagctaaaacatatgaaattattacgacgaatggtcattatcaagcggataaaatagtcattgcgacaggatcaccagccagtcatttatcaggacaaaataatttaaaaatgttagaaaaaatgcatatttccatgattccatttacaccaagtcttgttcaagtaaaaacaaaacccgtttttaaagctttaaaaggacaaagagtaaagggaattgcaatgctttatgatcaaaatcaattgattgaaaaacaaacaggagaaatcatgtttacagattatggtctatcaggtatttgtattatgcaattatcaagatatttagatcatttaaaaaatccaaaacttgttttaaatttattgcctgatattgaaaaagaagaatttcaacactatggtttagaaggtttcttccatgaaaaaatcgttcagatttttaaagaaaaaaatattgatcctcgttgtttagaattcaaaatcatcgatacaatgtcaattgaaaaagcacaagtttgtcatggtggtgtttctttaaaagaagtagatgaaaatttacaacttaagaaatatccaggcatttatgtttgtggagaagctttggatgttgatggtgattgtggaggttacaatttacattttgcttttgcaagtggtgtacatgtggcaaaatcgataaagaaataaaagagtagtaaatgtgttgtaaatagaaatgttataatgaatatataagtggaaaaattatatttaccaaataataaggagctaactatggaaagtcaagaaaagcacaatatagaatggaaatcagtttggaaagatgaatatttagttggtatatgtgcgtttgccaatgcacaaggtggtaaattttttattggtatagatgataatggtaaaattattggtgtggaaaattcaaaaaaattattagaatccttaccaagtaaaataagagatgctatgggaatcgtagtagatattaatttagtccctatttacatttgtgtgtctaataccaagacagtataattatacatttcacgaattgcgtaagcaattagaaaatcaagtagtccaaattccataaaatgaaattttagggcaaattacagacattggcttggctgtagtatttttaaacaacgtgtgttagactactgttatacaaatcgaaatttataaaggagaatattgatgaaactgtttttatgttcgcacttttcaagtgtgggaagtctgataaaggaagaaattgaaaataagaaagtcgcatttattccaacagcttcactgcgtgaaggctacaccggttatgtcggctcggctcgaaaattattcaaaaagttgggagcaatcgtaactgaaattgatatttcaacggaggcttattcaacgatacagtctgtttttgaagaagcagatgtgatatattttaccggcggaaattctttctttcttatggatcagctccgtaaaacgggagctgatgggctactgaaaaaggaattggcaaatggaaaattgatgatcggcgagtcggcaggcgcaattatatgcgctccaagcatccaatatatcgagcaaatggatgaaaagccggaggactactcacaagaagatgatgcagggattgatttgattgatttctatgttcttccgcattatcttacagcaccatttaagaaagttaccgagaaaataatgactgagttttcggatttggatctatgcccaattaacaaccgtcagggaattgtaattgatggtgaagattcaaaggttatttgcaaagactaatttgaaaattccagtttgtcaattacaagtgacattgaaagagtcagcccattcaaggtgctggctctttcaaaaattccaatctaataaattgcatgataacttagagtaaaaatgaatagaaaatgaataaaagcgtggtgtttcgtataattatgagttagtatgcatcagacacatttttgtaaaaagggagttaatttatgtaaagaaaataatttggaatatatagaaatagatgttccgtcttatccaatagctatatcttgtaaaggaaactattattttagaagtgggtgtacatcacaaaagttgacaggtattgaattagaaagttttattttacgtaaaagaggagcaacttgggataacgttccatacccattagtaaaaatagaagatttagatcaaaacgctattcaaaagtttaaagaacttgcaattcgcaaaaaaagaatagatgatacgattttagaagaagatacggaaacattattagataaacttcatttgataaataatggttatcttacaaatgctgccttacttttgttttcaaaagatccagagagatattttacaggtgcttttataaaagtaggattttttgaaacagatgctgatttaatttatcaagatgaagtaagaggatcgctttttgaacaaattgataaagttatagaacttattttctttaaatatatgaaagctaagatttcatatgatggacttcaaagagttgaagaatactttgtaagtgaagcaagtatgagagaagctatattaaatgctattgttcataaacaatatgaatctggtgtaccaatacaaataagtgtttataaagataagctctatattacaaatgttggaaagcttccagatcattggatagaagaaactctttatcaaaaacatggctctaagccctataatcctaatattgcgcatgttttctatttagcaggacatattgagtcatggggaagaggtatagaaaaaatatttgattcctgtatagaaaatgatttaccaatgccaaaatattatattaatcctacggatattatgattgaatttgatgcacctcaaagattggtgattgataacttttcaaaggtgactaatagggtgaacgatacaatgaataagatactagaatccctatatgatgatcctggatatacaattaccgaatttgcaaatattatgaaaatgagtagaaagagtatttcaaataatattaaaaagttaaaggatttaggaattattgaaagagttggaaataacaaaaaaggatattggaaaataaagagataggagaaggtatgttaaaagtaagtaatattgcagtttctttagatgaaaaagattacgctaaagttattgcgaatacattaaatataagaaagtcacaagtaaagaatgtaaagattgctaaaaaagcagtcgatgcaagaaggaagaataaagtatattttaatatgggttttacttttgaatatattgatgaagatcaattattaaaaacacatagtaaacaagtaagtaaagttaaagaatatcattatgacaagttaacaccaaataatcaaacaatcatggttgttggaagtgggccagcaggattattttgtgcctataatttagcgcgtagtgggcaaaaggtaatcttgattgaacaaggtaaatgtgttgatgaaagaaaaaaagatatcgatacttatttagaaacaggtaagttaaatactcaaagtaatgttcaatttggagaaggaggagcaggaacgttctctgatggaaagttgacgacaggtattaaggattatcgtaaacaatttgtattgaatactttttatgaacatggtgcaagtgaagatattctttacttaaataaaccacatttaggaacagatgttttaattaatgtggttaaaaatattagaaaagatattgaaaaatgtggagatgttcgttttgaaacaaaattggtagatattattattgaagataatcaattaaaagaagttgttttagaaaataatgaaggaacatataaagaaaaagtagatcaactggtattggctattggtcatagtgcgagaaaaacctatgaaatgctttatcaaaaacaattagaaatctctcaaaaagcttttgcagtgggaatgcgtattgaacatagtcaagaatttattaataaaaaccaatatggaaaattctatgatcatcctgcattaaaagcggctgattataaattggcggtgcatacaagtcaaaaaagaggagtctatactttctgtatgtgtcctggtggttatgtcatgaatgcagccagtgaagaaaaaagactggttgttaacgggatgtctaattataaacgtgataataaatacgctaatagtgctatcttagtcaatgtgacaccggatgattttggtagttcacatccgcttgcaggaatgtattttcaaagaaaattagaagaaaaagcttttgaactaggaggaagtgattattcaattccagttcaaagagtggaagattatttagaaaataaagaaagtaaagaaaaaatagagacaagtttaaaaagagttaaaaatgctaatctcaatgcattacttcctgaaatcctgaatataaatttaaaagaaggacttcttttaatgaataacaagattaatgggtttacaagtgatgccacattactcggagtagaatcaagaagttcagcaccaattcgtttttatcgtgatgacaatatggaaagtaatattaaagggatttatccaattggtgaaggtgcaggatatgcaggtggtattatgtcaagtgcaattgatggtttgaaatgtagtgaggtattactcaaaggagagagataatgtgtcattatttgaacttgttgttatttcaatttcattagcgatggatgcttttactgtttcgatgatgtatggtatttctatgccaaaaggaaacatcaagaagcaaagcttcattgctttttattttggcttttttcaggcattgatgccttttttaggatatcatttaggatgtgtattttcaaaaaagatacaagcctatgatcattatatcgcttttatttttttaatgattgttggtatcaatatgttaaaagatgcttttagtgaagaagaaacaaattataattttaaattattagatttaacaattcttgcttttgcaacaagtattgatgcttttgctattggtatgacttttgcttttttagaagtagctatttatcaagctttattgattataggaattattacttttctattatgtttgtttgctttacaaattggacgttatttaaacaacaagtttcaaaataaggcacttatttttgggggcattgttttgattttaattgcttttaaaacattgttggagcatcttttttgaaaaaagtatataatgaaataggtgacaagtatgaaagaagaagaaaaaattataaaaaatactataaagagaacaaaagaatatgatcgaacactttctccatatgcttgtaaaacaagtgaatgccaaaaattaagaaaagaagaaagtgaacatgaagagtttgatattcgttggccttttgaagaagatattgatcgtattttatattgtaaatcttatcaacgttacacagataaaacacaggctctttcattttttcaaagtgcccatatttctaaacgttcaatccatgttcaatgggtttcacgtattgccagacaaataggaaaaggtttgaatttaaatttagatttaattgaagcggctgctttaggacatgatttaggacatgctccttatggtcatgtaggagaaagagcgttgaatgaaaaactacaagaaaagggttttggatatttttgtcataatgctaatagtgtacgaaatattctttatttagaaagaaatgggaaaggctataatgtttctttacaagtcttagatgctattttgtgtcataatggtgaaatgctttctaaaaaatatgaaccagatcgtaaaaaaacaaaagaacaattcttacaagagtatcatgattgttggcataaagaaaatgccagtcttgagttaaaaccaatgactttagaaggatgtgtggttcgtatttcagatgttatttcttatattggaaaagatattgaagatgctatgagtgtaggtatcttacaaaagaaagatcttcctgaaaatgtagtaaaagtattaggagataataataaatcaattatgaataaattaattggtgatttgatgattcatagttatcaaaaaccatatttacgtttttctcatgaagtctttgaagcattatcatccctactcttctttttaggagaaaaagtccatcatcatccagttttagaaaaagaaaatgctaaactttcaagaatggtcaaagaactctttgatgtttatttagaagaattagaaaataatgatcaagattcaaatattgttaagtttaaaaataagatggtagaaaattatcaaaagacgcccaatccactgattgtctctgattatttatcaatgatgacagatacttatgttttaaatgattatgaaagaaaatttttaccaattcttcatggcgaaaaactttaataattattttatttggtgtaaaatataaatatacaggagggatggcttatgaaattaattattgctatcgtaaattctgatgatagttcatcagtacaagccgcacttacagaagaaggatacttcgttacaaaactatcaacaacaggtggattcttaaagaaaggaaatacaacattctttattggaacaaatgatgataaagttgaacatgctgtaggtattattaaagaaaattctaaaaaacgtgtagaaaaagaacctactgttccacctactgaaatgggagaattttttactccaatcatggtagatgtacttgttggtggagcaacagtttttgtattagatattgaacaatttgaaaaattttagaaaaaggacattgtcctttttttttaatcctttataatgtttgtgggtgaaattatgtctatcaaattattaaatgaaaaaagaatggatgaattaatacaatttatccatcaagaagaaataacaaaagaatatttaaaacaaaatcaaaagattatttatgtcaatgaaaatcaaaatatcaatggggttattatttttgatgttatcaaaaatgaaatagaactttgtttaggaactgatgaaattaaacaacaattaatagcagtcattaaaaaaatagctctaaaagatatcatttatcaaaataaaatcatacaaataaaaacaaaaaaacaatttaaacactatgaagaagtctatgaatttattcatcaacaaaaagatcgtgtctatagtttagataactttaaaaaatatatgcaagaattttataatatccaacatgctttaaaatgtatccatgtttgtggaacaaatgggaaaggttcgactgttaattacatgaaagaagttttaaaaaaacagggatatactgtaggaacttttacttcaccagcacttatttctaggttagatgtcgtacgtatcaatgatgaatggatcaaggaacaatttattgttgatgttgctaatagatatgtggataattggttaaagtatgagatttctttatttgaaatagaggtctttatttcaattctttactttatttatcaaggtgttgactatgccatttatgaggttggattaggtggagagttagatgcaacgaatattattttaccaatggtttgtgttaatacgaatattggtttagatcatatggattatttaggtgatagctatgaaagtattgctagagcgaaagcgggaattattaaagagcatgttgattttattacaggagaacataaacaagaatgtgttgatatttttagagatacttgtgaaaagcatcatagtcatttgatacgtttagatcgtatacatgatttacaagatggtgaaaatgtaaaatatacatataaggattataatattgttttaaatacgccagctctttatcaaattgaaaatagtgctttagcactagcaaccttattatatttaaaagaacatcattttattgaattagatgaatcttcaattgttgaaggtttatttgaagctaagtgggcaggacgttttgaaatcataagtgaaaaaccactgattattttagatggggcccataatcgagaaggtgttgatgaactctatcgttctgcacgtaaattacataatttaaaaatcatcttttcagcattaagagataaagatacggactatatgattgaaagattattagatttgacgtatgatataaccgtctgtgaattcaaacatccacgtagtcaaagtgcaaaattattagcaggggattatccagtaaaaattgaaccggattttagaaaagctttagacgatatttatttacaagaaggaacatttttgattacgggatcattgtattttatttctgaagtaaggaaatacttattacaaaagattcatagcaaataataaagaaggaggagtctacttttagtagcaattgtgtacggttttatatcggaattaacgcccgtggactagcaagaggacgaagcgggaaagcatatgtacggttttatatcggaattaacgcccatggactagaaagaggacgaagtgggaaaaaacatatgtacggtttcttaccggaattaacgcctgtggacttataagaggacgaagcaggaacaattggtttttttaagtagcaatcaaacgatgattcaaattattttaggggttattattgtttcgattgggatatttgttttttataaatatccaatgaaaagcgatgtgcgacaagtgacattgggggctttatttgtcattctagctattattttaaaaaggttagctgtgatggtaccttttcttggctttccaagtttaaaaattacattagaggtattacctttaatcgttgctggtttaacattacaaccagggtattgttttatagtttctattgccacagattttctaggtcttgttctagcaaatgctggaggatttccatttttaggatttactttaaatgcggttttacaaactgaaataccatgtctattaaagatttatttaaatgaaaaaaatgaaagattattagaaagaattgtaaaaatagtaatggttattatttcgttactaggatgtctttatgtttttaaaatcaatgaagttaatatttcaggatcttcatatcaagtaacattaccaattaaatttacaatctttgtcatcattgcagcaatgcttactattctctttatttttataagatattataaaaataaactcaaagaaaaagatttatgcttatttcatttaagtattctatcagttgtggctattgaactaacagtaacgatgtttttaacaccatattggttacaaacaatgtatggaataccattctttgcatcacaatttgtaagaattttaaaatcatgtgtgatgatacctgtaggtattatcattgtatatacaatgaatcgaatgattcaaaaagttattagataaagttttggatattgtccaaagctttttattttgtaccaaaaataaaagatcaaattaataaagaaaatttgataatttttgacaaatttatagcaaaaattacaaaacgggcaatttgttgtatttaaaattaaaaaacaggacaattggtgtattgtatagatggaggtgttgctttatgcatagaaaaagttcgatttctattagagaatggcttgaaaattctaataaagcacttttagtaacgggtataagacgttgtgggaaatctattttgcttaagcagattatggatgaaatgaaagaggatcaaggtgttaccgatgatcatattatatatatgaacctggaagatatgaaatacgcatttataaagaatgcgatggatttgtatgggtatgtggagaaacttatcgttgatgaagaaaagtattacattttcttagatgaggttcagatggttgaagaatttgaacgggctataaattcttttcacgcaacaaaaaatgtaagtatttttatcacgggttccaatagctggctgttgtcgggagaattagcaacattgttatccggaagatacgtgaattttcgggtgatgctgtttcgttttcaggaaatgtgtgagatgttgggagtaaagaaagaagaagcgtctgaaaaagaatttatgggctatattacatggggcgtaatgccacagcgcttttattttaaaaccgaagaagaaactaaagtgtttatgacagatttgtatgattctattgtgttgaaggatattttctgtcgaggtcaggtgagggatgtagatgcactgaacagactgttggaatacattgtattgaactcttcgcagacattttctccaacatcgattgccaagtattttgaaagtgtaaatcgaaaagtagcaccggatactataataattatatggaaaagatagttgcagcgatggtcatgaataaagcaatgcgctatgctatccgaggaaaaagggtattgaccaggtttgataaatattatctgacagatgtagggtttggaaaaatcaaaaatacagattcaagacagaaataggtggtcttatagaaaatgttgtatataatgagtttttagttcggggatatgaagtatatgtgggaaaaacgacaaagggtgagattgattttgtagcagtgaaagacggaaagagtattaccaggtcgcatatttgctagcaacggaagatgtcatagaaagagaatttggggcatataaggatattcaagatcattatccgaaatatgtactttccatggacagatttgatttttcaagagaaggaatcatacatcagaatataatagattatttgatggaaaggtaaaaaacccgttgacagattcgaaagaatcgactatattaactttaataaaagggagtaactggcgcctgtaagtcttgcaaagtagaaaatcaggcgtttgcgatgtcgtcagtacgatgagtgatcatccgtatcgtaatgaaatggtgagacttttattgcatatttttggtgtgcaataaaggtctctatttttgtacaccagatgagccataataggaaaaaggaggtacaaattatgttgacaaatgagcaggcgaaggaaaatctaaagaaatacggaccgaatgaactggaagagggaaagaaaaaaagcgtctttcaaatatttttagaacagttcaaggattttcttgtaattattctgatcatctccgcggtgatctcaggatttcttggagatgtggagagtgcgattgtaatttttgtagttattacgatgaatgcgattcttggaacggtgcagacggtgaaggcagagcagtcgctgaatagtttgaagcagctgtcggcaccggatgcgaaagttgtgcgtgacgggcagttgatgcaggtgccggcgaaagaagtgaccgtcggtgatgaagtgattgtggaggcaggagatttaattccggcagatggaaagttacttacagttgcaagccttaaagtggacgaaagtgcactgacaggtgagagtcttccagtggagaagtctttagatgaagtgccggagggcgcagcactcggagatcagacaaatcgtgtattttccggaagcttcgtgacttatgggcgagcatcttttgaagtaacggaagtcggaatgagtacggaggtcggtaagattgccggacttctgaaaaatgcatcagagaagcagacaccgcttcaaaagaatctggatgattttggtaagaagttgtctattacaatccttgtattttgcggaattttatttgccatcagcgtgattcgcggagaatcgattgtaaatgcatttctatttgcggtagcgctggcggtggcagctatcccagaggcgcttagttctatcgtgaccatcgtgctttcctttggtacacagaagatggcgaaggagcatgcaatcatccgtaagcttcaggcggttgaaggacttggcagtgtgtcaatcatctgctctgataagacgggaactttgacgcagaataaaatgactgtggaaaattattatgtaaatggagagagtgtctgttccgaagagattgatctgaaggatccagcacagcgagagttactgatgttcagtatgctttgcaacgattctacaaatcacgatggtcaggagattggggatccgacggagacagctcttattaatcttggcagccttttgggagaagattatgcacaagtacgtgatgaacacccaaggctttccgaggtaccgttcgacagtgacagaaaacttatgtccacggaacattttatagacggacggtacgttatggtcgtaaaaggtgcggtcgatgtgctgcttgatcgcatgagtcacattcaggatggagatattctaagaaagattacagaagaagaccgcgtcagaattgaagtgcagaataaacatttttcagaaaacggactgcgagttcttgcatttgcatttaagacgctggaacaggagcaagggcttacattaaatgatgaaaatgacctgacattcctgggactgatttccatgatggatccgccgagagtggagtctaaagatgcagtcgcagaatgcatcaaggctggaatcaaaccgatcatgattacaggagaccataaagtaacagcagcggctattgccaaacgaatcggaattctggaaaatatgtcggaagcctgtgaaggtgcggttattgaggatatgactgatgaagaacttcaggatttcgtaccacagatatccgtctatgcgagggtttcaccggagcacaagatccgtattgtgcgggcatggcaggagcgtggaaatatcgtggcaatgacgggagacggagtgaatgacgctccggcactgaagcagtcagatatcggagttgccatgggaattacgggaagtgaagtggcgaaagatgcggcagctatggtgctgacggatgataactttgcaacgattgtcaaggcagtggaaaatggacgaaacatttttcaaaatattaaaaatgcgattcagttcttgctttctggaaattttgcagcgattcttgcagttttgtacgcatcacttgcaagtctgccggttccatttgcaccggtacatctgctgttcatcaaccttctgacagacagcctgccggcgatcgcacttggactggagccgcacaatccggaagtgatgaaagaaaaaccgcgtgccatgggagagtccattttgacaaaaccatttcttacaagcatcggagtggaaggtctgtgtatcggaatcatgaccatgacagcatttatgatcggatatcgcgatggaaatgcagtgctggcaagtacgatggcatttggaacactttgcagtagccgtctggttcacggatttaactgtaaggcaaacaaaccgatcatttttacgaaacgattctggaataacacttatctgatcggagcatttgtacttggctggcttttgattacaggagtactgatgatcccagcacttcaggaaatgttcaaagtgcagacactgacggtggcacagttgatgactgtatatggactggcacttttgaatctgccgattattcagctgctgaaatggattagaacacgaaagaaatagaggatttgacaggatattgaataaaggaaggaattgaatggaactgaataaggaaaatatgcggaaaatccggaagctgattttgttcacagcactgctgatcgtggtgctgtggaaatatgaagaggtgttggaggtactgggatatgtgggacatctgatctttccgtttctgcttggaggagccattgcgtttgtactgaatgtaccgatgaactttatcgagcggcacttgtttacggaaaaagtaagaaaaaataaagtgtcagataagcttgcaagaccggtgagtctgttgagtgtactttgtatcgtagttggcgtgttgacggtagtaatctttggtgttgtacctcagcttgtaaatacatttggaaatctggggcagagtattacccagttcatcccacatgcacaggcgtggggggaaaagaggtctttcatggaaacaaggaggttgtcgaactgatcaacagtgtacagtttgactgggacaagattgtggagacactgattgatttcctgaataatggtgctggaaatatgctgagttcgacactcacattatcagcggagtttcaacatttgtcatagattttttatttgcaatttatattttgctgcagaagaaaaagcttgggatacaggcgaaaaaggtactgtttgcattcgtacgaagaggtcgtgcggaggctgtggtggaagtctcttcccttacttacagcacattttcaagcttcctgaccggacagtgcctggaggctgtgattctcggaagcatgttcgtattggccatgacaatcttccggctgccgtatgcactgctagtgggaatctttatcgcatttaccgcactgataccgatctttggagcatttcttggctgtgcggagggagcatttttaatcttcatggtcgatccgatgaaggcacttatgttcatcgtgttgtttcttgtgcttcagcagatagaagggaacctgatttatccgcatgtggtaggtaattctgtagggttgccgtccatctgggtgctggcagcggtcagcatcggaggcagccttatgggagtagttggaatgctgatatttataccgattgtgtcggtggcatatgcattgttccgggaaattgtgtatttgaagctgaaaaaacagggtgtagatccggcagagctggaggtttaataaagacaattaagtcagaccattgaagtgcttatgtgtagaataatgtaaaaaattaagaaaagttcgtgtagtttagtgtaaaaaaacgataaaaatacattgatttttacacgaataattcatatactacctgactttagaagttcaagacaaaaaaatggtgctaactcgttaacctagcgagtatgcatcatttttatttgtctatctgcaagatagtaatttgtaagtggctgattgagttttttgccaagttctgttatgaattcagaagctcgagttatattgatgtattttttatcatttactttgactagcctaaaatttctatagaattcacatatctttgatgtgctgtatttattatccagaactttgaactgtaatattcttgtaagtaaaatcgtaacataacatattaagaaatgtcccttgatactgttttctttttgaagatatacaggacgtgcatcaagttcacttttcattactctaaatgactcttcgattctccacaagttatgataggcatcatatatttcaacatccttcatttttatttcagaagtaacaagcatattatatcctgcaaggtctctgtctttttttattgcttcttcatttaatgttactataggatgatcatcatcgtttgatgtaatagttatatattttccagattctccatattcactttttttagcggaatatgtttttaaatttcttgctttttcaaccatcttatcgatttccataagtttttttcttgcaagttttggattgtaggtacagactcttttttctcttattgtttttttgacaatcttaccatcatcatctttataagaatagtcaaaatcttcaatacatgacttgtatctgtatactgtatttccatattcatcctttacatctttataatcattattaagaagtacccataccttttctttttcagaaagctgttttacagattttgaaaatatatatccatcactgttattgactgcctgtattatattttttgcgcagttcagccctttatcggctatctgaatagttcttccagagatattgttttgatttttcatatcctgaatgatgtttctcaatattggtttttcagattcgtttccaggatacatcttcttgccgataggaatcatattggcatcaaggaggagccccataccaacaatagaatcatttttattctctttggatggatcgcgtctttgaaagtcattttccttatcgatttcaaagaagaagttggtacagtcaaaaaaagaatgagaagtatccgtaccatagttttctttggtggctacagtaaatatttcaaccagcttttcatattcgctgccaacgaattctacagcgtcaagaagctgatcataggaatagttcatttccttaaataaagaaggaagaacatcatgaaaagtcttgtatttagaacagggcgcaacagctctggcaaatacaagtgatgaaaaaatgtcaaagacattgaactgaaaattcctgttggactgtaagaagccaaagtgctgttcaacatccaggttattaaggatattggccagagggaaatagacaagatatttttcaggagaaatatcggaaataagtttttcagttttcttttggacttctttttccattttcttttcagcatttggattgtctaatacaattatttccattttatcttttaattatggaatgaaagatagaaaaagaatagatgaatgtattaagtttggtattgttgatacaatcattgtttctttaatgattactttattatttgaacttcttgctcatccattatcacaattatttggattatcaggaagtacacaagaaatgattgatatttgtagtacagctttacatatagcaagtctgggatttgtttttatgggtatttctgtcgcgattcaaggtgttttacaatctattggttatgccattagacctttaattattgctttacttcgcttggttatttttgtatttccaatagcctatttctttactttaacagaaaatgtaacaacacttgtttggtggacatttccaatttctgaattgttgacagttattgtttcatttattatcttgaaaaaatcatataatgaaagaataagtcctattaaaaatgaaagtataacaaataatttagtaattgctatttcaagagaacatggcacaaatggaaaagaaattgcgagacaagtcgctaaagaattaaacattgaattttatgataaagaaagaatcaaagaatttgctcttaaacatggatttgtaagtaataaagaaagtgaagattatatttatagtcaattcttatcattagacatcaataaaaattcaattattcttttatcaaatgttattaaagaaattgcgaagaaaggaaattgtgttattgttggaagagctgcagattatattttaaaagaagatgaaaaattagtaagaatcttcttatatgctcctttagaatatcgtctaaataaagtaatggaaatttatcatgatagtcatgaggatgctcttcgatatattcataaatcggatcattctagaaaaagttattatgaagttatttctaataaaacatggggtgataaatcaaactatgatttatgtttagattgtaaattaggaaatgaaacaatcaaggatattatttgtaactatgttaaatctttaaataaataaagaagtctttcaaaaaatgaaaagacttcttttcttttaaagatattctatataatgtcttttacatagggagggcttatatgagtaaattaagagattattatttatttcatgcaggtatttcatgttttttttatttagggtatggtgcctttacagttgttttgtcaatgtattgtcaagatataggaatgtcagcctcacaaattgcttacattgtatcctttgcaccacttttatctattgcaacacaaccattttttggatacttggcagataagtggcaatcaccaagaaaagtatctattttattatcatttgcgaatatactttgtatgtttatttttgcaattagtcgtaatttttggattttacttttatcatcaggtctagcagtatcttttatgaatgctgttactcctttaacagatcgtattggtgtttcttcaccttatcaatttggtaagattcgtttatggggttctgtaggttatgccattatggcacaagtcagtggacttttatatcaatatatttcaccattttctaacttcatggctggtattttaggaacattaattaccattatttgtatttatatggtttctgatccaaagctttcagaagttcctgaaaaagaagaaaataaattatcgacagttgttgttatgaaagagcttgttcataatataccatttatgctctttctagtgatttcatttttcttttggggagcatgctccacaaactttaactatttatcattatttattaaatctcaaggtggaacagcttcacaagtaggaacctaccaactttttgcgacattatttgaaattccgatgattctagcaacagactatatcattaaaaagataccttatcgttatatcatgatgtttgcgattatcatgtcaatgatcaattttgcatggtatgcaactttaccttctgttaatatgattatttatgtttttgtatttaaaggtttttctactgtactctttacgatgattactgtaagattagtaatggttttagtaaaagaagaatatgtctctacagcctatggaattcaagctatgcttggtaaaggcgtaggtgcaatgcttttccaattaattggaggtagaattattgattccataggaatgaatggtttctatttattcttatttgcaggaattacgattgcttttgtagtgacacttttctttagaatgcctaggaaagtgagagtgtagtatgttagaattaaatgctgttatttttgatatggatggtttgatgattgatacagaacctgtaggaaagatgttggtgaaaacatctcatgaaaaatttggttatgaaattactgaagaaatgttttatcatttgattggtacaaatgaaaagacatcaaaagcttattatcatagtgtttttggtgaagattatccttatcaaaagattaaagattatcgagatcaattaagaaaagaatattttaatagtcatcctttagaagtaaaaaaaggtttatatgatttattagaaaatttaaaaaagaaaaatattaaaatggcagtggcttcttcaacacgttatgaacgtgttttatctaatttaaagagtattaaagttgatcattattttaatgccattattggtggtgaccaaatacaacatgggaagccagccccagatatctttttaaaagcagttgagttgctaggggtaagtaaagaagatgcccttgttttagaagatagtaaaaatggaattttagcagcacatgcaggaaatattcctgttatttgtattcctgatttgattcatcattctaaagatattcttgatttaactgtaggatgttatgattctcttgatcaattaatagatgttattgttaaaaaagatgacaaagcataatatagaacccgtttataatcaagattctaggattcttattctaggatcttttccatctgtaaaatcaagagaagccaagtttttttatcatcatcctcaaaatcgtttttggaaagttttagctgctttatttcaagaagaagttccacaaacaattgaagagaagaaaacttttttacttagaaatcatcttgctttatgggatgttattgaaagttgtgacattaaaggatcaagtgattcaagtattaccaatgttaaagtcaatgatttagatttaattgttaaaaattgtcctgttgaaaaaatcattactaatggcaaagctgccaatcgttattatcatcaatattttgattataatttacccgttattcaattaccttctacttcaccagcgaatgccatgtattcacttgaaaaattaattgagaaatggaaggtgattttatggaaagagatttaacacaaggaaagatagggaaatctattttattattttctattccgatgattttagggaatttattacaacaattttatagttgatacttatattgtaggaaaatatattggtagtaatgcattagctgctgttggatcaagttatacattaatgacatttctaacttttattattattggtttatgtatgggaagtggtattttattttcaatgtattttggagctaaaaaatatgaaaagataaaaatgtcattgattctaacaattgtttcacttggaacaagagttcttctagcctacttattagcgccttcatttggtttagaaatgatttggtgggcaattgttattggatggattttagcggatacaattggtattgtatatggtataaaaatagaaaaatggttcaagtaaaaaatactgcttttgcagtattttttattagctattttgactagacaagtgtataataatctttaccgtatgtgtctacttagtattatttggcatgatacgtaagcgcttactaaaggagttcgctatgaaatatttacaaagattaggtaaatcactcatgttacctgtttcaatcatgcctatagcagcactacttaaaggaattgggtattggattgatcctgctggatggggtatacataacccaattgctgctttactcattgctgctggtggagcaattatagataaccttcccattttatttgcgatagctgttgctatggaaatgtctaaaaaaagagatacagcaatagtgttaagtgctcttgcttgttatatgatgatgacaacaattctatcatctaaatgcatcgcattaatattgcaaattccagaatatgctgtggatttagcttttcataatacgcaaagtgcttttattggtattttggtaggtttgattgtggctatttcttttcaaaagtttgatcaaaaaagattacctcagtttttagctttttttgatggaaagagatttgcttccattgtttctataggaattacacttttgatatctttaatatttattgatatttggccaatgtgttatcacttttttatttggtttggaaaagaaatcgctaattttggacctataagtgcaggaatctatggtgttttaaatcgtttattgattcctactggtttacatcatgctctcaattctgtattttggtttgatgttactggtattaatgatattggaaaattctggggaacaatttccggtggtgttaaaggtgtaacaggaatgtatcaagcgggatttttcccagtaatgatgtttggtcttcctggagctgctctagctatgtatcgttgtgctagaaaagagaataagaaaaaagtaggtgctatcttattttcggctgctttagcatcgttttttacaggtgtgactgaaccacttgagtttgcttttatgtttgtagcaccaacactttatttaattcatgctttacttacagggatgatgctttttattgcagcaacttttaaatggatggcagggtttggtttttctgcaggacttatagattatgttttaagttttaaatcaccatttgctaataatattttatttttaattcctttaggaattatatgcggattgatttattacattgtttttagagtattgattacacgttataatattatgacacctggaagagaagaaaatgaggtaaagaaagtagagaaagtcgaaaataattttgatgaaattgctattcaattatttgaagcattaggtggtaaaaagaatattataagtgttgatcattgtattacgcgtttacgtgtagaagttaaagatatctcaataatagataaacagactctatcaaagatgaatttttctcatattgttgaagcaagtgagcatgaaatacaaatcattataggaactgaagttcaatttattgctgaaatattaaatgaaatactaatgtaggagaaatgaaattgaagattataaaaatatttaataataatagtattgctgctttatctgatgaattaggggatattattttaacaggatcaggaatcggctttcaaaaaaagataggtgatttagttgatgaatcacggattgaaaaaacatatatctttaaagaaaatggtgaaaaacgtatacgtagaggaatcaatgatattgaacctatttattatgaaattactagtttattagtaagcaaagcaacagaacaattgaatacccaattttatggggaaatctttctagcgattagtgatcatattgcttttgctattaaacgaaaaaaagaaaatattgatttgccaaatgtagttttatctgaaacaaaagctctctataaaaaagaatatcagttgggtttatggattataaaaatgattaaagaaaaaacagatattcaattagaagaggcagaagcagggtatattgcattacatttagttaatttttctactaaaaacaacgcacaaaatacttctaaaattgttaattttgtaaaagatgtttttgatattattgaaaaaacaatgtgcattaaattagaattagattctatcgattatgcaagattatctacacatcttaagtttttagctgaaagagtttttcgacatgatataggaaatacaatagatacaacagaaaatataagagatatgttaaaagaaaatattcggttatctctttgtgttaatcggataaaaaaattaattcaaaaaaaatatcattatacattaactccagatgaacaaacatatttatgtatacatatcaaaaagaattgtcacatttaatgtaagcgcttgacaaaaagtaatgctatttgttattgtatagacaaggattgttactttaagtaggcaagaccaaatatattgacggcattttagaaatgttgtttttatgtttggtcttttctttttaaagagaagggagaaaaatatgaaattgaaaaagaaaagtgttgtagctgcattaacgttatcgatgtcaatgggttcagtattatcgatggtaccagtttttgcagaaacatctcaacaaaatttagcgttaaacaaaacagcttatgtttcagctgaatatggcacaatgcctagaaaaaatttaactgatggtaatgaaaaaacacgttggtcaacagaaagtggacctactcaatgggcatatattgatttaggacaagaatatgaaatgaataagtttcaaatgttttgggaaaatgaatcgacttatgcctcagcttataatatttatgtttctaatgatcttaattcttggggtgaaccagtactttcaagaacagataataaaaatgttgtcagtgaagaattattaggtagtaaagtaagtggtcgatatgttaagttagaagttacagaaatgaaagggtatcctaatgtttcatgttatgaatttaaaatttttaatacagatgaaaaagtacaagatccaaatacaaatgttgcattaaagaaaacagcaatcgcaagttctcaggaagcagaaagtgttaaagcagcaaatgcagtagatggaaatacatcatcacatagttctcgttggggaagtaatattggaaacggaccagattggatctatgttgatttaggtgaaagaatgaatgttaatactgttaaggtattctgggaaacacgtaaagcaacagcttataagattcaaattgctgatactgaatctacgcctcaagaaagtgattggcaaacagttaaagaatttaaagatcgtccaaaatctttaacagaaaaaattgttttagatcaaatctataaagcaagatatgtgcgtttatatgttgattcacatacttcagaagatccagatggtggtatcgcttggaatacgatttctatttatgaattagaagtttatggtggaaatcctgatgaaaaaatgtcaatgagtgatgttttaaatggaattcaagtagaaacaccaaaaactggagataaaaagttaaaagtcactttaccagaagttgaaggatatacagttgaatataatggaacagattttgaacaagttgttgatgaagatttaacaatttatcaacctattagtgataaaaatgttaaagtatcattcaagattacagataatgatacaaatgattataaattcaaagaaattgctgttacagttccaggtagtcaaaaaaatgatgaaacagcgaataaagcaccaaatgttttaccagaattagctgaatggaatggtggacatggaaactatacagtttctaaaggggcaagaattgtttataaagatagttcacttcaaaaaactgcagaagcacttgctaatgattatgaagatattactggaaaaagtattgctgttgtaaaaggtgaaagcaaaacaggagatattactttagctcttacaaaagataaatcattagggttacaagatgaaggatatttaatggatattgatgattcaatcaatattaaagctgaaacaacaacaggggcttattgggcaaccagaacgattttacaaagtattaaacaatcaggaaatgttccttgtgggacaacaagagattatccactttataaagtaagaagttttattttagatgttggacgtaaaacatttacaatggattatttaaaacaaatcgttaaacaaatgtcatggtataaaatgaacgatttccaagttcacttaaatgataatttaatttcaattgaaagtttagctgatccaatgacaggttattcagcatttagattagaatcagatgttaaaaaaggtggaaacaatggtttaaatcaacaagatttaacaagtacagatttattctatacaaaaaaagaatttaaagattttattaaggattcaagagattatggtgtaagtattgttcctgaaattgatacaccagcacattcattagcacttactaaagtaagacctgatttaagacatggaacaaatggacgagaaaatgatcatctagctttaagagataaatatgatgaatcattaggatttgtacaaagtatatttgatgaatatatgaaaacaagtgatcctgttttcgatgaacaaactacagtccatgttggtgcagatgaatataatgcagataaagaagcttatcgtcgattctcagatgatatgttgaaatatgtacaagattcaggaagaacagcacgtatttggggaagtttaactcaatgttcaggaaaaactccggttagaagtaaagatgttcaaatgaatttatggaactttggttatgcgaatatggatcaaatgtatgaacaaggttatgatttaattaactgtaatgatggtcattattatattgttcctaatgctggatattactatgattatttaaataacaatattttatataatcaagcaatcaactcgattagtggtgtcacaattcctgcaggtgatgaacaaatgctaggtggcgctattgctgtatggaacgatatgacagactatttagaaaatggtattagtgaatatgatgtttatgatcgtttacaaaatgcaattccattatttggtgctaaattatggggtaaaggagataaaacattagatcaagctaatagtttaagaacaacattaggagatgctccaggtacaaattttggttatgaagcagctaaagatgaaaatggtgtaattgcacattacaatttagatgaattaaatcaattaaataatcacgaaaatgttgaacttgcttcattagatagtcatgatgcattacgtttgttaggaaataaaagttatgctactacatcatttagtactgttggtttgaataatgatttacgtgtaaaagttaaacgtgaatcttcaagtgaagaggaacaaattttatttgaaagtagctatggatcaattaaagctgttcaaaaagaaacaggaaaagttggattaagtagagaaaatcatgattattcatttaattatgaattaccagttaaccaatgggttgaattagaattcaaaaatagaaaagaagttattgatttatatgtaaatggtcaattagtagatactcttggtgatgatgaacaagtaagtggtagaccattaaaagcaacaatgatgataccgtttgaaagaattggaagtaagaaacatgcttttaaaggatatgttgatgatattcgtttaggtacacaaaaaacatatgcttcaacaatggaattggattatttagtaacaagtgcaagttatatagcagatgaatcacaaaataaacaattacaagaaaaaataaaagaagcaaaagtaattttaaaagaatatgatccaaatgaacaaacaatttcaacacttacaaatgaaattaaagagttagtaaatggaattgattacaaaaaagcaaattatacaagagtagatcactatttaaattcaattccaaaagatttatctatttatacagaagattctgttaaaaacttacaatttgttattgatatgattcaaagagaattacctaaatcaatgcaagatacagtcgatcaatatgaagtagaacttacaaaagcacttactaaactacaattaaaatcacaagttaatgtaaattacattgataacagcaaacttacagcaactgcttcatcttatcaacatgatggatcagatcctaaaaatgtattagatgataatccatcaacaatgtggcatacagattggaatttatcaacacctcattggattgcttttgaaaataaagaagaaatgagtgtcaatggtttaacatatgttcctcgtcaaactggtaaaaatggaaatgttacaaaatatcgtattgaaacaagtgatgatggtattaattggaaaacagttaaagaaggtaatttatcaagtgattcatctacaaaagtcattgaatttgatacagtaaaaacaaaacatcttcgtttatactacgtagaagctgttaataataacggaagtgctgcagaaattaaattacatcgtgcagatataccggcagatgttgatggtttaaaagatgttatcaataaagctaaagctatggaagatattggatatttatctacttcatggaatcatttacaggatacaattaaagctgctgaaggtttagtcaatgcagaaaatcctgacgctaatgaaattgaaattatgaaacgtcaattaacagatgcaatggtaaaacttgtattatctgttgataatgaacaattaaaatcattcgttgatgatttatcaaatcttgaacaaaaagattatacaaaggattcatggaaacaattccaaactgttcttaaagaagcacaggatgttataagtaatcatgatgcaacaaaagatgaaatcaatgatatgtatcaaaaattattagatgcttataatggacttgttacacttaatgataaatctggattaactgatttgattagtaaagctgatcaacttcaagaaaaagattatacaaaagattcatggaaacaactggtagaagcattaactcaagcaaaagaagtatctgctaaagaagatgctacaaaagaagaaatcaacgaagctatttttaatctagaaaaaactatgaatgctcttaaaaaagtagattcatctactaaagatgataatacttcaaaaggaaatacttcatctaaagataatcaagtaattacttctactactaaaaatgataaaaaacaatcttcaactgctaaaacaggtgatgaaacaaatattattttatttgtattaatggctttcatgtcatggttaggtattaaaaaagtaaaaaaagaagaattataaaaatagatgccactattaagtagtggtatttattttgtctagacaaatttattgtaagcccttgcatagacaaagagtgtatgttacaatacaggatgtaaatacggattgttactttaagtaggcaagaccaaataacttacatttttttagtgtatcttatttggtctttattttttggtttgtatttgcaaattaagattacattattcatttaagggagcagtaatgtaaataagaaaggaagaagaatatgaaagaaaaggtaaagagaattgtttctctagcacttgcatttttaatgtcaattggatgtattcactcttatccaatcgtcagtgctttggaaaatgattatgaagtctatccaaatcctcatatgatggattatcaagatggttcatttgatatgacatctactgtcaatgttgtctatgaagatggtattgatgaatatacaaaggatagaatgaatgaagtattagctattaaaaatataaaagcaagtacttctgaagaagtaaaagaaggccaaacaaacattttagtaggtattaaagattcaaatcaatatgttgatcaatatgttggtgaacattattcagtaaaaacaacccaattatttgatcaattagattcatacttattaaaggttgataatggaacaattacagtattaggtaaagatacagatgcggctttttatggtcttacaagtttgtatcatatctttaaacaattagacggaacaaatatccgtaattttacaatagaagattatgctaatgtagcaagtcgtggatttattgaaggttattatggaaatccatggtcaactgaggatcgtatgaaattaatggaatggggaggatactacaagttgaattcttatttctatgctcctaaagatgatcctaaacataactctaaatggcgtgaactttatacagatgaagaaattgaaacaaaaatcaaacctcttgctgaagcaggaaataaatcaaaatgtcgttttgtatttgcattacatccatatatgtataatgccatcaggtataatagtgaagaaaactatcaagcagacttaaaagtattacaagctaaatttgaacaagttattaaagcaggtgttcgtcaaattgctattttagcagatgatgctggaaatgttggtggtgctaactatacaaaaacattaactgatatgacagcatggttaaaagaaatgcaaaaaacatatcctgatttaaaattaacattaccattctgtacacaagaatatatgtctaatggacaaagttattatcgtaatttcccagcaaatattcaaatcgttatgactggtggtagagtatggggagaagttacaaataacttcacaacaacttttacaaataatgcagggcgtggcccttatatgtggatcaactggccatgtacagataactctaaaaaacacttaattatgggtggctatacaacatttttacaccctggtgtagatccaaataagattcaaggaatcgttttaaatccaatgcaacaatctgagccaagtaaagttgcaatttttgggaatgcatgttactcatggaatatttggcaaagtgaagaagaagctcaaaaatgctggactgcttcatttaaatatgtcgatcataatagtgctattgaaactcaagcatcagctgctttaagagaactttcaaaacatatgatcaatcaaaatatggatggtcgtgtaacagcattacaagaatcagtagatttaaaagatcgtttaacaagcttcaaagaagctcttacaaatggaacaacaatcagtgatgaacaatttgaagatttgatcaatgaatttacaatcttaaaaaatgcgagtgctacatatagagcacaagcaggtgatacaagaataaaagatcaaattgtatattggttaaactgttgggatgatacagcagatgcagcaataaattatcttaaagctgttaaagctgtacaagatgaagaagctaatgataagatttgggatctatattctactggacaagctgcttttgaaaaatcaaaaacatatggattcaattatgttgatcatttagaatatgcagaagtaggagtacaacatatcgtaccatttattaaagcaatggattcttatttaggagatattgcttctacaattgtaaatccaaataaacaagttactaaatttattacaaatcgtagtgatagtccaacaggtaatattgataatgtattcgataataaagccaatacagaaatcgtttataaaacaccaaatacaattagtaaaggaacttatgtaggcgttagttattcaaaagcaattgatattgatagagtgacttttagattaggaacaaattcaaattcaaaagatactttttctaaagctaaagtgcaatatacaacagatggtaaaaaatgggttgatttagataatcaagaatatactttaccaaatgatgtagctttaactgacttaaatttaaaaggggttaaaggtattcgcatgattgctactgaagataaagcgaatacttggttaggtattagagatattgctgttaatgcagatgaagtagtaactgaagaagatccaggtacattatctgttgataaattgacacttaaaggtggttctttaaataatttattagatgacagtaatgctacttatgctcattttgctgaaagtccttataaaggtggagaaattaaagattatttaccagttgatgcaagtattacattaactttcaaaaaagcaaaaacattaggtacaatttattttggacaagatgcaggaacagataaatcaacaaaatatgtcattgaatatacaacggatggtcaaacatggaaagtattaaaagaatataatggtgatgcttctgttgaattagatgtatcaagtcaaaatattaaagcaaaagcagttcgtattagaaacttagaattaaatttaaaaagtaatacagcaggatattggtggaaagtcaatacatttaaaatggctgatccaggacaaatcaatgcaacatttatgtatacagatacatggggaatttatcgaggaacagtagctaatttaacagatggtgatagttcaacagcattagattttagtacctcaggtgatagaacaagaaaaggtgattatattggttgggatttaggtaaagaaacagctattggtaaaattcatgcagttatcggtggagaccgcagtgcaggagataaatgggaaaaatatagtttacaatactctaatgacaaccaagactggactacttataaaacatatcaaggtttagctagtggaaaagatacaattgatgaaaatttctatggtttaaaagcacgttatgttcgtttagtgaatgaagaagagagagctgtatgggttattttctctgaatttacagtaaatgcatataatccagatgaggatttcaataatgctaatgtttatacaaatacagattatagattagcttcacaaagtgaagaagcacttacagaattgatctataatcaagaaattactttagaaaaaggtcaatacgttggtgttgatttatcaagaatcaaagatttaagtacattcaatattgattatgaaaatggtcaaggagcaactttacaagtttcaaaaaatggtgttgaatggacaactgtaacaggtcaagaaaaagaacttccagatggaagatatgtaagattaattaataaaacagacaaagctattaaattgacaattaatcattttgaagtacattcaaatgaaattacagcaccatatttatataaagcaactatgaatattaatccttcatggggtgttggtgaagatactagaaataatggtgctgcttttgatggtaatatcgattcaacaacagaatttggtgattttccacaaaaaggacaatatattatttatgatttaggacaagaaagaacaatttctaaaattcaaatgtattgccaagatagtgcagttaactatattagagatgctgatattttagtatcggatgatttaaaaaattggacaaaagttgtaactattggagatggtaatgaaaatacaaatgatgctggggttaaatgtattgattcagatgcgggttataaagcatcaagcacatatccaaataaagtctatgtagaaggaactgctaataatattaaagcacgttacttaaagatcttaatgacagcaacaaataataatagagctgttgttttcaatgaaatcgttataaatgatggagaatatgtaccagtttcaaatgatccaacatatacttcttcaactgtagaagcaaatggatttattcctcaatatatgtttgatggagatttatctacagcttatagaccaggttctaaagaagctggaagcattacttatacattatcaagtgatttagatgttaagaaaatgcatattattcaaaaaggtgaaatttcaaatgcaagagtatctgttcttgtagatggtgaaaatggaaagaaatgggttcaagttggaactcttaaaaaatcattaaatgaattctatatgcctgaaggaaacgtttatgaattaaagattgaatgggatgaaaataaaattccaacaatttcagaagttattatgttaaatgatgatgaatatgcttcaacagcagctaatgatttacaaaaatatattaattctttagatgttaaagaaaataaatatacagcagattcttataaagaatttgaaaaggcattaaaacaagctcaaaaagttttagataaacaagcgggtgaattagatgctattacaaatgcaaaagctgaattagaagttgcttatgcaaatcttgttaaacgtggagatattcaaagtgttaaagatgaacttgatacaattaacaagttaaaagaaaaagattatacaagtgaaacatgggctattttacaagatcaagtgaaacttgctcaagaattcattaaaaaggatgaagcaacaattactgaaaaagaagttattgatatggtagatgctttacaaaaagcaaaagctcaattagtaacaaaagtatcagtaagtaaaaaagagttaaaagattatattgcatcaaatgaattagataagttagatacaaataaatatttaacatctactgctgattcatttaaagaagcattaaagaatgcacaaacattaattgaaaaagaagatgcaacaaaagaacaattagatgaagctttaaaacaattacaagatgcaagaacacaattagttttaaaagcaacagatgatgaagtaaatgcattaaaagcattaatggatcaatatcaagaaaaagattatacagcatcatcatggaagaaatttgaaaaagtttacaatgatgttaaagctgctttagaaaatgaaaacacaagtgctgatgttcaagcattaactaatactttaaaagaagctgctcaaaaacttgttaaacgtggtaatttagatggtatccatggtttattagatcaaattaaacaattagatagtaaaaaatatacagaagcatcttattctaaactaatagatgttgttactgaaatttctaagaagttagaaaattcatcagaaatgacacaagaagaagtcgatgcccttgtaagtgaattgcaaaacgctattaatgcattagaaaaagcaccaacagtcactacagatacaaatgaacctactcataaacctcaagttgtaacaaataacaaagtgaaaacaggtgattcaacatctgtatggacatttgcaacatttgcattaatggcagcaatcgtttatgtatctttaagaaaaagaacaaaagaagactaaaataaaaggtttctattttcaagattaagaaaatagaaccttttcattttaaaatcaaaaaaagatagcgttttcataagcggagacgctttttttatgttatatttaaagaagaggtgaaaatcatgaaattaaaagcacttgatcaaagacaagctggtattttgttaccgttatttagtttaccaggaaaacatggaataggggatttaggaaaagaagcttatgaatttgttgacttatctgctcaagcaggtttttctatttggcaaattttaccattaaatccatcaagctctgggaattcaccctatactccttattcatcttttgctggtgatgaaatatatatttctttagaacttttaaaagattggcatttgttagatgaagttcctaactatttacaagatttaaaaagagttgattataaacgcgtacgtttatttaaagatcgttatttaagaaaagcttatcaagttttcttaaaagataaagaattagagaaagaatatcgtacttttgttaaaggaacattttggttaaaaaaatatgcgcgttttatggctttaaataaagcaaacgaaggtttaccttgggtagattggaatgatgaagatcaaaatattaaaggaagtaatgaaggattagaagcagaaattgattatattcaatttcttcaatatatttttgttaaacaatttaatttattaaaaatacatgcacatcaaaaaggaatatctatcatgggagatttacctttatatgtaggtgatgattctgcggatgtttatgagtatcgtaaatgttttcaattagatgataaattttatcctaaattcgtatctggagcatcacctgattatttttcaaaagatggccaactatggggacatcctctatatgattgggattatttaaagaaaacaagatataatttttggattaaaagattaaaatggaataatgaaatttttgatattttaagagttgatcattttagggcttttgatacatattggtcagttccttatggaagtgctacagcaagagaaggaaaatggatagaaggaccaagttatcattttttagattcagtttataaacaattgcctaaacttaatatgattgttgaagacttaggagaattacgtccacaaatacatgaactgagagatcattatgatttattgggaatgaaagttatgcaattctcttttggagaagatgaaagaaaagttaaatataaaattcctcaacattgtgttgtttatacaggaacacatgataatgctactcttaaacaatggtatgaagaattagatgataaagaaagaatgaaagaaattatgaagggtctaggatatacaggagaaaatcttgtggaagatatgcttgcatatacacttgaatgtgatgcggtgatttctattgttcctttacaagatctacttggctatggcaaagaagctcgtattaatttaccagggacagtaggtccacataactggtcttataaacttgcttcatttgatgattatcaaaatcaaatacaaataattcaaaaaatgttaaagaaagctaaaagataaataccatacttattatttatatatcctaaaaaaccgtgataaaagcggtttttttttaatgttaggagatgtaatcgcttttatttattaaattatgacaataaaattgatttttaaaaagaaaaaaatataataagtttcgtagacaagtcatgaacaggtttttcttccttaaatattttttgacaacaacattctaaatttgtacatagacttgaagttaagaccgaatggtctttttttatttctatatgaaataattgtagaaataaataccatacttattatttatatatcctaaaaaatagcgataaaagctactttttttaatttttcaacaatgtaatcgcttttattcgatgaatttaatttaataaattgatttttgtttataaaaaaatataattgttttcgtaaacaagtcatggacaggtttttcttccttaaatatttttttgacaacaacattctaaatttgtacatcgacttgaagtgtaagaccaatcggtctttttctttttatataaatgtataaaaaataaaacattacctattcgtgttgactttatttttaaaaccgatttataatacacacaacaagtgaaaccgatgaagtggagataaaaatagaacgtgcacttatagagagtttggatggtggaagcaaacagaacgcagtctattaaatggaccactgagggcaaaaggaaaggcattagctgagtattctttgacgtaaggcttacgtaagtagccatagatgtgatagcatctagtaaagtgcatgagtgtatcatgaatcaaggtggcaccgcggatataaccgtccttgaaagtttaactttcaagacggtttttttaattattagggggaattatatgtattatccaagtttagaaatgttagaaaaattagatctaaaatcttatgatttagttccaataaaaaaagaaatctatagtgatatgattacacctatagaattaatgagaaaattaaaacaatattctaaacatgtttatatgttagaaagtcatgaagataagacaaaatggggaagatatacttttataggttttgatcctaaaagcgaaattacttgttataacaagatgatgaaagtggatgataagatttttaaagtgacacatcccaaagaatatattagaaaagttttaaatgaacatcgtagtttaaaattagagggttttcctacttttacaggaggcttagttggttattttagttttgattattttaaatatagcgaaccttcaattattaaaaaccaaaaagataatggtttcaatgatgttgatttaatgttatttgataaagttatttgttttgatcattttaagcaaaagttgattttaattgttaatattggaacaaatgatttacaaaagaattataaaaaaggaatcaaagaattagatgagttagattatattattagaaaacatgttaaaacacttgttcaaccattaaaattattagaagattttaaaccagttctctctaaaaaagaatattgtcaaatggttgaaaaaggtattgattatattaaagaaggtgatatcttccaagttgttttatcaaatagactttatgcaaaagcaacaggttcattatttgatagctatcgtgttttaagaacaacgaatccatcaccttatatgttctattttgcaagtgataatattgaagtagctggagcttctccagaaactttaattaaattggagggaacaaagttaacaacttttccaattgctggaacgagaaaaagaggaaaagatgatcaagaagatcaacaattaatagatgatttattaaaagatgaaaaagaattagctgaacataatatgctcgttgatttaggaagaaatgatttaggaaaaatttctaaattcaatagtgtacatgtggtatcttatatggatattttaaagttttcaaaagttatccatatagcaagtattgttagcagtgaaattaaagaagaatatgatgctttagatgcagttgatgctttacttcctgcaggtactttatcaggagcaccaaagatcagggcatgtcaaattattaatcaattagaacaaaataaaagaggtatttatggaggagcgattggttatttagattttacaggaaatatggatctatgtattggtattcgtttagcttataaaagaaataatgaaatttctatttgtagtggtgcaggaattgtttatgacagtgttcctgaaaatgaatatcaagaatgtttaaataaagcaggtgcggttgttgaagcaatcaagatggcagatggaggtattgattatgattctactcattgataattatgatagttttgcttataacctttatcaattgataggttcaatcgatgaagatatcaaggttataagaaatgatgaaatgacagttgaagaaatagaagaacttcagccatcatgtattattatttcaccaggtccagggaaaccaagtgaagcgggtattattgaagaagttgttcaaaaatgttatacgaaatatcctattttgggagtttgtttagggcatcaagcaattgttgaagcttttggaggaacagtaagttatgctcaaagcgtcatgcatggaaagtcttcgataattaaagtagatactacaaatccaatttttaagggaatcgaggaaaagacagcagtggctagatatcatagcttagctgctaaaaaagaaaatttaccagaatgtttgaagattataggggaaagcgatgatggtgaaatcatggcaatcagtcataaaaactatcctgtttatgggttacagtttcatccagagtcgattttaacaaaagaaggtaaaaaaatagttgaaaattttttaaaggagatacaaaatgattaggggagcaattattaaattatcaaaaaaagaagatttaacatatcaagaagcttatgaatgtatgaatgagatcatggatgatcaagcttctgatattcaaaaggctgcttatttaacagcactttcattaaaaggtgaaacaattgatgaaataactgcaagtgctaaaggaatgagagaacattgtgtgaaattattgaatgatcaagatgttcttgaaattgtaggaactggaggagatggatcaaattctttcaatatctctacaacttcatctattgtgattgctagtggtggtgttaaagttgctaagcatggaaatcgtgcagcaagttcaaaaagtggcgcagcagattgtttagaagctcttggagtggatattacaatcaatgaaaaaagaagtaaagaattattaaacgatattaatatttgtttcttatttgctcaaaactatcatttagcgatgaaatatgttgcaccagtaagaaaagaactaggtattcgtacagtctttaatattttaggaccacttacgaatccagcaggagcgacttatcaagtcatgggtgtttatgatgaatcattagttgaactacttgctcaagttttaagtaatttaggggttaaaagagctatggtggtttatggaagagatggtttagatgaaatctcagcatctaatgaaacttttgtttgtgaaattaatgagaatcaatttaaaacatatacaatttcacctgaacaatttggtttacaaagatgtttaaaagatgaacttgttggaggaactccaaaagaaaacgctcaaattacacgagatgttttaaatggtaaacaaggtggatctagaacagctgtcttaatgaatgcgggggcaggactttatattggtggtaaggttgattctttacaagcaggaattgatttagcagcagagttgattgatagtggaaaggcaaatgaaaaactagaagagtttataaaagaatcaaacaaataggagcgtatattatgattttagaagatattgttgaaagtacaaaagaacgtgttgaaacaaataaaaaacgtcattcaatttatgaattaaaagaaaaggcctttgcaatgcctattgaccaaagttttccttttaaaaaagctttagaaaaagatggaatgtcttatattttagaagttaaaagacattcaccatcaaaaggacaaattgtttccacttttgattttaaagcaattgcgaaagaatatgaaatgattggagcagatgctatttcagtagtaactgaacctgattattttaaaggggatgatgattttttaagagaaatcaaacgtattgtgaaaattcctgttttaagaaaagattttgttgtagatgaatatatggtttatgaatctaaaatcttaggagcagatgcaattttattaattgcaggtgttttagatgaaattacattaatgcgttgtgttaatttagcgcataatttaggtatgtcagcaattgttgaaacacacagttcaatgcaagtaaaaaaagcattgcgtgtaggcgctaaaattattggtgtaaataacagagatttaagagatttcagtgttgatttaaatacaacattaaaattaagagatatggtcgatgatgatgttatctttgtctctgaaagtggtattaaaacaagagaagatattgaattattagaaaaacatcatgtaaatgctgtcttaattggtgaagctatgatgaaaagccatgataaaagacatacattagaagttttaaaaggtattgatgaagaagattaaaatttgtggtttaaaaagaagcgaagatgttgattatgtaaatacatatcaacctgattatgttggctttgtttttgcggggaaaaaaagaaagattacttatgatcaggcaaaagaattaaaaaaagatcttttatcttcgattcaagttgtaggtgtttttgtaaatgaggatatttcttttgttgaaaaattagttaaaaatgatgttattgatcttgtacaattgcatggtcaagaaacaaatgaatatataaagattttaaaacaaaaaatagatgttccaattattaaagcaattcaaattaaaaatgatgattctttcaatgtagactatgacgttgattattatcttttcgatcatggttctggaggaactggggaaagttttgattggtctatgttgaaagaagtcaataaacctgtatttttggcagggggaatcaatctttctaatattgatgaagcattaaaaatgaatgtttatggattagatgtttcaagtggtgttgaaacagatggttttaaagatagggaaaaaattaaggaaatcgtaaggagagttagaaatgaaggggagatatggaatacatgggggacagtatatcccagagactttaatgagtgaaattcataaaattgaagaggcttatgaattttataaaaatgatcaagcatttaatgatgaacttaatacattattaaaagaatatgctggtagaccatctttattatattatgcgaaaaagatgacagaagatttaggtggcgctaaaatctatttaaaaagagaagatttaaaccatacaggttctcataaaatcaacaatgtattaggacaagctttagtggctaaaaaaatgggaaaaacaagaattattgctgaaactggtgctgggcaacatggtgtagctacagccacagcagcagccttgcttggacttgaatgtgaaatttttatgggaaaagaagatacagatcgtcaagctttaaatgtttatcgtatggaacttttaggagctaaagtacatcctgtaactacagggacaatgactttaaaagatgcggtcaatgaagcaatgagagaatggacaaaacgtgtggatgatacgatgtatgttttaggttctgtgatgggacctcatccatttccaatgatggtgagagatttccaaagtgtgatttctaaagaagcaagagaacaaattcttgaatatgaaggtaaacttcctacagctgtgatggcttgtgttggtggtggaagtaatgcgatgggaatgttctataattttatcaatgataaagatataaaacttattggttgtgaagccgctggtaaaggtgtcgatacagctttaacagcagcaacaattgcgacaggatcattaggtgtcttccatggaatgaaatcttacttctgtcaagataaatacggtcaaattgcacctgtttattctatttcagccggtttagattacccaggtattggacctgaacatgcttatttacatgatacaaaacgtgcacaatatgtaccagttacagatgatgaagcagtggatgcttttgaatacattgcaaaaactgaaggaattatttgtgccattgaaagtgcacatgcgattgcacatgcaatcaaaatagcaccaactatgaaaaaagatgatattttaattgtctgtctttcaggtagaggagataaggatgttgcagcgattgcaagatatagggggaaagaaatctatgaatagaatatataaagcttttgaaaataaaaaatccttcattggttttttaacagcaggagatcctgtaatagataaaacagtagactatattttagatatcgaagaagcaggggctagtttgattgaaattggtattcccttttctgatccaattgctgaaggaccaaccattcaagaagcaaatgtacgtgctttaaaaaacaaagttacaacagatgatgtttttgaaatggttaaaaaagtaagagaaaaaagtgatattcctttatgttttatgacttatttaaatgttgttttccattacggttatgatgaattctttaaaaaatgtcaagaagttggcattgatggtattattcttccagatttaccttatgaagaaagccaagaagtcaaagatgtttgttataattatgatgttactttaatttcaatgattgccccaacaagtaaagatcgtgttgaaatgattgcaaaagaagcaaaaggatttatctatcttgtatcgtcaatgggtgttaccgggacaagagataatacttcatttgctaataatcttgaaggaattattggacatattcgtcaagtaacaaatacaccagtagctattggttttggtattaataaaccagaacaagtaaaagaatttaaacaatatgctgatggtgtcattgttggtagcgcaattgttaatattattaaagaacatggaaatcatgcagatctacctttaaaagaatatatccaatcacttacaaaagaactttaaggagatagttgaaaaactatctttttttatattttttaatgtaactattgacgttacattaaaaggatgctacattattaatgtaataaagacgattacatcgaggaggagaaagaaatgaataaagtaattgaatttttaaatgccaacccagtgcaatatcttgcaacagtaggaagagatggtaaagctaaatgtcgtccatttatgtttgctggagaaatggatggtaaattatggttttgtacaaacaaccaaaaagatgtttacaaagatatgttagaaaatcctgaaattgaaattagtgtttcatcaccagaatatgcttggattagattacatggtaaagctatttttgaaaataacatgcctgtaaaagaaatgtgtattgctaatcctatcgttaaaggacaatatcaaacagctgataatccaatttttgaagtgttctatttagaagatgcacatggtttaattgctgacttcagtggtaatgcaccttacgaattttaattatattttctttgggattttaacccaaaagtttcaattttaagactcaaagatttctttgagtcttttacttaaaggagaaagacaatggaaataaagacaaaaaaagtactaacaactaaaaatttaacgatgatagcaatgctttctgctattgctgctgtattgatgatatttgaaatccagcttcctttttcaccttcattcgttaaatttgatttttctgatttaccggtaatgcttggtggttttttaataggaccatttgctggaggaatcattgcttttatgaaaattttattacattttttattgaatggaacaacatccttttttgtaggtgatctttcaaatttattacttacactttcgtttgtattacctgcttcgtttatttatcaacaaaaaaagactaagaaaacagcaattcaaggattattagtaagtataatatgtacaagcctattggcgattatttttaatttatttttaatctttccactttatttaaaagtgttaaatttaaaaatggtggatcttattaatatgattcacgtagttaattctctggtaaaggatgtatttacgatgattgttttttcacttttaccgtttaatttatttaaatatagtattgtatcaatgattacaatgttaagttataagaaattaagtatattatttaaggagtaagaaaatgaatacacatgaaatcttaaaagttttacaagaagatatacatacagttattattgcaacaacagatcaaaaaggttatccctatacgtgtgcaattgatatgatgttattagaagatgaattgctttattttttaacagcgagaggaaaagcgttttataatcgtttgatgaaacaaagtcatattgctttaacaggtttaaaaggagaggatacaatgtcttcggttgctatttcattgcaagggacggttaaaaatattggtcatgaaaaacttgatgaaatatttgaaaaaaatccttatatgaaagaaatctatccagatgagatttcacgagaagttttagaagtttttcaaattgataaatgccaaggtgaatattttgatttgagtcaaaaaccgatttatcgtcaaagttttgttgttaatgaatctttaaaaaaatcaggatattatgtaggtgaaggatgtattggttgtaagatgtgttatcgtgtttgcccacaaaaatgtattgatatatcaagtaaaccagttgttattttacaagatcattgtttgcattgtggaaaatgtcaagaagtgtgtcctaaacaagtgatttctagatactaggaggtaaagttatgtttttaaaaaagaataatgaaggatcaataatacaattgtcaaagtgtatagaagagtgtgatgctattattattggtgcaggttctgggttatcgactgcggcaggtttgacttatgcaggagaaagatttgaaaaatatttttctgattttataaagaaatatcatttaagagatatgtattcagctggtttttattcttatgaatccttagaagaacattgggcttattggtcaagacatatttattataatcgttatatcaattctcctaaagatacgtatcaaaaattacttgaacttgttaaagataaagattattttgttttaacaaccaatgttgatcatcaatttcaaagagcaggctttgattcaaaaagacttttttatacacaaggagattatggtttatggcaatgtagtgtaccttgtcatcaagaaacttatgataatgaagaaattgtaagagaaatgattgaaaaacaaaaagacatgaaagttcctacggagcttgttcctcattgtcctcattgtcatgctccacttacaatgaatttacgttgtgataatacctttgttcaagatgaaggatggtatcaagcttacaatcgatatgaagattttttaagaagacatgaaaattgtaaagtgctttatttagaactaggcgttggtggcaataccccagccattattaaatatccattttggaaatatacaagtcaaaataaaaatgcaatctatgcttgtattaattatgaggatatatcttgtcctattgaaatcaataaaagatcacttcttattaaaggagatattgatcaagtcattaataatttattgaaagaaggaaaataagatgaatcaaaatgaaagattaaactatctcattaattatttattagaagatcttcatttagataaagatttattttttggtgaagatctctttacaacttatcgaaaacttgtcaacattcgtgaagcaaaacctgtttctaaaaaattcttagaaattcaagatgaaatgttacaagaagaaaatcaaaaaaaagggattgtttcttttgaaaatgataataataaaattattttatggaaaggggatattacccgtttaaaagtagatgcgattgttaatgcagcaaataatcaaatggaaggatgttttgttcctggacatcattgtattgataatgccattcatacctatgcaggtattcagctaagagaaaaatgtcatcaaataatgaaacaacaaggaatattagaaccgacagggaaagctaaaattacactagcttataatttacctagttgttatgttattcatactgtaggtcctattgtaagagaatttgtgacaaaaaaagaagaaacattactggcttcttgttatgaaagttgtttgaatttagcggaaaaatatggtttgaaaacaattgctttttgttgtatttctaccggtgtttttcattttcctaatgatttagcgtctaagattgctattgaaacagtaaaaaaacacttagaacattcaacaatagaaaaagtgatttttaatgtattcaaagatgaagatgaaagattctataaacaagtacttcaaaagaatctgtaaggattctttttttgtttatattcattatttttgtctatccttaaaatatggaggtaaaataatgaatattaaaagatataatgaaattgcagataagaataaacctcaaaaacaagtattaaagcatacattaagtgcttttttagttggaggaataattggaatgatcggagaattttttttaaacctttatcaaaaattattctcttttagtgaaaaagaagcaacccctattatgcttattacccttatactcattgcagctattttaacaggattaggtctttatgatcgtttaggaaactttgctggagctgggtcttttattcctattacagggttttctaatgcaatgacttctagtgctttagaagcaagaactgaaggtttagtaacaggtataggtgctaatatttttaaattaggtggtgcagtaattacttttggaatagttgcatcatttattgtaggaggacttagatatgtcatcacgtatttctggtaatagctttatttttgaaaatgtctatattcaaagtgttggtacaactgcaggaattgttgaacatcaaggacctttaggacattattttgataagcattatcctgatcattatcatcatcaaaaaagttatgaacaggcagagatagagatgttgaaagatgctattttgctttgtttaaaaaaaggaaaagtcaaaaaagaagacattgatttgtattttggtggagatttaaataatcaaattacagcctgttattattatgcaagtcatttatataaaccttttattggcttatatagtgcttgtagtacgattggtcttgctatcgctaatgcaagtataatgatagaaaatcataatattcaaaatgcgattgcttgcactgtttctcataatgcaacagctgaaaggcaatttaggtatcctattgaatatggtattcaaagaaaacaaaccatgacttttactgcaacgggaagttgtgcggtttatttatcttgtaaggttagtaaagtaaaaatagaatctattactttaggaaaagtgattgattatgatcaatatgatgccaatgacatgggacgagcaatgactccagcagccttagatacgtatttacaacatatgaaagatttaaaaagagatggtacttattatgatttgattttaacaggagatctttctaattatggaaaaaagattatgaaagatttattaaaagaagaaaatcaaaaatataatgaatatgatgattgtggatgtcttttatatgatgttacccaaaatatttatcaaggtggaagtggaccagtatgtaatgctttagtaagctttggatatatttatcaaatgattttaaaaggtaaatataaaagagtattagttctagcaacaggagcattgttaaatccagtaatgacaaatcaaaaattatctattccttgtgtttgtcatggttatgtattggagggtgtttcatgaattatttattatcatttttattttgtggttttgtttgtgttatagcacaattaatctacgaatatacaaaattaacaccggggcatattacttgtagttttgttgtccttggagcactattagatttatttcatatttatgatcgtttaattaaaatatttcatgcaggagcaatgcttcctattacaagctttggacattcactaatgcatggcgctatggcaatgacaaaagaatatggtgtttttggactggctatgggaatgtttgatttaacggcagccggaattgcttcagctattttatttgcttttttagtcgcaatcttttttaaaccaaaatcatgaataataattcatttgatatcaatgttagaacacttgattttcataatcgaaaaatagaaatcaattatgtttcaagtctctgttctgatgaattaattgcttatttagttgaaggaattacgaatgcgaaaggaaaaactttaaaagattgcttaaataatggagatgtcaaagaagaaacagagataagtcaatatgaatatgcgatgcttacaggatgtgctattgttaaagatattcaagaaaataaaaattatgttttagatacaaggcattttcctacacgttcaattgaagaacctgatacagaaaaaacagtaagaggaagtaaagatggttttaatgaaaatttattaaattgtgctggattaattagaagacgtattcgtacattagatttagtaatggaaaaagtaacggtaggaaaaacaaataaattggatatttgtttatgttatctgcaaagtaaaatagacaaaacaatgttaaaaagtattaaagaaagattacaagaaattaaaaatgaagatttaattatgacagatcgagctttagaagaactgatctttgatcaaggttataatccttttccacttgtaagatatagcgaacggccagatgttgtgtcaacacatatttatcatggctatcttgccatcatttgtgatacttcaagttcggttatgatgttgcccacaactctatttgaaattttagaacacgtagaagaacatcgccaaacacctattattggaacttttattcgtttaattcgttttagtgccgtttttctttctatctatttagttcctttatggatgctgattaaaaatcaaggaagtatcagttttaaaacactcttttctattattttggtagaactggctgtagaacttttaagaattgcgactattcatacgcctgattctatttcaaatacgatggggatgattgctgcagttttattaggtgaatttgcgattgaactgggtttcttttcaggtgagatattgttatttgtatctataggaaatgtttgtggttttgcaactcctaattatgaactctcactaacgaataaatatgtaaaaatctttatgattctattttcagggttatttggctggttaggttttattgcgtatcaagttattttatatatgtatttaatatcattaaaaccttttggcttttcctatctttatccattaattccttttaatggaaaagatttacttcaattcattattagagaacctaagaagtagtgtataaattgtacataaatcttttaaaatatatgtacgatttatacattttttataaaacaaaaaaaacagaagttatctcccgttttaaaataaagtaaaaataattaaactacatgtagcaatagcaacagctggtggatcgatatgtgttccacaatctgtgttaagcaccatgccaaaaatcaatccaataaaatgagcaatgactccaaaaacaacagcaatgataatattacctgtttgtgccatggcataacctacaacaagagttgtatggtgtgtagcagggaaagcaggatcacttaaagcaaagataagtgttaaagcactaattgaaaaaccaattgtataaagacctgtttcttttgcaaaataagccatgacagttgaaactgcaattcctataagtaattggaataaccaaaaagaattaggtgctgtttctaaaaaatctaaattcttttgattatatgtattttctctattaaataaacttctacctaaaactcctacaagaataaccgaaacagctccggtatctaccggaaatgaaaaataattttcaaaggcaaaaatcaaataacctaaaaccccaccgatagcgcctacgagtaaaacctttggatcattggtaaaagcaagtgatctagaagtttcaacacctcttatgttatgttttgttcctgcataggcagttgcaagtcctgcagcattaaagataatacatggtaaaaataaattatttgataaagcttcatttaaaaatgtggtatcaacaccaacatgttctaataaaaatataaggagaccgacaaaacctgtacaaataaaggtttgtgttccaccaattagtgctcctaaaattcctgcaaaaaaagctaaaataatagataataatgaaaacattttataacccctttcaggcgtattatataggaaataatcaacataataaatacaaaatataaatttatgttataatacctaagaggtgaaacaatggaatatcaagttatattagatgattttcaaggccctttagatttattgttacatttaattaaagaaaaagagatggatctacaaacacttgaactatcagttattacagatcaatatttacaatatatacatatgatggaatcatcacaacttgaagtgatgtctgaatatttagtcatggctgcacagcttattgaaatgaaaagtaaaatgcttttacctaaagaaaaagtacaaattgaagatgagtatcaagaagatccaagagaagcactcattagaagacttattgaatataaaagatataaagatgttttagacgagattcaagaaaaatatgaaaaaagacaatctatgttgattaaaccctctcataatatggaagaatatgtcattgatacttcaacaatgattccagaggggttagaagtatatgatttaatgaaggctatgcaaaaaatgtatcagagaaaaatgttatcacgaccattagatacacatatttctaaaaaagatatttccattgaacaaagaagtgatcaaattagaaattattttaaagtaagagttaataaaagggtaaaattagatgaattatttgatagaggggatcgctattattttatcgtgacatttttatcgattttagttttagctaatgataaagaaattgaaattatccaagaaggattgtttgatgatatttatgtagaggggaaagagtaatggaagattataataatattatagaaggtatcctttatctaaaaggtgatgaaggtattgatataaaagaattatcactaattttagaaatttctaaaaaagaagctgtggaagctatggatcattttatagaagcttattcaaaaagaggctttgatggcctacaagttgttgattttggtggtaaatataaacttgcaacgaatcctcaatattttccttattatcaaaaaatggtagaacaatcaaaaacaacactttctcaagcagctttagaaacactcgctattattgcttataatcaaccaattactcgtgctaaagttgaagatattagaggagttggttgtgatggcatgattagaaaactcattgctaaagcacttattaaagaagtaggcagagaagaaagtccaggacttcctattttatatggggtaacgaatgaattcatggatgctttttcactggcttctttagatgaacttcctgaattaggggatattgtagaaactgaaagtgatgaagatatatttacgacaagatatcaagaaggtgatttaagtgaaactgattaatcatttgaaaacaattaataaacataaatactatgtgacaatgctttgttttaaatgtggtttatataaacaaggattactacatgatttatcaaaatattcgccaactgaactaaaaacaggcgctaaatattgggtagggacgcgttcacctaattcaattgaaagagaaacgattggttattctactgcctggttacaccataaaggaagaaataaacatcattgggaatattgggttgatttttcaagagaaggggttgttcctgccaaaatgcctacaaggtatgttgtggaaatgttttgtgatcgagtagcagcaacaatggtttaccgtggagaaaattttgatgtatcggctcctttagattattataataagacacatggttattatgtcattcatcaagaaacagatgcaatgattaaagatatgttagttcatttatctaaaagtaatttagaagaaacaattgattatattaaagaaacttatttataaattctatgttttgcatagaatttttttatagaaatgatataatagttatattatatttaaggagcttgaagatgaattttttacatttaaaatatttaatagaagttgaaaaatatgaatctatttctaaagcagcacagcatctctatattaatcaaccacgtttatctaaaattattaaagaaatagaagaagaagctaatataaaaatctttgaaagacataataaaggggttgttccaacaactaaaggaagagaatttttatcacaggctaaaaaaattgttcaagaagtagattatttaaaaaatatgtatcaggatgatcctcataaattgaatttagatatttgtgtccctcgttcaagttacatctcagaagcttttattgaatatttaaaaatggataataatatgaaaaaggaattgaatctaaattatcgagaaacgaattcatttgatacgattcaaaatgtttatgatggagaaaataatttaggaattgtacgttttcctttaagagatcaagattattatttcaatattttaaatttaaaagaattgacttatgaaaaactatttacttttgattatcaaatacttatttcaaaagataatcctcttaaagacaaagatatctatatgaaagatttaaagaaacaaattgaattaaaacatggagatattcatattcaagaagatcatcataatcataagcatatgaacatttatgaaagaggaatacaatttgaacttttaaatgagattccagaaacttatatgtgggttgccccaatgcctaaaaagcttttaaaacaaaatgattttgttttaaaagcatgtaaagataagaaaataccatatgttgattatttaatttatcgaaaaggatatgttttatcaaaagaagatcaaaattttatagaatgtttgaaaaatgtaatcgaacaagtgaagtgaaaaaatgcacatgtaatgtgaaaaaaataacttgatatataaaaaaaggcatatcactatgcctttttagtatctaaccaaaaataaatgtaagtgctatcattagagataggaaaagaggagaataagttatgcaaagatttacattacctagagatttatatcatggaaaaggtgctttagaagcccttaaaacattagaaggaaaaaaagctattgtatgtgttggtggaggatcaatgaaacgtaatggttttttagatcgtgctgttaactatttacaagaagctggaatggaagttaaattatttgaaggtattgaaccagatccatcagttgaaactgttatgaaaggtgcagctgttatggaagaatttaatccagattggattgttgccatgggtggaggttcaccaattgatgcagcaaaagctatgtggattaaatatgaatatccagatatcacatttgaagatatgtgcaaagtatttggtattccaaaattacgtaaaaaagcccatttctgtgctatcccatctactagtggtacagcaacagaagttactgctttctcaattattacagactataataaaggaattaaatatcctatcgctgactttgaaattacaccagatgttgctatcgttgatcctgatttagctgaaacaatgccagttaaattagttgctcatactggtatggatgcaatgactcatgctattgaagcatatgtttctacagcaaactgtaattatacagatccacttgctattcatgcaattgaattaattcaagctaacttagtaaaatcatataatggagatatggcagcaagagatacaatgcatgatgctcaatgtttagctggtcaatcattctctaacgctttattaggtatcgttcactcaatggcacataaaacaggtgctgctttcgttgatcaaggtggacatattattcatggtgcagctaatgcaatgtatttaccaaaagttattgctttcaacgcaaaagatccaacagctaaaaaacgttatggtgtcattgctgattatatgcatttaggtggagcagatgatgatgaaaaagttgctttattaattaaatatttaagaggtatgaatgatgaattaaatattcctcatggaatcaataaatatggtgcagacggtatgccagctgaaactggatttgttccagaagatatcttcttagcacgtgttgatgaaattgctgataatgcaattgctgatgcatgtacaggatcaaacccacgtattccaaaccatgatgaaatggttgctttattaaaagcttgctactatgatacagaagtagatttctaatagaataaatgaggtcctaaataaaggacctctttttttatgtgcatatactataaatacgttttttaggtgtttaatacatacttatgaaaacaatattttttttatttatctataataaagatagataaaggggggtagctattatgaagtatgcaatattagatggaaaattaactcatatttctaaagtgaaaaaaggaacaattgccagagtttttggatacagtgatgatttagtaatagctgtaggtggtagggaaagacaatattggaaatatttagatgtgaaacgtacaagaatgtatcaaggattataggaataacattgtttattcctttttttgtatgtataataaaattattggaggttataggatgaaatatggaaatgagataaaaaatatatgtcatcttgcatggcctgctattattcaagaagcaatgaatacggtagtaacttatgtagatacagcgatggttggttctatgggagcaacagcttctgcagcagttggtttaacatctactgttacttggttgttaggaagtatttcggttgcctttggagtaggtgtcttagccgtatgtgctcagtcagatggtgctaaagattataaaaaagtacagattgcgggtcaacaagccttatttatttcttttattataggattgataacaactattattagtatcataattgctccatttttacctggttggctcaatggtgccaaagaaataaggcatgatgcttttttatattttttaattgtatcagcaccatttatatttagaacatttattattattctctcttcaactttaagagctgttaaagatatgaaaacaccaatgatgatcaatgtttatatgaatataatcaatatcgttttaaatttctttttaatttatccgacaagaaagatatttgggataactgtttatggagctggtttatccgtagccggagcagcgatagcttcagctatttcttatattgttggaggaattttgatttttagacattattatcaaaataaaatctttgattttaaacatacaggatttcattttcataaaccagtatgtttagaatgtttaaaaatttctattcctgttgttatggaaagaagtgttatttgtttaggacatgttacttttgcttcgttgattgctaaattaggagttgtttctttggcaacacattcgatagcaattcaagcagaacaagcgttttatgcaccggggtatggtttccaatcagcagcaagtacacttgtaggaaatgctgttggtgaaaaagatgaatctaaagttaaaagaatgacgtatcttacatgtgcaattactttaagtatcatggctattgctggtgttttattattcataaatgctcaaaatattatgtcgatttttactcctgatcaaaaagttatcgctttaggaactagggtattaaggattgtttctattagtgaaccaatctatggtatcttgattattttagaaggaacttttaatggaatgggggataccaaagcaccatttgtattttctttgattacgatgtggggaataaggatttttggttcaatgctcatgatcaatgtcttttcatttggacttgaaagtgtttggatcatgatggttttagataatatttctagatgtttattattatcaacacgttttttgaaaggaaaatggaaatatcgggtttatcaataggaggaaagaaaatgaaatataaaaaatttgaaaatacaattatcgcaagaattgataagggtgaagatattgttgaacaagttaaaaatattgctttaaaagaaaatatcaaacttgcaagtattcaagctttaggtgcaattaatgattttacagttggtgtttttaaaacaaaggaaaagaaatattatgctaatgaatttaaaggtgattatgaaattgtatctcttacgggaactattaatacaatgaatgatgaatattatagtcatatgcatctatctgctggaaatgatcaaggagaagtttttggtggtcatttaaataaagcaattgtttcagcaacatgtgaaatggttattcaagtcatcaatggacaagtagatcgttactttgatgaagaaattggtttaaatttattaaaattataaaggagctaactatggaatatttaacattaccacaaacggatttaaaggtatcaaagattgctttaggatgtatgagaattgctgataaaagcattgaagaagtggaagaacttgtcaaaactgctctagaatcaggaattaatttttttgatcatgcagatatttatggtggaggaaaatcagaagaattatttggtgaagtattaaaaagacatcctgaatatagaaaacagatgattattcaaacaaagtgtggtattgttcctggaaaaagatatgatttttctaaggaacatatcttaaaatgtgtcaatgaatcattagaaagattacatacagattatgtagatattcttttgcttcatagaccagatgctttatgtgatcctcaagaagttgctgaaacttttaatgagttatatgaagctggaaaagttcattattttggtgtttctaaccacacacctttacaaatagaattattaaagaaatatttaaaatatccaattattattaatcaattacaattatcaatcgttcattcagtaatgattgattcaggattaaatatgaatatgaaagaagcatttgcacaagataaagatggtggtgttttagattattgtcgtttaaatgatattacgatccaaccatggagttcaatccaagcttcttgggcggaaggaacttttattgatcatccaaattatcaaaaattaaatgatgttatgcaacaattagctcataaatatcaagtaactaaaccagcaatagcgattgcttggttacttcgtcatcctgcacatatgcaaccaatcgtaggaacaacatcctctcaacatttaaaagaaacaattaaagcatgtgattttacgcttacaagacaagaatggtatgatctctatcttgcaagtgaaaaaccactaccatagaaagttgcttaggcaactttttatataccttataataaaaataatatttattgaataaatataatatattgatataataaagatgggtgatgtttatgaaatataaaagaatatctacaaaagattatttagtaaatgaaaatcaatttattgaattattagaaaataaagctttagaaggatggtatttaaaaaatataagtctaaattttttaacatttgaaaaaagaacaccacaaagaaagcattataaaatatattataaacaaataaataaagatataaaggaagcaggatgccgtattattgttaattattttgggttacaagtagtagaagttgaagatctttttgctcaacctttaaaacaagacgtaggtgataaaaaagaaatcttatcaacgatttataattttacaactcattattttttaatgatcatggccattgttttattaattgcttatcaaccttttaaaatacatgggttgccaagtttaccttatttgactttttattttggtacttatttattttatactgctgtaagtcttataagcctctctttgttcttttttggcttatgtaatctatcacatttaaaaaaagtaatgaaaaataagcccttttatttagaaaatatttttaatactttatctaaaataaatttttatgttgggattattttgattttattagatttattaaaacaaaatggtttcaaatcatttttgattttacttgtttcttggttaattggttatcttggacatctttataaagaaaaacatcaaaaatctaatgcgattgtttatctttgtgttattgctacaattgctttaagtttgtatgaccatccagcagatgacgatccttatagcgctattgaacctgtccaaagcttacaacaaccttatagctatgaagatggtggaatgttatatcaaggatattctattgaaggggatcatggaataatggaaggctattataaaggatttacggcagctatttcaaaaggtatttttgaatatcaagtagaaaatatttttaaaaataaaatagcttataaaaaaattattcagcaatatcctctgataactcaaaaagatagtgacttatgttttaaatataaacaaaaatatgttgtattaaagggtcaagaagttttttacatcaataacaaagaaggattaccgctttctaaatatattaaatattatcaacgattaaaggtctaagaattacttagatctttttttatattaaaataataaaaataatattgatatacaaataatataataatataataaaagtaaggaaaagataaattacatctctaggcaaataaagtatttattagaatatatgtagaaaggaatgtgagatttatatgaagataatagataaagtatgggtctttgattatttaatggaaattttcatgatcatgaccatggtttgtggtcaaagcttacttacaaattctttaaatcctttaggatatattagtattcatattagttttattatttattgtttattttattttttacctattttatattttattgccttatggaatagtgatgtcatagattatcgaaaaaatataattctacttattatcttatttatctttaataaattatttcatggaaatcaagttcaactttcttttccattacctgctatagatttttatgtagttatttgtttaattataacgatagtattttatataaggagaaaaaatggtgaaagtaaaacttattttaagtcttgatgaattagaaaaagcatataaggaatataaaaaagcctttcgtttttctgggttattctttggtattcatcaagaaataatggaagataaagattttgaaaaatatttatatttttcaagtgataaagttgaatgttatgatatagaaaaacataagctttttgaaatagactatgatgatttttatgaaattgatctgtctttaaaacaaaaggtagtttgtatgttagtaacaacaagaaatcaacaatattcttttgaatgtaaacaagatacacgttttttacaaataattgatctttttgaacaaaagaaaataagatatatagatagaaatcattttatttcaatcaagcgataatcattgaaagaagggaaatttacccttctttttcatttaatgaataaatcttaatagaatgaaaacaggagggataaaatgatttattcgcttattgtactaacagcaggcttttttgttttagtgaaaggagcagattggtttgtagatggagcatcttcactagcaagtatttttcatgtttctcaattagttattggattgacgatttgtgcgatgggaaccagtttgccagaggcagctgtttcattagtagcagggttaaatggaaattcaggaattaccattgggaatgttgttggaagtaatattttaaatattttgattgttttaggaatgagcgctttgattacaaaaataaagattgaaaaatcaacattgttcattgaaattccttatatgttgctttcaagtcttgttttacttgttatgggaaaaagtcaacaagttgtatcgtttcaagaaggacttattttaataggtatgtttatcatttatttactttatttgttttggttgtcacaaaaagaaagtgaggaggaagtctcttcacaatactcttttataggatgtgtgttgttgattggtttaggcatcttttttgtcatgattggtagtcaactggttgttaaagcagccactcaaatagcttattggttacatttttctcaaagattcatcggtttaacgattgttgcttttggaacatcattgcctgaattagtaacctctttacaggcagctagaaaagatcatgcgggtattgcgattggaaatattgtcggaagtaatatttttaatattttatttattgctggaggtgtttctttaatttgtccagtaccttttgaaagtaaatttattatagatatgtttgtagctataggaagtggttgtttattatggcttttaacgatttatcgacatgaattaaatagaataggtggtcttttgatgttactttcctatgtagtgtatttaatctatttgtgttaaatggaaagaagaaacatagaatgatataggtgatataatgaaattattgattagttttttgatgatttttcaaatgatttgtaccaatgtcgagttttatggaaagagttatattgtatatgatagtttaaatcaatatgttgtagaaggcagaaatatagattatttacaaagtgttgcttcaatttctaaaattatgactgccatcgttgttattgaaaatagtcgcttagataaaaagattacggttgatgaaacgattaataaagcttatgggagttgtgtctatatacatataaaagatcgaattacgattcaagatcttttatatggtttaatgcttcgaagtgggaatgactgtgctttaatgctggctaaaagtgttggtggaagtgttgaacgttttgtggaaatgatgaatgaaaaagctagagatataggaatgaaacagacacatttttctaatccttcaggtttagatgaagaagatgaaggaaatttatcaacagttaaagaaatggcgatactttatcgttattgttgccaaaatcctctttttaatcaaattgttaaaacaaaagagtataaaagactagatggaaaaggttattggcataataaaaatcgtcttttaaaagaatatccttattgtgttggtggtaaaacaggttataccaaaaaagccaaaagaacattgattacacgagctataaaaaaacaagttgatttaattattgttacttttaattgtggaaatgattttgagtttcatcaaaaaaagtatgaggaatgttttaaaaattatgaaaaacttgtgttgtttgataaaggggttagaaatattaaaggaaactggtacttgtttgaaaatgatttgttgatgtcaaaagaaaaggatgaaagtgtaagttatttgattcataatgaagaaatgtttatttatagaaatcaaacgtatattaaaaaaattaaattaaagagatatcggtttagagatttttatttaatgatcttaaaggatctagtttatgaataagatttttcattatgggattattctttttattattgttggtttgatttttaataaacaagaagccatgttaaaagctcttttacaaacaccttttgatgtctttgaactttgtaaaacacttattttaagtatttgtttatggaatggtttattaaaaataattcaggcttcaaatatgatgaatcatttaaattttctatttaaacccctattacgttggatctatggacgatgtattcaagatgaacaaatctatcaagcactatcttcaaatttgattgctaatctattaggacttggaacacttgctacaatgagtggtttacaagcaatttctaaattaaaagaaaagaattatccccttcaaataaaaatactagtagtaatcaatacggcaggcttttctattttaccaactaccatgatgacaattagacaaaattatcatagtcaaaatattttagctttttatccttatggtttatttattggtttttcaattacaattataggaattgttattattaaggtgattgaacatgtctaatttaattctacttattattttatggagttttttagaatgtgcttataaaaaaatacctatttatgaagaatttattacaggagtcaaagaaggaatgcattatttaatgattctttttccttctttaatgcttcttactttatgggtcaatctttttttaagtagtggttttatctctttaataggtactttctttattcgatttttttcaattccccttgatttattattaatggcttttacaagaccaataagtagtcaaacttctcttattattttaaaaagaatttatgatcattatggaatagatcatctttatagtttaatgggatctattttacaaacaggaagtgatacaactttatatgttgtttctttatattatggaagtattcatttaaagaagtatagctatacattatggttaggctttttcttagattttctttcatttgtttttatgctttgtttttattatttaggaatgatttcgtaagtttttaatatattggaataaaaggagttatgataatggaaacgaaacaaattcttaaagatattggtaaaagatgtcaaggtgatatttatttaggaatcgttggacctgtaagaagtgggaaatcgacttttattaaaagatttatggaaatggcggttattccttatattgaagatcctgatgtaaagataagaacgatcgatgaacttccacaatcaggaaaaggcaaaatgattatgactgtagaacctaagtttataccgaatcaagccgttaagatagatttacaagatgattttaaaatcaatgtacgtttagttgattgtgtaggatatgtgattgaaggggcaagtggttatcaagatgacagtgggatacgtcttgttaaaacaccatggtataatgaaagtataccttttgatcaagcagctaaaattggaacaaaaaaggttattcaagatcattcaacgattggaattgttgttactagtgatggtagttttctagatattgatgaacaaagttatcacagtgcaacaaaagaaatcattcaagagttgcaagatatagggaaaccatttattgtgattgtcaatagtaaagatccttcaagttcaaagtgtcaaaatgttgttgaaagttatcaaaaagaatacgatgtaccaatcattgctattgatacaaccaacatgttagaaactcaaatcgtgcatcttttacaagaagcacttaatgaatttggaattcatgaagtgaaaattgaagttccacgttatattgcaatgttaaatcaaaaacattggttaaaacaaacattagatgaagcactaaaaaattcattagtagaaatcaaaaaaataaaagatgtcaaacatcttacagaaggtattgaatcgtatgactttgttaaaagagcttatttaaaaagtgtcgatacatctcattcttcagcgacgattcgcattgaagaaagaaatggtttatatgatgaattactaacaaatattgttggttatgaagtagatcgttcttctattcttgccttgttacaagaattgatgactatcaaggatgaatatgatggtatttcgaatgcccttagtatggtaagacaaacaggttatggttatgcgattcctcgtttagaagaaatagaattatcaaaaccagaaattattaaacaaggttctagatatggaatgaagttaaaaagtaaagcagcaaccacttatatgattaaaattgatattgaaagtacatttgaaccaattattggttcaaagcaacaagcggaaagctttattgattatttaaatcataatggaaatgataaggaagctattttttcatgtgatgtttttggtaggaaattaggtgatttaatagaagaggggatgtattataaattgaatatgatcccagaaaacgcaagtttaaaaatacatgatatattgtcaaaaattgtaaataaaggtaaatcaaatgtgatcgcaattgttttataattttttaaaaaagttctttaaaaatctcttgaaacaacgttttttagatgctatactaacctagtatttttattattgcggggtgtgaaaatgaataagaaagaattagttgaatcagtttcaatagaacgtaatttaacaaaaaaagaagcagaactacttgtagatactgtgtttaatacgattactagaagcgttgttgaaggagataaggtacttatttctggatttggtacttttaaagtcaatgatcgtaaagctagaaaaggaatttctcctaaaactcaagaagaaatgattattcctgctagtaaaacagtgacatttaaacctagtaacagattaaaagatgctatgaattaagcatctttttcattttctgttcataatagaagtgtaaactataaattgaggtgaataaaatgtttaattattactattatacaaattcttattatatgttagggaatatacttgttctagttggtgttgctttgatggcacttgcacaaatgaaagtttcaagtgcttataataaatattcaaaggttcaaaatagcagacatttaacgggctatgatgtagcgcgagaaattcttgatcaacatggtttgtcttctgttcaaatctttgaagttcaaggacgtttaagtgatcactataatccaagtaatcaaacattacatctatctcgtgatatttatcatgggacaagtattgcttcacttgcggtagctgctcacgaatgtggacatgcacttcaacatcaagaaggttatagaccattgacatttagaaatgctatcgttcctgtatgtaacttttcttataatttaggatgggttgccattatgattggtctttttatgggaagaacatctattgcttggattggtgttttacttacaagcttaatgttattatttcaaattgttacccttccagttgaatttgatgcatcttctagagctttgagtattttaaatgatcgttatttagttcaagatgaatattttggagcaaaaaaaatgttaacagctgcagcgctaacctatgttgcaggaatgttatcgacccttctttcattacttagaattgtcttagttgttttaggaaatgatcgaggaagagactaagccaaaaggctttttctttttgtttaaaaaggttataataaggtagcatggaggaataatgtatgaaagctttttttagaaaacatcgttttaaaatcgtgttaacatttttagttattgtttttgtatatatatgtttttacatgctttgggtacatgttccttacacaaagcataaaaatgatttagtaagtatacaagaagaaatatgtagtcaatatcattatgactatgatgactattttaatgcttatcaaaataagaaaataaattatattgttaaagtgaaaaataaaaagaaaacaatgtatgttgtatgtaataaaaaattaaaaaaggtggatacttttgaaggtgaaactatttctaaaaaagaagtgaagaatgcttttgttcaaaaatatcaagtaaatccaacaaaagtagagataggatatgaaaatgatcaatttgtttattgtttaacttataaaggaaaggatactttattatatgcgttttattctttagataatggagaatttttgaaagcatataaattataaaaagatatgattaaatatttaaaagatttagaatgtataaatttagaaagattattacttttaagagggaaagaactctctttgacagatgaagaatgtcatatattactattgattgatacttttgttacgttgcataaaaaaatgattacaccttcattattattaaaatattcatcacttactcctcatgaaatggatcatattttagattctcttttaaagaaaaaatggatttttaataaaaatggagcgatatgtttaaatcattttgaagaaaaacttttagaaaataaagaagctccagtagaagaaaaaatgaatatgattgatgtttttgaagaacaatttggtagaccattaacaccgatggaatttgatagtattaaagagtgggttcaaagcggttatagtgaagaaatgattttaaaagctttaaaagaagctgttaaaagtcaagttttaactttaagatatattgaaggtattttaattaattgggctcaaaatggagttaaagaaagatatattgatgaaaaaccacaagaaagaaaagtaaaagaaagtcattatcattggtgggaagatgaataaagaaaaaacaaacaaagtattagattactttgaagaactctttcctgatgctcattgtgaactcaatcatcaaaatgtctttgaacttttagtagctgtcatgctttcagcacaaacaactgataaaaaagtcaatcaagtgacggcttcactttttaaaaagtatcctactgttgaatcttttgctttagcatctttggaagatctacaaaatgatattaaaataattggactttatagaaataaagctaaaaatttaaagaaaatggcacaggttttacttgaagaatacaatggtgaagtgccaaaaacaagaaaagaattagaaagtttaccaggagtaggtagaaaaacaacgaatgttgttttatctgttggttttgatgaacctgcatttgctgtagatacacatgttgaacggatttctaaaagattaggctttgctaaaaaagatgatacagtaaatgatgttgaaagaaaggtttgtcgttctattcctagagatagatggaataaagcacatcatcagttcatattttttggtagatatttttgtaaagcacaaaatccaaattgtaaagaatgtcatttatatgatatgtgtaaagataaaataaaagaatcgaaaagataactatggatcaaaatattcaaaaaatattagaaataaaaaataaaaaaatgcaaaaagcatttaatcaaaatcatattgaattactttttttagataacaaacaagaattattaaattatttagattctttacttaaagatgatcaaacagtaggtgttggtggttcaatgactttatttgaaacaggagttattaattatttaagaaataaacccgttcgttttttagatcgttatcaagaaggtctttctagagatgaaattgaagatgtttttcatcaatcattactcgctgatgtttatttaacaagttcaaatgcaatcgatagaaatggaaatctttataatattgatggaaatggaaatcgagtagcagcaatgatttatggccctaaaaaagtgattgtgattgttggcatgaataagatttttgatgatgaagattcagctattcaacatattaaaaacatatcatgtccagccaatgcattacgtttacataagaacacaccatgtgttcaagttggaaaatgcgtagattgtcaaagtgacgatcgtatatgtagtgcttatgtgaagattgcaaggcaaccgttaagtagaatgacggtgcttgttataaatgaagaattaggatattagggggtaatactatgtttgaaaaagtaaatattcaagatttaaagtttaatccttttgatgaaattagtaatcattgggtacttatttcagctaaaaaagatggagttgttaatacaatgacagcaagttggggacaacttggacatttatggggtaaaaatgtaatgactgtttatattcgacctcaaagatatacgaaagaatttgtagatgccggagattattttactgttactctatttgatggttataaaaaggaactaggtgttttaggttctaaatctggtagagatggcgataaaattgctgaagtttcttttgatatagaggaagtagaaaatcaaccaacttttaaacaaggtaagatggtatttgtatgtaagaaaatttatagtgatatgattgatccaaaatgttttttagatgcctctttagatgaaagatggtatcctcaaaaagattatcatcaaagatatattggtgaaattattgctgtttatgaaaataaataagagttaaaagaggttcgaatgaacctcttttatgcgtctgaacgttcaaatttatttttcattgaaagacttaattcgtttaaaaaaagtgaaattgttttatttgtttcttcttttaacatatcagctatttcttgattggcttgatgtttaagttgaagttgtttgtttaaatcgttttctttttgtaaaagttcatcatagatgtttattaagtgatgccctttagccataacatttttttgataacgttcgatatgaatagatgatttcttataggaagcatctgccatagcagcaattaaacgacttgaccaatagaaattatctgtagaaacagtatctgttgtattagataaataatctggtgtttcactgatacttccatagaaaggaaccaatgcgttaaagacatttgatgcataggcgatccattcaattgcttggaaagacttaggtacatcattccttaattgaataactgataaaaagtcattacgattaattcctataggacggtacattcctttttttgataaatctccatatgttttataagggtcaaaatcagttccttggaaatgtaaagataaaacatatttaacatcttctactgtaattttcttttctggtacttgtgaccatggaatatcatcatcaaatggttgatgattaaatgtatgtggattaaaatatctttcaatatcataagcacgtggtgtattgtaaatatgatcagaatcatcatgacttccaaatgtgtcacgagcattaaatttagaacttaaagaaagatctagatgatatttttctatgaattctttcatatctaaagaacacatatgatttttcttggaagtaagtgcatcttctaaatcaaaattatcaataccaaattgattaggcatagctacatagtgatcatctggaacttttttagctatccaatgatgtccaccaattgtttctaaccaccatatttcattttgatcttgaaaagcaattccattcatttcataggtaccatatttctctaatagttgacctaatctttcaacaccttcacgggcactatgaatataaggtaaaacaatataaacaatatcttcttctccaattccaccaggaatattgttttcttgatcatattctactaatggatcagcccctaatactcttggatttgaggtaattgtttctgttgctgtcatcgcaatattttcttcattaataccgctggcagcccaaattccttttcctttaaccgcattaggcattgctgtataagacataggatggtctggtaaatcaatttctaaatgtgaaataactgttttatattttcttttttgttcttttgaagaaatgacaataaattttttaggtgtaaaaccattagctccagaatcatcatttctagcaatcattgtagaaccatcataggatgcattttttcctactaataatgttgtacaagacataaaattccccctttatgtttttatattataatacaaaaaaagggaaatgcatcccttatgattgatatttaatggtaaattgacttctaccatttcttttagaatgataaagagcctcatcagcttctttaaaagcttcatcaaaagttaatgatgtattaaatgcataaatacgcatactcatagaaaaacgaagacgattatgagataaagtaatttcatctaaatgatttattaattctttacataaataatttaaatcattttgaatatttttcacaaagataacaaattcatctccacccattctaattacaatatcatcttgatttgtataaaacaataaatacttagctagtgaaattaataattcatttcctgataaatgaccataagtatcattaacttctttaaaatgatcaatatctaaaacaattaaagcatttttttgaccaggatgatgcttaatatattcattaacaatatattttccagcttctaaattatataaatgagtaagagaatctctttgagctctttgttttaaagtattttgttcatgccaacgatgagtaatatctgaagctgttgctagtatgatttcaggttcatcatttgaattataaatagtagtagcatctaatgatttaacataataatcttttgaatttctttgatgttctctaaaaataattggtcctttacttttttgagtaaataaatcaactattttttgtttatcttcttcaaagacagtagattttgaagaagtaacataatctaaataatgatcataaattctttttttagattgatctaaaatatcaataatcatgcgatcttcatgaatatgatattctaatatagaaatagaattatcttttaatgccatttgatatttttctttttcaattaatgaatttaattctctatttttaatagacgtaatatcacttatacaactttgaacacgcacatctttttgtaaattaaaaataaattgtccttgatcataaacccataaataactatgatcttttcttctaatacgatactctaattgatgtctttcaagagaagaaatatcttttgaaagtgtttcaatgacatgataaacatcatttttatgaatacaattaatccactgattttgtacatcgtttaaaaattcttctttactatgatataaaagtagatttaataaatggtcatttacatcgataattgttagatttttatctaatttaaaagaacatataggtaatgaaaaagattcttctttttcatgagatatgttatttcctatagaagtatgaagaagttctatttgattatttttaagtacaatactataaaaatattgagttgttgcttgatattcttccatatgaagaataaaactaccttcaattacacatactgaatcattttgataaataatatttgtattaaattcatcaataaagaatgtaaattgattagatttgtattgctttaaatgattaataatatcatcatatgttaatataccttctgtatttaaacccatggctttgatatttttagataaatagggtagtaattgttcaatatcttgattattaaaaatcatttctagaatattttttgtatatgtttcataattttcaatagccattttctttttcctcactaccttattataacattatctaaaataaaaaccattcatttgtttaaatgaatggtttttcgttaagatactgtaaaatgaatggttttttcaacagatgctgaaccattagattctaagaatttaatagaatatgaacgtccatgacttaaattagaaaatgtagcgctatgatgattaacagatgaaagtacatttccattttgatcatataaagcaattgtcacactatgaccttgaccttgaactgaaatggttgcttgaatagaggttgatgaaatggttgccccatcatttatttgaccactatcacaagaaagtgatgcatttactgttgataaattaatagataaatctttttctatttgattagatgtacgttctggtgctctttcataactatagaaaccaattacttttacattttgattgactgtatagtttagggttccacttgaagtagagaagttttctcgatgaagctcttgaccattttgatcttgaacgacaactgtataaacaactttaccaaatgttttcgttgcatcattagcattttcatcagtaacggcgttttcaggattatatggagcaaagttaaaggtaatactttgaccacttaaacttacatcaaatgaagaaagttcagctaaattaaagacatcactatcaacgctttgagtaggggcagttccttttttaaaccaagcttgaataatcatatcttcgctcattccttcacttggtgaaacatatggataaatacctttgaccatcgctgcttgttcaacatcatctggttgatcaggataagatttttgacttcctttactttgcaaatgatttaaaagtgtttgaacaactttaccaggataagctttatattgactcgttgttttacctttatcaataccttctttaccaaatcccatccatacagaacagatatagtcagatgtataagctgacatccataaatcacggcttttacctgccattccatttttagccgtactagaccagttagaagtacctgttttagcacctacattttcaataccactgacatacgcataattaccactaccatttttagtataatctagcatgacttgtcttaccataaaagcactggcttttgaataagcactttgtttagcattgttttgaatttcttcatctatattaaatgtttcacctgtttggacaacttcaacataattgattgtatgactttcagtatataagccattattagaaatagtagcgtaagctcctgccatttcaagtggggaaataccataagaccaaccaccaatggcacttgctagaccaatgttttctttttccattgaaatacctatagattccatggcttctttgattttatcactaccaattttttgttgaacttcatcaaatgttttaatagctggtatattccatgaattttcaagagcgttttcaactgttactaagccatggaactgacgatcccagtttttaaatttaccattatagtaatcatcatcattaattgaatgtcctgtagaccaatcaagattttcaaaagctaaaccataatctaagaacggtttaacagatgaaccaggttgttgtttttgtgtagcataattataattaccaaagttataattacgtccaccaatgacagcgacaatacgaccatcttggcttgattgaacagcaccacccatgcgcatatcttcatcactataatcatatttttcaccattaccaatagcagcagcaagtgcttgggtttcactattacaatatgtatagatattcatttgtgtttttaaaggatctaatcctgttcttttctttacttcatctgttacgatatctacataagctgcattaacggaactgtttgtaattttagatgagcataacatgttttcaaccttcacatttttggcgtcatcacattctttttgagtgatataaccatgcttcaccataagatttaaaattgtattacgtctttccgtagcgttatttaaacaataataaggatcatagttgtatggtgaatttaaacttcctgcaagcatagctgcttctggtagggtcaattcactaacatctttatcaaaataataacgagaagcagaagaaataccaattgaacgtgtacttctaccaaaatagatcttatttaaataaagtgttaaaatttcctctttacttaaagctttatccgcttggatagcaagaataatttcactaaactttctcgtatatgttttttcagcattagggaagtaagtttttttaatcaattgttgggtgattgtagaacctccacctctaatacctccggctactaaattagacatagctgctttagcaatacgtggtaagtcaaaaccattatgttcaaagaaacgagaatcttcagcagcaacaacagcatcaacaagaacttgtggaagatcttcataggtgatattttctcttgttccattttcttcactaccataagtataaagaacttgtccttgatcatcgtacatcacacttgcaccggatgataaaagtttctttgcatcaaaggtttctgtatctttatagacaccataggctagaacactcacaccaccaattaaagcaactaagatacatatagtaagagcgataaatactttctttttatttattttcttttgagttttattttttttcgaagacataagatacctccatatttttcttatacaagtataccttattttgtatattaaaagcaaattttagccaaaaataaaagccaacattgttgacttttattgattcgtatttggatttggttgactactttcaccacttgagctactgctattaccaccagaagaaccaccgcttgtattacctccagtagtaccactagaagtaccactattatctgttgaggttccattattagaagaaccattattttcagtatttgtatttgaattgttgttttgattatttgaattgttattagtttcagaagattgattttcatttgtatcagtttgattttcttctgtttgtgtttcttctgtttgtgtttcttcagttgtttcttcgcttattgcagcatgtccttcatgcttagttccttttttataatattcatcaccatcttttacaacagtagaaggttgtgaaggatatgattttttaccacctttactttgtaagtgtttcaataacatttgaacaactttacctggataagctttataacgactggttgtttttcctttttcaataccttcttgaccaaatcccatccatacagaacaaatataattagaattataagcagtcatccataaatcacgactttttccagccataccttttttagcactgcttccccagttggatgttcctgttttagctcctacattagaaaggccggataggtatgcgtaattaccactaccatttttagtataatctaacatcacttgtcttaccatataagcactcgcttttgaataatcactttgtttagcattgttttgaatttctttatcaatctcatatctttcaccagtttgaacaacttcaatataattgatcgtatgactttcagtatataagccattattagaaatagtggcataggcacttgccatttcaactggagaaattcctttattccatccaccaatagcataagataaattggttacattactttcactggacatatcaataccaattgattccattgcggaagtaacgcctgatttaccgatttctttagtcacttcttcataagttttaatggctgggatattccaagaattttctagagcacttgtaagtgtaacagttccatggaattttctatcccagtttttaggagtaaatttacctttagaataaggtgtatcctctaatgttttaccagtacaccaatctaagttttcaaaagctaaaccataatctaaaaacggttttacagaagaaccgggttgttgcttacttgttgcatagctataatttccaaaattataattacgaccaccaataacagcgacgatacgaccatcttgacttgattgaacagatccacccatacgcatatcttcatcactataactatatttttcaccattacctaaagcactcgcaagtgtttgagtatcaacatcacaataagtatagatattcatttgggtttttaaaggatcaagttttgttcttttttttacttcagctgttaccatatcaacataagcagcaagtgtgttattattggttgtaggtgaagcacaaagtgtattttcaatctttgtattaactgcttcgtcatattcactttgagtaatataaccatgtttaaccatgagttttaaaatagtattacgtctttttgtagcgttatttaaacaataataaggatcatagttataaggtgaatttaagctacctgcaagcatggctgcttctggaagtgttaattcacttacatccttattaaaataatattttgtagcagcagcaatcccaattgagcttgtacttctaccaaaataaatcttatttaaataaagagttaagatttcttctttacttaaagctttatctgcttgaatagcaagaataatttcactaaatttacgtgagtaagttctttgagcatcagggaaatatgttttcttgattaactgttgagtaatggtagaaccaccacctgtaatatctcccgcttttaagttagataatgccgctttaacaatacgtggtaaatcaaaaccattatgttcaaagaaacgagaatcttcagcagctacaatggcatctactaaaacttgtggtaagtcatcataggtcacattttttcgtgtaccgttttcttgactaccataagtgtacataatatcaccattactgtcatacatgacacttgctccagaggataacagttttttagaatcaaaagtagctgtatccttatatacactataaccaaatatacatgcaaaaactaagattaaacaaagaataagcattgttactacttgaatgattttttttgaatttaatttttttgtttgtcttttcatttaaatacctcacaataatattgatcaataatttctaaataatgaagacgaggaagaaatccttgccttatcaaatgacctttttcttttattgtttcataacgaagggatttacgatcgttttttctatatgcttctaccataaaagaagcatctaagagataaacttcattcacttttgtaaaggcgataattaaaaaagcaattcctccatgatgaatgactttatcgagatgattaatttgatgtaaagaaatgttcgtaaagggaaaagataatgtttttgtttcttttgcttcaaaatcaatatattttcctttataaataccattataatctgttgttgaaggggttctaaaataagcttctactatttttgctgaacttctttctggataagaaaccttgacaatttgaataggggtaggttttttatgaataactgcaatatcatgtgataaataatattcatttgttaagttaatatcttcttctaagttcattccacggtgagcagtattatgtttaccttcaatcatagatgtataatgattattttttttcttatttggataattaaccatagaaactcctttttatttgcatatatatgagtattataacacatattttttttgtgataacaactctttagtaagaaattattttttatcttgaaaaaaggaaataaattggtacaatgatgtaaaggagttgaaaagcatggaatacaaagtcgtattaagtccaaaaaaaattgtcagtaaagaatttaaagtagattttaaagggtacaatgcggatgaggttgatcacttcttagatcaagtagtcaaagattatgaagcttttgctggactattgaacaattcttatgatagaatagaacagcttgaaagacgtcttgctgatcaaaaagctatgatagctcgattagaaagagaaaaagctttacaagatgataacttaagagcattagaagataatgtttcttccaatgtagatatcttaaaaagattatcattattagaaaaagcagtatttcaaaataaataacaaatgacagataatcgctgcttcattgaagtagaggaaagtccaggctgccacaatctgcgatgattgtagtgtttgtgcctcacgaatcaataagtgagggtagtgtaaactaacgacagaaggaaaacctaagggcaactatggtagaacttcataaatggctccacagagacaattccataggaaactatggctgaaaagaggaaagctccgcaaggcagaaacccaaatttggtaggggaacctttaaaacggaattgaacgggatagaggacgtgtaaacgtagataaatgattatctaatacagaacttggcttattatcatttgttttaaattggcatggaaacatgtctttttttaatagaactgaggggaaaatatgcaaagaaaaacacttcataaacaatataaaaaactaggtatatcagcagttagaagaattggctttagcttttttgcggttattttaataggatcgattttattaagtttaccaatgagtcatagtgttcattcaacaagtagttatttagatcatctatttgttgcaacttcagcaacctgtgtaacaggcttagtgactcatgtaacagctagtgaatatacgctttttggacaaatagtcattattttattgattcaaataggtggattaggatttttaacactgatgtcgatgttctttgttcttttaaaaagaaaactaacctacgctaataagattgtcatgcaggaagctttaaatagaaattcattaaatgaaacaggtatttatattaaaagagttattaaatatacagtttgttttgaacttattggagcaatttgtcttgcttttgtttttattccacaatttggaatccttaaaggaatttattatagtttatttcatgcaatttcagcattttgtaatgctggatttgatattttaggaaataattcaatggttccttatgtaggcaatgtttggattaatttagttatttgtggtttgattattgctggtggtttaggttttgttgtgtggatcgatttacgtttatctttgattcattatagagaacattttaagtattttaaaatgaaaaggtatttagaatctttatctttacatacaaagattgcattgatttctacatttgttttaatttttggaggaatgaccgttattttcatattagaatttcaaaatccgctaacattaaaatctttaccattttcacaaaagatactcgcaagtttttttcaatcagtaacacttagaacagctggatttgcgacagtagatatggcttctttacatcaagcaacgaagttttttatgtctattattatgtttatcggtggttctcctgcaggaactgctggtggtgttaaaacggtaacttttgttattggattgttatacgtccgtgcattaatgcgtggtgatgaaaatattcatgtttttaaaagaacaattgatgatcaaattgttaaaagagcattaacaattatgttgattagttttgcgattgctttaacaggtttatttattttatcaataagtgagcaggcagattttattgatctactttttgaagttttttctgcttttgcgacagtaggattaacagcaggtcttacaccaacactgacatttgttggaaaaattgttataattattttgatgtatataggacgtattggtcctattactatggttttgatttttgtaagaaaatataacgctaagaaaggaaaagatgtgaactatataaaagaacatatcttgataggataatgagatggaaaaacaatttgttgtattagggcttggaatttttggctctacacttgtaaagacactttctcaatatggtagagaagtcattgcaattgataaaaatcctgaaaatgtacaaagagtggctgattttgcgacaaaagcagttattggtgatgtcacagattttcaatttttatcagatttaggattagatgatatggatgtaggaattgttgctattggagatcgattagaagatagtattttagctacaatgaatctaaaagaactgggagtaccttatgttattgttaaagctaaaaacaaacgttttaaagttgttttagaaaaaataggtgctgattatgttgtccgtcctgaaaaagaaatgggagaaaaagtagcaagaacattacttcgaaaaaatattaaagatttaattgaattagatgaagaaaattgtattgttgaaatgaaagtacctcaagcatgggtaggaaaaacattatcacaactagatttaagaaaactttatagtatcaatgttttaggtaaacgaaatcctcatacacataagttagaagttcctgtagatcctaatttagaaatagaattaaatgatactttccttgttttagcacaaactgatgaaatagaaaaatatgattatttattatagaggtctattatgaaaaacgaagaaactttatttttgtttgctaaagcaatcaaaagcttaataaaaaaacagcctttagataaaattactgtaacagatattgtttcaacagcaggaaaaaccagacaaacattttatcgacattttcaagataaatatgatttagttaattggtattttgaaaaattagttttaaaatcatttgaagaaatgaatcaaggtggttcgttacaagaagcacttaatttaaagtttgcttttatcgaacaagagcatccattcttcaaagaagcttttaaatctaatgattataataatcttattcattatgatttttgttgtatttatgatttttataaagaatatatacataaaaatacaggaaaaacattatcttctgatatagattttttacttaaaatgtattgtagaggttctgtagatatgactgtagaatgggttttaaatgatatgcctatttctaaagaagatattgttacttatctaatagaagctatacctgataaactaaaagaatgtatgatgtaaatagacaagataaaattgtttaagagaagagatgaactggatgaagttaaaacgaagtaaaaataaaatgattgaaagatttttacaaggttttttaattataattttagtaattttgactatttttatgatgaatgatgttaataagatacaaggaaatgcaagagttattaactatgcaggcattattcgaggagcgacacaaagagaaattaagttagaaatatcaggtaataagaataatagtttaataaggtatttagatagtatttttgatggtttgatggatggcggaggaaaatatcaactcacaaagttaaatgatcaaaaatatcaaaagaaattagttgaattgaataaatcatggatttctttaaaagaagaaattcaaaaagtaagagaagacggttatgaaaatacaaatattattgaaatgagtgagaattatttttatcttgctgatgaaacagtagatgctgctgaagagtattctcaatattgtgcttctcaacttgatatgattgaaaaaggacttattgttacttgtacattaataatttgtattattatcagagagtctatttctgcggttgttctcatgaaaaagaataaagaacttaataagttagcttatattgatttacatacaggacttccaaacagaagtcgtgtggaagaacttttaatagaatatcatcaatttgaaaagccaatagcaatgattatttttgatttaaatgatttaaaagaagtaaatgatacattaggtcatattgctggagatacacttattatgaattttgctcatattataagaacatctattccagaaaagtattttgtaggaagatatggtggagatgagtttattgctttattaaatgatgtaagtgaagatgaagtgcaatctattattaaaaaggttcaagatgaagcaaatcgttataatgaatttagtaaacaaatatatattgaatttgcttatggatatgcactttctatcaattatcaagaaactaatttaaaagtattattgaatcaagcagataaaaatatgtatgaatgtaaaacacgtatgaaacaagctaaacaaaacttgaaaaagtaggttcaaaatgaacctatttttttgtaaataacttttgagacaaaaagatagctgaagtatgttataaatcaagtgtagtaaaaataaataaaaaaggaaggaagaatagtatgattcatagtgggatgacaagtgatacagcagctagaacactgcttagagataatgaagtatttgcttctagtgttctttgatgaagaagaagtcatagcttataaaacgttagtctcttatgaaaatgatcaatcggtattaatagatcatcaagatattaaaagaagaagagatatcgtaaaaaaagcaagatgggatgagttagctcgctatgatgatatgaaaaaagagttagatgctcaacttgctgaagcaaagatgaaagcagcagaagccaaagcaaaggcagcagcagaagctgatacaaaagctaaagctgaatttgtattaaagctttttaaaagcaaatatttaaatgaagacacacaatggcttgaaaatcttaccgaatatcaatatgatcaaatatttaagaagttaatagaagatgctagtctagaagaaataaagaaaataataggtgattaaagtacgagaaatcgtattttttttatatatttaataaaagggattgttttttatgaaaaatcatgtataatattggcaatttggggatttttaggaggacaattatgaaacaaaatagtggaaagcaattagcaaaaaaaatgctgattgcattagtgtgtggtttaattgctggatttggatgcattatatttagagagcatttaaattcaagtggtcaaggggaattatggaaaacaattaataatatcttatttcaagatattacagcagaaggtgcaacaagtgcgattggtattttctatataatcggtcagttatttgtaaatgcattacaattaattattgtaccaatggtatttgtttctattacacttgcgatttgtacaattaccgatacaaagaaattaggaagaatatcttctaagacaatcttaactttctttacaacaacagtttgtgctttaatttttgcaggagctgtaagtactgttatttatcatttaggtttatttaacactgttgatgcaggaaagattactgttcaacaaggaacaacaggttctaatccattaaatattattgtatcaattatacctaataattttattagtgcttttacaacaaatggtaatgtacttgctattgtctttttagcagttgtaacaggtttatcaatgaatgctttagaagaacaaactaaaacattgaaaaaagtatttgaagaagtatctaaaattattagtttatttttaacatttgttattaataagtttgctccatttgcaatcttttgtttactaacaagaacttttgctatttatggaattgattcattaaaaccagcattagcttatgttgttaccgttattattgctttatttgtttatttatttgttgcttatccaatttatttaatgacaatggctagagtaaatcctaaaccatttatgaaaaaagctgcaaaagttgccttatttggattttcaacatcatcatctgcagcttcacttccattaaatagaaaaacaacagtagaagaattaggagttcatgatcaaatagcatcctttgttttaccattaggtatgacagtaaatatggatggtacagccattatgcaagttattgctgcaatgtttgtagcagtaagttcaggatataaagtaacatttatgtctatggcgattatcgctattttagctttaattgcttctattggaacaccagctgcaccaggagcaggtgctattattctctttacaattctaacaggaatgggttatacaaatgatgcagcattacttgcttattcattaattctagcaatcaatagaccaattgaaatgttagtcacttcactcaatgttacaggagatgccgctacttcagtgattgttgctaaaaaagaaaatatgttagatgaagaaatttatcatagctaataaagaatgattacgaaacactgtttcgtaatttttttttacttttttaaagaaaaaaggtaaaaaaataacgatatataataggagacaaaatcatggatgctctaataaaagatacacttagtcagcataaaattatgttggatcaaaattgtaaattgatgatcagtcatgaagaaatgttatcaaaaatcatcaaagagtttgttgaagaaacaaaacatttaagtattgaagagattatcgaaattgtacaagatgagcatcgttttcaaagattaaataatgaaaatacgataccaggatatggaacaggcaggtttgatttctttggatgtattgatttaccacaattagatcatactatcaaaagaatttatttaaagtagaaatacaaaatgatgcctatccaaaatattctctcataacaagaggagatgcatatttatcaagaatacagacaacacattggggaaaggaacatgatgatcaaaactatgatggaatggaaaaggtctatttaatatggatactaccataagcagcaaaaaaaagagatggataagtgagtatttgtaaaatagatgaaaaaaagcatctagaaaaagaatatttaaataaaggaatttgaattggcgttgaaaaaggaacacaaaatgaaagaattaaaaatataagaaaactaatgataaagctaaaaatgacatttaaagaagcaattcagtttttagatatacttaaagatgaagtaaaagagatagaaaaatattttaaatcataatgtttataaggataatggttcaacatcgtcctttttatatcgataaattcttaacaaatgttctttaaatgtgtataatgacacggggtaaaaaagggggattttatgtttaaagattatataagagacttgaaaaatgagtttaaaagttataacatgcaaactcttttacaagatatcttagcaggtttaacagtagctgctgttgctttaccacttgccttagcgtttggtgtaagtagtggtgctgatgcaggtgctgggttaattacagcaattattgctggtctagtgattggtgttttatcgggggcaagttaccaaatctctggaccaacaggtgcaatgtcagctattttaattgggctttcaacaacatatggtttacaaggtgtcttcatcgcaagctttttatctggatgtatgttgattattgcatcgttatttaagtttggaaaaatcgtttcatttattccaacaagtgttattactggttttacaagtgggattgcgattattatcgcattaggacaaatcgataatttctttggaacaacttctgttggtttaagtgctttagaaaaactattttcatatttaaaattaggttttcctgtatcacttccaactgttttctttggaattttagtggttgtgatcatgcttgtttggcctaaaaaatggggagaatattgtccttcctcactagctggaattatcattgctttaatttgtcaattatgtatgaatttaccagttcatgaagttggtacaattccaagtactttatttccagaagcaagattatcttttcttcacttcaacttggaacaattacacaattaatgttacctgctttaagtattgctgcacttggaatgattgaatcacttttatgtggagcaagtgctggtaaaatgaaaaatgaaaaactaaatgctgatcgtgaattaatggcacagggtattggaaatatgttgattccattatttggtggcgttcctgcaacagctgcgattgctagaacatctgtagctattaaagcaggtggaaagacaagattagtcagtgtcttccattcaattgttattttaatttcaatgtttttacttggttcacttatgtcacgtatacctttatctgcacttgctggtgttttaatggttactgcttggcgtatgaacgattggcaagaaattaaaacattatttcataatagagttaaaacaaatatttcacaatatttaattacaatgtgtgcgactgttgtttttgatttaactgttgcgattgttattggagtcatggtttcaattattttatttgttttaaataattctcatttacatatagaagtacgtgatattgataaagatcgtgtaggaaaagatttaaaacatcatcatcaaaaaacaagaattatgtatttaagtggacctattttttttgggacacaagaacaaatgatacatgttttagatgaattagatgattcattagaagctattgttttttcaatgagaggtgttccttctattgatgattcagggattcatgaattctttgatatcgttgatcgtttaaaagtacaaaactgtatcattaaattaagtggtgttcaagaagaagtgatgattcaatttaaacgtaatcattttgatgaatatgttggtaaagaaagtttctgttgggatgctattatggctttagaagctttggatcaagaattaatttctgcttaaaacaattgacaaagataaagatatttattaatatagacatgcaaattgaatattgcttaggtaagctatagatttctctatttctgatcataaatagacatctatagctttttttatggaaaggagacttatatggaaaatagaaacccaatggaatacaagcctgtatttcctttattaatgtcaatggcgattccgccaatgatttcaatgttgattcaatcattatacaatattatagatagtatctttgtttctcaacttggagaagaagctttaacagcagtatcattgattttccctttacaaaatttatcattagctatttcttgtggaatagggattgcgatgaatgcctttattgcaagacatttaggagctaaagatgataataaggcatcttattatgcaactcaaggaattgtgatgtcacttgcacattctttattatttttaattattggtttattttttattcgaccatttttaaatatgtttacaacaaatcaaaatgtaattaactatggaatgcaatatggaatgattgttgtctcattagttattggccaatttattcatctagctattgaaaagatgtttcaagcaactggaaacatgatgatgcccatgatcatgcaaatctttggagctgttattaatattattttagatccaatcttgatttttggctattttggattacctgcttttggtgttgctggagcagctattgcgacagtaattggtcaattttcagcagcttctttagcatttgtcttatttaaaaaatacaatacacatcttcatatttcatttaagaaattcagagtagattttcatgttatttctcaactttatagtatagctattccttcaagtgtgatgatgtgcttaccatctgttcttgtttctttattaaatggtatactttcatctatttcacaaagtgcagttgctttcttcggggtttattataagttacaaacatttatttatatgccaacatcaggaattgtacaaggaatgagacctttaatgagttataattatggagctaagttaaaagaaagaatgcatcaaattttaaaagtatctggtctggtcattgctgctattttaggagcaggaacattattattctttataattccaaatgttttactttctttatttaatgcaagtagtggcatgttagaaataggagaaacagggcttagaattttatctttaagttttattgtttcatcttttggagttttaatgtcaggtgtttttgaagctctaggtttaggaaaatattctttaatagtttctttacttagacaattattgattacagtaccattagcatacattttattaaatgtcatggggattgaaggtatttggttatcatttgttattgctgaagcaattgcaagtattgtagcttatatcttatatcgtaaaaaatttaaaaccatataaaaaagaggctgttacgaaattaaataattaatttcaaacagccttttcttttgtaagataaaaataagaattttaaatatctatataataaaattattttactataaaaagcaattgtttctaattacaataattcctcaaacgttatcgttgagaaattaattagtaggaaataaatatcattgataagatatcaatatcctatttttagttagaaattataacaaaaaagatgttacgattttaaattatttcgtaacatcctctttcttacataaaaattattttttatactatttcttttctattgattttattgatttaccacctttaacacaatttaattttccattataaatagtaaccatataattatctctcgcaaaatttatagcttctatcttcccttgttggttatagaatatattaatagcaaatccattgaatttactaggcttataatcgttaagggattgaccgttgaggcagtcagtttgtactttgtatttataaatagctgaatttttattttcactttgtaaaaaatgtaatacattttttacaatttctttatcgatatatgatgcgccagaatagctatcactaagatacttgtcaggctctttttgtccataactcattaaagaatcagacactcttccaactggatttgttgttgtctttttataaggaaaatctgcaggtaatgtgtagttatatttaaaaattgattgttttttaaattcatcttcatctgttgcatagcattttgtagcagcaatttgcgctgcttcataaatcccatgtgcttcttgtataatacctgctttttttgcttcatctacatatcctaaaacggatggaatagccacagcagctaaaattgcaagaatgacaagaacaactattatttcaacaagcgtaaaaccatgtttatttctaatttttttagtatctatcatttcgtttctcctaattatttgattaagtaagataatatttttattactattttaatatgttaatctttatttagcaatgattaaaagtagattgccatgatactttttgtatatgattctatttttatattattatccaataaaaccttgaaataggtttctatttaaaaaaatagaaaagaaaaaatataaatttatgatatacttgtactccaaggaggaactatgatgaaaaaactctatttattattactttcattattgatgacatttactttaacaggatgtaatcaacaagtagaaaaagcatcttctaagcaaagtgtaacactttctttagaacaaacaagtagccaggatgtagatgtttatgttgatcaagatcaaattgatactttaaaaagtcaaggtgcaggaacttatgagctaaagttaactaaaggaaatcatgagttaaaagttgtacaagatggtgaagaaactcaaaaatcgttttatgtagactctaaagaaaccttatattatcaaattacaaatatagaaaaccaattacaaatagaaacagatcaggtttcttttgatgaaaataatgttcaagatattttaaatcaaatagaagaatatagtggacaaccatatattgaaatcaataacaatactcctacttttaaagaaaatgaatatactacaaaaacatatattcaattaaatgatttagatgaatatggacgtactcaaaaagatcaagcttgtttaggtcctgaaacacttccaacaaataaaagggaatctattggaatggttaaaccgtccggatggaaaatacaaagatatgatgatttgatttctacaaaatatttatataatcgttgtcatcaaattggttttgctttaagtggtttaaatgctgaagaaagaaatttaatgacgggaacacgttattttaatgttacaggtatgttgccttttgaagaagaggttagagattatattaaaaatacgaatcatcatgttttatatgaagctattcctgtatataaagaagatgaattagtagcaagaggtttgatcttacaagcagcttctattgaagatgaaacgattcgtttctgtgtttatatttataatgtacaaccgggtgttactattgattatcaaaatggaacttcaagaaaagccaaagaaggagaaccaacttatggcatcaaagaagcaaaagatccatttgattatcataataagtcaagtaataaaagtaaaaagtatgttattaatataaaaaataaaaaatatcatgattcaaattgttcaagtgtttcaaaaatgagcgaacaaaataaagaagtagttacttcaacttcaaaaaaattacaacaacaaggatatactccttgtggcatctgtcaaaaataaaaaagtgagatgtttccatctcacaaattaaatatgatcaataatttcatctaaatcaatacctaattgaaatcctaaagagaaatagtcatcaattgtattttggtaatcttgactagaataagttgatgaaacattcatcattgattgataaatttttaaaaataagtcttctaaagataaacgattaggaatttcagtatgatttttaatagtatcaattcttaattcataaccaatagacattaacatttttaaaccatctaaataatgttctaatagttcatcgtgatgaatagcttcttctttttcccaaaagataaaacatcttgaatcctgacaaacttctcctaaatcatgtaagaaagataatgttttttgcttaagtcgagcgacatttaaaatttcatttttgtttacttgtaattctttatttacgtaaacttgatacattttagataaatcattcataaaaatcacctcaaaactattatatcacgaaatatgaactaggtttgaatttgacatcaaataatcctctagatataatattcaagatttaaaggaggatgaaattatgcgaaaaatttggatatgcggtgctaaaggacaaattggacaagcaatcaatgaaattattgataaacttgaattcaaagttcttgatactgacatagacgatttggatattacagacacagatgaggtcttacgttttggggaaatgaatagaccagatattattattaactgtgcaggacttacaaatatagaggaatgtgaaaatgatatttctaaagcttataaagttaatgctttaggtgctagaaatttatctattattgctagaaaattagaagctaaattggttcatatttctacagatgatgtttttgatgggaaaagtgatcaaccttataatgagtttgatcaaacaagaccacaaacagcttatggtaaatctaaattagctggagaacaatatgttaaagaatttacttataagcattttattattagaagtacatgggtctatggtttaggaaataattttattaatgatttattagaaaaagtaaataaaggtgaaactctagcaattgcctctgatcaatttggatcacctacaagtgctaaagaacttgcacgttttattttacatttaattgatacaaatgaatatggaacatatcatgcgacaaataaaggggtatgtagtcgatatgaattcgctcatgagattttaaaacttacaggaaaagaagctcaaatgaaggcagtacctactcatttatctgatttttctaaagttagaccagcttattgtgtcttagataattttattatgtcaatgactccagtttatacttttccttcatggaaagaatctttaaaagaatattttaaagaaaggggtttatataatgaaaaataaaaagaagttaggtttaacaactttgatttttatagcacttattgcaggtgcaattaccggaattattattaattattgtattcctagtaataaaatcgttgatgattttattgttagtggtttattttatgttgtaggacaaggatttatacgtttaatgcgtatgttagttgtaccacttgtcttttgttcaattgtttgtggaagtatggcagtaggagatactaaaaaattaggagctgtaggacttaaaacaatgcttttttatctatgtacgacagcacttgccgttgttgttgctttatgtatcgctaatgttattaatccaggtattggtttagatatgtcagcaattaaaatcacttcaaaagtaacagagtcaacacaagcaacaagtgtgacagaaacattgttaaatattattccaacaaatatttttgaatcacttgcaaatggaacaatgttacaaattatcttgtttgcgcttattttaggtgttattcttgcaaatatgtcagatcgtgtagatattgttaaaaacttctttagtcaatttaatgatattatgatggaaatgacaatggttgttatgaagttagcaccaataggtgttttctgtttgatttctaaaacatttgcagaaataggttttgatgttttcattccattattaaaatatatgttctgtgtattgcttgctttaggtgttcaatgttttggggtttatatgtcaatgttaaagattttttcaggattaaatcctattatctttattaaaaactttttcccagtaatggcttttgctttttcaacatcaacatccaatgcaacaattccaatgaatattgatactttagctgaaaaaatgggtgtctctaaaaagatctcatcctttacaattccattaggagcaacaatcaatatggatggaacatccattatgcaaggtgttgcggttgtctttacagctcaagcctttggaattcatctatctatgatggattatgcaacagttattggaacagcaacgcttgcttcaataggaacagcaggggtaccaagtgttggattaattacacttaccatggtctttaattccgttggcttaccagtagaaggaattgctttaattatgggaattgaccgtatcttagatatgacaagaacagctgttaatattactggagatgcagtatgtacaacagttgttgcttcaatgaataaagcagttgatcgagatatttattatggtagaaaataaggaatgatcgaaaggtcattctttttttataccttttgtgctataataactttcaacaaaagttgatgaaagttaggtgatagagtgtcaaaagtaaatgatttaaaacaagaaaacgaaataaaaataagagaatgcctttatgatggacaaacttggacaaaaaatgacttagcgtataaaacaagtctttcattggcgacaactactaatattttacaagaaatgttgaaaaatcatgaaattgaatatgtaagtgattctaagtcaacgggtggtagaaagtctaaagaatatcagttatataaggattataagcatctgttaaagatagttttaaagaagaataagaagaattatgaatttatttttgaaatcatagatttatatgatcaaattgtttatcaaaaaaattattcttctttaaaaggaacagttgaagagtttttaaagatgttaaaagaggtattaaagaaagatcaagaaatcgttgtcatttgtttatcactgccaggggtttgtaatcagggaatgattgatttgtgtgattttgaagattttcaaaataaaaatatattagaaattttaaaaaaagaaattaaacaaagaataatcattgaaaatgatgtcaattgtgccagcattggtttttatcatcaatatccacactatcaaaatagtgcgttgatttatcaacctgcgattgattatgtaggctgtggtatgattattcaaggaaaactttataatggttttagtcattttgcgggagaacttcgatgtttacctttttatgatcatttacaacaagagcgtttattaaaagatgatcctcaagaattattagaaaaacagattgctactttatgttgtgtcttaaatccagcagctattggtatttgtagtgatgttttaaaagacatacaaatatctttaccaacgattcctttaaaacatcaacctcaaataattaaaattaatcaactatataaattaattaaagaaggactttttcaaataggaaagaatcaaatgataggagggatgaataatgaataaaagttatattgatttaccaaatgttgccgtaaagctcccagctttagctgtggagatataaggcaactaaagtgaaattaggaactttatcaagtcctttagaaaaacaactcacaaatacattgctagaaaaattgaatgaacttacattaaatatctttaacatcaatagtgaagaagaggttttaaaaattattaattaaaaaataaacagtttgaaataaatgctatctcaaactgttttttaatataaattattcaattaaaagaaagatttaaaggagtagttgattcttttgtaccatgaggaagacgtttttttaaaggaatgactttaaaaccagggcatagatacataaaaggggaataacgtaattcatggctaagtatagaaataactgttttttgatctaaagatgtataaacatcaaaaacaaggtcaaaatctaaaggatgaatgttttttaattgaatgcgagaatctttatgatttttaatcattaatttaaaaatgtgatagttacctgctgtaatacataatttcatgaaagcacctccttttatagtttgaacaaaagcataaataatatgattaaaaatagacaatttttattaaaaaaattataataaaggaaacggggagctttttgctgagagtaagtattgacttagacccataacctgatttggataatgccaacgtaggagatataaacgttaacagagttcaacagggctctctttttatttccagggaaataaaaaaagaatattgtaaagaaagaaggaaatttgatgaaattaaataaagaagatttattattgtatggagtaacagattcaaaatatttaaaaggaagaaaaatgtcggaattagttgaagaagccattcttggtggtgtaacaatgattcaactaagagaaaaagaaatgacacatgaagcatttaaacaagaagcattggatgttcaaagtgtgtgtcaaaaacatcatgttcctttgattattaatgatgatgttgaattgtgtaaagaaattgatgcagatggggtccatattgggcaagatgatttaaatttaaaagaagcaagaaaaatattaggtgaagataaaattattggtgtatctgcacataattatgaagaagcaaaaatagctttagaaaatggggctgattatttaggtgtcggagctatttttgcaactcaaacaaaagatgatgcacaaaatatttcaatggatacattaaatgaaatttgtcaaaaagttgatattcctgtggttgccattggtggtattaatcaagtgaatatcttagaatttatgggtgttgctattgatggtgttgctatcgtttcaagtatctttggaagtgatgatatccaaaaagcaagtagcctattaaaagataaaattcaaagagttatctctaacaaaatgccaacttgccttacaattgcaggaagtgatagtagtggaggtgcaggaattcaagcagatttaaaaacaatgcttgctaatcgtgtttatgccatgtcggttattgcagcactaacagctcaaaatactacaggagtcgatgctatctatgatgtcgatgcttcttttgtggctagtcaaatggatagtgtgtttacagatatttatccaatggctgttaaaattggaatggtttctcaaaaagaagtcattttatctattagtggaaagttaaaacaatatcatgcacgtaatatcgttgttgatcctgtgatggtggctacaagtggggcaaaacttattagtgatgaagctattgatacattaaaagaaaatctcttcccactcgcaacggttttaacaccaaatattcctgaagccgaagttttatcagaattaaaaatcaataatgaagaagaaatgttaacagcagctaaatatattggagatcattatcattgtgcagtattacttaaaggcggacatcaaatcaatgatgccaatgatttactttataaagaaggtaattatcaatggtttaaaggaaaacgtattaataacaataatactcatggtacgggatgtactttatcaagtgcgattgcttcttatttagcacgaggtgaaaatttggaaaatgcttttaaaaaagctaaagattatatttctggagcacttgcagcaatgcttgatttaggacaaggacaaggaccaatggatcatggttatgttttagataaaaaagattagacgaattgtttattttataggtataatagtggtgggtgatgaaaatgaattattatgaagaagccttgaaattacatgaaaaacatcaagggaaaatacatacggaattaaattgtgaaattaatacaatggatgatatgtctgttgtttatacgccaggggttgctgaaccttgtcgtaagattgctgaaaatgaagaagatgtttatcgttatacaacaaaatcaaatacaattgctgttgtctcaaatggaacagctgttttaggacttggaaatattggagccaaagcttcgattccagtcatggaaggaaaagctgctctatttaaaaaattcggagatatcaatgcggtacctatttgtttagatacacaagataaagaagaattgattcaaacagttaaaaatattgcaccatgttttggtggaattaacttagaagatattgcttctccagattgttttgaaatcgaagaaagattagatcaaatgttagatattcctgtattccatgatgatcaacatggaacagctgttgttgttttagcggccttatataacgctttaagagtgacaaaaaaagatatcaaagatattacagttgttttaaatggaccaggagctgcaggaacagctattattaaaatgatgcatacagccggtgttggtaaaattattgcagtggatgaatttggaattttatataaagatagacaagaaggacttattcctcataagcgtgctttatgtgatattactaatcctgataatatgcaaggtacattagctgatgcattaaaaggtgcagatgtttttgtaggtgtttctaaaccaaatctagtaactgatgaaatggttcattcaatgaacaatgatccaattatttttgcaatggcaaatcctgaaccagaaattacttatcaaaaagccaaagcagcaggagcaagagttgttggaacaggtcgttctgattatccaaatcaaattaataatgttttagctttccctggtatttttaaaggagcattagaagcaagagttccttcaattacaccagaaatgaaagtagctgtggctaaagctattgcagatacaatcagtgatgaagatttaaatgaagaaaatatcatgccaaaaatcttcaataaagatgtgacagcagctgttgctgatgcaattaaacaatttgctaaataaaaaagatattaacaaaataaatgaccctacctatttggtagggctatttcatataattatattatcatagttaaagtgaaagaaatcgatgataaatatgggtagagagaatagggtgaaaataatcagtgaaaataattgagataaaagatagaaatgatgaattattaaatacactgtaaatgtttgggaagattctgtaaaagccacacatacatttttaaatgaacaagaaattgaacatattaaagaatatggtccaatgacatcaaagaatgttgaacatttgatggttgtagataatgatgaagctgtgggatttatggaaattgaaaatcataaattagagatgttgtttatagcttctaaccaaagaggaaaagggctaggtaaagctttactacaatatggtatgaagaattatgatgtttgtgaattaacggtaaatgagcaaaatccacaggctattggtttttatgaagtaatgggatttaaaacatacaagaaaacagaattagatgaagcaggaaacccttatccgctgttatatatgaaattagatagataagattttatagaattgtttaaaaaattaattataatgaatatgaaaaaagaacaacaaacggttcaccttggattttaatagtatgaaataactatcacacatttttctagaaacaggaggtagttatttttgttatatatagaagtaattttacaatgatatctattactgacatgcttaatgcaagtgtccatactaaataatatataacaaaaatgattctattatgatagaatgatacaaggaggtacatagtatggaagttatgcttattgttgggttatttgcttcatctgcgctttccttaaattttattgttaatcaaaaatataaattagcaggatcaatgaatattattaacttatgtttagtggtagcgacagcttatcaatttgatcaagtaaagaatattgtttggttatttggaattgcggcaggagttgtacttgtttattttgtagtaagatttcttttaaagaagaagaaaaaagaaaaacaacaatctattgaaaataaggttgttgatgtagacgttgtagataaggagaattagagaatggaaaaagtattaattgaaattgaaatggaaaatggagatgtgatgaaaggagaactttatcctgaagttgcaccaattacagtagaaaactttttaaaattaattgatgaagatttttttgcaggattgattttccatagagttatcccaggatttatgattcaaggtgggggatatacaaaagattttaaagaaaaacattgtgattctattaaaggtgaatttaaaagcaatggtgttaacaatgaattaaaacatacagaaggtgttttatctatggctagaacaatgatcaaagattcagcatcttcacaattctttattatgcataaaccagcaccacatttagatggtgaatatgctgcatttggtaaaattactgaaggtttagatattgtagatcaaattgccaatgtccctacaaacttccaagattgtccaacaacaccagttgtgatcaaaacaattagaagagcgtaattgtatgaaagtaatgtttatatcagatattcatggttcttattattgggcaaatagggccattgaaaaatatcatgaagaaaaagcggataaacttattattttaggggatattttatatcatggaccacgtaatgatttacctaaggattataattgtaagaaggttattgctttattaaatcctttaaagaaggatattattgcagttagaggaaattgtgatagtgaagttgatcaaatggttttagatttccctatgcgtagtgactatgctttgatggatgttgatcaacatcatttctttatgacacatggacatttatttaatgaagatcaacttcctttattaaatgaaaatgatattttgatttatggacattttcataaaccacttgctaaaaaagaaaacggtatttatattttaaatccgtcttcgatttctttacctaaagaaggtacgaatagttatggtatttatgaaaatgactgttttacaattaaaacatttgataatgaaattgtaaaacaaatacaattagattaatgaaagaatcgtttgatagataatatcaagcgatttttttaatgtgtgccgggcatggcactaattcagttggagataaaccaaccacaggtatttaccgccaagtgtaatgaaccacaagtcgttgtcagtgatggcaaggatggaggaagtggtgtagtgattcttttgagcgtacgaacagaaacttgatataaggctaaatggtggatgagattgcatcacaaatcgaagtccaaaaggtaaacgtaaaaccaagacagtaaatcaagacgttgtaaaaaaagtgaaattaggaactttatcaagtcctttagaaaaacaactcacaaatacatcgctagaaaaattaaatgttcttacattaaatatctttaacatcaatagtgaagaagatgttttaaaaattatcaattaaaagagctatacgattcattcgtatagttcttttattctatccaccatttaaatagggggaagggcatattagaaaacataagataacgtggaagcaaatattgtttatcattgcgtgtcatatgtctattttgattgtaactaaaggctagtttaacagaacttgatttgagataatcttgcgcattttgacaactgacaccatatggaaaggcaaagtaatctgttgaaacaaggcctttgtttttttcaaagtctctttttatttcatttgttgtcatggtttctattttctttttatagggtaaatggccaatatggtgcatatcataagaatgactgtagtattcaacatattgatcatttttcaaatcatttgtttgtaagtaaagtaggttattggtttttgttttataaccaatgacaaagtttgtagcttgcaaattatatttttttataataggtttaacaatagtgttaaagtttttatatccatcatcaaaagttaaacatacagcttttttagatacttctttttttccatgataataggcttcaacatcttccatggataggcattgataattattatccgctaaatatttcatttgtttttcaaattcacttatagacataaaataaggatttgatgcatagttttcttttttttcttgttcacttacgacaccatgatatcctaagatagcaattccatctttaccgttttcatgaataatgatgtcttttgtcatccagccaagtccgattgctatgtaacaaacaagaacacataaaatgacttttaatatatttttcataatattccaactttctatcagtactagtttatagaaaaacagcactgatgtcaaaaaaagctatgagacttcatagcttaagacacaagtaataaacatcgctaggacaaattcttttaagaaaagattttcataatttaagtgttcttcttttttatttataaaataagataagtaatttttaagaatttgatgatttgtgagatccttaaaagattgggcgatatttttaaaatcaattctttctatttctcttaaatcaggtttaatttgatttttgatgtcttgaataatatctttaaaatgataaacctttaaatcatcgtaatcatgttcactcatataaagttctaaacctaagataaaataatcttctaattttaagtaatctaaatacgtattttcttttaataaatcaagaataggtgtttcatcagaaattgtaagtaaatgatgattgtattgattttcatagtttaaaatttgattatgaaaagataaagctatttcttgaatattttcttcaggataaaaagcaaaacgatgcccttttaattttttaaatgtttttaaagtatcaagataacctaagcgtattctttgatccaatagctctcgattaaaatcaagaaagccacctaaatgcttagacggtctaataaaagtgatattttcacgatgtaataaatagggatgggtcgcttcttgattgagttcaattgcaataattttttgtgctcccatttttaaagcaagagagataggtaaattatcataatatccgccatcaatatatccttgcttatctatataatgaataggaaatgcaggaaaacatgaggctgaagcaatagcatattctacaatgttatcttcgctcatatcatctactgtgatttctaatggtttcatagaaggaaaagcaacagtgcataaaccatatttgatgggtgaacttttcgcttttttgccattataaagacctttgattaattgaacaagtggttcaatatcagcaccttttttatcaagataggactttaaaaaaggacctatgttagaagaattgttcattagattttcaattgaaaaatcaaattgaataggatgctttaaaaccttttctaatgataaagtatcccataattcataaagcttttgataatcttcttgagctacaagtagcccatttaaagcaccaatagacgtaccagtaacaatatcaaaatgatatcctaattcttgtaacgctttcatgcatcctgattcataagctcctttagaaccgccacctgataaaactaatccatatttcataaaaacacatccttttcaataattatactttttaataaaaaaattacaactttatcattttaatatatgaagagtttgttataattatatggcaaggaggattaaaaaatgaaaaatgtagtgaaaacagatcaagctccaggagctattggtccatacagtcaaggaatacaagtaggggatatgtattttttctcaggacaaattcctctagtaccaagtacaggtgaaatgccagaaggaatcgaagcacaagctcatcaagctttaaaaaatgtgaaaggattattagatagccaaggattatcattttcaaatgttgttaaaacaactgtctttttagataacatggatgattttacaacagtaaatggtatttatgctgaatactttgtagaaccttatccagcaagatctgctgtagaagttgctaaacttcctaaaggagctttaattgaagtagaagttatcgctaaaaaataattaaaaaagagatttcgtttttgaaatctcttttttgtatattataagaaaagaattgcaataattcctactataaaacaatagtaagaaaaataattcaattttcttttatttaaaatactaaacaataaattaagtgctaaataagtaacgattccactgacaataaagctgattaaatatggaagccataatgcagcgacagttgaacttgttaaaaaatgtttaagttttaaaatgattgcgccaaagcttaccggcataaacataaagaaagagaaatctcttgctgctttttgatcaagaccaccaagcattccaccagtaagtgttgatccactacgagaaactccaggaagtaaagcaagtaattggaaaaatcccattcttaatgcatcccataaattcatgttttttgttgttctttttcctttatatccaaatttgtgaataagcattaaaaaacaagaagttaaaagtaaacaacaacctactaatttaggattagagaaagcatgttcaatataatcattaaaaagaacaccaccaattgctgcaggaattgtagcaacaattaataacatacaaaatctaaaatcaggtaatagttcatctctttcttgaggtttagcaatatacccgaaaaaggatttgattaaacaaataatatcttggcgataataaaacatgatagcaatgagcgaaccagtattaacaataacttcaaaagtaacatcattcatttgtggaaccattaaaccaagtttttcaaaaatactttggaataaaactaaatgtccactacttgaaataggaataggttcactaaaaccttgaatagcacctaagattgcatagacaataatatctttaattaaactcataatttcacctcgtcacccattatatatgaaaatattataaaaatatacaaaaacatttttttaatggagatgacatataataaagaaaaaggaggaagaaaatgattgttaattgggttaaagaagatgaagaactattagaaccatatgaatggtcaaatggtgatgatatcgaaatcatttcaacactttcatgttttaaagtagatcaaaaaacactccatgattttatttatggatgtttacacatttttgatcaaaagttgtgtcaaaaagtatttgcaataggagatggtcattatgctttagcgattgaaacagatgatcaaggaaagctttgttatcgaagtgtttttgatttttgtgatcgtgataaaatgaataaaaagattgctgctttagaactgtctaatattcattatcaaatgtatgatgaaggagaaatgaaagaatatggtctaacaagagaggaaaggttaaaaaagcaatttattgaacaaagaattgatgaactttatatggaaaattatgatgattttttgatgttatgtagacagttaaatatcgaagatgcacaaagtatccaaaaatataatcatttaaaaaataaaatagctaagggctatacatttatacatgaaatcctattctatgaatttactaaaaaggaatacaaaaagaaataagcaatgcttatttcttaattgtaattcctatttttctttcaactttcgcaagtttttttcttgccatataacgtgctttatcagcaccttcatttaaaattgtatcgatatagttaccttgattgatttcattatatttatcatggattttttgtaattcattacctacaacttcagctagatcttttttaaattgaccataaccaacaccttgataacgttctacaagtgcatcaatagattcaccacttaaaatagaataaatagtaagtaagtttgaaataccaggtttatttttaacatcatagtaaatagcgttatcactatcagtgacagcagacatgattttctttttagaaacattaatatcatctaaaatataaatacatcctttacctgtttcatcagatttagacattttctttgtaggattttgtaagtccataatacgtccacctacttttggaacaagtggttcaggtaatttgaaagtttcactataacgattattaaatctttcagcaatatctctagcaagttcacaatgttgtttttgatcttcaccaactggtacataatctggatcataaattaaaatatcagcattcattaatgaaggataattaaaaataccagctccaatagattcatcttttttaagtttgcttgctttatctttatattgagtcatacgtgataattcacccattgacaccatacatcctaaataccaaccaagttgagcatgttctaaaacatcagattgtaaaaataatgtgacttttttaggatctaatccagctgctaaatataaagaaatcaaatcttttgtattttttcttaaatcctttggttcttgataaattgtcatactgtgtaagttagcaacaaaaacaatcatttcatattcatcttgataagaaacaaaaggtttgatagctcctatataatttcctaaagttactcttcctgttggcttgatgccactcaacattcttttcataaattttcctccttaaaataaaaaacgtccttaaaaaaggacgttataaacgcggtaccaccttaattcgtataaaatatacgctcttgattttaacgcgattagcgacaaaagacttgtgccttttgtaactccagaaccccaatttctattatatcaatggcttatttccatcaaccataagctttctataacatttaatataatttacttatgttccttcaaagtctttaaaaacattataatgagctcatctataaaaatcaagatatttaaaaaaagatatacaaagtttaaaattgttgtataattatttacaaaggagtgattgtatgatacgtatatataccgccccaagttgtgcttcttgtagaaaagtaaaatcttggttaaatgaaaatcaaataccttatgtagaaaagaatattttttctactttattaaaagaatcagaacttcgagaattattagaacgtagtgaaaatggtacggatgatattatttccaaaagaagcaaaattattaaagaaaatgatattgacattgattcaatgaaaatcaatgatctaattaagtttatacaggaaaatccatcagttttaaaaagaccaattatgattgatgaaagaagatttcaagttggttacaatgctgaagaaataagagtctttattcctaaagaacttagaaagttagctgaatgtcatgatatggatcgttgtccacaattcagcaataaagattgtttgaattttaaaaaagaatatgaaagggatagagaaaaggaatcaagccattagattgattcttttttaggagacaatatgaaaaaaatattaaaagttataatgacacttattttaatttgttcatgtttttatctagcaatttcattgtttatgaatcatttgattattaatgatatggtaccaacagttgttaaatcaacggctgtaacaaatgctttagaagatacttgtcaaaatgttttaagtatgatgaatatggacgaaagccaaagtcaagcacttgtttcttctttacaacaagatgaaaaaacgcaagaacttgttaatgaatatattgatactgttttaaataatcaatcatctactctagatgaaactttattaaagcaagttttagaagataaaaaagatgaggtatattctattttaaatccttcaataaatgaagaaacgtttacaacactttatgatcaagctatcaatcaaatggatttacaaggtttacaagataaagtattaagtcgagtagaaaatacgatggaacaatctggagaaacatataagatcgtaaagaaagtatatagctttaaaaattctacacatattattgtgagtgctattttattagttatttctacagcttatcttatttttatttcagttcaagagagattgattacaaaatgtttatcagtaagttatatggtttgtggaattatgacattcttgatttcttttgcgataattttaggattaacagcaatggcatcttctacaatgaccattcaattaacttctattaaatatatgtatatatgtggagctagttatttctttgtaggtattattttattaattgtaaatgcttttttaaaaaagaaaaatcattatcattattattactagtataaaaagaaggggtatttatggatagattagatgcaaaggctataaagacgtataaagaaattatacttattttagatcaatgtattgatgattatttatttgtgatggatattgatcgagataattattttatttccccacatgctatgaaaagatttaatataccaagctatgagtttagtgattctttaccagcacataaaaaatttgtatataaagatgatttagaaatgttattatctgatatgaataaaatggtttcaggtaaaaagagttttcataatttacaatatcgttggattggaaaagacggtattcctatttggatcaactgtcgaagtaaatcgattaaggatcgtgatgggaatgttaaatatattattggctgtattaatgaaattggaaaaagacaagttgcggataatgatagtggtttgttaggtgaaatgagttttaagaatttgatttatccaattcatgaagatattaatcaaggttttattttaagaattgatattgatgattttaaaaatattaatgaaaatttcggtgtaaaatatggagatgttgctttaaaacaagttggaaattgtattaaaaagttattaactaaaaatcaacaactttataggattgtcgctgatgagtttattgtgatggatgttgttggcagtaaagaagatgcaagagatctttataaagcaatacgtagaagtattacacgttatgtagaatctattaattatgatatttatttaacgatttctgcaggtattctagattttcatgattatcctaataaaagttataattctattatgcaatggacagaatttgctttaaatcaatcgaaaataaatggaaaaaatacatatacgatttttaagcaggaagcttatcaagagtttttaagaaaaaataaattaacaaaagaattacataaagcagttaaccaacaatttaaaggatttgaagtttattttcagccaattattgatatgaaaacagaaaagattcatagtatggaagcattgcttagatttgaatgtgatgaatttggtaaaatttcaccactagaatttattccattattagaggaaagtgatttgattattcctgtaggtagatgggttttagatcaatcattaaaagctgtaagtatgttttcaaatattaaagtacaaattaatatgtcttatgttcaagtgttaaaaacaccagcattaaatgatattttaaatattataaaaaattataaaatagaaaataatcaattggttatagaacttacagaaagtggttttattgaatctaataaaaactttattgatttttgtaatggtttaaagaaagaaaatatcttacttgctttagatgattttggaacaggatattctaatttccactatctttataatttaaaaccagattatataaaaatagatcgaacattgatgaaaaatgcactttcaaatgagtatgaaaatatgttgctaaaacatatggtggatatggctcatagcgtaggtgttaagatttgtattgaaggaatagaagaaaaggaagaacttgaacgtattatgttattaaagccagattatattcaaggattctattatggtaggccggtttctttaagtgtgtttatggaaagctatgaaatataaaacgaataagtatgtgacttattcgttttttaatgtttctaacattcgtttgattttacttaaacagttttgtttatattctaaatgataaggttgaatgatttttttgaatgtttgaagtccttgatcataatcttccacttcaaattctatttcataatcatgatgatggttatattcattttcatctaaggataaaacaccatcgggtaaaataatatcatgacgtgttgtttttaaataatatccacatgttaaatctttgatataaatattttctttttctaaaatatcaaagatttcattattgatatgttgatgattaaaaatagcatctttaatttctttattaatatctatatttaattcattcagaccaatagttgaaggtcttttcaatgtgagttcgtaatgaccttttttttctctaattctgagtgagtattttttcttttccaatagaggatgaaaaagataataattggtttgttgataactgtctttgatttgatttttataatcagataatatttttttaaatatattttcttttaataacattttaaattcaatttctagatgttccatatgatacctctttgcttaaatgctctagatatattataatacatctatacggagggaagaaagatgaaatatgcattaatggttagaaatgatgatctttctaaaaaaacagctttgaaaattaaagaaagtttacaaaacttttttatttatgatgaaaaaaatccagatcttgttatttcaattggaggagatggaactattttagaagctgtacatcaatatttaaatgttgattgttgttttgtaggtatacatacaggaactttaggattttatacagattaccaaattgatgaagtggatcaatttataaaagatgtgacttctagacaatttaagacgatgaaaagatatatgttagaaattaaaattaataaaaaagactcttttcaaacatattatgctttaaatgaattaagattagatcaagggttacaagcacaggttattcatgtgtatattggtaatgttttattagaagtttttagagggaatggtttatgtgtttcaactccttctggatcgactgcttataataaatctttaggtggttctatcatttatccaggtattcctttgatgcaacttacagaagttgcaggaattcatcataatgcatatcgttctttaggttcaagtttgattttagatgaaagtcaaacgattaaattagttggaaattattttaatcattctttgattggaatcgatcatattcatttagaattagaggatgttgaaagtattgagattacgattgggcgtaagtatgttcgttttattgaatataaagaaatgtcttttattaaaagagttagaagggcatttattaattcatgagttatcaaattgaacaaacgattttattaagagattatttgaaagaattaccaattagtcaagcaatgattaaaaggattaaaagggaaggtgatttcttagtcaatggaaaaagtcaaacagtaagatgtttacttcaaaaaggagactgtttagaaattatttttccaatagaaaactcaaatattcaaccagaaaatattcctttaaaaatcatttatgaagatgactattatataatcattgataaagaaagccaaatgccttgtattcctactaaaagatatcaaagccatactttatgtcatgcattaatgtattactatcaacaaattggtttaaaaagtacaattcatttagtaaatcgtttagataaagaaacatcaggatatatgttggttgctaaaacatcacaagctcatgcattgctttctaaagatattaaacaagtagaacgtgtttatcattgtttagttgaaggaattttagaaggggaaggcgttattgatcgacctattttaaaaagtaatgattctattaaaagaattgttgatgatcatggtaagtatgctaagacgtattataaatctttaatgcataaaaaaaatcaaacacttgtagaatgcaaattagtaacgggaagaacccatcaaattagagtacatatggcttctattggtcaccctttagtgggagatcttctttatgggtcaaatgaagattacttattttatttggatagtgttgaaattagttttattcatccttttacccatcagaaaatacattataaaaaggagagttaatctccaaatggcatgaacttaagatataatcttaggttcatgtctttttatttttatcctttttttataatagtatctaatatttctttttgtgtagtataggatggtgatgttatgtttgtaaaagttgtaaaaaataatagaggtcgtccaaatacctcttttatcgcaattgttgaatcttatcgtgaagatgggtaaatggaggtaatgtttgaaagtgttctttatcgtagtcatagcccattaaatgacaagttccttcattccaccaaatagaaaggacatttccattttcatcacattccatagaccatctagcttcatctaatgaaccatagacagcatctgcactattttcattggtaaacatccaaatagtaagatctttatctttaggatcttatgagtagggttcactagatattttaatgagtgtgccatcttttttctgtatttttgttcaatgtttttatctttagaaagtttttcgataatagtgttgtaattaataaattgagcaacattttgttgattgttttcgctaatatatagattattataaagtttcattgttacagaaaaacaattatgttgttcttttccaagttttaaaaaataggaaggacctataatatcacggaagatatcttttttaagtcaacgacataaacgcccatatatttaggggcaattaattttaaaaattgttggttatcttttttatcttgaagtattttattgattttaattgaaaaacgattttgttgatgaagatccatctcttttttttgtcatactaatctccgtttcttaatacaattcgatttattttaaaataattaacatacttgcacaaaaaaagctgtactttgtgttacagctttaatctatttgattatatttagcgatacttgtttggcgatggatatcaaaacacattccaatcgcaatcatgtaagataaaagtgaagacccaccatatgaaagaaacggtaatgtgataccagtgatagggagtattcctaaaatcatagcgatgttccaaaattgttggaaaatcatacatccaaaaataccagcaataaaatatttatcgctttggtgcgttgcttttaaaccaacatacaaaatacaaacatctaacgcgagtatagcaatgagcgtaatgatggctcccacgaatccaaagcctaaagtaataacagaaaagatgaagtccgtatgagcttcttgtaaagaaataatcactgtgtcaaatccatgaccaaaaagcccagctgttccataagccatcatcgcattataaagttggtatccttgattttgataagttccttcaggatcgacccagccataaaaacgatcaagtttatgtcctgtgataattgaagaaaatatatcttgacgataaataaataagtaagtaaaaatcacaagaacaactgctaaacaagcaaatcctacaatataccatttcttattaattcctgatgcaaataaaataacaaccactgaaaaagccataatcaaagtaacaccagcatcattttgtaaataagttagaatcattggtggtagagaaatagctgctacacgaccaattaactgtaaatcggtatcaaatgtatgaattaaatatttttcattatgtaaagaaacagttttagacatacatataatcattacaactttcataaattcagaaggttggaatgaaaatcctggaaagttataccatgatgtggcaccatttagatcttttgcaaagggaatgatatgcattcctaatttataaatagcaaatctttgaataacaagaccgactaaaaagacaatcaagattccataaaaaatccacattcccgaataaattcgatcatttccaaaacgattgattaaaaaaatcaaaccgacaccaatcatataataaaggagttgtttactccaatagcctgtaggattgggataagtaatataaccagctgcacatttaattgtataacaactaataagacatagaataaataaaatgatggcaagtggccaacaaattgtagaatctaaatattttttcattttgtcacccctagtgatttatagtatactataaatatatcataaaagaaaatgtttattaagaaaggaaatagatatgtcagattattttatttatgttttaattgcaattattgtaattgttggagtatggtttatttttgcaaaggtattaaaaaataaaaaacctaaagaagttactttaaaagatattcctattgatttagaagctttaatccatgctttagggggtattgataatattaaagagagccaaaatcaaggaagtaaagtacgtttctttgtagaaaatgatgatttagtaaaagtaaatgttttaaaagaattaggtgcaagtggtgttattcaagctacaggcaaagttactgttattttaggaaagttctctgatgaaatcagtagaatagtaaatgaaaagaaataacgttccaagttgtattgggggtgaaggtatgaaagaaagaattcacttatatgaacctttttttcatcattattatattgatgaaattctaaatgattatgaattagaaactttaattcgtgtaaaaaaagatgattatcaacaatcaattgcctatattaaattaatttctatttattcacatcatgcaagtattgatgaattacaacaacaagtagattccattcaaatgatgatggaaacttatgaagattatcatgaatttgaacaatatttgatagaaaatgaagaacatcaagtgataggaattgatttatgtgcacttacttataatcatcattatgatgaattagatttagaagaattaacacctgatcaatattatcaagtaggattatattattatgaccaaaaaaaatatgatcaagcattagaatgtttccatttaggagaagaatgtgaagattctgattgtttatgtgtgttaggttatatgtatgaaaaaggacaaggggtcaaacaaagtaatcaaatggccatgacatattatcgtctagcaagtgatttaggaaatgttgttgcttcttgtaatcttgcttatttttatgaatatgggatagatgttgaccaagattatgaaaaagcttttgaactttattctttaggagtcgatgaaggatttccaagatctttattttcaacggcttattttttacaaaatgggtatggtgtaattcaggatctagaagaagcttttttacgttatgaagaagcagcagccttaggacataatgatgcgatttgtgctctaggtgaatgttatgaatatggtcaaggaacaagacaggattatcaaagagctttacattattatgaaaaagctgcttatgaagggaatagtcttgctaaatataaattaggacgtttttatgatttgggttacggttgcaatgaaaattatcaaaaagcttttcattggtatcaagaagcagcaaaagatggtttagaagtagcaatcacagcgatggcaacctgttatgaatttggtagagggatagaaaaagatagtcaaaaagctttagaatattatttaaaagcagcgaatatgggctatatgaatgcgcaattttgtttagggtatttttatgaaatgcatagtgaatatccagaaagtgaaaaaaatagtttttattggtatttaaaagcgagtcatcaaggagatggacaatcaacgttggctgtggcttattactatggtcaaggaattggaactgttaaagatgaaaagaagtcttttgaagcttatcaaaaagcagccaatcttggagaaagagaagcgttttattatttaggtgtttgttatttagaaggaaagggtgttttacaggataaggaaaaaggaattgctggcttaattaaaatagaagatcagtatcctgttgcagcttatttaataggacagtattttaaagaaaaacacgatgatcaacaagcaattcaacattttaaattagcaattttaaaagaagatgaggaacagtctttgtatcaattagcactttatggtgaacaaggaatagaagtcagtaaagaggaaatgcttgattatcttttaagaagtgcaaaaaaaggttattcaccagcacttgtaaaatatgcttattatttagaaaatggaatttatgtagaaaaagattatcagatggcttatgaatattatttattagcttgtcaaaaacaaaatagagaaggtttttatcatttaggtagatggttcttttatgggataggacaaaaagaagataagcataaagcaatgcaatattatcaacaagctagtcattatcattattcaaaagcaagctttatgctaggttatatgtatcattatggtgatggtatttctaaagatttagaaaaagctaaagaatattatcaattagcacttcaagaaggatatcttgaagcgcaaaaggaattagataaattagaggtggaaaaatgagttttgaaacaaaattagaaaaatatgcaagattaattgttcaatcaggtttgaatgttcaagaaaaacaaaccgttgtcattagtgcatctattgaaagttatcaacttgtaagagaggttactaaacaagcttatcttgtaggtgctaaagaagttgttgttcattatagtgatgaagaagtcacacgtatgaaatatgaaaatatggaagtagaagattttaatcacgtacctacttggttttcatcttttagaaatgattatgcgttaatgaatgcttgttttctttatgttgatgatgaagatcctgaaatgcttgcaggtattgaacctaaaaagatttctaattggcaaagagcagttaaaaaggcatgtaagacatattttgatttatccgataatatgacaaatgcttggtgtatcgtaggtggagctacgcaaaaatgggcgaataaagtttatcctgatatgtcaaatcaagaagcgttagatagtttatggaatgctatttttaaagcagctaagattgatgatgaacatgatcctgtcgaattatggaatcaacatcgtcgttcttttgaaaaacgtgttaattatttaaatagtctaaatttaaagaaactttattataaaaatagtaaagggactgaaattacaattggtttgaatgatgattatttatttgctggtgggggaagttatttaaaaaatggtgtttacaattttcctaatataccaacagaagaaatctttacatcacctaataaggatgatgtagaaggaattgtttttagttctttacctttaagttatggtggaaatattgttgatgaattttatttacgttttaaagatggtcaagtgattgattttggagctaaagaaggatatgaggttttaaaaggaattattgatagtgatgaaggaagtaaacatttaggtgaagttgctttaattccttatcattcaccaattaatgaattaaaaacattattttataatactttatatgatgaaaatgcttcatgtcatatggctttaggtattggattttctgaatgcattaaaggtgggattgatatggataaaaaagaattgtttgaaaaaggggtcaatgattctttagttcatgttgattttatgatgggaacagaagatttaatgattgatggtattttagaagatggcagtcatgtaaaaatctttgaaaatggaaattttgtattttaatgatctgtggggattgctccccactttttaattagtaaaaaaagatttctattatatattatttgacactccccatgtctaaagacaggggattcttgctacctgccaacattgtttgccgccctgtcacggcggaggtcgcgggttcgagtcccgtccagaccgccaaataaaaaataaactgcttatacagcagtttttattttatatatttatcattgtatgctttcataatagcgatgattgttttagaatcatggatttcattattcgtgatttttttataggcttcatctattggcatagagataacgtctataaattcatcttcatctccttcaaggggattttcaactttaaatagaccttttgcttcatataaatgaataacttcatcacaatatcctgttgttggatatatttcattaataagttccatggatttacaactataaccagtttcttcttccaattctcttttaccggcaggtccagcttcttcacctaattctaatttaccagcaggaatttctaaagtatctttattgtaggcatatctaaattgtttgacgagcaagatacaatcatcgacgactgctaaaatacctacaccgccatgatgtcttacgatttctcttgttgcgagccttttgttaggacattctacctgatctttatagactttgatgatttttccatcgtagattatttcacttttaacttttttttccatcttttttacctcgtttatattttataattctattatacgttattttgaaatgaataaaataaaaaaagtatgcgggggtgcatactttttttcatctattatttacgtaaggatgataatagggggtatgttagagtgaatgcgtttcacttaacaaatatattataacatgtttattttaaatgtaaagggtttcataaaaataaaagctaactttagcttagtctatgttataatgacgttggtgatagaaatgaaaaaaatagtaattaaagaaaacgatgcaaatcaaagaatcgataaatatttaaaaaaattattatgtaatgcacctagtaattttatatataagatgtttagaaaaaaagatattaaaattaatggtaaaaaagtaaatgaaaaatatattctacaaaaagatgatattttagaaatgttcctttatgatgataaatttaatgaatttacaaaagaaaaagatatttatgatttaaaaagagaatttaaagtattatatgaagatcaaaatattttaattgttgataaaccagtaggtttattagttcatggggatgctaaagaaaatgtaaatacgctttctcatcaagttttaagttatttaaaagaaaaaggtgaattggatgtaggcagagagagtacgtttactccaggaccagtccatcgtttagatcgtaatacaagtgggatcgttatttttggaaagactttagctgctttacaggatttaaatgaaatgatgaaaaaacgacatcatattgaaaaatcatatatgacgatttgtaaaggaaagcttactaaacaacaagaactcgtaggatatgttaaaaagatagataatgaagatcgtgtacgttttgttaaaaaagatgataaagatgctctaatgatgaaaacaattgtaaagccaataagaactacaaatgatttttctttagttgaagttaaaattattacaggaagaatgcatcaaataagaatacatttatcaagtattgatcatccggttataggtgatcgtaaatatggtgattttgctttaaataaacaaatgaaacaacaatttggattaaataatcaacttttacatgcctataaaattaattttgttgatccgtttggttcacttagttatctaaaaggaaaaataattatttgtcctaagccaacacaatttaaaaaaattgaaaaaagtttatttgaaagcgttctctaaatacatattttattgtataatttagttatagttttaggaggaaatagaatgaaatattatatcggtatcgatttaggtggaacaaatgtaagaacactattagtagatgaaaatggtgaatcttatagtgaagttaaaggacctactgaatgtgaaaatggtccggattatgtatgtgataagataataaaacaaatcgaagcattagatacatctgtatgtggtggtttgcaaggtgttgaaggtattggaattggtgctccagggccagtagatacagaacttggtatcatgattatggcaagtaacttaccaggatttgaaaactatccaatttgtcataaattaaaagaaaaatttggattaccaacttttattgataatgatgccaatgttgcaggtttagcggaagctgtattaggtgcaggaaaagattataaaacaaattattttattacttgttcaactggtgttggtggagcatttgttgttgataaaaaattagtatctggtggtagaggtcacgctggtgaaattggaaacatgattcttgtaccaggtggttataaacaaggtgctttaaatccaggagctgttgaaggagaaatttctggtactgctcttacaagaaaaggtaaagaagctaaaggcgatttagtaaaacatgcaggtgatgttttcaaattagccgctgaaggagatgaagcttgtcaaaaaattgctgaagaatttattgatggtttctctacattacttgctaatgttgctcatactgtagatccacattgttttgtattaggtggaggagttttcaaatctaaagcttatttctgggatgaacttgaaaaaagatttaatagtaaaattcatgtaggtatgagaaatcatattcctctattatttaaagaaattgatgattgtggtgcaatcggtgctgccatgttaccaatgtctcaattagattaataagaaatagcccctttaaggggctattattgtgtcttattgttttactttaattttgtttttgatataatacacgagaaggaggacgattatgaaaaaaagagtcgttttaggattaagtggaggtgttgactctgctgtagcagcttatttacttaaacaacaaggatatgaagttattggcgtatttatgcgaaactgggatagccaattaaataatgatattttaggtaatcccacaaatgataacgatatttgtcctcaagaacaagattataatgatgctaaagcagtagctaaacatcttggaatagaaattagaagagtcgattttattaaagaatattgggataaagtttttacgtattttattgatgaatatgctaaaggaagaacaccaaatcctgatattttatgtaacaaacatattaaattcaaagcgtttttagaatatgctgaagaacttaatgcagattttatcgcaacaggacattatgcgcgtgttgaacatcatgaaggtaaagattcagtgatgttaaaagggattgatcaaaataaagatcaaacatactttttatgtcaacttaatcaaaaacaattacaagcttctttatttcctttaggaaatattacaaaacaagaagttagaaaaattgctgaagaattagatttaccggtagctcataaaaaagatagtacaggaatttgttttattggagaaagagactttaaacaattcttacaaaattatattccagcaaaacctggaaagatggttgatattcaaactggtaaagtgattggtgatcatattggaattatgtactatacgattggtcaaagaaaaggtttaggtattggtggttcaggtgatgcttggtttgttgttgggaaaaactatgatcaaaatattttatatatttgtcaaggtgaccaaaatgattggttaatgtctacaggtgctttaattacagatgttaactggataccaagtattaaacctcaagaagctattaaatgtaatacaaagtttagatatcgtcaaaaagataatccagtaactcttacttttattgatgaaaatactgtaaaattagaatttgatcaacctgttaaatctgtaactccaggacaagcagctgttttctatgatggagatgtttgtttaggtggaggaacgattgaaaaagtctataaagacggaaaagagattgaatatctataatgttaaaatatacaggatatattagaaagattcgctattatagcgaatcttctcattatatagttgcattattagaagtagaggaagatcaggaacttttgacaatgaatggttatatgtcaaattttaatgattatgataaatatgctttttatggtgattttgaaattcatcctaaatatggtcaacaatttaagttggatcattatgaaatagttttaagtacagatgaagaagaaattattaaatatttatcaagtcccttatttaagggaattggtcctacacaagcaaaatacattgttgatgcattaggagaaaatgcactttctttaatcaaagaagataaacatcatttagatttagttaaaggaatgacagtggctaaaagagaacttatttatgaagtattgacttctaatgattatgatcaagaagtcacacaattctttatgggacatggtatttctttaaggcatattggtattattcaagaaacttataaagaaaaaacattagaaatcttacaaaatcatccatatcaattagtagaagacattgatggtattggttttaaaacagcagatgaacttgctttaaaaacaggaggaactttaaataatccggatcgtttaaaagcaggagttatttatagtattaaacaaagttgtttttcatcaggaagtacatatgtactttatgatgaaataaaaaaagcttttcataaaattatttatcatattgatgatgaggtttttgatgaatatctcaatactttagtagaagaaggaagagtcatcaaagaaggagaatattattatgatgaagagctttatgaaagtgaagaaatcatagcaaattttttacacaaaataaatgaatatccagaagaattttatgatgaaaatgaattagaaagactgcttgataactatcaggataaatttggtattgtctattcaacaaaacaaaaagaagcaatcgaatactttttaaaatatccaatgatgattttaaccggaggaccaggaacggggaaaacaacggttgttaaagcactgattcaaatctatcgaacactttatccagaagatgcaatttctctggtagcacctacaggaagagcagcgaaaagattaagtgaattaacaggtttggatgcttgtacgattcatcgagaacttaaatgggatttacataaaaattcatttgcgatgaatcgaaataatcctttaagtagtcaagttttaattattgatgagttttcgatggttgatagcttacttttatctaaattgtttgatgcaagcagacgtgttcataaagtgttgtttattggtgattatcatcaacttccttcagtagcaccaggaaatgttttaaaagattttattgaaagtcaattaaaagttattgaattggatgagatttatcgtcaatcaaaagattcaggaattgtgcaattggcacatcaattaattcatcaagaagtgaatgatttatcgttgtttgaacaatataaagatattcatttttataatagtaccaattttgaaattattaaaaatgtgacaacaattgtaaaaaaagcaataaaaaatggctatgatcaaaatgatatacaagttttagcaccaatttatcaaggcgttgcaggaatcaatgctttaaatttggctttacaggaaatttttaatcctaagaatcatcaagaagaatatcgtattggacagaaagtttatcgagaaggagataaaatcttacaattaaaaaatagaccagatgatgatatttataatggagatattggtgttttagttgaaattaatcgtaaagatggttttgaatatttagaagatacgcttattgttgattatgatggtaatttagtcgaatatacatcaaaagattttatgacttttacattagcttattgtatgtcaattcataaagctcaaggaaatgagtttaaaattgttattatgcctgttttaaatgattattatattatgcttaaaagaaatttgatttatacaggtctaacaagagctaaacaagctttatttattttaggtaatccacaagcttttctttatggtataaaaaatatttctgatagtaaaagaaaaacaacattagtaagtaaaatcaatcaaaataaaaatggtgaaacatatgaagaatcttcatataatcaagaacttaaacaaaatattacagattttttaaatgatgatgaaactgtataattttgtaaaataaagacatactcaaatagaggtgataaaatgaaacgcaataatattattatggcattaactcttacatcattagcacttctatttagtgaaactgaatgtggttgccatgttatggaaacaattaaagaaaaaatgtaagatattgaaatacttttgtatttcgtgtataatgcaaataaatcgttgaaaaagatcagtactatatagaatattttagagagaacatggtgggtgaaaatgtttataggatatataggaaagctactttggagagtaattaatgattaccgtagaactgcgttaaagtttaattaagggcatgtatttttacatgaactaggatggtaccgcgataaagtcgttcctagataaggacgactttttatattgtcaaaaaaggagaaaagaaatgaaacaattaaccggaaatcaagttagacaaatgttcttggattatttcaaatctaaaggacatatgatcgaaccaggtgcatcacttattcctcataacgatccaactttattatggatcaatgcaggggttgctgcactaaaaaaatattttgatggtagtgaaaaaccagcatgtaatcgtattgcaaatgcacaaaaatcaattcgtacaaacgatattgaaaatgttggtaaaacagcaagacatcatactttctttgaaatgttaggaaacttctcaattggagattatttcaaagaagaagcgattccatttgcttgggaatttttaacaagtccagaatggattggttttgataaagaaaaattatatgttactgtttatacagatgatgaagatgcttatcgtatttggacagaagtatgtcatgtagatccaagtcatattttaaaaacatacgaaaacttctgggaaattggagaaggtccaggtggtcctgactcagaaattttctatgaccgtggagaaaaatatgatcctgaaggtttaggagaaaaattattcttcgaagaaatggaaaatgatcgttatattgaagtatggaacgttgttttctctcaatatgattgtaatccagcgattgatcgtaaagaatataaagaacttccacaaaaaaatattgatactggtatgggacttgaaagattagtaagtattattcaaggtggagaaacaaactttgatactgatttattcttaccaattattcatgctactgaaaaattagccaatgtttcttatgaagaaaataaaatggcttatcgtgttattgctgaccatattcgtactgtaacttttgctttagctgatggagcaatgtttgacaatgctggtagagggtatgttttaagacgtattttaagacgtgctgttcgttatggtaaacaaattggtattgaaaaagcatttatgtatgatttagtaccattagtttgtgatatgatgaaagatttctatgattatttaccagaaaaacaagattttatttcaacaatggttaaaaaagaagaagaagctttccataaaacattattaaatggtgaaaaattattaaaatcattaattgataaaaatgaaaatggagaaatcagtggaaaagatgctttcaaactttatgatacatatggtttcccatttgaattaacattagaaattgctgaagaatcaaatttaacagttaatgaagaagaatttaaagaagaattaaaaattcaacaagaaagatctcgtgcatcacgtgataacaatgaatcaatggcaagtcaaaaacctgatttaatggcttttgttgaaccttctacatttgtttatgatcttacatcagtccaaggaaaagttattggattattcaaagatggtgttaaaacagatgaaatcactgataaaggagaagttatctttgatacaactccattctacgcagaaatgggtggacaatgtggtgatactggatcattagataatgagacaacacatgcaaatgttgttaatactttaaatgcgccaaataaacaacatatgcattttgttgcagtaaaagaaggagctattcatttaggtgatacttttacattatcaattgatcaacaaaaacgtcgtcaaattacagcaaaccatagtgcaacacatattttacaaaaagctttacaagaaactttaggtgatcatatcagccaagcaggttcttatgttgatgataaagttttaagatttgactttactcattttgaaaaaatttctgctgaattattaaaagaaattgaagaaaaagttaatcaaattgtttttgaaggacgtcctgttgttattaaaaatatgacaaaagaagaagctttagcatcaggggcaatggctttatttgatgaaaaatacggagatgttgttcgtgttgtcaacattggagattactctattgaattatgtggtggttgccatgtttcaaacagttctgaaattggtttatttaaaatcgtgagtgaagaatctgtaggtagtggaattagacgtattgtggcacaaagcggtttagctgcttataatgcaatggttcatgaaaaagaaacagtagatacaattgcttcaacattaaatcttaaaaatagaaaagatgttgtaaacaaagtagaagcattaaaagaagacttaaaagaagcaaaagcagaaattgaacaattatcagctaaattaaatgcaattcaagctgcatcaaaagcaaatgatattgaagagatcaatggagttaaagttctttatgttgaagaacaattagaaaatgccaaagcaaaacaattaacatttgattttagagatcaattagaaagtggaatcgttgttttagtttcaaaatatgaagaaaaatgttcatactttgtttctgtgtcaaaagatttagttggtcaatataaagcaggaaatatcattaaagcaatcaatgaagttgttgacggtcgtggtggtggaaaacctgactttgctcaaggtggatgtgctatcaatgataatatttctaaaatcaaaggtgctttaaaaaatattttgtaatttaatacagtataaggtataatatatattatagaaaagagggtgagttagatggaagatttaacaaaaacaagagtatttagttcagaagatatgcgtagagaaatgatacgcagtaatcttaaaacagttatcaatgctttaaatgaaagaggatacaatgctgtacatcaaatcgcgggttatctcatatctaatgatcctgcatatatctcttctcataaaaatgcaagaaatattattcaacaagttgaaagagatgaaattattgaagaattagtaaaatcttatttggagaaagaataatgaaaaaagtattaggtcttgatttagggtctagaacttgtggtattgccatgtcagacattctaggaatgattgctcatggtgttgaaacgtttcgttttaaacctgatgattatttaacatgtgcaaaacatgttaaagaaattgttgaagaaaatgagattgaaacgattgttttaggtttaccaaaacatatgaatggtgatattggtgaaagaggacaaatttcaattgaatttaaaaaacaattagaagaaatgattgaaggaatcaatgtgattttagttgacgagagattaacaacggtagttgctgaaaatcaacttctttttgcggatgtatcaagaaagaaaagaaaacaggtaattgataaaatggcggcagttgctattttacaaggttacttagatagaggataagttatggatgaaaatacaattgttgtaactgatgaattaggaaacgaagtagagtatgaaattttatttacatttgaaaatgaagaaaatggacatcaatatgttgtttacttcgatccagaaaaagatgaaccagaagcacaagcagcaatctttgatgatgaaggtggactatttccaattgaaactcctgaagaatgggaattagttgaagaagttttccaatcatttgtttcagaagaagatgaagatgaaactgaatattgtgaaggagaagatgaagattgtaattcataaaagctaatgaaaattagctttttccttttttagacatgaacagttcatggaaggaaattagaataatcaatgaggtgaaagaaatggcatttaatttatttggaggaaaaagaagaattacgaaaggtttttttgctaattctttaggaaataaacaaacaagaggagtctatacatttcaaatcgatgtggaaaatggagagttgatatttaaaaaatattttgtaacaccaacggatccagtttatgcattcaattatggacgtttttcatgtattacttatagaaatagaacgggttctgtagatgatggaggaatttgttcttatgcagcaactgctgaaacattagcacttgcttcacgtgtgacagataaaggaaagacatatgtgcatgcttgtgcaaatggtgatgtagaaactgctgataaagtattctgtgtcgattattttaatagtgaaatttcggtaatttctgttgttaagaaaaaacttgtaaaatgtatttctcattttaagttgaatggaagtggaaaagatcctgttaaacaagcacaaccatatcctacatatgtgggctttttaccagatgaagataaactttatgttgtttgtttaggattagatcaagtatgtttctttgatgttggtgaagatggaacattaacattagataatgtacatacattacaattagaaccaggttgtggtcctaaaaaaatgatttttaatcaaaaaggtgatcgtgcttatgtaatgaatgaattaaacagcacaatttgtatttataaatatgatcatttaaactttgaattaattcaaacaatcgatagttatccaaaagatgatgatcctgaacttgtaagttctttaagtgatattaagtttaatagtgatgatagtcatttatatgcaattaataaaggacatgattctcttgtgttgttcgaagtcaatgaagatggaactcttacatatattgactttgaagatacttcttatgatccagtagatatgcttgtttataatgaggaaggaaatgaatggatcgttgtggcttgtcaaaaaggtggaattgttgaatcttatcgttttggtaaggaaaaaggcggacaagtttatgaaactgaatatagctgtatggtaaatgagcctgtttgcttaacaccatttattaataatttctaaggcaatttatttgccttttttctttggttgaatatcgacaaaaaataacatataatgatacaaggtgaggactcaacatggaaaaaaagaaattgaatattaaagttaaaatagcagtaggcattattatttttattgttgctttgtttattggaagttttgtatattataagcaaggaatcaaggctacatcttccaaaaataaggaagtgatcgtcactattcctaaaggtagtagtggaaatgatattattaaaatattagataaaaataaacttataaaaagttctacatgtgccaaaatatatttaaaaatgaatcaacatgattttaaaagtaatgtttatattttaaataaaaaaatggatttaaaaacaatttttaaagcaattgaaggaaaagataaaaaatatatttctaatactaaaataacagttttagatggacaaacaattcctgaatacgcttctattatttctaaacaaacaggaatagaatataatgagatcattcaaaaatggacagatcaaacatatcttcaaaagttaattaaaaaatattggtttttaacagatgatattttaagtgatggtatttattatccattggaaggatatttagcaccagaaacttattttctaacacaagaagatacgattgaaagtattacaaaaatgatgttagatcaaacacaaaaacatctagaaaaatataaaacacaaatattagattttaaagtgaactcacaaccattaacagttcaccaatttatgacattatcatctattgttcaaagagaatcaccagtcaatgacgaagataggcaacttgtttgtggtgttttaattaatcgtttaaataaacaaatgccattacaatgtgatgtcactgttaattatggaaatcaagaagttaaaattgatgttaaacatactgatttaaataaagatacaaaatataatacatataaatataatggtttacctgttggccctattagttctatttcaacaggaattataaaaaatgttttaaattataaggaaagtgagtattattatttctttgcgacacaagatggaaaagttttatatgcgaaaacatatcaagaacatcaagtaaatgtaaatagtaataagtggtattaaaatgaagtattttgatgaaatagaaaaaagtgcaagagaaagaaatattccagtcatggaaaaagagggtttggaatttttaatacaaacatttaatgaacatcaatgtcatcgctgtcttgaaattggcagtgccattggttattcagcaatgatgatggtttcaaatatagatgattttgttgttgaaacaattgagttagatgatgcacgttatcttgaagctattcaaaacattaaagaacaacaattagaagatcaaatagaaatccaccatgatgatgcattaacatttgatatcaatgatttaaaataccaagaatttgattgtttatttattgatgcagcgaaagcgcaatatcaaaaattctttgaaaaatacatgcctttagttcaaaaaaatggaatttgcattgttgataatctagattttcatgggatgatttttgatattgaccatattaaaaatagaaatacaaaacaacttgttaaaaaaattaaaagatttaaagattggattttcaatcatgaagaatatcaagtcacttattatggcataggtgatggaatttgtgtaataaaaaggaagtgaaataagtgtcattaataattaatataaatagtttatcatatctttatgattatttggatttaggtgtccatgattttattgtaggaacaaatcaattttcatgtcgacaagctttaacagttgattatatagaattaaaagaaataaaggaaaaatatccaatgattcgtttatttgttttagttaatgcgttagttgaacaaaaatatttagatgatttaaagaatcatttagataaattaaatgaatgtcaaatagatgggattatttttcaagattttggagttttacaaatttgtaatgaaaaaggatattcatttgaaaaaatctatgatccagaaacattaaatacaaatcatctcacattatctgttttaaaagaacaaggaatagatggcgcttttctagcaagagaaatcccgctaaaagaaaaacaaatgattggacaaaattgtaaattaaaaacaatggttcaagtacatggggttgaatatatggcttattcaaaaagaaagttattgtctaattataaagagtatacacatcttgattttaatgtagataaagaggcacaaattgaaatcaaagccaatggtgtagaggaccattgtcatatttatgaagatcaatatggaacccacattacttcaactaatcaaatgtgtgcactagatgttcttaatcaattcaatgattttgattatttatatattgatggtcaatatataaatgaaacagatttattagaaattacacatctttatatacaagctatagaagcaattaaaaatcaaacatacaataaagaatcaatagagttgatgcaattactttatcgtttaacaccaaatgttcattattatcatagttttttatttgattcaactgtttataaaatttctgatgtaagaaagagagaagaaaatgagagaagttagtcaagttattaatggaaaaagagtcattgttaaaaagcctgaattattagcgccagcaggaaacttagaaaaactaaaagtggctatcctctatggtgcagatgcagtgtttattggtggtaaagagttttctttgcgttcaagtgcttctaatttttctttagatgatattaaagaagctgttgaatttgcgcatgcacatcatgcggcaattcatgtaacatgtaatattattttacatgaagataatttagaagggttagaagattatcttttaaagctagatgaaattggggttgatgccattattgtagcggatccttatatcatgtcactggcaaaaaaattaaacttaaaattagaagttcatgtttctacacaactttcaaccatgaataccagtgcgattcatttctatgaaaatttaggagttgatcgtgttgtttttgctagagaagtggattatcaagatttaaaagaagttagggaaaaagtggatattgatttagaatattttattcatggagctatgtgtatccattattcaggaagatgtatgttatctaattatttttcaagaagagatgccaatcgtggaggatgttcgcaatcatgccgttggtattatgatatttttgaaaagggtcaacaattgaatcatgatgaaattgtaccgtttagtatgtcaagtaaagatatgtcactcgttgatgaattgcctaagcttattgaattaggagttgattcttttaaaatcgaaggaagaatgaaatctcttcattatattgctactgttgtttcaacttaccgtaaattgattgatacttattgtgctgatccagatcactttaataaagaaggttatcgtaaggaaattgaaaaagcagcgaatcgtgctttatgtacaggattctttaaagattttccagacagccaatatcaactttataatcaaagagatgaacatccaacacaagatttctgtgcgcgcgttcttcattatgatgcttcaaaacaagaagcgatgattgaacaaagaaactattttaaagtgggagacacaattgaatttttctcaccacatcatgaaaatattttaattcaagtaaaagaaatatataatgaagatagagaagcagtagaagtagcaaatcatccaatggaaattctttatttaaaatgtgagcaaccattgtctgaatttgatatgggaaggaaggttttaacaaatgaaaaatagtattattattggtattgctggaggaagtgcttcgggtaaaacttctatttctagacaagtgtatgagttttttaaaggaagtcatacaacatgtatcattaaacaagatgattattataaagaccaaagtcatctttcttttgaagaaagagtgaaaacaaactacgatcatccttttgcttttgataatgatttacttgtagaacaattaaaacaattaaaagaaggaaaatcaatttctaaacctacatatgattatactcaacatacaagaagtgatgttgttgaaacaattacaccaagagatgtttatattttagaaggattatttgttctctatgatgaaaaaattagagatttatgcgacattcttgtctttgtagatacagatgctgatatacgttttatccgtcgtttaaaacgtgatattgaagaaagaggacgttctattgattcagtatgtaatcaatatttagaaacagtaagaccaatgcatgaacaattcgttgaaccttcaaaaaaatatgcacatatcattatccctgaagggggaaataatacagtagccatcgatcttttaattactaagatttcaagtgttattgatgctaaggagtaaaagatgtattgtacaaattgtggtcgaaaaattaaagatggagaacgttattgcccttattgtggagcgaaaacatttaatgaatatgaatttaatcaacaaagagtagattatgcaatttctagacgtagtattccaatgtgtattattttatcaattgttacgtttggaatttatggactttattggctttattgtcttgctagtgatgtcaatacacttactggagaagaagattcttcaggttttaaagtcttgattttaagtattattactttaggtttatatgaactttattggttgtataaagttggagagagattaagtgattttcaaacttatcaaggagaaatggtagatagttatcgtgctcttgtttatttgattttaggaatatttggattaaatattgtagcaagagcacttattcaaaatgatttgaataaatatgcttatgattcataaaaatagactagatatttagatataaatatgctatattattgattacgaggtgacttaaaatggataaagataaagtattacttacgaaatctggtgtagaaaaacttgaagaagaaagagataatttaattaatgttgaaagacctagagtcattgaagaattacaattagctcgttctcaaggtgacttatcagaaaacgctgattatgatgcagctagagataaacaagctcaaatcgaacaaagaattaaagaaattgaatatatgcttcaaaatgcagaaatcatttctgaagaacaaatggatttaaatgttgttaaacctgggacaacagttacaattttagatttatctttagatgatcctgaagaagaaaaatatacaattgtaggttctttcgaaactgatcctgttaatggtaagatttcaaatgaatcaccacttgctaaagcacttattggtcatggagttaatgaaatcgtgactgttggggttgctgaagcatatgatgtaaaaattgtagatattgaatttactgcataaaacaacaagttattgttgttttttctttatataataaagtaaataataaataataaaaacaaataaaggttttattaaaatttgaatatttatatcttttaaatgaaatataaattgaataattaaataagtcattgaaagggtcattccgtggatcaatggcttttcttttaccattttataaaaaataaaagtgaaaacaactaagataagataactaaaaaaagtaatcagtaattgataaataaaagatgaaacatgcataaaagaaaaaagaatagccataataaaactaatgattaaataacttacaaataaaaatgcataagataataaataaggcattaactttcttttcatagaaacctcctaatagagaatatgaaaaaaaagagtaagtagaacggagaacatatgtttaaaatatttatcattagtgtttttatgtatatctatctaacagttttacttaggctttttggaaaaaaagaatttagtcaactcaatgtttttgattttgttgtttttttagtgatttctgaaatcacgacaatgtctttagaaacacaagatttgtctgttttagatagtgtgatagccacactgacactcattattttagatagaatagaatcttttattacgatgcgttcaaaaaaattgagagatttttttgaaggaagaccgtgttatatcatttatagaggaaagatacaatatcaaaatatgaaaaaattacgctatagtatagatgatttatgtcatcatttaagagtaagtgatatcgatagtgtttctaaagtggattttgctattctagaaacaaatggttctttatcggttattccaaaacaagaaagtcaaacacttttacctgatgcattgatcagtgatggctgtattaatcaagaagcacttcaaattttaaataaagatgaagcatggttgaaaaatgaattaaagaaaaaacacatttctcatatagaagatgtgctttattgtgttttagaaaaaaatggtctttatgtgataaaaaaataattatccaaacataatatctaacatcatcatgatcataaatcctaccataaaactcatcgtaccaacatctacttcttttaaggcatttgcttcaggaatcagttcttcgatacaaacaaacatcatcgctcctgctgcaaaacttaaagcaaaagggagaatactactaaaaagttgagcaaataaaaaccctaaaagtgcacttggaatttctacaagggcagaatattgaccatacatcattgctttaaaacgtgagataccactttcatgtaaaggcaaagaaatggctgtaccttcaggaaagttttggataccaataccaatagataaaataagggcaggaacaagattagttttaacgcttgcaatggcaattccaaccgctaaaccttcgggaatattgtgtaaggtcattgctagtaataaaagtttatttttagaaagagtatttgtaggaccttctttttgatgagaaataatatgttcatggggaagaaatttatcacatagtcttaaaaataagccaccgctaaaaaagacaagtggaatcaaaaaaagtaaaagtagatgatcttcaacttgttggattgctggaagaagcaaagaaaagaaagtggcagcaatcataataccagcagctaaacctaaagcaatactgacaagtttttgacttttacttttaacaaaataaacaaggcttgaacctaaaaaagtcatcaaccaattaaaaatagaaagtactaaagcaagtaaaaaaagttgtaaatttgataacataaaagacctccatagtatcctatgaaggtcttatcattttatctaggcttatctattaataaagtcatagtcactatcatcaatagttactaaaattgctttttcagttaatctttgttttttactatcataagtaggtaaaacagtataattaacacgaatatttctttctacttcttcatcgtaagcaaaatctgcttgtctaaagaagataggatcatgatcataaacagaaatattaccaaattgattttgttcattgtaataaacaactttacctgatttacgagtaactaaactatcaagatgtgacatgatcaaatcatacatttcatcataaagagtacttgaatctttatcttgatatttttcatcaatgacaaaatcacaatctttttgattttcattacataatgctttaataaatgaatgaacaactttgaccaataattcattaccactattttcaacagcttcatttaatctttgatataaaggaagttgttcaagggcataaccattttcaaagaattcataaagtaaataagcatttgcttcttttactttaccaacagtagcatttgttttatataaaacttcgtagaagttaactcctttaatacgattatgtaaagaaataaattctctattagcttcatcatattcttttaattctaataaagcacatcctctataatatttgatccattgtaaagcgttataatgccatttaagtggtgtagctaatgcttgatttgcacattctacacatgctttatattgttttgtttcaaataaagcacgtacttttaatctaaagtatctttctttgaaagattcaaattctctaccttcgttattaacaaaaggtttatcagataataatttaacatctaatttgttaagcattttaatcattaaatcataattgattggagtttgatttaatgcatatttaattgctctattaattgctggttcaacaggagaatatttttcttgtttacaaatacctaaaatatcttcaaggatatcaaagaataaactttctttttctttgattttttcatcatcaatattaataaacttattatataaagcatacccatattgattaatatatccttttaaagaaggagccatttgtaaaaatgtatttcctacttcaattgcatcatcatttctaccattgttttttaataatttaataaaatcatttgcttcaaattcattgaaagaagcagcatcttcattgaatttattgaaatatctttcaatactttttaattcgttttcgttcataaaattcacctcgtgcattattatatcatttatttatcatgaataacataaaatgtttttaaaaacattttttatatgctataataatgcagaaaattaagaggtgaaaaaatgagtaaacaagtgtttagtacagatttttacgggaaaaatctgacagtagaagtaggagaattagctaaacaagctaatggtagtgttttagtaagatatgatgatacagtcatcttatcaacagctgttgcaggaaaagaaccaaaaagtgtagatttctttccactaacagttacatatgaagaaaaattatattctgtaggtaaaattcctggaggatttctaaaaagagaaggacgtccaagtgaacatggaactttaactgcaagaatgattgatagaccaattcgtccattatttgcagacggatttagaaatgaagtacaagttgttaatactgttttatcagtagatcaacaagcttctccagaaatggcagcaatgttaggggcttctcttgcattatgtgtttctgatattcctttcaatggaccaattgctggtgttaatgttggtttaattgatggtgaatttaccatcaatgctggtcctgaagaaatggaaagaagtttaattaacttagaagtagcaggaacaaaagatgctatcaacatggttgaagcagatgctaaagaagttgatgaagatacaatgctaaatgctttaatgtttggacatgaagctattaaagaattaattgcttttgaagaaaaagttgttgaagcatgtggtaaagaaaaaattgaaattccattatttgaattagatgaagctttagttcaagaaattacagatttatgtaatgatgaaatggttgctgctgtatctattccaggaaaacttgaaagatatgcagccattgatgaaatcatggatcgtgtaactgcacaatatgatgaaaaagaatatgcagatgaagaaacaaaagaatctgtgatgaaacaagttggaattatcttacatgatttagaaaaaaatgaagtaagacgtttaattacggaagaaaaaattagaccagatggtcgtaaaattgatgaagtgcgtccattaaatgcacaagttgatttattaccaagagttcatggctctgctttatttacaagaggtgaaacacaagttttatctgtatgtacattaggagctatgggagaagttcaaaaaatcgatggtttaggattagaagatcaaaaacgtttcatgcatcattataacttcccaccatattcagttggtgaaacaggaagaatgggtgctcctggacgtcgtgaaattggacatggtgctttaggagaaagagctttagcgcaagttattccaagtgaaaaagacttcccatatacaatccgtgttgtttctgaagtcttagaatcaaatggttcaagttcacaagcttcaatctgtgcatcatcaatggcattaatggctgctggtgtaccaatttcaaatccagtttctggggttgcgatgggacttgttaaaaaaggtgacgattatacaatcttaacagatatccaaggtatggaagatcacttaggagatatggatttcaaagtagctggtactaaaaatggtatttgtgctttacaaatggatatcaaaattgatggtattacaaaagaaatcttacaagaagctttagcacaagcaaaagtaggacgtgctcaaatcatggattgtatgttaggagctattcctgcaccacgtgatcatttatctaaatacgcaccaaaaatgcatgttatgcatattgatccagaacaaattagagatgttattggacgtggtggagaaacaattaatgaaatcattgaaaaatcaaatgatgttaaaattgatatcgatcaagacggtacagtggttatctaccatagtgatcaagaagcaatcgacacagctgtttctttaattgaaagaattgttaaaaaagctgaagttggtgaaatctatgatggaacaatcgcacgtgtaaatgataactatgcattcgttactttatttgaaggtacagatggattcttacatatttctgattggtcttatgaaagaacaagcaaaatgcaagatgtatgtaaggtaggagatgtcatcaaagttaaggtaactaaagttgatgataaaggtaaagtaaatgtttctagaaaagctttacttccaaaaccagttaaaaaagaagaaaaaaatgaaaaaaatgaaaaataaaatcatacttgcaagtagttctccaagaaggaaagaacttttcgataaatatggaatagactacacagtagattttgtagaaacagaagaagtgttagacgaaagtttaacactttttaaaagactagaaaacattgctttacaaaaagctaaaccacttcaaataaaatatccaaacaatatcattgtctcagcagataccatggtaaccttccaagatgaaatgttaggaaaaccaaaagatcgagaagacgctaaaagaatgcttgagttgttatcgaataataaacaagttgttattacagcagtatgtatcattaaagatcaacaaatcacaacatttacagatgcaacaactgttacatttaaaaaattatctgatcaagaaattgaagattatcttgatacaaatgaatggcaaggcaaagcgggtgcttatgcaatccaaggggttgcttcaaagtttgtagaaaagattgatggagatttagaaaatgtcattgggatgccaatgtataaagtcattaaatatttagaagcttaacgagaaatcgttaagctttttctttacattgaaatagtaaagaatatttaaatagtttataataataccgaaagggtgatcaccgtgaaaaagataccaacaggaattaaaagttttagaaagcttagagaagaaaattattactttgtggataaaactttaatgattaaagatttcttagaaagaggttcagaagtgacattgataactcgtcctcgaagatttgggaaaactattaatatgtctatgatgtcagaattctttgatattaccaaagattctaaagaaatttttaaaggtacaaaaatcatggacacaccatatgctagtgaattaaatcaatatccaacaatctttatttcttttgcggatgcaaaagaaaataaagaaacaattgttaaatttataaaaaatcagtttcaattagaatattctagatataattatatttttaaagatatggatgaatatgaagaaaatgattatagaattatcaatgaaggaattaaaaataatcaaaatggaacattacaagatattgaaaaagcattgatttttttaatgcgtcgattaaaaaaatattatggaaaagatgttgtattatttattgatgaatatgatacaccatttatagaagcaaatacaggtaatttctatcaagaaattaaaggaagtctagcaaccttacttagaagttcgcttaaaaattcagatgatttaaaatatgcaatgctcacaggaatacaaagagtagctaaagaaaatatcttcagtgatttaaataatcttgttgtttgcgatgtaacagatcaacgctatgcttcttattttggttttacaaataatgaaacacaagaattattagaatattatggtctagagttaaatgatgaagttaaaaagatgtatgatggttatcatataggaaatcaagatatttacaatccctggtcgctattgaattatgcagatactcaaaagttgatttccttctgggtcaatactagtgccaatagtatgattaaaaatgctttaaaacaagcagattatacttttaaaaatcaatatgacaaactcatcaaagaaagcaaattagatacttatgtttcaatgcaaacaagcttctttgaagaagcaaataattcaactttatggggattgtttgtcaatgcgggctatttaacagttacaaaagaaataaatcttttaaaagggaaatatcgcatagaaattcctaatgaagaagttaaacaagaatttattaaattaacagaatatcaattgggattaagcagtggaacgctagatacagttaccgaaagtttagtcaatgaagatcaagaaacatttctagaaaactatcaagaaattttaatgataccaagttatcatgatttagaaaaagaaaacagttatcatatgatgatgcttggaatgtgtttatgtttaaataaagattatgaaattatttctaatagaaaagtaggaaaaggtagagatgatttaattttgaaagcaaaagatgaaaagagaacatcctttgtattagaatttaaatacttaaaagaagataaaaaagctcttgaagaagcattagatgaactatcaaataaagccatccaacaaatcaaagagaataaatacgattatggattaaaaggaaaagtcatctatataggtttagctcatcatggtaaaaatgtgagtgttaaatgggaaaacaaaatatagtcttataaagctcattttgtacgagcttttaatatcttattatatttttttgattccattaagaacaatcagtcattgtaattcattttttcacaagatttagacaagtataatttataataaatcttcaaggaggttgtgataatgaaaaagaaaatagatctttatttgatatatttatattatattttagaagtttgtctttatattggttatagattttggacaatttatggaggcacagaaaaaggaaatgcagtttatacttttttagtgattttggttaatttttattcaacagtatgtttactttatgtaattttacttgcttattatatgagaaagaaaaaactttcaattaatataaaaagaaacacaattttgttatcggtgattcttctttttgatttgttagtttatggttttgatcgaattttgacaatgttttcaaactttccacagttttatatgatctgtcttatgtgtgtagcacatgctataatttatataagagataaaaggaaacctttaaaaaatgaggaatagataaaaaaatataaaaatcattttttaatcaatttttttataaaaagcacgtaatatcaaggaattccacgcttcgtagacatattctctagatggaatgttgtatcttttaaagaaagtttttagtatgataggtgtaagggagttgtttatatggatagtaaaaaaattggaaaagtaattgcaaagagaagaaaagaaaaaggaatgactcaaggggaactggcagaaagattatctgtttctaataagacaatttctaaatgggaaaccggggtagggttacccgatatttcaattcttgttgatcttgcaagtgttcttgatataagtgttgatgatttattgaagggaaaagaaaataaagttcaaaatgctctatgtgagaaaaactttttaataaaaaagaagtattataaaaaatatttgagagatcatttttttgaaagtaaggcttattggctattcaattttataggaattatgtttatcttaggaggttttgcttttttaccacttcaacaatatactcatcattatgtagatattcttggtaaaagttttattgttttaggaattattctcatattatttccttttatgcaaattttttgtaaaagcaacttttttaaagaacatgaagtcttttatacattaaaagataatggaattatctatcaagaaaatgaagaagaaattttttatagttttctccaatttaaaagaatcaagtataaagattttatacttttaaagaaagatcaaaagattttattcattgatcttaatgatctagatcaattagaaaatgatataaaagaaacgaaaatcaagaagtgctcgtttttgatttctttgtttacaagtgttatagggtgttcgttattgatcttacaacttggctattttgcagtcttgaaaagatttgaatttgaatatattcattcaatgaatcaaattatatttaatctcattattttatgttgtctttttattaattattgtttaattaagaaaaagaatattaagattcaatatgttttaataggctgtttaggagttattattatttctatttttggacttcattcttttcaaaaaacagaagaaatctcatcattttcttcaaatttaaaaaatagagctgttttaaaatatgatgatgatcaacatcgcttggatatttaccattatacttatttatgctttgctagaaaaagtgatacagttgctacagaaataaatggttatcatggaaaatggcttacaaatgattgttatgtttttacttacagtaatgaagaaaatcaaagaaaagtgaatgtgtctacttttggtgatcgtggtaatggaatttcatattttaatatttttcctacattacaaggagaatggtttaataaaaataatggtgaaacaaaaacatatcttaaagaaagcgcagggcagttaactctaaaaataaagaataaaactcaatactttgatgcaagtgaaacaaaacaaaatggtacaattgctttaactttatctaaagatgaagaagcgcaatttattattgttttagatgaaaactgtattttgaatgatgacaatcttttagataaaaatggaacaattcaagtttataatcttcaaaaagattcaagtgtgaccctttattgtggaacttataaagaagataaaaaagaacaagaagagattgataatgattatcgaaaacaagctaaagaacttgttaataaaatggatgcttatttgaaaaaagactcaacattgcctcgttttgatgatagggatacgctttttaaagttccttcttcatctaatgatttttatgttgttacaagagatgcatattttcattctttaaaattatttaaacaaggtggggcgcaagaaactggacaaattaaacaaattaaagttttagcgggagatataaatgatttctatgttgaaatgacctatacgtcgacgattacttatttaggtgaaacggaaacaatggatattacatataaatatcgcataaaaaagggaaaagattgttatttagtagcattcattggttatcgtgtaccaggagatattggtttagtaaagtgtgatccggttattgaaaaagatgtttcaacaaatgaagattatgcatattctgtaggaggatagtagaaatgaaagataaaaagaaatggattataggaataagtatatgtgttttattaatagtttctgtgttttttatgtttcatcaaggaaaaagtaatgaacaagttgttacagagtattttgaacttttaaaaaagaaagattataagcaaatgtatcaaatgttaaatcccaaaacagtgtatacacctacacaaaaatactttgttgaaaaatataaagaattttatgaagaaattgatgcaaaaaatattcaaataaaaatcttagatgaacaagataatgttattgaatatttaatatatattgatacccttgcaggaagaattacttatcgaaataaagtaggggtcaaaaatgaacaaattcaatttaataaagaactgattatggatggttacactgaggggtgcaaaataaaaataacaacatataatcctgaaaaaagaggacgtattttagatagaaatggaaaagttcttgctgaagatggaaaaggttattctattggacttgtgaaaggaaaactaaatggtgaaaatgattatggacaaattgcacagtatttagaaacagatgttgaaaccattcaaaagaaaatgagtgcatcttggattaatgatgattcttttgtacctatcaaaactgtttctgaagcaactaaaaacgatttaatcaataagaatattttaggtatcaacggcgttaaaatttcgacagtgagtattcgtacgtatccttacgataaagcggcttcacatatcgtaggctatgttcaaaatgttaatgctgaagacttaaaaaagcataaaaatgaaggttataatttaacttcagtcattggaagaagcgggattgaagcagcttatgaacaacagctaagaggaattacatctggtaaaattgatttggttgataaaaatgataaagttattaaagaactctgtcataaagaagttaaaatgagtccacaagatattacactcacaatcgatattgatttacaacaaagcttgtataatgaatatcaaaatgataaaagtgcttctgttgctctcaatccaaaaacaggaagtaaaaaatagcgatttttaggtagtgacacccttttatatgggtgacatccacgcaaatcgctattttttgattttttaaaatatcttaaaaaacgttgatttcatcggtattttttcgatgacatccattttaactcttaattttggtggagatgaggggaatcgaacccctgtccaaaagcaattcctccaaagcgtctacagtttagtccattgaatcatttaacttggctacaatcaatgaacaattttacaccaagcgattctttaaattttcgtggttaaagtcaagactccttcaacccttatcctaaaagttataatactaacaaaaagctataggctcactcaatgttagcagctttcatgtctatgtcgactaagcgaaagcgtaattagtttgtctgtttccagttattttttgtttgagtttaacgtactccaacgactgcagctaaggtcaaacatacccctgtcgaatccaagacatccccaaattagtaataatttttaagcgatttttcgatatctttttttgccgctttttcttttaaatcattacgcttatcataaagtttctttcctttagcaagcgcaatttctaatttagctttagaaccactaaaatacattttagtaggtacaacggttaagccaccttcttttaacttattagttattttaaggatttcttttttatgaagcaagagttttcttgttcttcttgcttcatgattaaagatgtttccatgatcgtaaggagcgatatgcatgttttctacataaacttcatcatttttaattctgacaaaagaatcttttaaattcacatttcctaaacgcacagatttaatttcagttccttttaattcaatacctgcttcataagtatctaataagaaataatcatgatgcgcttttttattttgtgaaataatcttcatacatatcaccacctttatctatcttctttttcttttaaacttttgttttggctttttatctcgtcgcttatttattataacagtttttttcttctttttgttagatttcataccaacaatttgaaaatctatcgttttttctctttttgaagcagctgaaaccttaattttgactttatctgacatcttaaaacgtcttcctgtacgttttccaattaattgtaaattcacatcatcaaaataatagaaatcatctacaagatcttccatacgaattaatccttcaatcgtatttggaagttcaacaaacataccaaaattagtaatagaagaaacaattccttcaaaagtttcaccaatatggtcttccatatattcagccattttcatatcatcaacttcacgttcaatatcaattgcttttctttcaagtgaagaagcttgatcagcaacattttgcataatagaagcaaaatggaaaagagtttcttgatctaatttctttttaaataaatacgtacgaattaaacgatgaaccattaaatcaggataacgtctaattggtgatgtaaaatgtgtataatattcatctgctaaaccaaaatgtcctaaacattgttcatcatatcttgcctttgccatgcaacgaagaagtaatgtagaaataatcacatgttcatctgttcctttacttgcttcaacgattttacttaattctttagaacgaatatcttctaatgaaccttttattgtataacctagagttctagaaattgtagagaattttcttaatttatctaccttaggattttcatgaacacgatagataaatggtaaatcaagccatttaaaatgttttgcaactgtttcattggcaactaacataaatgattcaatgatacggtcactttctccacgttgtcttaaaacaacatctattggtttacctttttcatcaactaatactttagcttcatttgtatcaaaatcgattgctccacgatcttctcttgttttttgtaaaatttcagcaagttctttcattaggaaaaataaatcacatacatggctatactcttcttgtagttttttatcccctgcaagtattttattaacattattataagtcattctttcagttgaattaataactgattcaacgatatcatgatcaatgacttccccttgaggggtaatttccataaaacatgaaattgcaaaacgatccacatgaggattgagtgaacaaattccattagataatttatgaggaagcattggaataacacgatccactaaataaatagaagttcctcttgcaagtgcttctttatctaattcagatccttcttctacataataagaaacatcagcaatatgtacccctaaataataatttccattctttaatcttcttaaagaaattgcatcatctaagtccttggcatcatcaccatcaatcgtaacaatcgtttcatttcttaaatcagttcttgttttagcttcttcttgatcaatttcattttcaattgattcgatttgttcataaacttctttaggaaattcaacatgtgcttcatgttgagaaacaacagataaaatatcaacccctggatctcctacatgtcctaaaatttctacgacatttccttttaaataaggtttatacgttttaatttcaacaacaactttatgtccagctactgcaccatgactatgtgcatgatctatataaataggttgtgtaaacttttgatcatccgcatcaaagacaagttctcttttagcgtttttcaacagcccaacaagtcttgtttgtcctctttcaataactttaacaattctaccttcttgacgcgatcctgtttgatgctttttaagttcaaccatgactgtatccatattaaaagcatcttttaaatctcttgaagaaataaaaatatcatcactttcttcatcaataatgacaaaaccaaaacctcttttattaatatgtaaagcacctacaatataattagagttttctattaataaatattcatttttatcatttcttacaattttaccctcatcttctaattgatttaaagctttaagcaaaactgtaaaaccttcactattatttagatctaatacatgttgtaattcatgaattgatctttctttatcttttaatatatccaaaattctttctttcatcttctcacctccaaaaaaaataggacgccttgcgtcctattattcattaattcatacgtagtagaattgcgatcacgaagaaggcaatactcaaaatcatcgtcattctagacattactaaatcaacaccacgttctttttgttcagcaaaaagatttgaactttgaccagttaatgcattaacaatatcatctgattttccactttgtaataaacataatataataagagcaacggaaataataaccatagcaacctttaaaattgtttcaaacatatttttaacctccttcgattaatttaatacattgcatagcaaatattatcataaaaagctcataaacacaacataattttaaaataacttatgcattatctaacccacaaacatagtaacgatcttctacccttacaaccgttacattaactgtcgaatttaagccttcaatttcttcattaaacgttaatgaaatcaaaatattataataatcattatcctctaatccagcaattgttacctttgaaggtgaataagatataatattatattttaaaacctctaattctggatattgatttttataactataaaatgatgtttgtgcatattgactaaagttttccaccatttcagaatacatataatcaacaccacctatttcattttttttcttatctacaaaagtataataatcacacacaaaataagcagccactaattgacattcatcttcttcatctttatttttataacttgtatctagtcttgcataaatattatttaatagttcgctatctccagatttagtgtatggagattgtactgtttcagtttttattggtaaaggcgtatctttagatgtcataaaataaccaacacctacaatcacaagtaaaaaacatagcgcaataattaaatgatctctcatggctttttgaggagatcttcttttacgataacgatctaaaaatttaatttttggtaatttatcagaatcaataaaaatatttacaattgttaaaattggtttatattttctagaaatcatatctgttacttctacaaatatttcaaacataatcattaaagcaataaataaaattgttcctgcagttggattataataatataaataagatgaaagcgaaaataagaaagtgactaaataaagcactaaaacactttttctttgtcctaattttaatttaaacatcaaattatgatgtaaatgtcctcgatccgcttcactaaattttttatgatgtatttttcttcttaaaattgctattaaagtatccatgattggaaccattaaaacaataattggtgctcctaaagtaaaaaaagtagaagcattgtatccaaatcctaataatgaaataactgaaatcatgaaacctatatataaagctccacaatcccccataaaaatttttgctggatgaaaattaaaaaacaaaaagcccataatacttccagcaagaatgagtgataaagaagcaatgtcacttcttccagataataaagaagtcattgagatagtaacaaggacaataattgaaatacctgcagataacccatctaacccatcaattaaattaatcgcattagtaattcctacaatccaaaataaagtaacaacccctgaaagaaatgtcatcgcatcacttgggaaatatccaaatccttttatatagatttctccataaacaatgacaatcaacgccgcaatgacttcaaaaattaattttactttaggggataaatcatgactatcatcataaagccctaccataaaaattataaatcctgcaaccataatagcatttatttgatgatctgctttcaaaaataaggctgatcctataagtgaacttaaataaatggcatagccaccaatacgtgctatttcatgtttatgaactgttcttttattcatatgtgcaacaattcctaattgatttccagctttaattacaagtggaatcattaaagctgaaatgattgttgttacaacaaatgaaagaatgaccgtcagtgacattttgccacctcctttatgcctatattattcattattttttagtaaatttcaacttttaaatagctctatgacttgtattctgacaaaaacttgtctatactagtatataaggaggaatatgtttatgcatagtttaggaatctctgtttatccagataaaagtgatattaaagaagtctatgattatatggaaactgctgctaaattaggttttactagaatctttacttgttttttatctattccagatgataaaagagaaagttatttaaaagaatttaaaggattcatggataaagctcatgaattaggatttgttgttgctgctgatacaaatccagaagtatttaaattaattggagctactccaaataatttaaaaccatttgcagatttaggattagatattattcgtttggatggtaactttggtactcaaggagatatcgctgttactagaaatccttatggtattaaaatcgaattcaatgcaagtatggatgctggtgttgatttattaattaaaaacggtggaaataaagaccaaattattatgtgtcataactttttcccagaaagatatactgggctagatttcgatttattccaacaatttaataaacaatggaaagcattaaatcttcatacagctgcctttgtttcaagtcacaatgatccaacaattggtccttgggaagttttctgtggtttacctacagtagaaatcatgagacctttaccaattgaagtacaagcaagatatttattagccactggtgatgttgatgatattatcgttggtaactatccagcaagtacaaaagaattagaagcattatcaaaaatcaacttccaagctttagaattacgtgttgatgaagtaccagaaattactgataatgaaaaatacatcatgtatgaatttgctccacactgggatcgatacgatcattcatcatttatgttaagatcaagtttcccaagacttcaattcaaaaaccaagcaactgttcaagattcaggatttggtgataaaaaagaagctaaagaagacaaatctattccacatcatgactgtggtaaaaaagtatttacgcgtggtgatatcttagtggttaacgataacttagctcattatcgtggtgaattagaagttgttttaactgaaatcccaaatgatggtgaaagaaacttaattggtaaagtaaaagatgaagatttaggtttattagatttcattaaaccaggtcaacatttcaaatttattaaataatttaaatgaggttcaaaacgaacctcatttttaatctattgtttttaaatattcttctaaaccattttcatctacatgaccaatcacttcatcagccacatcttttaactctttaacagcatttttcatagcaatcccatgacctgcatatttaatcatttctaagtcattcaatccatctccaaaagcataactatgctctttatcaatatttaaatgttctaataccttttgtacacctgtagcctttgatgtatctaatgcacatatttcaaatgaattagctgttccatgatgatcaaaataaaatttatcagcaatatattctataattttatcatgatcttttttagcactaatttctatttttaaagtacgatgcattacttcttctttatcaaaagaaatgattaacttttcatgacgaatatcacatactttaaaaaattctataaaatctttataagaaggatcaatataacaatctgttgctgtttcaaaatcgtattcacaatcaacgctttctaacaaattcattaaatcattcactttttcataaggaattctattttcatagatgatttcatgattaagctctacatgtgccccattacataatacaaaaccattaaacccagccccaatgatttgatttgaaataaaggctaaaggtctacctgaggcaacaaataaataatgtccagcctctttcaatcttttaagttctctttttactccttcaggtatttttaattcactattcaataatgtcccgtctatatcaaaaaataatactttcttcatactttcacctcaatgaaattgtatcatgattctattataatattatttaatttctagataagaaaaaaactgtcaatcagacagttttatttcatataatgtaagttttctaacataactccacatccattagcaacacaatttaatgcatcatctgctacgaatacaggaacatttaattcagattctaataatctatctaagccagttaataaagctcctccacctgttaagaaaataccacgtgatacgatatcagcagctaattctggtggtgtttgttcaagaacatgtttagtttctttaacaattgttgcacaagtttctctaagtgctaattcagtttcgtttgatgtaatagtaattgtatgtggtaatccagttactaagtctctaccacgtacttcaaatgttttatcagatgatccttttacagcagaaccaatttctaatttaatttgttcagcagtacgatctccaattaataatttatatttatctttaacaaatttaataatgtccgcatccatgacgtcaccagcaatttttaaagatgaacttgttacaatatcacctaaagataatacagcaatatcagtagttcctccaccgatatcaataaccatattacctgttggtttattaatttcaagaccagctccaattgctgctacttttggttcttcttcgataaatacctttttagctccacatctttcagcaacatctctaattgctgatttttcaattgaagtgatgttagatggacaacaaatcaagattgttggtctagcaaaaattccttttaaatttaatttattaataaaatgagttaataagatttcagtaattctaaaatctgcaataactccatcttttaatggtctaattgcttgaaccctaccaggagttttacctaacatatcttttgcctcttgtcctacagctaatggctttttagtttcttcatctattgacactactgaaggttcattgactacaataccttcacctttgacataaattaatatatttgcagtacctaaatcgataccaatttcttttgataatgccattatttctcctccttgtatgttttttcctcaatattgtatcacgattttattgaattacaaggcaaaaaaacaaaagacactaatttttttataaatataaatttatcatgatgttgtcttaattttttcaattttttgattaaaatatttatcaggatttacagttttatcatcaattgaaacaataaaatgtaaatgtttttttaatgttgattgataaacattatttcctgcttttccaataacatctccttgtttcacttgatttcctttttcaactttaatatcatctaaagattgataaatggtttgaatacctttttgatgttcaatcgtaacaatccaccctaataaagaatcattttcttttctaataacagtcccacttgcactcgcataaacatcaaagctttcattatcctttgtataatcaatcccatcattaggacgatagactccttcaaaataaacaagtgcttcttctaattttttatcatctaaagacgtatcataaaaacccttacttactttaacatcatcattgactggtttttttaagatttcacttccttgatttttattttcatcttttgtttctaccgaaactactggtacatcttcgaatggttttaaattcttaacaatttcctgaataacaccgacacctattaaaaataataaaagtgaagtcataaaaataaatgtttttttattcctcttcaataatcctttcatgcttttcacctcttaagaagtgtaaccataaaatcattctttattctttgaaatctctactccttgataatagtgttttaaaatagcttgataattatatccttcctttgccattccttgtgcaccgtattgagacaacccaactccatgtccacatcctttagtcacaaaaatataagaatttccttctttaactatttcaaaatcacttgaagacaattgtagtttttctcttacttccctaccactatattgtttttgattaataagaatagatttaactctcccactaggatagcgttctaaaaaacgatattgaaacgaacctccaaaaaatgaattaagctgtgctttagtatattttactttttttataaactgaggatcatattcttgatcccaatgtgaatctacagaaaccaaatacggttgacttgaacctttaaaatagttttctacattttcgctttttccattactacttgaataaaaaagagctgaaatacactttccttggtaagttaagatttcccccttagtttctacaatagctttttgaactttctctttatattcttcataatgatcactccatgaaaccttcatcttttcatcatctagataaacttgtgtattggttgtattatctacacttaataaacgtgaataaacaaaagttcgacttgcgacaacttgtgctttaattgcttcaagttcaaaacttgccggcatttctccagcaacgacccctaataaatagtcatctaaaagaattttttgtgtattatctccaacttttacacttacataaacatcttcattttcttttcctttatataaagaatctttctctttggttggttgatacaacaaaataattgctaataaaataaatagaataagtaataatttaaaaaaaatagttttcatattttaatatatgaaaacttaaattaaaaatgtattgttacaaaatctaaaataaatgaagcaagtaaatatcctaaagataaggaaacaataatatataaacaataaaactgttttaactttccttttaatatatacttttcataatgaaaacaacttaaaccatacattgcagataaaacagaaaaaacataaacaattaatttcaatacttgatatgacatattattctcctcatataaaaccttgatctacatataataaaaagggtgatccttttgacaaataaaactttacaatatcttatctataatcaactctattcagcaagtatgtatgaacttcttgctttacaagcaccaactaaaatactagaaaatcaaatgaaactctttcaagaagaaacacttaataatgcatcttatttagatcgttattatcaagaacttaatacttctagttaccatccaattattcaagagcctgtaaatcatggaagttttaaaaaaaatgtttattggatgttagaatacgaaagttcaagtactaaactattttgcaatgaaagctataatgcaaataatgatgaaaaaataaaaacactcacatcttatatttcttcttctatagttcaaagaaatacaaaacttacaaatatctatataaacatacttgatgaagaaataaaaaaaacaccaccgaagtgatgtaattgacaaatggtgactcgtacgggattcgaacccgtgaatgcatgcgtgaaaggcatgtggaagtaaaaaatagcaatttttaggtagtgacacccttttatatgggtgacatcctcgtaaatcgctattttttgattttttaaaatatcttaaaaagtgttgatttcatcggcgtttttttgacgacatccattttaactcttaattttatagatattcaacatatacattaattaatattattttttcagttattattatttcgttgataagtttgtctgcctcctatattaaaagaatattttcataacatttataatttgataaaataattttaagaggtgatgatgttaatgataaatattttaatttatgatgataatcaaaaagatataggtcaacttttacaatgcatagaaaaattttttattgaggtaaatttgcaatatcaagttcatatttgcaaaaataagcctgatttattacaaaatataaaaaaatctgatttactttttttagatatggaaatcaatgaagaaaatggtattgacataggattggaacttcaagaaatcaaacatgattgtagaatcataataacaacaagttattcaaaatatgcaattgatggttataaaatacatgcagatagatattttataaagcctataaatcaattggaatttaatttagaaatggaagcagtaataaaaaaatatataaaaaaaactatcggcttctatgattcgaaaataagcaaccataaaatttttattaaagacatactttatatagaatttgttgatagaaaatcaacaatacacaaattggatggtaacacaattattacaaattgtagtttaaaatactggtatgataaacttaatgaatttggttttgcatacccatataaagcgtttttagtaaattttgagtatattagtgcatttaaaaaaaatgaaattattttaattaataacgagagtattccgctttctagacactataaaaaagaatttgatcaaaaatacaatgattttctacacgaaatgctatgattattgtttctaatatagtctcttttttattactaacttatattgcaaattcttttttaattaaaaaatattcaaaagagaaatcatttatatatttttttctcgctataattactattagtgtttttaattataatggtggatcacctattaaagccatatttgtattagttatttattttttatatatagttcttttatttaagggagatattataaaaaaattacttgtaattatcccctttttcttaatacaaataattacagaattattagtaggttttattttaggacatattcccattatagaattaacaagaaatgtactttcgtttggatatatatttggaattgctatttcaattataatatctattttatttacttttgtttatgtttatatattaaacaatattaaatttcattattttccaaaatacgcttggctcatttttatattaccaattattacaattgttttactaattgatgtagatgattattttaagctttttaatagccatattaatatttttgttaatataataggtcttgctctttcaaatttaattttatttattatatttttattagtaatcaactcttcaaatataaaactcgaattaaaaatagagaaacaaaaaaaggaattcgtcaaatcgaaggcaaaactgctttctcaacattatgattataattttcaatttttacatgacttactacatacttgtaatgaactagatatgcttctaaataattcaaaaacgaaggaagcaatgaatttattaaaccaattaactgagacaacgtataaagaatttaatgcaatttatagtaattcttttattctcaactatgttattaataacaacctaaatcaaattatagaaaataaaatcgaaattaagactgtaatagagtataatctatttgatattttcgattttgatacacaattaagcttatttgaataccttattaatctatctattacttcttgtatacaagttactaattctgatagaatcataataataaaatcagtaaaaacagcaaataaaattattttaaaaatattgcattcttgtttgtcaatcaatgaatccaatattaaaaaaaatattaacgaaattttgctaaataaatatagctctttaagtattaaagagcttaataactcatatgcaagcattctgatatcttttgatatttctggttcattttagaatcaacaaaaacagtaaagaaacaaataatcttattaaaatcaaactctaaagttaggatcttcaaaatacttaaatattccaaaacaaaaggattcatgggccaaatccctataaatccttttatttatctatattatcaagctgcttttttaaaaattgatatttctctacaaattggtcatcacatccaatataatcataagaatatgtttgttttaaagtcaatgaattattatcataattatttatactttcatttctatcatctacatcaaatgcaccaaaatgaacacttgaaaacatataagtattttttacatttactttttttgatttttttaaaaatacgatatattctcttaaaggaatcagtggtttcgagccctcaatgtacccaacagatgtttggtcaattacatatgtcatatcataaatatttattttttgtttaacttttcccttgtatgttcttaaaacctcgcattcattaattattccattacctgctatactcttttttgaagtattttttacttttaaaatataatctgattgatcaacaagttgcgccattgatgctacttgctgatcattaatcatttttttcgctgtatcaggatatagttttaaaaaatcttgattgctcatcgttgtatacttaaaattattttcaatatctaaatattctattccgtgaaatttattcttcccataaaaacctaatccagcaaataacactaaacaacaaagacaaaatattctcaaatatttaatcattgcttatctccgttaaaaaatctttaactcttccattttctataaaataaattttatcacataataatttcaaatcatctaaatcatgacttgctaataatataattttgcctttgttcttttcttcttttataatttcatgaacatcctttaacccgcttctatctattccattagttggttcatcaagtataattattttttgattttccataattgcttgagcaatcctaagtcgttgcttcattcccaaagaatattctttatactttttatcaccagcataatccaatcctacactttttaaaatatcgtaaatatgttgatcattcttttcattatttaatctatataacatttctaaattttcaaaacccgtcaaatgtggataaaatcctggattctcaattagtataccaatttggctcaaatcaaattcttctttaagaattgattttccatcaacttttacatctccttttgtaggataaataagcgttgtcaatgcacgaaatagcattgttttccctgaaccgtttcttccatagaatccataaacattaccacttctaaatgtaagattaatattatccaatattattcttttattaatcgtttttgaataattttcaatctctaatatcatattttattcctcctaacagattcctagaaatataaattttttttataaaatgtaatacaaagcatatacaaggaagtgttaaaaaattaaaagagtaattatagtataaagaaataataggaaataaactactttttaatatatttagcaaaatcaataataaagttaactctataagaaatgatatagtatatttttgaataacaagtgaaacaagaataagtaaccaaatataaaacataatttcaatataatatttgcaaaacaattctaatatacccacatcaaatttaaacggtattcctgttaatatcatcaatccaattatttgtactactataaaagacgttgtgtaaattgcatgctctttaataaaacacaaaaatatattttttaaaaaattattcctgtttttatatctcaaatcaaaataatttagttctacatatattttttttgatataaaaaatacctgaatcaaaattggaataagccatagtatatttacaaattggtcactaccaaaaaagataagcgcttgataccaccaattatctatatatacttcggaaatatatatactttttaaataagttacggctagtaaaattaatagatatatcaaaaaatcttttttattcacaaatttcattttgttttattatataatccctttccttcattttttttgatgttacaaaaagtaaaacaatatccaatgtacacataaataaaaaaataaatggataaaagtgataaacatatggtagaacaagaattgcatcaaaatcaaaaatataatgttccatataaaaatagctaaagtgtcctaataaaacatccaaacaagcaaatactaataaaaaaatactagtagaatttaaagaaaaaggtaataatcttcaaagattattaccatgtggacaaaatttatcccttttttatcataaaaacttactaaatttctgattatcttttcataagttggtaaatgccgatatatcccgtattttagggctttatcggtattttctttttggaagataccttgcataagctggcatttaccagcatgaaaatgcaaccaaaagtagtaaatgagtagtaaatataagctccgatattaacaagccagtctttccagttccgcttttgcagattgaaatgtaccgtgtgcgtaatagccaagtgtcatggttatgttagcgtgtcccatgagatattgcagggtgtttgggttcattcctctatttgccatattcgtacaataagtatgcctgaatgaatgtggtgtgatgttcggtaacttatccgtgtgatacttgttatatttcttaatcaatcctcgcaccataccctcatagtttcctgcaactttaggcaagccctcacggtttaagaataggaaattgctgtaaccacctacaatcagcggttgtgcttttcctctgctctttagtattctttggattgcttgataagcccgttctgtcaatggaagttcccgttttccgtttttggtctttggtgtttcaatatagtagcctatttcgctatctttcaatagctggtggtctatattgagtattctgttctgcatatcaatatgcgtcgtcagtccgcaaaattcagaaatacgaagtcccgtttccagcagaagcacaacctcatcataatacttgctgtaaatcttgtccttttccataaaggcaagcaggcgttcttcctgctctggtgtaaggataactttctgctccgtatcatcttccagaacatcacttagcttaaattcaaacgggttttttctgatacagtcgtcttgtatcgccatgtaaaatgacgctttcaaggaacgcttatagttatcaatcgttttataggcatatcctttttcactcattctgatagcccattctttagcgtccgattgcttcacagtatcaatcgccctcatacccaacgggtcgtttttcagagcgttcataagatactgtcgtcctttttcagtagcccttttgatgttctttctttggctgttcttcttgtcgtagagctggcagactgtcattttaccgccgactgtgtcgataccgtcgttaaggtctttttttatctgtgcttctttttccctcaacgatatatcatcacgctttccagcaggtgtcttgtctgtcggtacaagtttccaagaatagacaaattgtggctttccgtatatatcggtatatttataaacgtatcttccgtcttttcgctggctctctccattacgcaaattgcgatttttaccgtcttttcgttttacattagacatagtgtaaagctcctttccgtcatggaatgagccgtgatacgctatatttattataccatatctacggctcaatgacattagatttcgtccaatgtatctatgattttttcaaattgttttcgcttaatctgaatacggttaccgttcacgataacccagccagcgtcaatattttcttcggctaatttacgcaatttcttttcgccaatgcggaagtatttggacgcttcttcaatcgtcagcgtatatttttcccagataggcacatcagtattgttcataatctatgcaccccctttactgtgtgtcattttttacaagcaggcagacggctttggaaagctccgttagtatctcaactattcccattcttgtgggcagaaccgcaccatgcggacgtatcattattctgtgaggataggtcgtggcaaaacgacttttccaacagtcgctctcggatcactgcgtgggtcgctcgctttcttttgaaaaggtcgtggcgtacagtccccgtggctcgctatctcacaaacgtatctgtctgctttattcagttgtcaaagagctgtggcgaaagcgtgttgctttcatgtaaaagcagaggcagagcaggaaagaggggattgaacaaatcatgctctgcggttactgcttgttattcttcggtttctaaaggaatatcaaagtccaaaatcattttgataagtgcttctctgatacgtccttttaattccatgtctacgactatgcagacattaccatatttgtcgtagaacggacgcaaacaacattttgatatgtacgggtcatacaacgccagtatcttttcaatcgcatttacgttgccgtccacagccgacgaaataaggtaaaatgacgggcgtgtgttattcatcattcatgttctcctttaattttttcttgatttcttcaagtgagttcttcctactgcggaacgacgttgaacggttaatctttaatctgtcgccgatttctgtatcgctcatgcctaagaagaaatacatcaacaagatttctctgtctttttcagacagatacttaatcgcttctgctaaatcatcatcaaggacacgaacctcaataccacatacatcaaaggcggtataatcgctttcgtattcgtcccagactgccagcttttctacgacgatttctggaagttcacaataggaaatttccttatttcttcgtcgctttaattctttgcgataattacggacaatgcctttcactacacgtttgagcttgcagtcaaattgacattgtattgtcttttggaagtccgacggtttcatatcatcacaccccctttccgttatgacgtgaaaagtgtttatccctctttccgcaccatatctgtacagcaaggtgtgatttgttgcatgattttgaaaaaaaatgaaaaaattttttcgggtacaaaaaaagcccgcacaaaacatatagtctgtacgagctattaaagctgtgagatattcagttgttaataaaatgctgttaggtagtgtatgaccgtataagattatgcttaaaactttccatgacacaagcccccttacagcacttgatttctattaaacttttgtcttttttgtaatcttgtaaatatattcttctggagtagggcgtttatttccaaaatactttctgaaattctcctgcacttctgggtcggtgctgttcatagcttcatcaatcgtcgcttcaatatcagctcgaacatcagctaatgacacaccgccagcttttgcaccagctttcaatgcttttttaatatctcgttttttaagtcctatcatagtattacctcgtcacaatttactgaatgttttagaaatgtttttcaaaatgcttatatagaataatccctaaaaatgtttgcagtaggaataaaccaaatataatgcctataatccatgcttcaatatgaagtaacgcaagtacaaaagcaacaaacaagtacacgaaagtcattaactgatatactaaagaaccagctttcattcttaaaaatatttttctttcatcaacattattgatgtgattttctctatttatattttgtaatttttctttattttttggcatttcataataacaaattttcaataattgaacaccagaagcaaaagctaaaccgaaccccattgcgtaaaaaagtgtagcgtaataatcagtatcaataacgaaatatccaaaacatataaagattatacctataataatctcaatgataaatgataattttttcttcattgttaattccacctttcaaaagactacattttctgtattaaaaaaatcgttttatggttgttcaaattatcctgaatgtaagtttacttcatcagtaagttttctcacaatagcctgtatcttttcttgaccattaatcattgctgcattcattcttctgtgacctgaaatcatttcatatccgtgactatttggatgtggtcttacaagaacaggaactaaaataccattttctgaaacactttttacaagttcagacatttgttcatcatttctaactctaaacggatgattcttaaactcctgaatatgttcaacaggaatttccattatcttctctagttttgcctcctgtctttgttcttcgttggtaaataaatcatcgtacgtaggaactcttatgtcgtttatgctctttttcggcatttaagatgacctcctttgtaaaagcttcataagctttagttgctgcaccttttggatcatattgaaatatgctttctcctattcctgtactttctgctgcctttgtacatcttggaattgttgtatcaaataccttaatatgccctccaaagttttctctaacttcatgtgtgattttctttgatagattggttctttcatttgtcatcgtaatcaacacaccttcaatttttaaatcatggttaaggtttcttctaaccatattaattgatcttaataagtcagccataccttcaactgcataaggttctgcttgtacagttataacaactttatctgaagcagtaagagcattaataggtagattatccaatgatggatttgtatctataatgacataatcataatcatcttttacggtatcaataaatcttttcaataccgtttctctacacatagcactttctaatttagaatttattcctgcaagagaaatatttgatggaacaatatcaacattttcattactgtgaagtattagctgttctctatcaagttgtatatcttcaataactgatacaataacatccttcatagataaaggatattgtgtactgtcataaaatccaaatgcttttgttgaatgtccttgtggatctaaatctaacagcaatacctttttgttatttaatgcaagacatgcacttaaactaacagatgtcattgttttacctacaccacccttttgatttgcaattgctattacttcgctcatttgtaatcactcctatctttatatatagcattaaattgacctcctttcttttttgccaatcattgattggctatgtaaaaaaagccatctgctatgatgacttttatatgctatctttcttgttgtttatgttttgtatttttactgtagtcttttaacggaactttcttatccattacatgctctctaagtttaaaaaaattatcatgactttcagaagcaatgatatagtcaaaacagaattttcctttatctgtcgatggctcaacagtacttagatatcttttatcattaaaagcagaatagataaaagcatccgaagatagtacattgtgcgaaaatagctcgttgccagttccttcttttttttatacaaataaaggagattatttatatgaataagaaaaataagtttttattattttttttcacgatattattgttttttaatattcttttatttttaactaatatttggatttttgataattttggtaatgttaagatacaagaaatattatttactttactttctccaactagtgggacagattcttcagttgtttattcatacatactaagagtattattgatagctgtttcatttactgttctttcttgttttattgttttatatacacgtaaaaaaagtaaacattttaaatatattaaaaatataagtgctatttttgttgttgtatctttgtttttatcttgtttatatactaattctagatacgatatttatggctatataagccaaaaatcacaaacaacatcaatttataataaaagtaaaaaaacaaagaaaaaagtaaaaaaagaggaatatcaaggggatagtactatcgtttatcaaaatcctaaagaaattaatatatcaggtagtgatactaataatctcatttatatctatttagaatcaatagaaaatacttttttggacacagcacatggtggagtaaaagcaattaattgtatgccagaattaacagaattagctttaaataacactagtttttcaaataatgagcttttaggtggagcaattccatttactggtacaacatggacaatagcatcaatgacttctcaatttacaggtttacctttaaaagttgaagttgctaatgatatggatcaacaaaatcgatttatgccaggtgctaaaacaattggagatattttagatgagaacggatatatacaagaacttatgattggttctcaaaaagaatttgctgggacagataaattatttttacagcatggatttgataaaatatgtgatattaattcgttaaaacaggaatattcatttaaaagtaatgaacttaatcaatggggattagacgattacaaattattcgaattagctaagaatgagattacgcagcttgcacaaacaggtaaattcaattttacgatggcaactatagattgtcatatgcctaaggggtttctatgtaaatattgccctaatacatatgaaaatagatatgaaaatatatatgcatgtcaatcaaaacttattaatagttttattgattggtgtaaaagtcaatcttggtatgaaaatacaaccattgtgttagttggtgatcatccaacaatggcacaacaatatgttaatgatgttccgtcagattaccaaagaacgacatacaattgttttattaattctaaagtgacgactgatcaaataaaaaatagacaatttacacatatggatatgtatcctacaacattggctgcaatgggattcaatatagaagggaataagttagcactaggtacgaatctattttctgaattaccaacgattattgaaaaatatggccaagattatattaatgaagaagtacaaaaaagtagtgaatatttagataaaaatatatatcagtttaattaaaaatggatctcaagacgagatccatttgtttttttattcttcaactcttcctttatctacatacatgttttggaaatagtttttatattcaccagaaatgatgttttcccaccattctttgttatttaaataccaatcaattgtttgaggaatacctgtatcaaatgtatattttggtttccatcctaattcagtttctaatttagttggatcgattgcatatctcatatcatgaccttttctatcagaaacaaatttgattaatgattcaggtttacctaaagcttttaagattgttttaacaacttctaagttagttctttcgttatgtccaccaacattataaacttctccaacacgaccttttctaatgattaagtcgattgcaacacagtgatcataaacatgtaaccaatcacgtacgttttcccctgtaccgtatactggtaattcttcatcatttaatgctctagaaataattaatggaattaatttttctgggaaatggtaaggaccatagttatttgaacatcttgaaatagttactggtaatccaaaagttctatgataagctaatacgaataaatctgcagaagcttttgatgaactatatggactagatgtgtgtaatggtgtttcttctgtaaagaatagatcaggtctatctaatggtaaatcaccataaacttcatcagtagatacttgatgatatcttttaataccaaattcattacatgcatctaataaagtagttgttcccataacatttgttttaacaaagatttcaggatcttcaatacttctatctacatgtgattcagctgcaaagttaacaacaacatcaaatttttcttttttgaataagtcaaagataaattctctatcagcgatatcacctttaacgaatttataatttggtttaccttcaactggtttacaagtttctaagttacctgcataagttaatttatctaagttaacgatcatatcttctggatatttattaaccatataatgcacaaagtttccaccaatgaaacctgcaccacctgttactaaaattttcatttatttatctccttcatatacaaattgattatttgaattttctaaagttggtcctgtttgatctttttcacttaaaacaggttcaataccatttaataatgatccccaatcaacgttagctgttggatcatcataacgcataccaccttcagattctttattatacacattatctactttatatctaaattcaacatcatctgttaaagttaagaatccatgggcaaatccttgtggaataaagaattggcgatgattttcagcgcttaattcaacagaaacccattcaccaaatgttggacttccttttctaatatctactgcaacatcaataacttttcctttagtacaagatactaatttagattgtgcataaggtgggttttgccaatgtaaaccacgtaaagttcctttttgtgcactaaaagacatattgtcttgtacaaaatcaacagtaatacctaatttttcatatttaggttttgaataagtttctgtaaagtatccacggtgatctccaaaaacatctgtttctacaattaaaacacctggaatttttgtttcaataactttcatcttttttacttcctttttattgatctataaattttccatccattacatcttttaaatacttaccatattgattctttttataaagttcatatgcagtatttaattcatctttagaaatccatccgttgttataagcaatttcttcaaggcaagcgatttttctgttttgatgagtttcaacagttttcacaaagttagttgcatctactaaactttcatgagttcctgtatctaaccatgtaaatccttgacctaataattcaacatctaaattacctttttcaagatagattttatttaagtcagtgatttctaattcaccacgtgcagatggtttgatttgttttgcgtattctacaacatgtttatcatagaaatataaaccagtgacagcataatttgatttaggttgagctggtttttcttctaatgaaatagcttttccattttcatcaaattcaacaacaccaaatctttcaggatcatcaacataatatccaaagacagtcgcaccatcttctttatttgctgctcttcttaaacgttttgataaaccatgtccatggaagatgttatctcctaaaatcatagcacatgcttcaccatcaataaattcttctcctaaaataaaggcttgagccaatccatcaggagatggttgaaccttatattgaagtgagataccaaattgatgtccatcacctaataattctttaaagcgaggagtatcatcaggggtagagataattaaaatatctttaatgcctgcattcattaaaatactcaaaggataataaatcattggtttgtcataaattggcaataattgtttacttgttacttgtgttagaggataaagtcttgttccagatcctccagctaatacgatacctttcatagaagtacctccttttgtttacttctaaataataaaccatgacgttacgtaagtgtcaatacaaaatataaaatttcttcattttatcaataaaaaaagtgtcacacttaaagtatgactactttctacaaataaataaaccacaatctttagtaattttaattccattattttcatcaatgattttttcaaggtaagcttgaaattcttttaaacgatatcctaaatattctttttgattgccatgacaactcattatatagttcattagtgctttagcgtcatcaactattaaataatcatcatacctctttaattcaatttgtttaaaataaggccttaaaagagtttttccattttctaatccaaaatgttctacaaggttattattagatagttgaatacgtgaatcaaaattatgaacaatttcagtaatttccttcatatgatttttaccataagttgtacaatagaatattccataatccttaagaacacgagatatttccaaaagaccaagattcaaatcttgcagataaaagagaacatgatttgcaatcaccgtatcaaagaaatgatttttaaaaggaatattttgagcatctaaaacaatatagttataatcattaccaagttttttcctggtatcttctaacattccttcgctaatatctgataagaaaatctctctatttcttagattataggtattattttcccatagttttccatttccacaaccaatttctaaaagttgataaacatgagaaaagtctatttgatgatagagccattcaaaccaactttccttattaatagaaaaatgatcatgaagataaatacgtgtagataagttttgactattgaaatattgttgaataatgctttcatcattatttgtgagattaatcagttcaataatcttttcccaagaaatttgatcatgttctaaaattttttcagtgcttttaatggttgcttttaaattattaagatgattcattttttggttaatcaaagaagtttgtagttttaaagattctttaaaactatctttatcgttatctataataagaggatagatttcttctagtgaaaatcctagttcttttaaagcaagaatcttttgaagagtaattaaatctttattacaatattgacgatatccattgtctagaatatgcgatggttttaaaagccctattttatcataatatcgaattgttcttaatgtgacacctgccattttcgcaaattgtcctgttgtataatatttttccatagaaatattataaaatagaaaataaaaagatgatagtttttatcatctttttatttgttttttaatgcttggggtttctttggttcatataagatccaccatgaaggaggtacatctaaaacagctgcaaaaccaactaataaatcaaataatcctttaaacatgattttcacctctttttaataaaattaaaatagtgttaataaataaagaaatcaagtaaataacaagtaaagatgaatcaataaaagagcataagtataaaatcaatatttctatgcaatgaagtcttttatttttttcaaaagataaagtgtaattggctactattaaactcaaacatatcaatcttaaaaaagggatatttgtaacatatttaataaaatatgaggcaaagagaatgatcatgtttgaaaagacaagacattataaaaatgatgaacaatgaaaacttttataggataaccttaatggtataaaaaagaaaataaataaaacgaattcgtaagttgtatgaaaaatgaatgataaaataatcgctacaaaaagggtagaaaggttgcataacaatccttccattccataaactgcaagttcaatttgatctaaatcattttcatattctctaggaattattttcattgttagatacttagcaagatggttcatatatacttcctttcttgatttcaattttattttatagaaaaaaataaaatttgatactattagggaaaattaaagaaatagtgggaaaattaactagaatgttattgattaaaaagtatataatactatttgagatagtagaatatcgcaattatttatttatcaaacgagaatctttttatggaggacaaaataatgttaggagagagattacaatatttaagattagaaaaaggaatgacacaaaaggaattatcaaaagtatttaaggtatcattgaaaacaatacagttttatgaacaaaatagaaccatcccagatatatatttagttgctgaaatggctaaattttttaatgtttcatgtgattatattttaggagttgtcaatacacctattccattagacgaaagagaagcagaagctaaagaccatatttatatgccaaaagagtttatgaaaaacaaagaaacaagaagaacatataaaacaattgtggagtatgtaaaaatggttcatgagatgaaataatgtataaagtagcaattttagatgatgaaaaaaactttttagaagaaatacataactgcttacaagagtatgaaatgtttgaagtttcatattttcaagaagcaaagttgttgattgatgaaattgattattttgatgttgtttatatagactatgagatggaaaatatgacagcatttgagttttttaaagaaactcaaatgagtaaatacattagaatcatcattactaaatatgatcatattgtttataaaagcatagattatgatatttttgattttattagaaaaaagaaattaaaagaagatattcacaataagatgaatagattacttaaaaaattagaatcagatcacgatcgaattattgtagaaagtggtaatcgaattgttgcgatatattatgatgatatacaatatatacatacagataaaaattatattgtaattcatggaagagaggagtacaaaatacgctctactttcaaagattttattaagaagataaagaaaaatgattttattacaatttcttatggaatccttgtaaatatgagatatgttcaatacattaatctaaaagaaatgatggtggttttagaaaatgaaatacaattacctttaagttataaatataaaaattctgtaaaagaagcttatcaggaatataaaatacgatgaaattatttatagatattatttgtgttttgatagaaaatttaatttatgtgatgtatcttgatttattctttaaaaatagaaaagaggtaaagcataataaaatattctttatagtatttatgagttttttatctttaatgatgaataaatattttgctataagttatggaggcattatcttattgattataagcttaatatatattcatcttttttatgatggtgacatttataataagataattaaacttatttttgtgaatgttaatatgttgcttattaatggattgtgtatgtttttattaaatcaacaatcactatattatattgtttatacttatgatggatatttaggatatttgattacttttatttctaagggaatatgggtgatagaatatttttatttaaaaaagtatttgaaagaagagtttcaattaaataaacatatttggttttttgttatgataacacttgtagctattatttttttagatctctatacttttaatgaatatctgatgaatcaaatgcgtttatcatcgattatttgtttgtatgtagtttcattaatgatgattgtgttgatttatatattatgtttagaaatgacgcagtactatcaacgtttaatgaatcgaaaaattcatgaacaagcattacggtatgaagaaacacttgtggaaattgctaatcaaaaaagtaaaaaatataacaaaattattcatgattataaaaagtttgttaaagatttaaaagagaatcaggaaattgaacttcaagatatatcattagaaataccgacagaggttattcacacaaacaacattgtgttaaattatgtttttaatcggtatacagaaattatgaaggaacatcagattgatttttatggaacttattctgatcaaatttatcaaggtgtttcttcttatgacttagccactattttaaaatttttattggatcatgcgattgttcttagtcaaaaaacaacacataaagcaattcattatacgatagaaagtcaaagatattatacaattattaagataagatgcttgattgaaaatgaaattgtcgttgatcatcattttaagaagaatgaatatttgatagaagaaatatgtagaaaatataatgggaaaaaattgtcaaaaatagaagataatcagtatatgtttggatgttatttagaaaatagtggcgatttgctataaaatgtcgattgtgctatgataaacgagaattaaccaacatatggaggatgattatgaaacaaaacaaatttatgcgatttatgacatccagagcacttattttgacattacaagttgtcgcatctggtgtccttttatattttgtgtatttaacaaaattattgcctgttaaatactttgctattttagctgctgttttggcagtattggttttattgctttggattattattcaaacaggaaagaaaaaaattgttgaagggaaaacaagtaaaagaactattatttctaaagtgttgagtttaattgtttcaattgttttagtaattggaagtacttttgctgcaagaggaaatactttcttaaataatgtacaaacaacaactcaaaaatacgctatcaatgtcattgttttaaaagatggtgattatggaacagcatcacttgatgatttaaaaggtgttaattttggtagatcatatgaaaaagaaaaagctacattaaataaagctttagcacaaatggaagaaacgattgatacacaaaagtatacgacatatgatacatattctcaattagcagatgctctttataataaagaagtagatgcaattgttgttggaacacaatataaatcaatgttagagttaaatcatgaaggttttgatgaagaaacaagaattgtaaaaacatatgaatttgataaaaaagcaaaatcagtaacaacagcagtaacagatgtaactgaaaagccatttaatgtatatgtaactggaatcgatacatatggttctgtatcaacagtatcaagaagtgatgttaacttaattgttactgttaatccaaaaactaaacaaatcttaatgacaagtattccacgtgattgtgaaattgaacttcataaaaatggtaaaatggataaattgacacatactggtatctatggtgttgaagagactatttctacgattgaagactttttagatttagatgttaactattatgcaagaacaaactttagtggtattacaaatattattgacgcattaggcggagtaactgttgattctgattatgaatttacaacaagacatggtaactatcatattgtaaaaggtgaaaatgaattagatggtgataaagggctatgttttgtaagagaaagatataatttaccaagtggagattatgatcgaggacgtaaccaacaaaaattattaaaagcaatgttgaataaggcaatgtcaccaaagattattactaatttccaaagaatcttaacagcaatcgaaggatgctttgaaacaaacatgtcttctgacgaaattaaatcattaattaatatgcaactagatgataatgctgaatgggatgttttcaatgtacaacttgatggaaaagggtatatgacagatcaaacttattcaatgcatggtacatcaatctatgttatgaaaccttacgcatcatatgttaaaaagattactaaacttattgatcgtgttgaagacggtgataagataactgaaaatgatgtaaaaggtttaggtggagaatagtagaaaatttagaatggatttataaggtccattcaggttgttgataaataaatagaggaatttgatttctataatgaaattgaattccttcttttcgtttttttatgtttattggtgaaatatctttaattaggatctatatatatcctaatctctttttactcaagcccagttttttgagattatggcagctaaaaataatcagcaattcatgctgatttctctctagtcccttcaaacgtgtaaatctcatcccatggttttccttggcatctgcaaacactcgttcaattgtttcttttctctgtggatagatcttcttccattcatctgtatgccttatatgattggctttttctttatatgattcccatacatgtcttgtgatcaccttttcttgattttttgactttgtacattgtgataagaatggacacccttcacagtcttttggatcacttttatagattctatatttctctgttggtcgtaacataatgcatttcaaatctatctgcatctataaattcgctgcctctatcggttttcaaaacttcaacttctttagaaaataattcttttcctaaaatagtttctaaaagatcgagaccttctaccatagcacttgaagactttacttcctgatatataataaacatgaaagagtaagacaggaatttaaatgtttgcataaaaggaccggtggaactgttgttatagacggtgtccatttcgacgatgctgagatttttattttcattggtatagttgatgaaatcatcatatgtacgtcctttgagatattttctgtcttctctttttttgtgatttttctttttgttttgattctcaaatcaatatcaagaagaccaaattctctaaatacaccatcttcgatgtaattatagagagtttttttctgtattccttgtgtgcaagatcggcagaatatttaaacttgtcataacgacaatgagtatatttggaacagccgttgcaggcaccaggggatctgtctctgcgattgtatttgaaaggcttaaagtcagggcagtcagaacaaacatgattgtgagaacattcatctttgtttgcacatgaagggttataggaacatctgtgggctttaatttctttgccgatggtagatttgtctttgccaagagtcaaagcaatagcagctttggtagaactattttcaatacctttttcgatgatgattctatcttgatcagtaagatgtagatttttattgttggtagacatagtgatcgatctttcatgaaagaagggaacagatatcaaatcagttatacaagagaaagagtaaattccacaaagaaagtgtaaaagtaagttcaactgtaagagtaaaatcaactagaagtttgtgaaagactaaaatcaactttgacgcatttaaagtggaatttaacttttcactttagaaaagttaaaaaattataaatagttattgactttattaaaaattaattgtattatatacgagtcggcaggaaacgaacttgctgatgaggatattgaaaactgaacaggaaagaataaaacacaacgtcaattaagttaaagaaataatcaaataaataagcattttctttttctttgatagaaaagaaataataaagcatggacatattaagtgtttttccaaatcttcgcggtcttgtacaaaagataacttgttcatttaaaaaatctataattaaatttgttttatctatataatagtaatttttatcaatcatttctttaaagttttctattcctataggtattagcttcatataaccattcccttcaattatgattatactgatataagccattatttctattggattatttagtcaaaataattattattaaaatctattttggacttgtagtattaattctaaccaagaaaatcattttcaaataaaaaagatacgatttctcgtaccttaatttattattttaactaaaaggctatttgacaccaataatacttttctatcagatattcattctttaattgatcaaataccgtttttttatcctctaactcatataaataatcttgttttaattctatagtttccttatttatatatacaatggtaaacatattattatcctttatgtagttcatgttaattatttaaaaaatttcaacattaacaactacattgccaatgcagttcacttgttgaataacaaccaggtttctttgtgttttatcctatacgatttcttaacctgcgacgcttctaacgctcggatcaaggctaatcatgagtatcattatttcagattgtatattaatcttggacatgtattaatattgtctttattaacttgtcaatgttctcttcaaggaaaaaatccccttatatataaggagattcaaagaagattttttaagctatttctaaatattataaagacaattatatcacatatgtaattctacatttatacttaatgagtcatcaaagcatcctgaacttacgctcaaagccccttcaacttcctccatctcatactcgtctaaccgatctaaatatctaattaatcttgatttatcaatcgttcttatttgctcgcacattattatagaatcatgttcaagatcttctcggctgttaataaagacatgtgttggtaaatttcctttttttgctacgtgagatgtcagtgatgcaactatagtagtgctactaaaataatttcctgcatcattttgtaaaataactacaggtcttatcccaccttgttcaaaaccttgatacggatttaagtcggctacatatatttcacctctactgatttttttatcattgcatactcctttcatataattccaatactatttagtgttcaactcgcataaatatgttaaaaaaatctccttaaatataaggagattcaataaagcatttttaagttatgatctttgaattaatcattaatgttataactatttttaataacaattataaacaaataaaaaagatcatttaaggggaatgatcttctttatttttatagggaattcgtgtaataaaaaaattaatatcttgggaaactattacttaaaatgtaaatatatgagatataaatatatatgggttatctcattcttttacatgttaatttttattacaatttcattataatgaaatataacaaattgagtagagacaagcatcctaaattaatcattagtatttgtgcaatgtgcacaaatgatgtgaagcgttaagagcttgtttttattaataaaataatttaaaaaaactgtcaacttcatatttgtcaacagtcttaaatctccttaaaataatgagatttataaaacatttttaagttacgatatttaaattaatcattaatgtcataaccgtttttaattagaacttctttaattttttccagtattattttaatagaatagtaaaccgcaggcatactacagttttcttcaatagcaattgattctagagtcttacattgaacatatttttttaaaatacgttctttttctttgactggtaaatctttaattgttaactcaataaaacttattaattcttgatgtatcaattctttcaacaataagttttcgttaacatcaaagccttctttttctaattctaaaaatggacttcgatctaacgaaaaatatcccttatgataatctacttttcttttatatactgcatcaatatgatcatatttattcattgtctcataaacatcctgatcaacttcaacaaagcaatcttgattatattatttaggatacatttctctcaggtttaccctaactttagttgacatattatccctcccttcttcataaaccgagagaaacaactgtcgaactttaaattttataaaaaaaaagctctaatgattttggggtctcattagagcatacttaagttattcaatttttaaaagatttatgtgtgagtttatcttctttttttaatttgtttgtactgaattttcttcttctaatttttgtttttctaataatttaaagaatggataatataaaaccgtgtctaaaataattaaaccaataaccataatagcagctttaaaatccatacatccaagtgcggctccaagtggcgctggtgttgtccatggtgtttcaataattccttttcctacaatatggaaggccattaagccataagcaataattgaattgattactggtacaaagataaatggaatcatcattaatggatttaaaaccattggtaaaccaaagataatcggttcattgatattaaagattgcaggtccaattgataattttcctaatgtctttaattctgctgatttagatctcaacaacaagatacaaagtcccattgtagctccaccaccaccaagtgtaataacatatgaccagaatgattgagtaaagtaatgtacgattggttgtccagcagagaatgctgaaatattagcaatcaaatacatttgcataaatggtaaacggattggttgagtaatacttgctccatgtaatccaaagaaccagaatacttgagcaatcatggtaattaaacaaataccaactaatgaatcaagtcctgaaattgcaggtgctaaaactgtcatgatcatacttggtaaaagttgtccgctaaagttttgtacaactaaagaaagaccataaaaaatgattacacaaataaataatggtaagattgcatcaaaagatgaactgattgctggtggaacaccttcaggcattttaatacgaatgtcttttttaaacataaaatgcataatttccacacaacctatagcaaccaagattgctgtaaagatacctttggcatccaaataggtcgttggtatgtaattaccagctaaagctaataagtctgtggcactttttccatcaacaataagatttgatgctactgctgaagttgttggtgcagatacaattaaaaatacggcagttgatacgattgctgaatttaattttggcatttcgtattcatctgctaaatgataagcaattgcaaatgcaataaataaccccattaatgccattgtcatattataaggtaattgcaacattgctttgttagcttgcgcccaattataccaaccatttaacatatcagagacaaatccccaatttggcaacgtttctggtttaaaaggtggtgtggaaataattaaacatacccctcctaaaatagataacggaattgctactaccattccatcacgaatagctgctaaatgtctttgattccctaatttgttagcaattggtacaagtgtacgatttgcaagttcattaaatttttccatgaaattcatgaaagttccctcccttctcttgctacagtgaaattatataactgtaaccgcttaaaattcttttgatttccacaacaaaaaacatctttccaattacttgaaatcttttccaaatcatggaaataaattgttttattttttttattggcatttatttttttatgttgacactccctttttattttttataatgaaattgtgtgtgagttatatcttcttataaaataggaggatatatttatgaaattaatcattgaagaaaatgaacaaaaaatgagcgaaagtgcaatgcacattttacttggagcaatgatgcaagataaaagagtcaacatctctttaactgctggacgctctcctatcaatctttataagatgatggttccttatgttaaagaccaagaaaaattcaaagacattcaatactatctttttgatgaagcaccttatcaagataaaccatatggcccaaactgggaagaaatgcaagaactattctttaaagatgcaaatatccctgatgaaagaatccatacaacaactatggaaaattgggaaacttatgatcaagaaatcagagatgctggtggtattgatgttatgttgattggactaggttgggatggacatttctgcagcaactgtccaagatgtacacctatggatagttatacttatccaatggatcgtaaaacaaaaaatgcagctaatccaacatatccagcaagagatcatctaccaatcactttatcaatgggaccaaaaagtctaatgagagtgaaacatcttgtaatgattgttactggtaaagaaaaagctcaaattttaaaacaagtgttagattcacctatttcagatgaactaccagcaactgttttaaaattacatcctaacttcactgttatctgtgataaagatgctgcatctttattaaatatggatgattataaaagattataaaatctttatagaaagcttcggctttctttttttatttccaatgtttggaaataatttctaccttttgaaaaataaaaagtaaataaagcgttcatttgttataatttttctatcctggaggactacttatgagaaaaaataaaacaaaaaataacaaaagcaataaaaacagaaataatatggatattatcgaaacacgtgttagaagatttgtagctatgatcatcgattggtatcttactaacatgctggctgttatccctattaccttctatttaagaggaaatgactacttaaaaccttatatgtttgatttaacacactatgatttttctataggtcttgctttaggtctttatggtgttttgattggtattatttactatgtatttattccaacatatctttttaaaggacaaacacttggtaaaaaaatatgtaagatcaaaatcattaaagaaaataatgaatcaatcaatttaaaagatatgatgttaagagaacttcttggagcatccttacttgaaggtgggatgattatcatcccaacctatataagaaagctacttccattatttaaacttacaatgattgttgatcctttaaaatatattgcctatgctttaactatcggttcaattatctatgcttatttccaagcaaatacacaatcttttcatgataaagtagctaaaactattgttgttaaacaataattaactatggtataattatgcaaaatatacataaaggagattcttcatgtttaacctaataattatacttttatcaacacttaatgatgaaccaaaaggttcaaataactataaaatagctaaatatatgatagaaaatatgcgcgatttagaagaatattctctcacagatctagctcaggcttgctatgtgtcaaattctagtatttcgcgcttttgtcgtgatattggacttaaagatttcaatgcattgaaaaatcaaatcgcaaagttttctgttgagtctgctcgcttaaaaagaaagtttgactatgaaaaatatgaatcctcatcaatgtttcaatcatatgtaaaaaatgttatttccaatttaaattacttcttagaaaatgatattgaaaaacaaatcaatacacttgttcaagaaatcagttcttatcagaaaatagccgcttttggctatatgcaatctgaaagtgttgcctgcaatttacagttcgatctgcaaacaagtggtaaacttatcttttcttgttttaatatcaaagatcaggcagactatattactgacgctgatgaaaataatcttattattattttttcagaatcaggaacctattttgatcgtatttttccaagagccaagccattcaaaagtaacaaaaagaaaccaaagatatgcatgattacttctgaccagtcaatagaatatccatttatcgatttctacatccgttataacagtaaaggtggctacgcaagtcatccctatccgttacagcttatttctgatctaatcagtatcagatattctgaaactttataaataataaaaaggtttaccatcgcaaacctgtttatttttatataatagggtctaaaatttgttcgagtttgaaatttccatttgaataatcaacaatcattactgaagcattattaggaaatttaaaagattgttgaggtaataatgatttgataaatccatataacgaacagccgtgccctacaattaaaacggtatccttttcattacaatcctctatgatttcttgaagtgcttcatgatgttttgaaataacatcatgaatgtcttctccttcataaggtctgtaatccatatccaaatcttctaaccagtttggtgattcaatattgagttttcttacaagttctgtggatattccttcaagtattccaaaattaacttctttaaaacgttcttcataaatcggttcgacttcttttttacttagaataatatttgacgtttgtactgccctacccaatggagatgtgtatgccttatctatttggtattgttctagctgctttgaaatactttcaacttgtctgattcccacttttgacaaaggagaatcacaccaaccctgtgtcagattgatttcattaaaatgtgtctttccgtgtcttacaaatataaatctcattataacttacctttaaaactaaaacgtaaatgatgtttttctttatctaataagaattcatcatgtgtcttagcaccccatgtatcatcaccagcaacacccatttgtttttcattgatacataaaaccgtttgataaacatttggaagttcatctttgtgacgcgcattttctaattcataaggtgtatagtgtaaagctgtaaattcaaagtcttcacctttgactgttaattttgtattttcacctgcaactgataattctctgacatgtgttctgttaccacattcttgtggatataaataaggtgttaaattgtctgttacttgataagtatattttccaagaagtgcccctttgtttcgatcaatatagttttcttctggaccaaatccataataatttacttcttccatatctttatataattggaagataagtccaaatacaggcatttcaatttcagaaacaaccggttgataagacatatctacaatgattttaccatcaccatagacttcataaactaaatgaaccttttcatcttgtaaatttggcaaatcataagcatattcaatcttgcaggaacagtctccttttgaaataccaacaaactcacattttgcatatagactggcagttaaccatttaccatagcgataaccatatttgttttcaacatcattatttgtagctgctctaaagaaatttggtctgacaggtactctaatatattcttgttgatgatatctataagaaaccaaacctttttgttttgagaaaatcgcattgaaatcttttcctacaacgcctacattcaaatagtcttcaacgatatctacatgttttgttgtatgaatgttatgtgttttattttttacttcatagatatattgttgttgagcgtatatttcatgattctttttcaaatagactgttactgcacattcttggtcttgatcatttattttaaatggattttcaacaacaactgatgataatggtttacaatctactgtcattgttttggtttgaacaacattaccattgcataacatatccatttgtaattgatattcatttaaatctgtaaacagataattattgttgatatgaatatcattttcatctattctaaaatctacatattgataacagtatttgacttcttgcatctttggagtatttgtacgatctgcaaaaacaataccgtttccacagaaatcatagtcacttggtctttcgccaaagtccccaccataacataattttccatcatggtataatgcttgatcgatgtaatcccagatgaatccaccttgatacaaggaatatttcttttctaaatcaatatatttgaataatgctccattactgtttcccatagaatgggcgtattcacataaaataaatggtttatcttgatgttcctttaagtatttttcaacatcaactgcaaaagtatacatttgactttcaatgtcacttgtttcattgtaacgacgatcatgtgaaagtccttcatagtgaatcaaacgtgaagtatctttttgcttcataaacttagacatttcataaagatttttaccaccataagattcatttcctaatgaccaaataataatcgaaggatggtttttatctctttcatacatggaattggcacgatctaaaataatatctagccattcagatttatcatctggtatgatatgtgttttatcaaaaagttcactccatgttccatgtgtttcaagattaacttcatcaatgacataaagaccatattcatcgcataaatcataaacaaatgtttgatttgggtaatgacatgtacgtaaggcattgatattattagctttcatattcaagatatcttttttagtatcttcataagaaaccgttcttcctgtcttagcagaaaattcatgtcggttgacaccatgaaaaacaattcttttaccattgatacacatgataccatcaataagtttaaattctctgacacccacattgtattgactacattcaactaaacccttttcatccatgatttctacatataattggtaaaggtttggtttttctgctgaccataaatgaggatcatcgaattcaaaattgattggactgcaacaatctttgctttctttttgtccaataacttcatctttatactttaaagtatagactgccttaaatttagcctctttttttacaatcattggcgttacttcaacagttgcatgatcataattttcatttaaatgtgtcaaaatcttgatatcttttaaatgaacgtgtggtaccatttgaagttcaacatttctaaaaatacctgaaaaacgccagaaatcttgatcttctaaccaacttccactgctgaaacgataaacgttaacagcaattttgttttctccattaacaatcaaatctgtaatattaaaacttgaaggtgtaaatgtgtcttcactgtaaccaacaaatgttccattgacccatagagccatggctgattcaacaccatggaaagtaatataagtatcgacattatctttgattactgaactgtcaaaataagtgacataacttccaattggatttttatcagggagttctccaggaatgatttgttgtgttcctgaccaaggatagatttgattgacatacattggttttccatatccttgtaattgaatatgaccaggtactttgatttcatcccagtgatctacacaataatctttattagaaaactccggtattaattgattaaatcctgttgcataatgaaacttccagctcccatttaatgaataattgaaactgctttgtttttcttttaattctttaatacttgcatatctatgaatcgatgctgttgctcttaaacgattgacattaaaaatctttggatctttgacccattcatttttcatttccatttttctttcctcctgactatattataaattaacccttaaaaatagaaatggaacaaagtataatatagagtaaaaaagtataaatatgttttttattcattatatttctacctatttatgatataaaaagaaagaagtataataattataagcttatattatataaagtatggagaatattatgaatgaattagaaaacttattaaaagatttatataaaatatcaggtttgaatatgtctatatttgatttgaaccaaaatttattagcttcttatcctcataagaaatcaaaattttgtaatgaattagaaaaaaacaacaatgcttttcaacattgtattgattgtgattataaagctatggaacatgtcaaaaaaacgggtgaactttatatttataaatgtcactttggtttaaatgaagcaattatgcctctttattcttatggaagtttaactggttatttaatgatgggacaggccgttataggaacatatagaaattattctgaaatcattgaaaaatctaaagaatattttcaagataaagaaatattaaaaaaatatatcacagaaattacaattttaaacgaggaacaagtttatgcttttgcgaatatttgtgatgtatgtgcaaaatacatttcacttacaaaccgtatccaagcaaaacatgatcatcttgcccaagaagttaaacactatatcattgcaaactacaataaacaaattacaattgaagaattatgttcttattttttctgtagtcgtggaactctacttaatcattttaaatcaaaatacaatacaacaatccatcaatatcttttggattatcgtttaaaaaaagccacagaacttcttataaatgatgagttaaatgttaaagaaattgcctttttttgtggttttgaagatcctaattatttttctaaagtatttaaaaaaagatatggtcaatctcctctagaatttaaaaacaatataaaccagtaaaaaaagcccttagatttctctaaggacctttttaactttataataattttattcgacaccaataataaatgaataaacaggttgttttccttcgataatatctacttctgcatcaaagttatcttcaatgtagctttcgatttcttctacttcttcatcaacaacatcttcaccaactagtaaagtaatcaattcagaatcttcatctactagtttttctaaacacacttttaaagcatctaatttatttggtttacatgcaacgatatctttttcgactaaagccatgtagtcatttgctttaatttcaacaccatcgatgtttgtatctttaatcgcaaatgttacttgtccagttttaacattagcaacagcatcttccatttcagcaatattatcttctaatgaaacttctggattatacataacacatgctgataatccttgaggaattgtttttgttggaataacaataacattgacttctccttctaagattgtagctgtttgttgagcagtcattacaatattagagttatttggtaagataataacatttttagcgtttacttctttaacagctgcaaccatatcttcagtagatggattcattgtttgtccaccacttacaacataatcacaatgtaattctaagaatgcatcttctacaccttgtccagcacaaacagaaataatagctgtttctttagcttcacgtttttgaggtttgctatcatcaacacctacaatacttccttgatttgctgcagcattttgtaagttatttgcttgttcttgcatattttcaatttttaacttcacaaattcaccaaatctttgtgctaagtttaaagcttcacctggttttaatgtatgtacgtgtactttaacgatatcttcatcttgtacaacgacgatactgtttcctggaattctttctaattctttctttaattggttttctgagaatttatcaattaatgaaggttcaagacgaacaataaattctgtacagtatccatatccttcttcaccagattctaattcagttccagcattgacttgaccttctgatttaatatcaacaaaatcaacacgatcacctgataaagcagccataaatccagttaaaaccaacaataaacctgctccaccactatcaacaacaccaacttcttttaatactggaagtaattcaggtgttctttctaatgaattttctgcttctttaacaaaataagagaaaacatcttcaatttccatacctggttgagtatattcaacgatcttttcacttgcttctctaataacagttaaaattgttccttcaacaggtctcataacagctttataagcaacttctgccccacttttccaagcattggcaaaagcaacagcatcaacactttcatgaccttctaagcccattgcaaatcctctaaagatttgtgataagataacacctgagttaccacgtgctcccattaataaacctttagataattttttagcaatatcataaatattgtcactatccatatctttgatttctgctgctccagcattaaaagtcatagacatgtttgttccagtatccccatcaggtacagggaatacatttaaagcatctatttcaggatgattattatgaagagtattcgcaccacataaaaccatctctttaaatagctttcctgtaagtatttgcatatttttcctccactaatcgatattacgaagtccttgaacataaacattaactgcctcaactttgacatctaatgttgattcaacaacgtatttcactttcttttgaacttcaactaaaatttcattaattttaattccataccctaaaatgatatataaatctaaaattaaaccagtttctccatcactcgcaataattcctttagaataattttctttctttaataattcataaaatccatcttttaatttcttttggctagccatacctactacaccataacattcagtagcagctccaccagctacagtagaaactacatctaaagaaatatttactgatcctaaatttgtatttttttcaatcatcaagttatcctccttaaaatgatttcatgttcaaacattattataccttaaaaatataatatttacaaattataatcactcttttagtatctttccaaccgcaagccatcatatcacatattattaaaaaaaaatacaaattaactcatttttatcattatataaagtatttataatcacaaatattgataaaaacagcttttttgtaaaaaaatgtttgcattatactataaataatgttaatataacacagtacgtagaacaactactaaaggagggaaagaacatgtcaagaaaatgccaaatcagtggtagaggtccattatcaggaaacactcgttctcatgcgttaaactcaagtagaagaaaatggaatgttaacttacaaaaagctactattttagtagatggtaaacctacaaaagttagaatttctgctaaagagttaagaacattaagaaaagctggataatagatgaagacagtacatagtactgtttttttgtttataaacaacttattaaaaaacaaaacacctgtagaaagtataaacaatacaacaaaagcaaaatcttattttcaaaaaaaagacatcgatcattaccttaaaagcaataaatccgatgtcttttatctttaactccaaattgactataaaagtctataacacattttattaaatcataaatcactatatagccacacatttatatgtgttatatagcttttattatttaatcttctttatttcttctttgaagtgcaatataacccccagctgttgccataagtaaaatatatggtacaactgacatatcatcaccagtttttatatgagagttattttttgttgatgatgttttattgtcatcttcttttttaatacttgtttgtatttgatcatttggtttttgatttggttgatcattatttccagtttgagaaactgtttttaaattcttaatggcatcttgtagagatgctaaagcttgatcaacttcatcttgagttgtattttcattttgtaaaacatcttttgcatgatctaatgcttctttaaatgctttccatgaatctaccgtataatctttttcaacaaaatcattagttgtttcaataacatttgataattcttttttatctactattacaggagcatcaattaatcctttaatagccttatctaaatcatcataagccttatcaacttgttcttgagtagcattactatcttcattaacaatgattgcttctaataaagctttttcaaatcttgaccatgattcaatagaatagttattattttctatttcttttgcatcattaatcttatttgttagtttttctttgtttgaggtaactgtatctcttaatgcattgattgcattacgtaaattattagtttcttcagttacatcaacttttccttcaacataagatttttgagcaacaattaatgcatcaatcatttcatttactgagccactagatttaccagtaatatttaatgtttcagcttctaaaatcatatcttttaaagttgaatcttcaggtatttcttctaattcaaacttaacttctgcaatttgataccagttccccttaccttcagtaaggacaattctaacatatttagtcaatgtcttatcaaaagtaatagttttttcaaatgctgaattatctaacgttcctactgttgtccaattttttccatcagtggagatttgcacatcagcaccatcaattatatcttcaccagcattgcttggttgaatgatttggatagaactaatatttattggacgagtaaatgtgaatttaacttctttaccaatttcttggttgctattaaaccaacatttagtattaatattaccatcaatcatattattgtagttattagattgataataagtatcagttgctgaaatagttggaactttagcattaggtttaactaatgattgcttagctgtttgaattgcattataagcttctttagctttttcaacagttaatccttcactattaagtaatgtttttcctgtagttacagcatttttataagcttgatatccacttgaatagtcactttcatttaatggatatgtaacttcaacatataatgaataatattccaattttacagctttatttttagcatcttgtaatgctcttaatgcgttattaacagctaattgtccacttgtttcgtcaaaatatatttcttttgccattgttaatgctttattataatcagctacagtttcattaatatattcacttactgctaatggttcaaatatttctttttttaaatcagttttatcacaatgtaattgatattttaaagtaattgtcatattaccgttatatttaccatctaatggtaaatctgattcaataaaactatatccaaataattcttttgcttcaaaatgatactcactatcatttagaccatagaatacatcatctgcagcaatagtcttaccaaaattatcaatatatttgatagtaactgttgctgtatcttcaccctggaacacttcacccggagcaggtaaagcctcattgaagcctggagttcttcccaatttatcaacagcagctttaaaaacatcatagtctggttgattatcgttcgcgttccacatcttataagctgttgcacgtgtgcgatgatagattttatcttctacgctttgttcgctttcataatttggatcatcacaccaaactgcgtaagaaccacccactacatattctggataaggttcttcaaaagtttgtgctgttccggataagttagagaatttaccaggatgccattcattataaatacgatcaccttctggtactgcattagtttgccaccaccaagaaagtacatagtacatataaacatcagaatagttgattactttgttaccattagcaacaaaatccgctaccgatgcacagttttcaggagctgcccagtaacaaacttcaatgtcactatccaatgtataaccctcataatcaccaaataataaaccatcattccatgctcttggagtcattccgttatctttaactatcttagaaatatcattaaaatatgacataatttgtccgtattgttcattactaaaactagagaatttagctaagaactcatcaccgccaatattaaaatgtttacatcccgcatcaccaaagaattcaataaattcagtcattaaatttactaagaattctctagcttcaggatttgtaaagatattaaagcattgatttcgtcgagcatcggttgggaatagttctctacaactgtaatcagttggcagatattgtaaaactgctcccgagtgacctggagaatctaaagaaggcacgatttcaatatgataatcattagcaacttgaataatatctaaaatatcttgtttacttaatacatcatcatatttatatttaaatccttcgattgcatctagagtatcactttgaattctaaatccttcattttcagaaaaatgaagttgaaccgcattatatttttgccaagataaatctttgatttgacgaattatccattctttagagaatggtttacgagcaatgtctaaatgcattgaacgtaattcaacatctggataatcaataacagttcctttctctaatattttatcattaatctttaacatttgaattactgacattaaaccataataaataccaatttcatctttagcggttactgtgattttatcagtaatatctaatttgtagctttcagcttttccttctaattcagccacatcctccattctaacaacaatatcattaactactgcattttcttctttaccgaatactattattggggctttggataaaactccagcggcttcaaaatttgaactagttaattttaaatcttttaataaaatagtattatttaatgttttttcatttgctactacaaaaattcgactattttcagcaagagtaaaatcttgccccgcttctttagtatattgttgaacatttggataagtcattaatgatgttgttgcaacattgcctttagctaaaactacctgaaaaccgactgcttgacaaataatagcaactaccaaaagtgccggtaaaactactttaagaaacttattcttcgatacttttcctttcattttctactcactttaaattaataaattaatacatatactagtttttattaatgatgtaaattaggtatataaaaccaaaaaccttatctaaaactttaatttatgctaattattatcaattgttttatcaataatagaatattagtaaattattataatagaatagtaattctgctatatttgtgaatgcctatttaagcgagtcataaaactataaataataccccttaacatcaacattaatcattcaccagtattttacgtattatttaagtactaatttaacccctttcctaattttctttttaaactgcgaacatccgtttaagcgcttacatttctcgctaaaaaaagtggttaggtttaaataaaatgaccgtatttttttataaaaacctaacatcacattcacttctataagaatcatatcatgatataaatacatattcaataatatttaacatattatcccgctttttgtgatttttttaacaattaataaaaaacataacaaactactacaattacaaaaaattttttatccattaataaacgcttaaaaactgtattcatcccaaaaatccagttatcaatacaactataaaagccaaaaaagtgagatgaaactgaactcaccccactatatttactcgctattctatcttttaaatcctttcttaaatgattcaaagatagattcttttttacttaatttttgtaattgttcatacaatgatttttctttactagaaagttttgtaggaattttaacttcaaccttaaccatttgatctccgtatccgtttcctcttaaatctttgacccctttaccttttaatcttaaagttgttccagattgtgttcctgcaggaattttaactttcacgtcaccttgtactgttggtacatctacctcacatcctaaagttgcatcaactgaactaataggaattgtaacataaatattacgtccttcacgaataaagtgtgtattgtttcttacacggatttctacaaataagtcaccattagatccaccattagatcctcttccacctttaccagcaacgcgtaattgttgaccatcattgataccagctggaatatctaattgaacagtaactgttttagtaatatatcctttaccatgacagtcaggacatttaactttaatttctttaccagtaccattacaatgtggacattctgcatcataagttactttaatatcttttttaacaccattgattgcatccatgaaatcaatttctagacgcattaaatgatcatcaccacgacgtggtccattttgtctttgacgacgacttcccccgccaccaaagaatgatccaaaaatatctcctaaatcgacatcttcaaaaccaaatccaccaaagccaccggctccagcaccacctgcaccttgttcaaaggctgcatgtccataacgatcataagccgctcttttattatcatcagataaaacttcgtaagcttcttgaacttctttaaatttttcttctgcatcaggttctttacagatatcgggatgatattgttttgcttttttacggtatgcacgttttatttcatcagcgtttgctgtttttgaaatccctaagacttcataaaaatctcttttacttgccataaaatcatcctttctataatacttttaaaaaaccaaggaagaaccttggttttttaagtgattagttcttttcttcgaaatcagcatcaacaacattatcatcattgttatttgatgttgtttgtccagcaccaccattagggtttgcttgttgttgttgataagcatatgatgccatttgttgagccatttgttctaattctgacattttagcttcaagagtagccatatcattgttatctaaagcagtttttaattcagtttttaattgttctgcttgttgtttttgattagcatcaatcttatcaccttgttcagctaaagctttatcaatttcattgatcatttgttcagctttatttcttgtttcgatatctttacgtttcttttcatcttcagctttattagcttcagcttcttttaccatacgatcgatttcttcatcagataatcctgtagagttttgaataacgattgattgttctttttgagtttttaaatctttagctttaacatttacgataccgttaacgtcaattgagaaagtaacttcgatttgaggtactcctcttggagctggttcgataccatctaatttgaataaacctaattgtttattatctctagccattgatctttcaccttgtaatacgttgatatcaacagctggttgattatcagcagcagtagagaatacttgtgatttagtagttggaattgtagtatttctttcaatcaatactgtcataactccacccattgtttcgatacctaatgaaagtggtgtaacatctaataataagacatctttaacgtcaccagcgataactccaccttggatagcagcacccatagatacaacttcatctgggtttactgatttgttaggttcttttccaagtaaacgtttaacagattcttgaacagcagggatacgagtagatccaccaactaataatacttgatcaatttcacttggttgcattccagcatcacttaatgcttgtctaactggtccttcagtagctacaactaagtctcttgtaatttcatcaaatttagctcttgttaatgataattctaagtgtaatggtccagcagcaccagctgagatgaatggtaatgaaatttgagtttgcattacaccagataagtcttttttagctttttctgcagcttctttaatacgttgcattgccattttatcgttagataaatcaataccattttctttcttgaattcatctacgatgtagtccatgattttcttatcgaaatcatccccacctaatttattgttaccagcagtagctaatacttcaaatgtaccatcagctaagtctaagatagatacgtcgaaagtaccaccacctaagtcataaactaatactttttgttcttggtctaatttatcaagaccgaatgctaatgctgcagcagttggttcgttgatgatacgttcaacatctaaaccagcgattttaccagcatcttttgttgcttgtctttgagcatcattaaaatatgcaggtacagtgataactgcttttgttactgtttcacctaaataagcttcagcagttgcttttaagttttgtaagatcattgctgaaatttcttgtggtgtataagatttaccatttacgttttctttatgatcagtacccatataacgtttaactgacattactgtatcagggtttgttactgcttgtctttttgcagcttccccaacaataatttcaccatttttgaaagatacaactgaaggtgttgtacgatttccttctgggtttgcaattacttttacttcattgttttctaacacacttacacatgagtttgtagttcctaagtcaataccaataatttttgccataatataaatcctcctattttattcacttacttttactaaagatgcacgaataacgcgatcttttaacatataacctttttgtaactcttcaacaaccataccaggtttaaagttttcatcacttacagtcattactgcttgatggaagttaggatcaaattctttaccttcagcttcaatcactttaactccttggttttctaataatgtcatgatttgtttataaatcatttcatatccttttaagaagtttgccacttcttcacttggattttcaattgctaatgatctttcaaagttatcaacgattggtaacatttgttcaataaaaccttgcatcatgaactttaagttatttgcatgttcattttgcatacgtcttttaatgttttccatatccgcaaacactttataataatcatttttccatttatcaacttcaccttgaagaattttaatttgatcttcttgatcaactttttcctcttcaacaacttcagcctcagcttctttgttttcttcaacttcttcagttacttctttttcaactttagtttcctcagccaatttgttcacctctatttctcatcttgtttatcttctaaacaagccttttcaatattttcagatatatactctactaatgccactactttttcataaggcattcttgttggaccaattaccgaaatagaaccttttgatgtttcccctgttttaaatgaagcagagattactgaaacatcattcatttttcctagaggtgtttcatttccaatattgatttgaataccatcctcactcgataacggtagagttttccacacttttgaattttcaaaagcacttacaagtcttcttaatttatccacatcattaaattctggttgatagagaatattttcttttccagaaaaataaacactatttgaagcaaatttaacgaatgcttccaaaaacgcattaaataattcttcatgttgcttcacttgcgttgtaagaattggtcgaacatctcgttctaaacgaaatgccacttcactgataggtgttcctatcaataattcattcatcacattaacacaacttaataaatcttccatttctacatcacttgaaaattggaaaactttattttcaacatgaccttgacttgtaatgataattgctgttacacgtccatcatccaaaggaacaacagagatgcgttgcaacatatcatctgaagcatttcctaatgcaacacttgtaagatgagttaattcactcaacatgttacaactttcatgcaccatctcatttaaatttcgacgatgcttattaataattgtagcaacttgattttttgttccttcatccaaatcaacttttcctaagttatgaacatagaaacgatatccttctttagaaggtactcttcctgaagaaatatgtgttttttctagataaccataattttctagaaagttcatttcattacgaatcgttgcacttgaatacggtagttgatattttaccatcaatgccttggatccaaccggttcagcattttcgataaattcttcaactatacatttgaatatcagcatttgtcttgctgttaacatcaagttcaccacctttagcactcctatttctcttgtgctaaatacattatacattttattttagcactgtcaacaacttggtgctaaaaaaataaaaaaatagcattcctgctatttcataaaatcaattaatatatcatttaaaacatattgcccttcttgcgttgcttttaaataatcattttcaatcatcaatctacccttttctatatttctagtaaccgcttctttatatagaacacaagcatcttcttgatatctttctttaaatttttttaaatctaaaccttcttttaaacgaagtgacatcattatttgattaaacatcgtttcttcttttgtttcatcaattgttgttgttttaaaatcaccatttaaatatttagtaagtgatcgactatgttctataatttgtccatcaattttactacatgcacctaatcctattccataataattatcataataccaataagttaaattatgctttgattgataaccttgtttagcataattagaaatttcatatttttcaaaacctattttttctaattcttgatcaatgaataatgttaattgatattcgctttcttcatctaaaggttgataatttttatattttaaaatcgttccttcttctaaaatcaaagaataataagaaacatgttgtaaatttaaagtttgtaaaacttctatatccttttgaatatcttcttttgtttgttttggtaaaccatacatcaaatcaattgagatattatcaaaacctatttctttagcgtatttaataatattttttacttgtgttgtattatgatgacgatctatttcttttaataaatgatcttgaaatgtttgtacaccaatacttaaacgattaatgccacttttttttaaaatctttaacttataataatccattgactctggattaacttccatacaatattcttccacttctaaactataggtttttaacattgacattaatttttctaattgttcatcatttaaagcactaggggttccccctccaatataaatcgtttttaaatgatgttgctctatttgtgataattcttcatttaatctttgtaaatagagatcactttgtttttgatcataatagaccttgcaaaaatcacaataactacaaatagattcacaaaaaggaatgtgtacatataaacttctagtctccatcttttaaaccaaattcctttgctagtccacctaaagaagtttctttataagcactatttaaatctttccctgtttctttcataacattgacaattgaatcaaaagaaactttattttttcttaaatatcctaattgcttcgcataacttgctgcatcgattgcacgtaaagctccaaaaccatttctttcaatacaaggaatttgaacatagccaccaaccggatcacatgttagtcctaaattatgttcaagacccatctcggcagcatattcgattaaagaattgttaagttctaaaatccaaccatacgctgccgctgccatcgcgcaggcacttcctacctctgcttgacatccgccatcagcaccagaaattgttgcattatgtttaataacatttccaaataatccagcaacggccaaagctttgatcaattctttacgaggaatctctaattgtttataacaataaaataacactgctggtaaaattccacttgctccacatgttggtgcagtaacaattttattaccacaagcattttcctcagaaactgcataagcatagcttgaaacaagcaatctttctcgatcactttctcttcgcgtattgatagcttgttgatacatacttttagcaactctttttagttgtaaccttccaggaatcactccttcatgatgtaagccattttgtacacaggtaaacatactatctaacacttcaaataagtaggccttaaaatgttcatcttcataatttaaaacataatcatagaaggaaataccattgtcttcaatatattgaataatttctttaagatttttatgaggatagatttgttttgtttgttgcaacttacttccttcatattcaacagttcctccacctatagaataagcagtaattgtatcaagaatttcttcatcttggtacacataaaatttcattccatttggatgataaggtaaacgatcacttttaaaacgaacaatcgtttgcttgcccaatgtttgtttaataatataatctgttaaatgacctttcccagttaaggcaagcgacccatataattcaacttcaaaacgtgaagcatttggatattgttcttttattttagaagctgctctttgcggacccattgtatgtgaagaggatggtccaaatcctatcttaaataattctcttaatgattccataatttctcctatattcttaacataaataattctaagcctaattttttatctatttgtcccgtcttaattttaacatccaataaagataattcatttaaacatctaagtagttcatctatttgaaaaaatcgaccttcttttcttacatattttaaacgaaaaggattaactgccaacattttagcaatttcttgatcagtatacccttttctatctaataattttacttgataaatcaaccgcatagaattagctaccaaaacaatcaatttaactggttcttcattaattgtcattaaatctttataaatagacatcatcttttgtttatctttacttaaaatagctgttgttaaatcaaaaacattttcatctaaggggcgactgacaagttcttcaacacaatgaatatcaatatgctgtgtatataaacaaagcttttctacttcactagcaatatccattaaatttgttccttttctacttaaaagtaactctaaagcatcatcatcaatagtacaatttctttttttaacagcctgtcttgctgtatcagaaactttataataatttaaaggattgatttcataaaactgtgcttcttttcttaacatcttgacaactttttttctttcatcaaaatttttttcatcattaaaaataacaagatgcactgttttatctaaataaggtaaacattgcataaaataatctatatcatgattatctttttttatttttttggttgttagaaaatctgcttttttaataacaaccattttttcatcacttaaaaaaggaggtgtcattacatcttctaaaacaactttcattccctctttagaaacatcataaactgtataattcatccgttcttgattacaatgatgatctttttttaacttatctaaacgttgatccatcagtaatctttctgttccatataatacatataacatatcatcaccatagatattataaactaaaaaccacttgaagtcatgacataattcttacctccataataaacaatcttaaccattccctgaagatcacttcgataaattttcaccccatatgcttccaaacgatttaatgttaaataagatggatgtctataacgattattctttcctacagaaataagcgctactttaggatcaatcattttaaacaaatcatcacttgaagaactgctacttccatgatgtgccacttttaaaacgtcgacatctaaatgatgatatatctgatataaatcactttccacctctttagaaatatcacctgtaaataaataatttaaacggttgatagtcacgtaaataatagaagagcgatcatttgaatttgtataatatttatctaaagctaaatttttaaaaactaaatcgccaattttcttttttttaaaatcatagataacctttttaactttaaaatgttctttcaaagacgctaacgctccacaatgatcatagtcttcatgcgaaataaaaacggcatccaaataaaaaacaccctgactttgtaaataaggaatcaaccgagaagtcgcaagatcactcttttgtaatcccccagtatcaatcaatacatttcctctggcataaggctgttgaataaaaaaacaatccccttgacccacatcaatcatcacaacttgtcctttcatgttgtaataaggataaaaataaaaagcaagtaacacacttaataatagacatacttcttgggttacttttctattgacattcaatttataaattccttttaaataaagataataataaacacctataaaaaataaagtcggttgactaaaaggcaatgtaaaagaaaaatcataaataaaagcaatcatttttaataacaattcatattctaaagataaaaaaggtaaaatatattttccaagtaataaataataaagcatacttttataaatcatttctatataaggcattagaagaatacctattaaaaaagaaaacaccggtaaaacatgttgaatagaaataataatgggaattgaacctaaaaataaataatatttccctgctttttgattttgtaaaagtaaaataaaaaaataaatcaaataagaaaaaataaaagataaattataaaccaaataaggattatacattaacataccaactgttaaaaaagaaaaaatatccaactgatttaaccatttaccaaaaatcattggtaaaaaaagcattagatacgctcttaaataagaaatattataaggaatactaaacatgtaaaccccaatcaatataagagatatacatttttgtcctttttttgaaaaaaagaattttaaaaaattcatcaaccatttctgtaaaattgtaagatgcatacccgaaagagcaaataaatgaacaatcgagagttgcgttaacttttgataatattctttcatttgttcatcttttgttcctaaaataaataaagacaacagactttttactttggaagatgtcttgattcttttttctaaataatgatatagatgatcttgatgttgattactttttattttttcaagttgtaaagtatcaaaaatatttaaactatataaataatattgataattaaacgcataatcattttgtatttgatggaagttataaggttttcctatcaaagaaatgttatcaaacaacgaaatatttttaaattctccataaacctttactttatgataccccctcttgacaacaatactttgatcatccttacttacgacctttcctgaaatttcattttgatttaaaggttgtggtaaataaaaaaagagaaataagagaaatgataatagtaaacttacactcaatagtattttaaaatgttttaaatacagaaaaataaaataaaaaataagaaatacatataaaataggatgtaacattttagctaaaacaaccaccaataaaggaagtgctagataaaaaccttttccttttataaacataaatactctcttaatcgaagatatgtcttttcaccaattccttgaatattcattaaatcttcaattgtttgaaatggtgttttttgtcgatactcatcaatctttatggctgttttttctcctattccttttaatttcattaaatcatcaagtgaagcatgatttaatgaaatcagattttgaccatgaggtaaataaagtttactttcatttgtaagttgataattttcattaaattgataatggttatctgtttgcagttttgttaaaacatcattaattgttggttttgttttaaaggagagttttttttcaaactctccttctacataaatgacaatattttgtttggtttgaatattttcaacaatagctgttggctttacataactataaatgagagaaataaaaaataggacaataagtcctatcttttcaaaactattcataatcttgttcaatatttaaatgacgataagcctcagctgttgctatacgtcctcttggcgttcttttaatcaaaccaatttgtaataaataaggttcattgacatcttctaaagtttgtggttcttccccaatagatgcagcaattgcttcaagccctacaggtcctcctttaaaacgatgaatgattcctaataaatacttatgatcaacatcatctaatcctaaattgtctacttttaatctttctaatgcttcaattgttctatctcttgtaattgttgcatcgccgtaaaactgcgaaaagtctctgactcttctaaataatctatttgcaatacgtggtgtcccacgacttcttcttgcaagttcccttttagcatcatcatccataacaatattatacacacgacttgtacgatcaataatttgagtcagttcttcttcactataatattctaattttgaaacaataccaaaacggtctcttaatggtgctgataaatcacctgctctcgttgttgccccaacaagggtaaaaggtggtaaatcaattcttaccgatcttgtagatgcttcttttccgataacaacatcaacacaaaaatcttccatcgctggatataaaatttcttctaccactttatttaaacgatgaatttcatcaataaataaaacatcacctggttcaagagctgttaaaatagctactagatcccctgttttttcaatacttggacctgttgtaattttaatatgagttcccatttcatgagcaatgatcattgacatagttgtttttcctaaacctggtggtccataaagtaaaacgtgatctaacgactcatcacgaagctttgcagcccctacaaacacttttaaattttctttaagatttgtttgcccaatatattcatcaaaatcacttggacgaagcgaactttcatcatcttctacaatttcaggatctaaaacctcgttcatgttttccctcctatttaacaattaaacttaatgcttttttgacataaccatttgtatctaaattttcatctgtcaatttcttaacaactttatctacttcactttgtttataacctaatgcaattaatacttccatagcttcttccaattcttgattaacgacagtttgttttgtagcagttacttttccttgtaaatcaagaataatttgtcctgctgctttaggtccaataccgggtattttctttaaataggtcatattgccactttcaatagcttcacaaattccttcaacatctccacttgctagcattgtacaagcacttttacaaccaattcctttaactgaaatcaattttaaaaataaatctttttcttcttttaaattaaacccatacaataaaataccatcttcttttacttgttgataaagataaacaaccacttcttttcctttagaaaaagcataaggattgctcacataaatcaaataaccaatcccattattttctaaaacaatatgatcactttgaatatcaacaatcaaacctttaatataactatacatacatttctcctattactattatattataaaaaacgaatcatttcgtctcaaatttgtgtcaaatttgtctcaattatatcatagtatctattaactgaaaataaaaaatcaggcataaagcctgattcattaatcatagaattcgaattcaaaatcaagaatagaaacaacatctccatcttgacatcctgcgtttctaagagcttcatcaattcccatattacgcattttaatagataaacgtttaattgcatcatcacttactagagaagtcatggatacaagacgttcaatcttcttaccagtaattgtccactgaccattacctaaattatgaacaacaaatggtgcctcttcttcttcataattataaacaactgtattttcttctacttcttccatatcaaacttaggtgcagtttctaaagcatctgcaacagcatataatacttgatcaacaccttcatgaataatcgctgaaatagggaatactttaacatcttctcctactttttctttgaaagcttttaaattttcttcagcattttcttcatccattttattagctacgacaatttgtggtctttctaataaacgatattgatattgtccaagttcttcattaattgtacaataatcttcataaggatcacgtccttcaataccacccatatcaataatatgaacaataacacgacatctttcaatatgtcttaaaaattgatgaccaagccctttaccttgacttgccccttcaattaatcctggaaggtcagccataacaaagttacgaccatcttttgcttgaacgactcctaaattaggaacaatagtcgtaaaatggtaatcagcaatttctggtcttgcacgtgaaacaacagataagaatgttgatttacctactgaagggaaccctacaagtccaacatctgctaataatttaagctcacagcaaacatcaaatttttctcccggttctcctctttcacaaatttgtggtgcaggatttcgagaagttgcaaaacgcgcatttcctcttccaccacgaccacctttagcaagaacgacacgttgtctgtcttctgttaaatcagccatgatttttccagtttcttcattcgtaataactgtccccactggtaccttgattactaaatcacttgcatctgcaccatgcatttttttagccatcccattaccaccaggacgtgccttataaacacgtttatattttaaatctaataacgttgataaagatgttgttgcttcaaaaataatgcttccaccttttccaccgtctccaccggcaggtccaccttttggaacatgtgcttcacgtctaaaagccactgttccatctccacctttaccagcttcaatatatattttagctttatcgataaattgcatacttccacctctctttcaaaaaaaaatcccttttcagggatttcattatgcagctgggtaaactgatactttttttctatcttttcccattctttcgaatttaacaattccatcacacatagcgaataaagtgtcatctccaccttttcctacgttagtacctggatgaattttagtacctctttgtctataaataatagaaccagcagtagcgaattgtccgtctgataatttagctcctaatctttttgattttgagtcacgaccgtttttagttgatccaaccccttttttagaagcgaataattgtaaatctaatttaaacatcatgatgttattcctcctcataggttatcttgatatattgatgatagtcttctgtaaatgattccaaactaatcacaagagtctctagtatcacttgcattacttcatcattttcatacacatctatcattatattaccattttttaaaataattgcacactttttttcttctagaaatccctttttagcaagagtattgcaaatacctgtagccacagcacttacgccagcacacacaagatctttgccatattcgccaaactgggcatgtccttttattttaatttgcgtaatatatttattatttctttttatttgaactttaatcattatttaacgttgattgcatcaacaattaattttgtataaggttgtctatgaccttgttttttgtggtaatgttttttagcgttatatttataaatagttacttttctttctttaccttgtttttctacagtagcttctacagtagcaccttcaacgtaaggagcaccaatagttacagtttcatctccgactaataatactttatcaaaagtaactttttctcctgcttcaacttctaatttttctacgaaaattgcatcaccagcttcaacttttaattgttttccacctgtttcgataattgcgtacataccgcacctcctataaattttttctaagactcgccaaccaaggcagcaaacgcatttaatacctcttatgtgcggttgtagtctagaggtctacaacaagtgcattatacttaatattccaattaaagtcaatgcgatttcttagattttatcaaataaatttttattgtgtcaaaatcataaaatcgttgatgaaaatgatagatattttgataaggtcgaaaatattcaagatgtttatttattttcactctttttttactaagatgatcactcattaatgtttccatataaatcaaacgataatttttaagatataaaataacttgataaaataaatatcctaaaataatttttctccctatttgttttgtaataatccataaaatacaaataaacaatagtgaaacttttatttgtatttgcatggctttttgataatctatgaaataagataaaaataataataaaagttttgaaccatccaaaggataaactggaagtaagttgaatattaaaatataaatattgattttagctaacaatggttcttttataaaaagaaaaaaaataaaacaaataagattaataaatggaccacaaagaagcatccctatttcttcatagacataatgctttcctaaatcttttaacaataaaaaagccccaaaaggaagtatcatgattttttcaatttcaaaagagaaataaagagcaacgagataatgtcctatttcatgtaaaatagaaaaaagtaaaaaagctacataataagaagatcttgatataaaagctaaaaacaaataaagataagtaaggggatgtattttcattttacatccccaaatattcttgataagtgatttgttttcctaaatattcaaatatcattttaaacttttgttgatacaaagcaattgtatccccttgttttattttctgaaatgtttttacttgaatatcttttaacttagaaaaagtaatttccgtaccgttttcatctaaaatagttacttgttgtttttttacatcaatcactttaccgttattcattgcaagaacctgatttcctgttcctttataataatcatccttgatcaaggtatattgtaattcttgacttactttaacatcttctggtaaaaaatctaaaacactttgtgaaacaaaggtaatcaattgttgtaaatatttttgattaaatattttttgttcaagttctggatttttcaaaacaatcaacgaacctaaaacaacaatcatcatgaccatcaaacgcaccataccattataaagctttttgaaattatgatcattaagtggtcttttccttttttcaatgcgttttcttacatcatccaaatctgacatataatcacctattacatcatatgaaatcatcccaaaaagatacgacttaataaacctctccttttacatttagcaaaagctcttttatgtcctaacaaacgatgtgcgatattatcaaaacaatcatgtaaaagatgacccttcaacaaataaacagggcgtcctttattattagcttcaatcatttcatgatcttcataaacaattcctaaaagtggtaaggacaaaatatctaaagcatcatcgatcgttaatgatttgccatcttcaatatcatctaaattcactttattaataatcaactttaaatcctgtattccctttttaagcaataggccaatcactcggtcattatctcttaatgttgcaagatcaagattaacaacaataattgcttcatcagcaattgatgaggcataagtaaacccttgttcaattcctgctggtgaatctacaataataaaatcaaaatcattttttaaataatcaatcagtgccgccatgatcgatgcgtctaaattttgaaaagacaacgttttacacgctggtaataaataaagcgtttgttctcttttatctttgaccaacacctgatgaatttcacatttaccagaaatcacatcatttaaatcataaacaactctattttccaatcccatcataacatctaaattctttaaaccaaaatctccatcaatcaaacatacttttaagttttgatgtgccaaagcaattgctaaattaacactgatactacttttacccacaccaccttttccagatgtcacagtaatgattctagacatgtatgtaatcccccttttctacaacgatatcattatctttataataaacaagtgacatttcgaaagttgtaaaatggtgtatagattttccaaaaaagcgaattgttgcattcttaaatctttgactagaaatacaagctttttcactttggccttctataatcccaaaaacaccttgcatgacatataatttagcatacacttgaacaatggcccctggattgattttacctgtaattaaagtatcttcataaatttctattttttctcctgcatgtatagaagcaccgatcattcttaattcttttttctcctccgttttttcttctataaaaccaccaaacaagagacttttacattctacaagaacaccaaaaaattgtaatatctcatcattttccaaaattcgacccttcaaatcaaaaaaggcctttgggtaataatccttctttttaaagaaagattgcaccaaaagaccttttaattcatttaataaaacttcaaaatcgacttcattatccattataaaaatcaaacgtccattaagattcttaactaaaatatacatcaatatcaccttcaaattttaatttatcgtggataaaatacaccccattaaaaataacaatattgaatagtaatgttggtagtagtctcttaattagaaatgttgttatcactaattgagttgtatttgttatccacattaaagaatataacacactttcctgtacaaaaattgtcaaaacaacgatgacaattgcctcaaaataagtcataacagcttttttcatataacgcttttcaaaaaaagaatacataaagaacaataagacatatacaaaaatagaatttccataaattacactaaaataaattccacaaattcctgcaaaaatataacgatgatcttcatcaattgtattcgtcaataaatcaaacatcatcacaccaacataaggaacaattgtcaaatttaatttcaaaattgaagatggtaaataaaaacgtaaaatactgtcgataacaaaggaaacaaacatgataattaaatatctaacaagcttattcttcattaccattgaccttctttactacacttacataagataaatctttaaactgcgcagccgttttaacagttaaagtcattgttgttccatcactttgagttaccagtttttttgctttaccaatataaattcctttaggacattttccatctccacctaaaccagaagtataaactttcgcatttttttctaatttatcaattcctgaaagtaaagtaatatttaaaactttcttattaacatcataattttttaataatccataaatcgtttgatcaccattaataatcattactggaatttgatttgatggattttcacttgtaagtaacgaaacagtagaactaatttccgttacatgactaacaacaccgatcattcctttagaatcacaaactgccattccttcttgcacattatttaaacttccagcatcaattgtaatttcatcattccaatttgtttgatcacgtatttgtacactagctgccttcgttttataatcatttggaagataatccatttctgttaatttctttaattttttaatttctgattgtaaaacttcattttcagattcaacattgacataagaatctaacttttcttttaaaatcctattttcatcataaacatcctttagatcattatattcattaaagatatcatttacaaaagaaataggttttttaataatatagtattcaatcatagaaatagaattacttaatgtcttttctaaacgggattgttttctccctacaaaaaaaccaataactgatactaaaataacaacgacaaaaacaccaataataattcttttatttcttttttttctacgattgttcatataatcacctctagtatcattcattatatagagttcactaaaaaaaatcaatcttctttattttgatagattttttttgaagcaaaactataaaaacaatgcttaccaacaattagatgatctatgaactctatttctaaacaatctgccatttctttaaccttttgcgttattaattcatcttctacagatggtgcaggatttccacttggatgattatgtatcaaaataattcgattagcaccacatctaagtgtatgttgaaacacctcttttgtttctaacatagaagcgtctccacttcctataaataataatttctcttgaatgatttctaaacggctatttaaacaaagtaaaatgactttttcctgtttttcaaacatcaatttatgtttaatatattcataaccatcttgaggttctttaataacaaatctttttgtattttctttttgcattcttttcgcaagttctatacttgccattaattcaattgcttttgcttgtttaatacctttgatcttcgttaattgataatagtctacatcttttaaagcttgaaaccctcctatttcttctaataataaagaagccaaatttaaaacagacatttctttatttcctgttcttaaaatcactgcaattaattcttgattcgataaagtttcaattccattacaaattgctttttctcttggtctttcaaagcgaggacaattcaacatcatttaaagctttacttttatttttttacttaaacaataggctaatactatttttataagatctccaggtataaaaggaacaacacacatcattaaagaagcacttaaattcatcttcgtcacaaacataaaccacagtgttccaataaaatagcagatcacacttccaataatacatgctaaaacaataggaactcttgtttttaattttgaaataacatagaccattattggaaacgaaaagatatatcccccactataacctaaaagtgatcccataccaccttgaaatccagcaaaaacaggtaaaccaatcgctcccatcaacaaataaacaacacatgcactaactgctactttacaaggagcaatcaatgcaattaaacaaaccataaaggtttgtaatgtaattggtacatatcccggtaaatcaattttaatttgcgaaaatatagccatcatacatgccataagcgcgcaataacacatttcttttactttgaagttcaaagttttcaccccctgaaagcatattatcaaagagtgacttccttgtcaatttgtttttaaaaattgataaattgtattatattcttttttttcaatcttcttttgataacgatcatctataaaatattctttaaccacacatgtatttcctttttcagcaatctcttttgcttgttgatgtgcctctttttgttttataaaaatatcagtaataacaacatactcttgatcttgatacataaaacccttataccctaattcttctatttgtttcattgtattttcagcatttgctttttctttatagcgtcctacttgtacaacatagatattgatttcttgcttaagcgcttgacttacataatacatagttagtgtattacataaaagcatcaaaaaagtaaaaataagcattcctttctttttcatagactcacctctttctagtctatgaaaattaataaagaatatgaaggtaccaaagtaccttcatctattatctccattcaatagaaacaagtcttggaattgaaatacgaccactagaagaatataacattttataaacggctgctcccacaacaacacagacgatccatgttcctactcctccaccaataatttccatttgatttgttaattgtaattcttgcattttcatttcctcctttttttatttaaggaacagacacccactaacttcctcactatttatatagacattttttgagtatttttcttttaaaaattaaaaaaaatcaagttttttcaaacttgattttacatagctgctaatttttctttaacagcattatattttgatgtataatcttctaatttttgacgttcactatcaacttttgcttgaggtgcttttgatacaaatttttcattacttaacatatttgtacaacgtttaatttccccttcaagtttttgaagttcagcttgtaatttttgtttttccgcttctttatcaacatacgcaccaagttcaacgatcaatgtattaccaccttgaatcatagctgtcgcaatatctttagaagctttttgattatagccaacacaagttgcattacataatttctttaagtaaggaacacattggtctaataaagcttgtaagttttcatcttttgtttcaattgagtattctacttcgattgcatttttaattgtatagtttgcacgaatttcacgaacacctttaacaatatccattaaataagtaaattgtctgttgatgttttcatcattgaaatcaggatttactgttggatatttagaaatacaaattgattcttctaaatgtggaattgcttgataaatttcttcagttacaaatggcatgaatggatgtaacattctaacgattgcatttaatacataaacaagagtatgggcacttgcttgtttttcaacttcattatcactatttaaatgaacttttgtaagttcgatataccatgaacagaaatcatcccaaatgaatttatataattcgctaccaacattaacaaattcaaatttatccatgttcgcatctacttcttcaattacgttatttaaacgatttaagatccatttatcacataaatttaaatgatcaaattttaaatctttatattctaaatcttcatcaatattcattaaaacaaatctagctgagttccaaattttattaataaaattccatgatgcttctagtttttcaggaatatatcttaaatccatacctggtgctgaatttgtagttaagaagaatcttaatgtatcggcaccatattgatcgataacatccattgggtcaaccccattacctaatgatttagacatttttcttccttgttcatcacgaattaaaccatgaatcaaaacatgttcaaatggtctttgacctgtaaattctaatgattggaaaatcatacgacttacccagaagaaaataatatcatatcctgtaactaaagtatttgttgggaagtatcttttaaataaaggatcttctgtattaggccaacctaatgttgaaaatggccataatgcactagagaaccaagtatctaagacatcttcatcttgtgtccagttttcgatatcttctggtgcagtttttccaacataaacttcacctgtttctttatgataccatgctggtacttgatgtccccaccataattgacgtgaaatacaccaatcttcgatattttccatccattgtgtaaatgttttttcaaatctttctggtacaaagtttactttagaatctttcttttgattagctaaagcagcttcagccaatggtttcatcttaacgaaccattgttttgataaataaggttcaacaatagctcctgatctttctgagtgacctacttgatgtaaatgtttttcaatatgatcaacaatacccgctgcttcaaaatcagcgactaattgtttacgacattcaaaacgatccataccttgatatttatgacaaagttcattcattgttccatcatcattcatacaaataggcatgtctaagttgtattttttagctaaggcaaagtcatttggatcatgcgcaggtgtacatttcataacagctgtcccaaaatccatatcgatataactatcagccataattggtaatttttcaccattagctgggttgattgcatatttaccaactaaatctttatatctttcatcatcagggtgaacaaagatagcttgatcggcaaacattgtttcaggacgtgttgtcgcaatgactaattcttgatcactatctacaattttatatttgaaataatacattgccccttcaatttctttatgaataacttcgatattacttaaagctgttctttgtacaggatcccagttaataattcttttgccttgataaatatatcctttttcatataaacgaacgaaaacttctttaaccgcttgagataatccttcatctaaagtaaatctttctttcgaataatctaaagataaacctaatttttcccattgagcacgaataatagaagcatattcttctttccaagaccaagctttttctaagaaaccttctcttcctaaatcatagcgagaaattccttcttctctcattcttgcttctactttagcttgtgtagcaattccggcatggtccataccaggaagccataaagcatcataaccttgcattcttttataacgaataatcatatcttgtaaagttgtatcccaagcatgtcctaaatgaagtttacctgtaacgtttggtggtggaataacgatggcataaggctttttagaaacatctcctgctttaaaatattctttttctaaccaatgttgatatttacctttttcaacacttttatgatcatatttactcgctaattcttttttcattttcatcatccttttcaataaagctttctttatgttctttaatatattctcctaatttatcaccaattcctgaagaacgtaataaagaaacaaattcatttgtaaaatcagagaaattgtatgtagcgtattcacttgtttcatcaatttcatcttcttgatcattttcaattaaaatagctaatttttcagcttcttctaataaatgagcaatatcataacatttcattgtttcaaatgcttctttataataaggtcgataattacaataaggttctgttataaaaaacgaatggattgaacctcttcccccttctaaagaacattctaattggtacattgtataaatcaataattcctcatgtgttaaataaggaataatatttccatcatagttatcatcttcatatagacgatcttctttcgcattaatatgaaaaataacagctcttgttagatcaattggttcaatcttatcaaaaacatcacttgtaagatgagaaaacatatctttttcttgagctaatttttcttcatattgctttcttttttctttcacttgtttaaattttttaccataaaaactaaacaagaacacacacatgatagcaaaaataatccatacataccaatactctgtaaaataattcatctttttcctccttaaaataaaaaagccatccctctaaggacgacttatatcgcgataccaccttagttctaagtataaaacttagcaccttaaaactttaacgcagttctacgtgttaaactactttatttcatctaacatgctccttggctaccttcactcttttcatttatccctttccagcaaacgggactctctatcaaacaaagaagaactactcctccaaatcattgcagttctattctatcaaatagactatttctcgtcaatcattaactttttgaatatttcttgtaagccatctaaataacaaattaattttgacatttgataaatattgacttcttcttgtaaatttaattgaacttgcggaacaattgataaaatacattgtattaagattttttcttcttttaaaagctttacttcttttaaataatattctaataacggtaaactctcatagagttcatcatgattttgaaaaatatctatcaaatcataaatacaataattaattttcatttgatcaattgaaataagtgtttcatcactaacaaaaatatgttccttattaaaatgattatacgttaaagaaagtctaatttcatttttacctttcattatttcttgatattgacttaaataataatatgcttgatttaaataatgaacgatacgataataatttaaaacaagcatccaacctgctggagatttaaattttctaaattcaaattctctcattaattcttcataatcattttttctttgttgaatcaaagaaaaaagatcatcatactgctttttaaaaaaagcatcttcttcatgttgcataaaaaaagaatgattgtgtaaatacgctaggatttgataatatgtttttattttcatttctttttttatatgattatcttcttgtaaataaggcataagatagatatattgatcttgaaaaggtgtaaaatagtgttgttcattatttaatatcaaatgaataaaatgatggagatgtaaggtattaagatgttgataagcaacttctagtttcttttcatcaacaatcttaacacaataaaaatgattagctgttttcactttatagacacgcggactgatttgaatcagtccaattacgtctaaatcatactttgtttgaatgatcttttggagcataaggaataataagaatttgtcctgcatctaaatttagatcttgattatagtctctaatcattttttcatctacctgatattgtctagctattgaagcatacgtatcatttggtaaaacgacatataaataataaacacctagatcctcgtcatcatcaaccttttcttctttttctttcgtttcataaattttttcttgtaacttttcaacatcatgaatttcttcgggtgcctcagcaacgacttgttcatttatcgtttgagtctcaacatcccttgataatttttcaatttcatcaataggatcttcatcaagttgaatataacgattttcaccttcttcaaccccatacactccaacttcaattttaattttcaaattaccatcaataatatcataatgaaaatcttcaacctttaaatgaaaatcttgacgatctataatcttttgatcatccgcataaacatctaattccacattttctaaaaaatgtcttttttcttgactaatatattctcctttaatagcaagactccccaccgctctaacaccatgatcttcaatcttatagtcgatagattcatcaaccgttaatgaaactaattcctttaattgatgtagtaaatcaatttccttttcgtaaaatattttttgcatagtcatcctcctaacaaagtctatgcaacaaatcatcaaatatgaaaaaaagtaggtttccctactcaaaatctaaatcacacaattcataaattgcattccaagcttcttgaattccttttttctttaaacttgaaaaacgaataaatgtatcacttggatcaaaatgtaatgtatctttaattaatttttcatttttctttaaatcattacgtttaagtttatcttctttagtcgcaacgacaatgacaggtacaccatgatgtttaacaaactcatacatcatcacatcatcttttgttggtttatgacgataatctacaagtaaaataaaacctcttaaagtttgtctttcactaatatattcatccatcgttttaccaaattgttttgtgacattattagcaactttagcatatccatatccaggaacatctacaaaataaagtgcatcattgacattaaagaaattcaaagttcttgttttacctggcgtacttgatacttttgcaagaccatttctagataacattgcattaataaaactactttttccaacatttgatcgtccagctaaacacatttctggaaaactttcttttggccattggcttttccatgcggctgataatatatattctgcttttttaatttttaccatttttcatcaccttttgtattgtacaaaaaaaataacgaaaattcaagatttccgttatttaacaattgcatgctctaaaactgtatcgatatgatcagctaaaacaatttctaaatcatttcttactgattctgggatatcttcgatatccttttcattttctttaggaatgatgatttttctaattccagaacgatgtgctgaaatagatttttctttcaatccaccaattggtaagacattaccacgtaaagtgatttctcctgtcatggcaacatcatctcttacaggtttatttgtaaaagctgaatagattgcagttgtaagagtgacacctgctgatggaccatcttttttgatagctccttcaggaacgtgaatatgaatatcttgtttatcaaaggctttatcatctaaaccatatttttctttattagcttttaggtaatctaaagcaattgatgctgattctttcataacatcacctaattgaccagtaataataaatttaccagtaccatcaaaatgattaacttcgattggtaaaatatctccaccaaattgagtataagccatacctgtaacaacccctacttgaggacgaggaagtttcttagtatgatcaaatggtgcttttcctaagaattcaacaagtttatcttgatcaattgtaactgattcaactttttcttttaggatagctaaaacagttttacgacataatttagcaatatatctttcaagttcacgaacacctgcttcacgtgtataatgttgaatgatttccatgatgatatcatcagaaataatcatttgttcaggttttaatgaatgcgcatctaattgttttttaattaaatgttctttaacaatcattaatttttcttgttctgtataacttgaaacttcaataatttcaagacgatctctaagtggtccaggaattcctcctaaatcattagcagtcgcaatgaataaaactttagataaatcatatggttcttcgatatagttatcagagaattgagaattttgttcagggtctaaaacttcaagcattgcacttgtaggatctcctttataatcacttgccatcttatcaatttcgtctaataagaagacagggtttacaacaccagcttttttcattccttgaatgatacgtccaggcattgatcctaaataagtacgacgatgtccacgaacttctgcttcgtctcttactccacctaaagaagctttaacaaatttacgatctaaagcacgtgcaatacttttagcaatacttgttttccccacacctggtggacctgctaaacagataattggtgcttttaaagattgtgtcatttgtttaactgctaagtgttcaacaattctttcttttactttttctaatccaaaatgatcttcttctaaaattgcttcaattttagaaatatcttcttcatctttagtttcttgataccaaggtgttttcatcacccaatcaatataagttctaacaacgttcgcttctgaagatgctggtggcatagcttcaaaacgacgtaattcttcttcaattttatccttgatatattgaggatatggattttcagctaattctttacgaatttgatcagcatcgtctcctttatcaacagtatcaccaagttcatctttaatagctcttaatttttctcttagatagtattctttttgattttcatcaatactttctttgacttttctattgattgtatcttctaattgactaatcattttttcagactcaatagaacttgctactaagaataatctttcattaattctttgttcttcaagaattttttgttttctatctaaatcaattggtaaatattgaccaattgtatcagcaagtaaactagctgatgttccatttgaaagcaatgttaagctttcagctggaatatgaggcatatgacgtcttgcttgttcaaaataagctgttgtttttcttactaaagcaacttcttcatttgtgtctccataaatatcttctaaaacttcagctgttgaaaaaattgaaccatcttcaattttaaaatctcgaagggcaactcttttttctccagtaacagttaatttgattgtccctgcactatcgcgacggattttcttttcaattttacataaagttccaacatgataaacatcatcatatttcggatcatcaacaataggattgatttgtgatacaaataggatattgttatcaaagtcacgacttgaaagttcaagtgcttttaaactaagggggcgaccaacatctaatgataaacggttacccggaaagacaatcattcctcttgtgcacacaacaggaagggttaataatgtactttcactcataataatcctccttttttaaaaagacgcttacgcgtcttttaaactatttctttaagttttctttaacaacgtctaacgcttttctatttaaaatatcagcatcgatttggtacatattttgagcgaagatttgtttgatttcttctaagtctctattatatgtatttgcgattgtttctaattcgctattacgttcttcatcagttacttcaatattttcagcttcaacgatagcagctaagattaagtttaatttaactctgtcttttgcttgatcagttaaatcagctttgatagcatctttgtttttaccagtgaattgttcatataattcaaatgataaaccttgttgttgtaagttcatttcaacttctcttaacattgtatctaattcagaatttaataaagcttcactatcttctactttacaacattcaattaaagcttgagttaaatcagagaagaatttgttttctacttcattttctttttgtgattttaattgagctttaatatgatcttttaattgatctaaagtttcaacaccttcgatgttaacatctttagctaattcatcatcagcttcaggtaaaactttttctttaatttcatgaacagttactttgaatgtagcttctttaccagctaattcagtagcttgataatcttctgggaatgttacaacaacatctttttcattttcacaagtcataccgatcatttgatcttcaaaacctggaatgaattgtccagaaccgatttctaatgaatgattttcagcttttccaccttcgaatgcttcaccatcgatgaatccttcaaagtccataactactgtatcacctttagcaacttcaccgttttctttagttgttaattcagcgaattgatgacgatagttttcaacttgtgcttcgatatcttttttagcaacagttactctaccttttttaacttctaatcctttgtattcacctaattcaacttcaggtttaacaggacataagattgtaatttttaagttatcattatcaacactatcaatatttaatgttggttgagcaattggagcaacttcagcttttttcatgatatcagcatatcttttttgtaagatttgatcagtagcttcatcatagatagcttgttttccaagtctagctttaatcatagcaactggagctttaccaggtctgaaaccatctaatttaactcttgtagctaatctttttaaagcagagtcttgagcttctgcccattcttttttatcaaatgttactttaatttgagtaacagcattttctaatttttttgtagttgttctcattatatatttctccttattccgtatcaaaagacattatatactaacctttttttaaattcaactatattaataaattttaatattcgattgattgtattgtttccaatacatcttttacatcctcttgattgcaattatataaatattcaatatcttctaattcaatatctatatattgtaaagatgctaaatgataatgaatagctcctgcaatactacgataatcttgttcatcgatatattttggatagattgaataaagataaaaatttaaaaattgttcacacatcgtaagtaaagatggattatcatcttctaaagcatccattaatagtttataaatttcaacaccagattcttgattcaagaccattggggcataacttgggttaatgtcgtagtgcacaccttttttgacaacttccaaatcttcatcaatttcttgatcaatcattaattctattaataaacttttggcaaaatcaggttgatcattatctctaataaattgacgaataggaacaatcatacgacgaatattcataccttccatttgttcaatagccatataaagtaaatcttcatttgtatcttttttagttaaaatattttcaatatcttcttcattaaagactttttgagtcaccccatcaaaagatgcttcttgtttcgctaataacaattcatcataagctgcattaaaaactgtttcatattgataaggaatataaggcattgataattcctctacaataatattaatagcttcttcaaattcttctaaatcttttaaaatcgatacataaatagcaacaacatcataataagtttctccagcaagaacttttgctttcataccttctcttttagcttgttgtaattctttcaatccatataaacaaacaagtctttgataacgtacttgttcattatccatatcatttaaatattgcaacgcttctttatattgacctgtttcaattaaatcttctatcatttttcttcttcatcctcatcatcatctaattgtaaatcataagtgatttcgggttgtgtttgttcttcttcatgtaatttttgaatcatttcactataaccctctagtttcccagtcttcacaaaatcatcatcagtaagtggcacaactatccctccttcattttcgctattataatataaaataaatctttaaaaaaggcaaattttaagactattttatcactcttttcatattttaaatagtgaggtgatttcatgtataaaaaatatttaagaaatatttcaatgatttttttatgtgcttttgcaacctttgtttattttaaaaatgatgatgttaaaacagtgaaaaagaaagccaatatgcaaacagttatttttaaagatcaagatgaaacgcttattcctgtttctgtggatattggtgttaaggataataaggaaaataatattcgagggattattgaaacaatgaaatcaaaagattttactcaattaggactttatcctatttttaataagaaattagaacttaatgctttaattatggaaagtaatcaacttacgtttgattttacaaataattttaaagtatcaaataatcaacaagctttagatatttgtgaagctcttagctatttattttgtaaagatggtatttctaaaatcaatatgaaaatagatggtaaagctgtttcttcatttgaaaatacaacaataccattaagttgtatcactcctaatttaggtattaataactttgaaacatccacttttgatctttatcaaacctcttccgtccttgtttataacgaaaaagaaattgctggaaaaacatattatattcctacaacaacacgtattcaaaacacaaatcaaacaattgatcaaaaagtatctttattattagatcattttgaaaataatactaaagtagaaacaactaaaaaatcacaattaaacgatggcttactttctatctatttatcatcacgtattctagataatagcgaaaatatttcccctactctttatagtcgtcttgaaaaatcatttttatcacttcctgatgttagttcagtccatatctatattaataatgaacttattcaagaagatcaaaatgtaagtacatcaatcgataatattgtacaaatctagtaaagttttgttataatatttttggtgatgaaaatgaaaaaaatagtagtaatgtcagatagtcatggttatcatcaaatgattgaccgtgtaaaagaattagaacctgatggagatttttatattcattgtggagacagtgaagctgaaacatatatgatgcaagattggttatgtgttaaaggaaataatgattggtatagtgattttccaaatcaaatcaaatttaaagttgaagatttaaactttttagttgctcatgggcatcgttttggatatatggatcgtgaaacaagtatgatctatactttgcaagaagcaaactgtgatgtactactttcaggacatacgcatgttcctatgtataaagaagttgatggttatacacttattaatcctggatctacaactttacctcgtggaggaagtaatcgaagttattgtgttatttatgtagaaggtaaagatttaaaggttgaattcaaaaatttagatgatttttaaaaaagtattgctttttaaaaaaatatatgctattctagttgagcagttgaaagtaagcaatgtctacgtagctcagctggatagagcacacgccttctaagcgtgcggtcaggggcgaagtccaaaaggtaaacgtaaaaccaagacagtaaatcaagacgttgtaaaagttagaggattagtgaattaccccgtgaggtcttgtggacaacgaattccagtaaactttaaaaatagtaatggtaccgttggtcgaaaaaggtttgtcgcaaaaagttagctgaggttggtactacgtcaagaaaaagtaacagttaaactgaaatatttcatctagtttaactgttttgcccttgtaagaggtgcaaaatattatagaggaaaataaaaaatgataaatcaaaactatgaaaaactaatgaaattaaaactaccaaagatggctgagttataaaaagaataattagctaataaagcatctttggaattatcttttgatgaaaggctttctatattgattgatggtgaaacagatgcaaaatataacaacttgatttatagaaaaaaagatcacacattaaaatgacaaatgcatctgtcagcaatattaaattctatccagacaaagaaatcaataaaatattgacaatgaaattatctgcatgtgattacgttaacgatcatttaaacgttattgttgtgggtgcaacaggatcaggtaaaatgtattatatatctgcattaggaaacgaagcatgcaagaaagctatcaacgttaaatatataagacttcctggtttattatatgaattggatcaagcaagaaataaagataattataaaaaagaaattaagcgcgctatcacgtattgaattattgatcgttgatgaatttttattgacaccaacaacaaaaagatattttagaattattggaattaagatatgacactcattcaacaatatttgcatctcaatttttgccagagggttggcatcaaaatttaggaggtggtgcattagctgatgcaattctagatagaattatagctaactcatatttgattcatactaaggaaaatcactcaatgagaactagagaaaataaataatttaggggctcaactttgggggctactttaaggggatgaatctaaaaatcaatattaaaaaataacaactaaaaattatctcaattaattgttatttctttattaaattcaatcaaataaaattatatttgattttaataacaatatattaatacgttaattatcacaagatactccattctattaaatattattaaatcgccaaaaatgcttaaatatagccagttttcttttatttagtatattttgatctaacaatttattttaatagcatactttctatttctagcaatatgttgttattgttttcttatttatataaaaaaagaacaatttgcatttcgcatttgttctcttttttcataaattttcttatagtattttgggatggcccctaaagtgtccccctaacttttaacagacttttttcaagccccctaaaattggcccctaaataatttggctttccccctaaattatttggttacccttttattgtcggcgtttttattaacacactgtcgtcactcgatcaacatggtgcgtgcaggaggctaaaatattcaatttgattaaaatcactcaacaatatcaataattaatttcaaagtataaatactctccacattttttaaagagtaatccgttgtaaaatatttaatttttttatataaaccatctgtaactttatattcttttaaatcacctatcatctccacaattataaaattattttcctgatgaattcctaagcttaatcctattttagaatttaaattatctttaaaactatccaacaagtaaataattaaatcacaaaattcattcgtatcgtaaataggattttcacatataaataacgtattttttaaaaaaatatcatcatacataaactcatgtatttttgaacttaaaacaaagtcaaaatatggattattagtatttattgcagttgaaaatctcttaacttttgaaatatattgttctaacataaaatttgctttatctatttgatttgactctaagtatttctttacacctattaatatatacatcattctatgttctgtttctatgatttcattatacatatatttcattttactataattttcttcactaaaatgatttttttgaagcttaagctcatattgtagtctcttttcattatcaatctgtaattttctaaatataaatagaaacaaaccacttataacaataagggatattgttaatgaaacaccttttttcgtagaaaaagcacctgttaataacatttctaataatacagcaatagtatattcaatcgttagacataataataggatagcccatccattcttcattgttaaagaatcataaaaatgtcgtttaaaaatacaagcaaatattataaaacataacaaaataaatttagataatattgtacagaatacataataattttttgtataaatttctaatgtgctaatattaaatataaaagttgtaacaagcattgacaataagtttgccaagtataaaaatattcctgctatagaacaaataataattttttcaaacaaactttctgtttttaatttcaataaagagataaataatgttgcaattacaataaatatcaacaactgatcaaatgtattgtagtaatttgaaatagatatttcaaaaaaacaaattatcgttgttattaaaatatacatttttttcctcttaacattgaaataatatgccatgaatgaactcaataatagaccctctaaaaaatttataaaataattatatattgtcatcgtaaaaagtgctccttgtatttttgtataacattatttttaaattttctgcctatattaaattcttcattattttttaaaataatagtatttttttctatttccttaatataatctaaatttactgaaaatgatttttgaaattgtacaattgtttctgttcccaaagtatccaagatatttctcatagttgatctatagcaatattctccatttttagtatataaagtaacatcatgtccactggattctataaaataaatatcttttaaaaataggtttgtttttcttccatgaaaatcaaaagtaaataattgcattgtttcttttaaatacgtctttaacaaaataaacatttcttctaaatcttgtcttaaatatgcctttcgtacaaaataaaatggtctaactgaaagcgacgaaaacactaaatcacctcttgatgatacaaagataattataggatttgcttctgaaactaataatttctttcctatatttattccgtttatctcttttaaatcaatatccaaaaaaacaatatcatagtttttatctaaagaattattaaaaaaatcactatttataatatcaatctcatacctagtgtacaatctttcaataaacattattacatattgttgaagttcactagaaaaatcaacatcatcatctacaattgctatattcactatatgtacctctcactatatcattattaaaacaattttatcataattattgacacaattaaatactttcatatacaattctaaagatacatcgatacattgatttaattattttttgatattgtatgtattttaaaaacaaaaatcatctggtttttttggttgatataatccactaatagagtaattattaactcctgcagtagccataaaagccaatactgttaatagaaaatttaccatattctttttcaatttaatttttttcatattccttttccctccatatttaactttatagtatctttaagcatttgtatttattatctacgtaactaacaaaaatatgtcacaactaacaaaagcataacgtgattaattctattttataaagaaaataattttgcgttatattacacatttatttttttaaaattatgattgcaaaaatacctatatttagaaatgaaacaaatatattgatataataatttaaatttttctcctagttatgtattaaaaaatatttagactaaactgtattagaaaacacacatgattctagattatatactcataaaataatttatgataaatgaaaatacttaactaattaaaacattagctcaaaaaaattattagtaatttacttagaaaaaattttttgttctataataacatagtagaaaagatcaaacataataaaaaaatataaatgcaaaaaaactattaaaaataaaatagtataaactatctaatcaattaaaatttttgattaaaaaaagaattactacaatatatttaatcattccaatatcaaaaaatatactatatccacatccaaaaagagtacattattttgacgtcaaagtttctactgactgaaatctaaagtctacaacgttttcattaactcattcgtaaacaactccaccttactttttcatttttaattttcaggctattttcagtatatcactgaagttttttctcaatgctaaagctattctgttaccacatgcatagcatgtgatattggttttataattaaaaaggctgcttttaatacaatgttattaaattatgatgaaataaatataatcagaagagatatcaaataaaaatattcttctgatttttactttgttgtaactaaaaaagagatattttcataattttgacccctacattactaagtggagcatatatatgtaactattttaaaatcctttctacataaggaatttttacatgttctcattgtaggactatgttcaaaattaggttattttaggtttaaattaggtcaaaatagaacaatcttttggcatatcagtgaatatgccaaggtgtgagccgcttaaaataatggtttgccataaaaatgtgtgttatataataatttataatcttattaaggagaacttgaagatgaaaaattgattatatttagctactatattaagtgtcatttcaattttaattcaattctataaattgattagtttgaaaagcagtattgattttatagatattttattaggattacttactggtattgaattgcttatttcatcttttataaaaatcaaagataacaaagagaaacaataaaaagatatatgaaaagaaatattgaaaaatatgctttatggattgcttttatataataatcaaatcccatatttttaggataccatttgtagtaatgaaagcatgccattaccatctttatattttttaatacaaggattctacttacatctaaatcaaattcatcatctggaaatggtcctaataatctggacaactcgttctaaaatgaatattttttaccctaatcagatatttattatcaaattttaaaacattttcaataccattgtaagattcatattctttgttatctttattactttggtaacagtcaactatttgacagagaacatcattttcatccattatagcttttctttgcatgataagatatcaaaagtaaattccaataaatcataagaaacatttagatagaatacactgtatgttttgtcctatttattacagtttctaacagttgtttcattatcctaaaaagcattgtcgataagaagctcacatccatctacagccaaaagcgatattctttaaagaacttttcatcatatattttcttgttgaaagtattaagaatatgaaaaaagcttccattttaatcttacttttggattatacaaaagtggaagaagcaggagtagtcgaagaataatcaaataattgataaaatttatcttttaaagaacttgtttccatacaaaggatggaagtagttttaaaatcaagtttacaagaacgaataaaatcagtatccggattttcacaaaaaagagaacaagaattgttcatatcatcaatgatatgatataaaatatttttcaaatacttatagttatccataaaaacaactccgacaatatctataaaaaattgacctattatcaataaaatctattgataatagactgcatactttatagccatgtcaatattaaaaataaaaaagaggtctactttaatgtaaacctcctatagccataaaatcttaacttaatggcattggcttttaacacccttttcttttattgcttgatctatatgaatctaaatggtattgattagcaatatcatcaaaagttttatctaacttttcaaaatatttttttctatactgtttgtaattttcataaacatttaatatatcatccactaacactttttctaactttaatttttctatcatgtaaataaaattatcccatgattgcgtttctaattgataagaatatccatctaataattcaataattaaatcaatatggtattcatttacaattattcccgaaatagcaccataatttcttctgcaaattgatacttctattttttctatttctgaataattaattattttaaatggctcttgtttccatttaccagttaatgaaccaattgaatgtaattctatactattagctgttatattaacaccaatctcaggtttatatttgtgataatatttttgttcatttttactatttattgaaattactgcattaaaaatattagtttttgataatgttatataacttttattcattgtatttttgccttagcaataattgcatccttctgtgaaatttgttaatgttgcacagacaattgatgtagagctatttgttcctactactgaagaaagatatctaattatatatgttattgataaaaacttaaaaaagttgccttatatatccacagctaaagctgggagctttacggcaacatttggtaaaacttgtgttttcaattgtaagtacataatatttacacataataatgttataatataacaaagataagaggtgatctatatgaagcttatttattcagtagtttttattattatcatcattattggaatttacctttatttattcatccaagatagaaaaaataaaggtaaagaaaacaaagaaacttacttaaaaacaaaagaacttcatgatttatccagagatgttcatagtgacaactatgaaatttcaagagcacaagcacatatgactttccgcagtcccggaggcatgtaagcttacactctaactctatcatattgaaaaggatgtacaaaacatccttttcatttaaataaaaaaagagtcttacgcctaagcgtaaaactcacttcttcactatttaggtaagaacactaagaagattacaaaacagatatctaagatccatacaattggcttaatttctttaattttaccaacaccaatcatagaaacggtatatgtaataaatccaatagcaataccatttgaaatagaataagctaagatcataaaaataactgtcatgaatccacttgctgcataaacaatattatcccattcaattccttttaattgttgtgccattaaaataccaacaataattaatgcaggcgctgtcactgcacttgtaacgcatgaaagtaatggtgaaaagaaaacagataataagaagcataccccagtagtaaccgcagttaaaccagttcttccccctacttcaacacctgaagttgattcaacgaatgatgtaacagttgaagttccagcaatagaaccaataactgtaccgattgaatcagctaataaagcacgatctacgttttctggatttccagtttcatcaactaagtttgctctgttacatacagcaactaaagtccctgcagtatcaaaaaaatcaacgaataataatgagaagattgcgacataacattgtggatgtgaagttaattctccaagtcctgaagcaaatgctcctactaatgaaaaatcaaagtcaaatgaaataactccagtaggaatttctggcattcctttaacaccacaaactccagcaataattcccacaacagctgtaacaactaaaccatagaaaacagctccaggaacatttttagttaaaagtaataaagtaattaaaataccaactactgctaaaataactgttggttcttgtaagttaccaagaccgacaaatgttgattcatttgcgacaataatacctgcattttttagaccaatgaaggcaataaagaaaccaatacctgccccaattgctaatttaagttgtgcaggaatagcattaataatcattgttctaattcctgtaatagaaataactaagaaaataatacctgagacaaaaacacaggctaaggctcctttataagataagcccataccaaaacaaattgtataagtaaataatgcattcacacccataccagcagataaagccactggatagtttgcaacaagtcccataataatggtagctacagcagaagcaatagcagttgcaaggaataccccttgaacagacattcccgtttcaccaagcattgctggattgactgctaaaatataagccattgctaagaatgttgtcacaccagctaaaatttcagtttttactgtagtgcctttttcacttaatttaaaaaacttgtctaacataaatttctcccttcttcaaacgttattatcgtacattatttttagacaattgacaagcaaacaaaaaagcacttacataaaaagtgctaataacaagggcataaataccgctggtaaaagattgcctactttaatttttgtatgaaaacataaatttgtccctaccgcaaatattaaaaccgaacccacaaaagaaatattagaaatcattattgtcgtaaaataaggtgctagaaaagaagcacagactgtcagcaatccttgataaacaaaaataggaattgcggaaaaaattgttcccaccccaagtgttgaagcaaaaaccataacgattacaaagtccattacggcttttgaaatcaaaacacttgaatcatgtaacaaaccatcttgaaaagaacccacaatagccatggctcctacacatataacaagtgaagtagaaacaaaaccatcaatgaatttagaatcattacttttaactttattttttaaatagatcccaaattgttcaattcttttttcaatattaataaactctcctaataacgctccaaagcataacgataaaacaagaattaaagaaccggtggattctaatccttctttagatatctttaacatccctgtcatcgcccctgaaataccaacaaacaaaactgctaaaccaattccttgcataatcgtttcttgatacctattttttaaaccatttttatacaatagaccaataataccacctgcaacaacagctatggtattaacaattgttcctaatccaaacattcaaacaatcctaacctttccatttcataatacacaccatcattttcaacactttcacaaatgttatcagcacttgcttttaattcttggcaggcatttttcattgctacaccataattgcaaacttgtaacatttcataatcattcatactgtcaccaaaagcaatcgtatcttccattttcatatgaagtgtttcaacgacctttttaatagcaagtcccttatccattccttttttgatgatttcaccattgatagaatgttggctaaacatttcatgaacaataaaatgataatttggtaagagtatttttgttttttcaatatcttctctattaaaagcaataaaacaaagtttatgaattccttgatcttgatatttgcttatatcaaccatatgatattctttcttttgttgttcttttaatctttcaaattctgaatttgttccttcatcacctaacagagcatgtgcaaagtaatgccgtaattcttcactcgcaaaagtcatataagttgattctaagttataaagaatatgattttgctcaaaaacttttcttgcttgttcaacttcttctttatctaaataagttgtttcaatcatttcccctttaatttcaagataaccacccgctgaacaaatacaaccatcaaaatcatctgacataatactttcaataccgacacgatttcttcctgtacataaaaaaatcaaatgcccattttctcttgcttttttaattcctttttttacaaaatctgataaaggataatttggtgtgactaatgttccatctatatctaaaaatactatttttttcatatatatctccttatagcgtttctattttaatcatattttatctttttagcaataaaaaaagagagcaatgctctctaacgtataatgatataggctaagtaagcaacataaagaagaagcataataattccttctttacgatcaattttatgtttcgtaaatccaaaatataaaactattaaagaaaaaatagttaaaataagaatatcaataatattttcaaagataaaagtaattggactaattgttgctgcaatacctaaaacaaataaaatattaaaaacatttgaaccaataacatttccaagagccatatctacttcaccttttttagcagctaccattgaagtaacaagttctggtaaagaagttccaagagcaacaatggtaagaccgactaagttttgtgacattcctaaagataaagcaatattggaagcactatctactacaaaatctccaccaaatttaatagcgattgctccaccaacaatataaaccaagcttaattccattgaaataactttaatttcttcttcctcttgatatgtattcatggcttttttagccgaaacaatcatgtaaacaatatatcctacaaataaaatcaaaagaacaattccatcaatatgtcctaatatcatcccaaaataacctaagatcattaataaaatagcacataaaacagaaaatggaaattctcttttaagcgtatttacttgtactgcaatcggtacaaataaagcagaaataccacaaacaaccattaaattaaaaatattagaacctacggcatttgctaccgctaaagcattatttccttccatcgaagctgtaatactgacagcacattcaggtaaacttgttcccatggccacaattgttaaaccgatgattaatgaaggaatatgaaatcttgtagcaatagaagaacttccttctacaaaaaaatctgctcctttcattaataaaataaaaccaacaataagaactaataataatacaaatacatttgtcataactttctctcctttaaaatagacctaaatgttctaataaaatttttaaaccaatcacaattaaaataataccaccagcaatctctgccttatgttcatattttgacccaaaaactttaccaatataaacaccaataaaagaaataacaaaagtcgtacaaccaataatgctcatacattcaactattggataatttaaaaaagcaaaagtaattcctactgctaatgcatcaatcgatgttgcaatcgcaagtaaaaacaattcctttaaatctaatttaaattctccttcatcttcatcgtcttctgctttaataccatcaatcaacatcttaccaccaataatactaagtaaaataaaagcaatccaatgatcaatacttttaatataactttcaaaacctctacctaaaaaccagccaataaaaggcattagtgcttgaaagccaccaaaaaataaagcgatgataaaaacatctctcttctttactttttgcattgataagcctttacaaattgatactgcaaaagcatccatggaaagacctaccccaattaaaaagatttcaataaataaactcataccaaattcctttctccttaaaataaaagagacccatgcataaaaaatatgcatgagtctcgttctttaagatttgccaggctatacgccatgatgttgacaaaccgcgtcctaagacgtgtactactccctcattcaacaaattgatagtatcaaagtactcgacataaatcaagttattttttaactttcatactcataaatttacaaataaagataataatcgcaccaatggctgtcattaaataaacaaaaacaaataaagcattcaatccaatcgtatcttgtaaaactccaccaagaacatttcctaaagttgaaccaattcctgatgtcataatcccaatcattgtttgtcctgacatttgatcttgggtttctagattataagttacataatatgtaataactcctgtaaacaatccataagaaagaccttggaacatcataccaataattaaaacaattaaattaggagctaaaccaattgtataatttcgacaaagatagaaaatagaagctactaaaataagtgttacactattaaatttcttcattaacttaggaactgtcatcatgactggtaattcactaaaagccattgcaaacatagctactccgtataaagaagtatttcctcctagatttttaacaatattaattaaataagtaccgattgctgttgctcccgaaaacataaaacaaaaacctaaaagtaagaaaaagaaaattttatattttttaataacagtaatcacagatccttcttcttgaacttcttcttttgtttctgtaatttttgattctggtaaatgatataaaataaataatgtcactaaagcaaagatacaatatgcaattgataaaacattagctcctaaaaaagaaactacttgtccaaaaatcaaagcacttgtcgcccatgaagctgagccaattcctcgtgctaaaccaaagttgacatatgtcccttcattaatataattcatagcaatcattgtaagcatgggtactgtggacatatttaaagcatacataacaacatagaaaaccatcactaaaaatgctggtattggtaaaaaagccatcgcaatatataacaaaactgttgttaacattaaaattgtcattaattttttaatagtcatcccttttattttagaaataagtgatgacataaatggtgataaaaagattgttgctatacaagaacctcctgtaacaatccctatctcagtatttgtaagcccttttgattgtaaaaagacagcaataaaaccattaatacaacatccagtaaaccaataaaataaatgtaaaaaattatattttgcttttagtgacatatttcttcctccctagtcgtaaaatatattctaacataattttttaaagatgatgctattttcataatttgaaaaagaaaagaaagggttatccctttctaaagttttaaagcaagttgagtagttttaaaaatagcttttttagcgtcaccaactttacttgcatcgacaattaaataaacatgttcaatttttatttcttaataaaggttttaatttgcttttgaaccaaaagttaaaacaatcgtatcaaaatgagaaagtatttctaattgattatgtttttcataaacaataccatcttgatcaattttgataactttactttctaaagtaaattctacatgaagttgttttaaatgatctaataaattaaatcttagtcttttagaggcaagtggtgctttgtatcatcaaaatcattctaaaacacttgatttatttttagagtattaaaaaaacatagattagattatctaacctatgctttttattaatcattaccaataactttcaaatcttttggataactatttaagaccttacatccatcttctgttacaagtacaagatcttcgattcttactccaaattcaccttgtaaataaacacctggttcaatagagaaagtcataccttcttgaacttcaatatcatagttttgcgaaacatcgccccattcatgaacatcacgtccaataaaatgacctaaacgatgattaaattcaacagtataaccaccttcagcaataatatctcttgcacatttatcaatatcacataatcgaacacctggtttaatcatggcttctgctgccttttgagcttttaaaacaagttcataaaccgctttttgttttggtgaaacttctttataaaaaacagttcttgtcatatctgaacaatatcctttatataaaccaccaatatcaataacaatgctatctcctggttttaaagtagaatcatcaccactatgatgattatcagctccatttttaccataagcaactattggttcaaaagaatttcctgtacaaccatgtttttggtaaataccagcaagttgatcagaaacttctttttcagttaagtttcccttggcacaaatattaataacttcatctactactaaatcattaattttagaagcttctatcattaattgttgttctttttcatctttaaccattcttacacgatcaacacattcagaaccaagttcaaaatgacattcatctactaaatccatcaatggcattaaaaatctagctggaaagtttttatcgataccaattgaacaagcgccatcaaattcatcagcaagtaattgaagataattatctgtatcactataccatacttgttcaatatcaatttcacgatctaaataaaataaattattcataaataatttatgatgtccatcacttgataaaagaagtaaatacattctttcccctggattatttttataattaattaaataatcaatggatgatggatcactaataatcaaatgcgttaattgtcttttttgcatttctttgagtactttttctaatctcatctttaaatccccctactgcatttattttaatacgttttattttaaattaaaagaaatataattactttatttacaatgcttataaagtattatattggattaattataagtattagacattattaataaacatttataaaataaagacagtaaaaggaggaagatgtttatgaaaaaacattggttggtattagtttgttgctgtggcttagctgctgcatcgattggaatttctattaattcatcaggtgttttctatacacctgtttcaaagaatttacatatgttaagaggaacattttcaatgcatatgacattattttcccttgcaactgctatgatgtcattatttgttccaaaaatctatgaaaaatttgcttttaaaaaagtacttactatcagcgttattgttgccgttgcctctacagcagctatggcactaggaaaaaatgctttaacattttatattttaggagctgttcgtgggatgtcgacaagtttattttccatcgtacctattacaatcattattaatggttggtttgaaaagaaacatggacttgcaacaagtattgcttttggttttagtggtttaggcggaacaatttgttcacctattttatcaagtatcattagttcatttaattggcaaatgggctatttattaaaagccatcattattttattattatgcctaccagcttgcatttatccttttaaaatgacagcctttgatgaaggacttgttccctatggctatcaagaaagaaaagaaactatacaaaaacaaacaacttcttctttccattttatttctgtttcatttattgctttctttatctttggaatgttgattagttgtattacaagtgtgactcaacatttaccaggatacggagaatctttggggtatccacttacaacatgtgccatgttgttatctgcgggaatgatgggaaatattgtttctaaattgattatcggtagtttaagtgattattttggagaaatgaaagcaacacttatgatgattggagttaatattttaggaattattttactcatgattggtaaatcaatggttctacttattatcggagcttttatgtttggttcttgttattctttaggtgctgtcgctgttcctttacttacaaaatatttctttaaaacagaaaattatgcaaaagctttcccaacaatttcttttgcttctaatgtaggagctgctatttctttatccatggttggttatatctatgatttctttggttcttatctttatgcatttataatcgctttaacaatgattatgatcagtcttgctttattgtttatcgtaacaaaaaccaaggaaaattagttccttggtttttcaaatataaccgtttgtttttgcgtttcttgattgacttcaataacatcttttacataacagatatcttttctattttttataaactcttcattggttgataatacatcataacccatagaaccacttcgataatgcattggtataacaatacgtggttgaatttgattgatatattctaatgcttctttagtatctattgtataataaccaccaataggaatcattaaaacatcacaattcttgatttttgaaagatcatcaatcatacagccaatatctcccatatgcacgactttcatattttcataagttaaaatatgaatcgtatttttaccacgacgactacctaaatgatggtcatgatacgtttcaattttttctactttaaattctttaggcaatacatctacacaatctctagcattatgatcatcgtgctcatgagaacataaaactagatttccttttaaatgaagtttgtttaatcctggaattgaatcttcttgataaggatcaaaaataactgttccatcactgcctgttatttcaaaacaagaatgtccataccaaataattttcatcaaatcactcctttgcacttaaaatcattgcacctaataatatatattctaaaatattttccactttaataatctttggatatacttttaaagaatattgactcaatgatttttttatttcatcactcacatcttgactatctaaaatcaaatcactataaacaactatcgcctctggtgatacaattgctataatactcataatatttttactaacaagttccaatgtgccttctggtgtattcgcaagtgtaaaataatcattagaaagttttaatggtaaaagtgctacttctccagcaagatgatccattcctcttactagttgaccattaacaattatgccacttccagccatacgtccaataggttggaataaaaaagcaatagatttatattggttttgtgaagcataatagcctacaacagcagcattaacatcattaatcaaataaatttccttttcatatctcttctccaacaattccttaagttgatgatttccaccctcaataatccccgaataaacgtttccttcaaccatcactcctggtaaagcaatagaaatcacatcaatcatttcattttgtaaaacaactgtatctaaagcatccagaacatcatgtaatttgatattacttttaataatattactatctaatacaatttcttgtagattattatataaacgataagaaatatgactattttctccattagcgttaatagaaaccgctaaaatatttttctttgttttaatttccatcattgatgcaagaggttctactgtactatcatatttcttttccttattttttatagactcttcaacaaaagtaatcaaagctcctacattataagaagcaaaaatttgtgtaggtatctttaaaaccaatttatttttaaatactttttccacttgtaatttaacataagaaacttgaggagcgagtaagatgacatcataattttgagcaacattatatattttttgatatgaagtagcagctacttccatatttaaatttaaaacttttattccatttttgattttatctgcaaaaaatgctgttgtcatcccgccactacaacaaagtaaaagacgacatattggttgattaaccattttttgaatacattgatccatttcttcaaataaagaaatagcatgtttcaatgttttgaattgaaaatgaagataaaaagccatttcatctgttcttttattcattacacataattctatgatacattgtggattaaaagtcacataactataacagtattcattttcaataataatcgcatccggatccgtttcacttggataaagataataataatctcttttttgattactgatccactttctaaatatggcagtttgtatctctcttaaataatcatccatttcaatcccacctttattattattttaccataatcctgcccactaaagaaagctcttacaaaaatagaaaatatttctcaaaaaaaatccaacctttactcaaaaagttagaaaattattcctaatatatctttccttataaacaatcatcttcgaaaataaaatataaaaagcataacaagcaataagaacctatctaaattctattgcatgttatgcattgaattattagttaataatttttaaaacatcttcttcatttgttacattaaaaatatgacgtgttaatatgttaagtttttcaataggtgcttttgataattgatttgttagattatttgatagatttccaaactaaatttctaattgttcttttaacgtattttgtttttcttccaattttccttcaataactccttcagacctaccttcttttctaaacccttctgccattctttccattccttcacacatatccatttcatctccttctagaacgttttcaacttgatctatacttcctgtaataatggctgcatagagaaagttttcttttttcattctctttaatctttttaaatcttcatagcttcctttatacattgcttgaatagcttctataaagtaacgagtttgttcatctttgatcttatttgtatccatttctttaacatctacaagaataattttccaatcattaaagtatttctttaattcttctggtatttcaaaataatcactgagttttaaaggaccattccatttctttggtcctgtataaagtactactattatttgaggaactaatcttttatactctttattttctgcctgttttaaatattccaacatttcatagattccacaacgaataaccatcgtttcatcaatactactttgatgctctattcctagtatacagtagattccattaatatcacttttaacgacaatattccttcttctttttttatcttctgctcttttcgaatcattgataataaaagaaatatcattttcataacgtaccaatctatcaggatgaatgatttgtttcccttcaaatatagctgcattataaaaagatgcaaaactgacatcattactgaatactgttcgacaagcaccatcagctgttaacttatttagaggttccatacacattacctactttcttttaaagtaacatatctagatttattacaagtagattataacatgtatgaactcaatatttgtcccaagtttgtctcaaatttgtctcacaaatgtctcatttcttatacttattttatctgatggctactgttttcccatctaataatgataagtcacaatctgattcataaaatatttttgccatttttaatatcccccttaatcttcttggcttcctctatgcattccaacgagtcctgtacgggcaatttctgtcacgttgaatccgttaagcatcgttaataactgattgacttttcttgtatttccagtaacttctataattaatgaagttggtgaaacgtcgataatatgtgctctaaagatatcaacaattgagttgatatttgttctttgatcagcatttgcatctactttaattaaggcaagttctcgataaactgaatcatctggttcaagtttttcaatttcaacgacttctacaagtttccctaattgtttttcaatttgcgttaaaatttgttcatcaccagtagaaacgactgtcatacgtgacattcctttaatatttgtttgtcctactgaaatactttcaatgttatatcctcgtctactaaataaaccagcaacacggtttaatacccctggattattttcaacaagtaatgacaaaacaagtctatccatgttttaatcctccctattttttcaattgtttatgaattctattcatagctgaaatgattgctttaattgttgctgttgtaatatttggatgtacccctactccatattcttgaacagcacttcctttaactcttaaataaacataagcagctgcttttgagctagatcctgatgataatgaatgttcactataatctaagaaatgtgtataaacaaagccattttcattaaatgcatctttaacagcatcaattggtccattaccataaccaacaattgttcttacttcaccatgatcttttaatgtaatttctgcttttctttcaaattcagaatcatcttcagaaatatcaattaatttttgtttaataaattcatatggttctttaatatctacatattgttcaataaatgtatcataaactctttctggtgaaacttctccttcttcttcagaaatatcttgaatcacttttgcaaagttcacttgtaatccttttggtaaatgatagccatacatgctttccataacataagcaacgccacctttaccagattgtgaattaatacgaacaattggttcatattgtctacctaaatcacttggatcaattggtaaataagggacttcccacatctttgaatttctttctcttaaagcatgcattcctttattgattgcatcttggtgacttccagagaatgctgtaaagactaattgtccaacatatggatgtcttggtggaatatccatttttgtacatttttcataaacatgtttaatatcattaatacttcctaattctaattgtggatcaactccatgagtgaacatatttaaagcaacagtcacaacatcaacatttcctgttctttcaccattaccaaataacgttccttcaacacgatcagcacccgctaataaagcaagttcagttgaagcaattccacaacctctatcattatgaggatgaacagaaacaatgactctttcacgatctttgaagttacgacacatccattcgatttgatcagcataaacatttggtgtatccatttctacagttgaaggtaaattgataatcactttattatctttacttgctccccatgtatccataacagcttcacatacttccattgcataatcaacttcagttcctgtaaaactttctggtgaatattcaagaataacttttccttcaaattcttttgataaatcttttactaattgaacaccatcaattgcaatttgtttaatttcatctttatctttgttaaagacaacgtctctttgtaaaatagaagttgaattgtaaacatggacgatggctttatctaatccttttaaagcttcaaatgtttttctaattaaatgttctcttgcttgagttaatacttgaaccgtcacatcatcaggaattaaattttcttcaattaataatcttaagaaatcatattcaatttgacttgaagaaggaaaacctacttcaatttctttaaatcctaagtctactaaaagttggaacatttccactttttcttctattttcattggtgtaattaatgcttgatttccatctcttaaatcaactgaacaccaaattggtgctttttcaattgttttatcaggccaagtacggtcttttaatttaattgtttcaaatctcttgtacttttcgtaattcatttccatttcctccttaataatataaaaaaactcccgtctcaaaatagccaatccagccattttgaggacgagagttatattacttcgtggttccacctcaatttgtgaataaatcactttatccacctcgctaagtacgctacataatagttcatactcttacaaaataacggttgcataccgtagccacctacttaagttcagcgctccactcaaggatgagttcagtattactcaaacaactcttttcaccaaccagaatttctctacgccttgaaatagtacttactagttcctatcgaagtatttattttatggttacttgtaatgttagactttttttttactaaagtcaatgtctttaagataatttcaataatttaaaatatattattaaattaatatttttttattatttatcaaaagcaagtttaatgactctatctaataattcactataagaaataccaaaatcattcattaattgtggatacattgaaatctttgtaaatccaggtaaagtattgatttcatttaaatagatttgatttgatttcttatctaagaagaaatcaactcttgatagaccatgtccatcaactgctttaaatactcttaaagcatattcacgaatcttatcttgaatttcttgatcaactaaagcaggaatacatgttttactttcttcatcttcatatttagattcaaaagtatagaattcaccatgaggcatgatttgtccaacacgtgaaacgattggatcatcatttcctaaaacagccgtttcaagttcgatacaatcaacacattcttcaacgacaatatgacgatcatattttgaagcttcaataagtttagtcattaaatcttctttatgatcacaacgataacatcctacacttgatccagaacgacttgctttaataaaacatgggaatcctaattcttcttccactgttttttcaatatcttcaatttcatcaaattgtttattgacaacaacaagttttccatcatatctttttttaacatataaggattttacttgaggaatccctgctgtttctaaaatcttctttgtatagattttatccatagatactgctgaagctaaaacacgacatcccacataaggaactccagcaagttcaaataaaccttggattgttccatcttcaccaaaggctccatgtaaaattggtaaaacaacatcttgttgttttaataaaccaaaaacatcttgaagagcttttgcattgtctagccatatatctttagcaagatcttcttgattttgatctaaaatataccaagaaccatcttgatcaattcctactaaagtcacatcataattttctttatttaaattattcattactgaagtacaagacatacgagaaacaatatgttcactcgattgtccgccacaaacaaccattaatttttgtttcataataatctccttatcgatataattctaaccaatcatcaacaagagaagtatctgtataataacgtaaaacatgatatacatacttactatctccatagacggatacattatattcttttttacatttttgcgaaaacgctatagcattttgataagtgtattgcttgtcagtttgttcaacatatttaatatatccaataccataattataagattgtaaggctaaaaagatgcctttttcatcttttattgaagtcacatttgcttgttttaaacactttgcaaagtattgaatacctacttgaatggaatattcaggattattgatggcattgggcttcttttcaaactgtgtattaaattcacattctgaagattgcataggatcatttccctgcccccctgattcttgcatcatcatcgcttgtaataattctatatattcttctatatcattttctctagcatattttagcattaaatcttcataattcaatacctgagttgaaaccaatggattctcttgtttaaattgattttttataagttgaaagaatgaaaaagccaataaaaacaataatgctgcaagaattaactgaaagggtctttttaatcttaactttttcttttttttcataacttatatcttttctacaatttcttttaaattcatagagtgacttcctttaactaaaaccacatcatcattctttaaaaattgatctaattgttcaataacttcttgattagaagtaaaataataaacattcttcattttttcttttgctttttgatacatatactttgcttcttttccaatacaaatcaacacatctatttctttagtagcaacatagtttcccacttcttcatgaagttgttgactataatctccaagttctaacatatccgctaaaatagcaactttacgttttttataatttgttagaacatcaatacttgatttcattgaatctacacttgcattatatgttccatcaataattgttttatgatttttttcaagaatatccatacgattcttcgttaatttaaattcttgaattccttttttaatatcttctaaagaaatatttaattcaatacctaccgctatcgcaattagtgcattaaaaacattatgctctccttgaacaggaacccaaattttttcactttgatcatgataatgaacaataaatgtactgtgatcttcaaataattcaatatcacttgcttgaatagaagccccttcattttttccaactcttacaacatttaaacgaggtaaatcaacagtctgtaacatatcattatcattattaataattaaagtggattgatctttcataccatcagtaatttctaactttgcttttaaaatattttcacgacttcctagttcaccaatatgtgctgttccaacattggtaatacatgagacatcaggatgagcaatcatagataatcttgacatttcatttaaatgattcatccccatttctaagaccatgacttcttcatcttgatatcttaaaattgttaatggtagacctatttcattattataattaccttctgtttttaaagttttatatttttgtttaacaacactatagaccatatcacgtgtacttgtttttccaacacttcctgtaactcccacaacctttacagggcgatgacttcttaaataaatggccatatcttttaaagcttgataagtatcttctactttaatcacaattttatctggataacttacatctttagcggtaataattgctgttgctcctgtttgaaaagcactttcaataaaatcatgtccatcaaatctttcaccttttaaaggaatatacattcctccatttttcatttgtctactatcttgactaaagaaacaaatctcatcttctttatttccagaaactaaaataccttttgttgcctctaatatttcatatactttcatattattctcctatgcatcttgtaaattttcaaattcttgtgctgtattttcatttaaagctttatattgccctttaatattgaaaacaatatatttgactccactttcttgaacatatcctttggtaaataaatcagatcctaaaacttgtaaatctgatacaacgatattcttaaataaaatctgatcatctttcccatttaaactcatcattttaagttgggttcctgtcgcatagacaattttattattgactaaagcaatggctctattttctacttttttaattgtttcttgttttaatgtttctttattgatttttataatttgtgaattatcagtaagatataaatctttgttatcaagagcgaatgtacattgtttttcatagagtgtttcaatattttcacctgtaattgtcattctttttaaagcatattgttcatcatttttagctaaataataaatatattttccatctattgtaatatcataagatgtttcatcatttaatttttgatttgtttgatcatccaatgaataacgatataaactttcatgatcttgatctaattgataataaataacatgattttttataattgggtaatacacattttctaatatttgggtcgttgtttttgtctttaaatcataagcttgataattatattgagaatcacaataataaagaacatgattttcaatacttaaatagcccacacaatcatctatcaatacttcacttgtttctaattcatctaaatcacttactaaaagttgattattgataacataataaagatgttgtttatcttttagatattggccacctgcttgattattagcagaaacattatacgtactcactttgccttctaagacataatttttttcttgacttgacgttgattgtaaaggatgacttgtcatataacttcctagaaaaacagctgataaacataaaacagctgaaagtatccaaagaattggctttttccaatatcctttataaggatcctcttcttcaacaacttcctcttgtgtttgtcttgttccacaggcaggacaaatttcttcatcttcgcttaaagggagatgacaacgaatacatactttttttattggttgaagctgttttccacattgaggacaaaacagcatatcatcttcgacatatgttccacattgactacaatacattcttatcactcctagtgaccttattctaccacagtcataaaataaaaagaatgactaaattgtcattctccaattgatgtatacattccttcactatttccaataaaataatgttgactataatcatcatcataggcataaaaaacaacatattgaccagcaacaaaataatctcttgcatcatcgtaaatagcatattgctcatctcctacatatgcatccaattgatcatcaaagctttctacataagcaatatcttgttgatttgcttcatctcttgcgagtgcaaaacgataaatattatcaacttctttaagtcctttttcctcttgtgtatctaaatcaacataatagattccttgataagtacgataatataataaaccattagaaaaataacaatcatcataactatcaacatcttttttcaaaacatttccattaaaatcaattaattgatttttataatttaaattttcatataaaatacgttggctttgatcatcaatactaaaatgatttacattctctttgatctttttattatctactttattcatttgatcatctatcgttaaacaatataaattatcattttgaatatagaaaatagattgatcaagaacataacaatcataagcatcatttaataaagtctttttattattttgatgatctgcaaaaatcaaatctccatattgtaaatagaaataacctcgatcatctacataaagatgatcacaacttccttcttctaaaacttctttattttcaagtgttgaatcatatttaagaagttgatctcctgttgctagatatagatgattttgataaatataaactccaccactatttttttggaaattataattataatcactgcgtgatgtatcttgttgaatgttaaagtctgttaatgaactatttccactatcatcaaaagatgtcgtttcatctgtttctaaactatctcctatgaatccaataattgctcctgcaatcggaataattaaattaaaagcaacaataattcctataattattttaacaattcgtttattttttcttacatttggatgattaaacgtttttttatttttttgaatgggtacatacttattcaaatctttaaaaggctttttataatcataggcattctttttataatcataactttcagaaactgtatgataattatgacttgcttcactatgtacacttgtatcaggggttactttttttattggctcagacttacgataaattgtaggacttccacaattagaacaatattcttgataaggataaataagttttgaacatactggacacgttgttttcccaatttgtttatgcccacataaatgacattctaaactattaccaatttctaccccacaatatttacacttcatactccccctcctttttttcatcatatcataaaaaaagaccgctttggtcttttaagataattttttatataaatgattgccgattgtttggataatttgtacaaagataataagaatgatacttgtaacaacaagataaggaatcttgtaggcttgatagccatatcgaatcgctatatctccaagtcctcctgcccctaaggcaccacccattgcactatagccaataatactaatcattgtaagcgtaattcctgataaaatagcaggaattgcttcttttaaataaatacgataaatgatttgaaaatcactggctccaaatgatttagctgcttcaattaacccaacatcaacacttcttaatgcactttcaatgactctagcaacaaaaggaatagctgaaattgtaagtggcacaagagctgctgtcgttccaatcgctttaccggcaataagtcgtgtaagaggtattacgatgaccattaaaattacaaatggaaaacttctaaaaatattaacaagaatatctaaaattgtataaataactttattaggttttaatccatcaggtgctgtgagtgttaaaataatagcaggaataaaacctaaaataacagcaaagaaagttgatccaatgaccatatataacgtttcatacgttgcttttaaaataacatcactcatacaatttcctcccatgtaattttttcttgatctaaataattttctactgcttgtagatctttttcatcaatattgataataaggcttcccatcatggaacctctaaagttttcaagttttccttggcaaatatcaaagttgatatcaagtgttctagcaagttgtgtaatcgtatgtgatttggaattattatttgtaaagaataatttaatatttttaccagtttgtggcagaatttcaatatcatcgcccacaaatttttgaatttcttgatttggtgccacaaaaagttcttccggtttacccactgataaaacacgtccatctttaagaaaagcgactttattacagatttgtttaataacttccatttgatgtgtgacaactacaatcgtaatattcatctctttgttgatttttaataatagatttaagatatctcttgtaatttgtggatctaatgctgatgtagcttcatcacataaaagaattttgggatttaaaacaagtgctcgagcaatcgctactctttgtttttgtcctccacttaattgacgaggataagcttgacttttttcttctaatcccaccaatttcaaaagtttttcaattctctgtttattttctaaactatgaggatcttgtttccaaaactttaatggtaaagcaatattatcataaacatttaatctatttaaaagattaaagttttgaaagatcatacccatttctttttgaatatcactcatttgttttttatttaaagatgaaattgcttgtccatcaacaatcacttctcctttttgaaaattctctagaccattgaaacaacgtagcaatgttgacttacctgctccactttgtccaatgattccaaaaatatctcctttttctatcttaaaagaaatatctttgagcacttctaaagagccataacttttatataaattttgaatttcaatcataaacctcttcctctcaaccaaagaaacattttcctatatggcaatatccttggggattcttttctaaatatttttgatgatactcctctgcttcatagaaattatcgagtggttgtatctcaacaaccactttttcttgataatttttttgaatttcatttgttttattttgaataatttctaagtcactttcatttgtataataaatacctgtacgataagaaattccttcatcttctccttgtttatttaaagaagtaggatcaattattttataataatcatccaatatttgatttaaacttcgaagactttcatcatattcaatttttaccgtttcaacatgtcctgttttccccgctttaacatcttcatattttggattttctgtacgtccattggcataacctactgttgttttaataattccttcaaattggtcaaaatacttttgaacgccccagaagcatcctcccgctaaataaataacactcattttaaatctccttattttgttggatctgtaaagacatctttcactgatcctttatattttttaatatagtttttcacttttttagattgtaatgctttctttaaagcttttgttttagcagtgttttcatttccttctttaactactaagtaattgatataaggttgtgcttcttcatctgtaaaactttctgttaataaaacgtttgcgctatctcctaaattatgttctaatgcatagtttccattgataacagcaacatctacatctggtaagttgtttgataagttggctgcttctaattcttcgattttataattatgtggatttgatgtaatacttgatgttgtataaagtgtatcatcgtttaattcaattaagttatttttagcaagtaaagcaagtgctcttgattcatttgaaccatcgtttggtacagcaattgtagctccatcttttaaatcatctaatgattttaagttttctgaatagagagccattgcttcataatgaataccggccacggcttttaaatgtaattttctttctttattttgttcttttaaatacgctaatgtttggaaatagttagcatctaaatctccatcttctaatgaagtattaggtgttacataatctgtaaattcagtcacttctaatgtataaccttctttttctaactcatctttaacgacatcatttaagatctctgcatgcggtatagctgttgctcctattttaattgttttatcatcgtttgatgatccattagcacatcctgcaattgataatgcaaatgctgctgataataataattttaatccctttttcatttttcttttcccctttttcttttattacaatacaacaaacaaaaaactcgtcctttatacaaaggacgagttacctcgcgttaccaccttaatttaaaataacctcacaattatttcctcatcgagtaccatcatactctatcactttaacgggtgaatccgtcatagcctaaccaagatcttgggtcggtatgcaactccaaggccattttcgtttatcttccatgtttcttttccaccaaccaagaactctctaggcattttcgataaattactttccttttcaatgtctttttgtattgttggtaccatagtatacctctatgaattagatgtcaatagtttttattcattttcatctttttctacataatttacatcaataacatcgtcactcccattacggtaagcttgacctgattgataagcagcttttttctctgcgatttctttttcaattctttcattatattctttcaattgtttttcatataagtatcttctaataaaagaataaatcacaagaatagcaataatgatccatgtaataggactgaataataaatttaataataaacttaaaactaaaataacaactgcaataactaaaataatttgataaattggcatttttttactcctatttagaaaaattaaataattccttcacttctactttcaaaccatctgctaattttgaaatagcttttaaggaaatatttcttgtccctctttcaacatctgaaatataatttttagataatcctgaacgaaatgaaagttcttcttgagagatatgtgctctcactcttaattctttaattcgtaaaccaaataaaatgtgaatatctttattcattttgcatttgcattaattgtgctgcttgttcacttaattttttaaaacgatgatgcaatcccgatttactaatcgtcaaacctgtttcatcttgataagcattacacaattcatttaatgtataatctggatattttttacgaatcaaagcaacagttcttgttttttcatcaagcatatcaagtcccataaacatctcaataatactgatatcttctaattgtttattagaagaagccattgatttgacctcattagcaatatcacagttattccatctatttacagtatttgacatactacgatcaatacgagtactttcaaaattcatcaccgattggctcgcaccaatggctcttaaaaagtctcctatcttctctgccgattttaaatatataacatatttgtttcttctttttgtcattttggcatttaaatgaaaataattcattaattcttgaataaataaagcatattcttcttcatcaacagataactctaaatgataattagaggtttctgggttattcacagatcctccagataaaaagatacccgctaaaaatgctcttttacaacattctttttgaattatttttttatcaggaagtgtatggaaacctaatccattcattaaacctaaatcatctaagatttctcttgcttttgagactttaagaatatagacattatttttttgtaatttcatttttctagaaacaagaaactctatatgaggatgatacacttcttttaacattttatgaactttagatgctatttttgcattttctgttcttattgtaagtaataaaccttgatttgataaagaaagtgttccattgactttaataattgctgataaaatagctttttgacaacaaatatcaaaatcattaaaaacaacttcctctttaacttgtctagcaaatgatactttcattaatgaacagcatccctatgtagacgatgaacatgatacttttgactatagtgatctgcaaaataatttgttaagctcactgaacgatgttgtccaccagtacatccaataccaataacaacatgtgtctttccttctttatcatattcttctaataaataatctagtaagtttgtcattttttgaataaagacttgtgtttcaggtttatctattacataatcataaacttctttatcgtttcctgtaagatttctaagttcctctatatagaaaggatttggtaaaaaacgcacatcaaaaagtaaatctgcatctttaggaattccatgtttatatccaaaggatacaaaacttattctaaatggatctatagattgatgattaaattgattttctaatagttgttggaatttatttccttttaaatgagttgtatcaataaccatatttgcttctttagaaataggtcttgctaattttctctcatattcaatagcttcaactaatgtagaagctttattagaaatcaagataggatgtgttcttcttgtttctttatatctttttaaaataatattatcatcacaatctaagaaaacaactgatacatttaaccaatctacattgtttaaaaaacgaatagcttttggtgcatcagctaaacttactgccatggctattctttgataattcgtattatcttttaaaaattctgaaaaagcccctaacaaggcaataggataattatcaatacaacaataagccatattttcaaaagcagccattgcagttgtttttccagcacctgacatacctgtaacaatgacaatctcaattttatccataatacctcccctttctattttcgtatctattctatcaaaattcatctctaaataaaagacagatgtgaccatctgagcttttattttaatgaagcaatgtattgtccagcaatagcaccatcatttgtagccgtaacaacttgtcttaattgcttacttcttacatctcctgcaacaaaaactcctttaactgctgtttccatattttcattagcgtcaatatacccctctgcattaacaattcctaatgactttgcacattgtgtcataggatccaaaccaataaatgggaaaataccattgatcattaatgcttctttttcacctgtctcactattttctaaaacaagaccttttactttgttatcttcttctaaaatctcagctggtttccttttaaaatgaacttcaatattttcactttttaataaacggtcttgaataattttatcagctctaaaaacatctcgtcttacaattaaatgtacttttttacataatgttgcaagatacattgcttcttcaagcgctgaatttccaccaccgatgacagcaacttcttgatttttaaagaaagggccatcacagacagcacaataagaaattccacgtccaacaagttcattttctttttcaagattcatttgtctttcttttgtacctgtcgcaattaaaacatattttgtttgatatgtttgtttagcagtgataacttctttgtaatctccgtaatctttaatatctaaaacttcaccatattccatttttgctccaaaactcaaggcactttcatacattgtaaaagcaatttctgggcctggtgttggtttaagtccaggatagttttcaatttgagcagtaacatttaatttaccacctggagctgcactatcaaatattaaaacatctaatcccgcacgactcgcatataaacaagcacttaaccccgcaggtccagcaccaataattattaaatctaacatttttctttctcctttatataatttataaattcttgataatcattaattaacaaatctggatgttctttttctataagagcatatcctttaggtgaccatttcactcctactgttttaattcccgcatttttacccgcttgaatatcagttacattatcacctacgtaataaccttcttgacaatttaatttttttaatgcacataatattccttcaggatcaggttttgaatgtttcacatcattttctccaatgatgacatcaaaatatggtgttatattaaataaatccaatcctaatatagctgcttctttatattttgttgtaactacagctagaggaaaatcttgtgcttttaaatattttaacatttcttcaacatatggataaattgtgacataatcttcatgatgtgcatgattatattctcgataatattgaattaattcatccacttgatcttcttctacatatcgactaaaggtattttttaaagaaggccctaaaaatgaaagcagttcttcttcacttaaagtataacctggtttatattttttaaatgtgtgtataaatgatttttttattaataaatctgtatttaagagtgttccatctaaatcaaaaataattgcttttttcatacttttctccttaatgtaaattattatatctattttacaaaaaaaagatagtcttatgcactatctttcctccaatacatcttgtcctttaaaatgacaataaataaatcctattaaaccaacaataaaaaatacaatagaaacaagttgtgctgtttttaatccaaaaacatataaactatctgttctaaatgcttctatgaaaaaacgaataactccataccaaataaaataagtaaaaaactgaattccttgtttttgttggtactttctaataataaagaaaataattaaaaaaccaatcacacatcctaaggattcatataaaaatgtaggttgataatattgaccatgaatatacattttatcaatgataaactgtggtaaatgaagtgcttttaagaaacttaaatcaactgcacttccataagcttcttgattaaagaaatttccccatctcccacatgcctgggcaataaggacacctggcatgatggcatcccccgcaacaagaaatgaaatatttctttttttaaagaagaaataactataaataagtcctgtgataactcctccttgaatagcaagtcctccatgattgatcataatgatttccatcggattattggcatacaattcattccacataaaaatcacataccaaattctagcaccaatgattcctacaaataataaaccaaaaacataatcagaaagtatttcttttgaataacctaattttttaaaatgatattgccctaaaaaataagcaattgctgcacctgtcaatatacaaactgcataccattgtatagaaagtggtccaatttctataaaggtattaaaacttgggaaaaatctcattgttcttgtttattatgatcaatatttttaagaatacgttcaacaaattctttacttgaatcaatacctacgtcacgtaaacgcatattcataactgccgcttcaataataaccgacatactacgaccacttgatacaggaacaactattttaggaattttaattcctaaaacatcttctgaaatatcattttcttcaacccctacacgtgtatattcacgtgatggtacccaacgttctagctgaatcaccaaatcaacatcatttctatctaaaatagcagaaataccaaacatcttagaaacatcaataaccccaattcctctaatttctaataaattagcaagaacagcaggtgctttaccaacgattttttgtcctatacgataaagttctacagcatcatcagcaactaataaatggcctcttttaacaagttctaaagcaatttctgatttaccgattccactatcccctttaataatgacacctttaccatgaatatttagaaaaacaccatgcattaatgtttctcttgcaagtttttcttctaaggtattcataagttcacttgatacaacacctgtaatcatttctgtttgaaaaattggaaagtttctttcatcagcaatattttttaatacttcaggacaagcatgtcctttacaaattacaatacaaggtacttcttcattaattaaacacggaaagatttctttttgtctttcttctgtcatctcagcaataaaagccatttctttatcaccaaagacaataattcttctaaagtcactatgtttaaagaatcctgctaattcaaaacctggtcgattgatttcaccagttaaaataactctttttaaagattcttcatttcctgtaacttgttgataatttttattattccctaataatttttctactgtaattgatttcatcttttttctccttaaagcattgatttcaagaactgacctgtataacttttttcacactttgctactttttctggagtacctgtaacaacaattgttcctcctccagctccaccttcaggtcctaaatcaatgatatgatctgctactttaataacatctaaattatgttcaataacaataattgtatctccttgatcaacaatacgttgtaaaacatcgataagtcttgcaacatcatgactgtgtaatccagttgttggttcatcaagaatataaacagttttccctgttgacttcttttgtaattcacttgcaagtttaactctttgagcttctccaccagaaagagttgttgcactttgaccaagtttaatataaccaagaccaacatcataaagtgtttggatcttatttctaatttttggtaaattatcaaagaaatctaccgcttcttctactgtcatttctaaaacatcataaatatttttatctttataagtcacttgtaaagtttcttcattatatcgtttaccttcacattgttcgcaaggaacgtagacatctggtaaaaagtgcattgaaattttctttagtccatcaccttgacacgcttcacaacgaccacctttaacgttaaatgagaatcttcctttatcataacctctcattttcgcttcatttgtttgtgcaaataaatcacgaatatcatcgaagacacctgtataagttactggatttgaacgtggtgttcttccaattggatcttgtgaaacttctatgactttatcaatattttcaattcctaagatttctttatgtaaacctggtctctcttttgattgataaacatatctcattaatgattttcctaaaatatcattcactaatgttgatttaccacttcctgatactcctgtaacgacattgaatttaccaagaggaaatttaacattaatattctttaaattgtgttccttagcccctttgacttcaataaataagccattccctttacgtcgtttttgaggaacttcaatctttctatttccagataaatattgtcctgtaatagaatctttacaattcataacttcttctggtgttcctgcacaaatgacttgtccaccatgaacaccagctcctggaccaatatcaacaataaaatctgaagctctcattgtatcttcatcatgttcaacaacgagaacgctatttcctaaatctctaatatcttgtaaagatttaataagcttttcattatctctttgatgtaaaccaatagatggttcatctaaaacatataacactcccgtaagacgtgttccaatttgagttgctagacggatacgttgagcttctccaccagataatcctcctgcacgtctagcaagtgttaagtaaccaagaccaacattatttaagaatgtaagacgatcattgatttctttaacaactaatcgagcaatattcatttcatagtctgttaattttatattttgaataaaatgtaaagcatcctcaattgattgttctgtaaattcagcaatatttaaaccaccgactcttacagaaagaacttgatcattaagtcttcttcccttacatgtaggacaagtatgttctgacataaaggatgcataccattcttttgaccattttgaagttgtttcttcatatcttcttgcaattaatgttctcacaccttcaataaattttgttgtacgtgagacatttccactatctgatacgatttcataactaataggttctctcgaaccatcaagaatataactcaattcttgttttgtaaaatcttttaatggtttatctaaatctattttatatttcttacaaagaattaaaaatctttgccattcaatacgatttgttcctactgctgttttaaaataacgaagtccaccttcattaattgatttactccaatctggaatcaataaatcatcatccacttcatttttaatccctaatccacgacaatctggacaagctcctaatggattattaaatgaaaataaacgtggttctaatttaggaacagaaaaaccacaaattggacaagcaagatgttcactaaaaagttcttctgtttttgttgttaagttttgaacaatgacttctccacccgttagtttcaaaccgacttctaaagaatctactaaacgactacgataaccttcttttttgataatacgatcaataacgacatcaatatcatgttttttatttttatctagttcaatttcttcatccaacatgtaattttgtccatcaacaaccacacgtaaataaccatcttttaataagtccgcaaaataatctttaaaagttcctttctttcttttaacaactcttgcgacaaccattaaacgatcgccatcagcgtattggtcaatcgtatctgccatttgtttaattgtttgactttcaataacaacatcatgtttaggacaataagcttttcctacacgtgcatataacaatcttaaataatcatagatttctgtaactgttcctacagttgaacgtggattgttagaagttgttttttgatcaattgcaatagcaggtgataaaccttcaatcgcatcaacatctggtttttccatattgcctaaaaactgtcttgcataagcacttagtgattctacatatcttctttgtccttcagcataaattgtatcaaaagctaaagatgttttccctgaaccagaaagacctgtcataataacaagtttatttttaggaatatcgatattaatgttttttaaattattttctcttgctcctcgaataattaatttatcttccatcttttcttcctttcaataattgaataacactttctttgtcatgccctctcatttgtaaatcataggcccaatcaagtaattctttgaaatcttgattaggtttaaatcctagttctattaagagtttaccatccacaaaaggttttaatgcatgatttccacatcttgaaaccttttcttcaacataagtatctaatgttgaaattgtttctggacgatttgcaagtcgtcctaacttatcacatttcgacatacatactaaatcgtttaaaggaaaaattccttctattccttttaataatttatagtaactataatctttactttgatttcttaccatattcatcaaatgcatatgataatagatcattgtacgaatatattttttcatttttttatttgtaaaaaaatgactaaaatattgattaaaaacttttacaccactttcattatgccctggtgcttttccttcaggagttgttactaatggttttcctatatcatgaagtaaagcactccacatgaaagcaagtggccaacttgttttatctttacataaagcagctaagtcaacaactaataaagtatgattcatcacatttccttcaggatgaaaatctaatctttgaggacatgttactaatgtttctaaaggacgaataagagcattgagttctaataagaattttaaacccattgatggatgtgaagacatcaataacttattatattcttgttgaattcgttctaaagacaaatattgtaaaactccttcattgaccattttttgacaaatctcttttgtttttaaatccacttgaaattcaaaacgagacataaattgagctaatcttaatactcttaaaggatcttcataaaatgttttttcatcaaccatttttaaacatttatttttaatatcttctcgtccttgataataatctatcaactttccattttgataatcatacatcattgcattgattgtaaaatctcttctacaacatgctgttttcatatctaaatctttatgaacttctacctcaaattctcgatgtgtttgtcctttttttctttcaatacgaggtaaagcaaaatcaaaatttggtaaacaatccaattttaaaataccaaaacttttacctacctcgtttacttttccatattgagataaaatatcaataatctcatctatttctagatcatagatttctacatctacatcatggtaatccaccttttgatacatcaccatatctctaacaataccacctacaagataaactcgaccttttttagataaagaatctaaaacacttttttctaaatgattaaactcaaacttcaccttgcaactccaacatcatatctctaagttccattgctctttcaaaatcaagtgctttagctgcttctttcatttgtttttcaagttctttaataagtgtttctttatctttcttcttcgctttcttaccctttttaacaagagaaatggcttcatccacattttcttgtccatggatagcttctctaatttcctttttgattgtttgaggaataataccatgttccttattatatttttcttgtatttcacgacgtcttgctgtttcatcaatggccttttgcatagaatcagtaattttatcaccatacataataactttaccatgactatttctagcagcacgtccaatagtttgaatcaatgatctttccgatcttaaaaaaccttccttatcagcatctaaaatacaaacaagagaaacctctggtaagtctaatccttctcttaacaagttgatacccactaaaacatcatattttccaagacgtagatctcttaaaatttctgttctttctaatgttttagtatcactatgcaaataagcaacttttaacccaagttctacaagataagcactgagatcttctgccattcttttagtaagtgtggtaatcaatacacgttcatttttttcaatacgttgatgaatttcatcaataatatcatctacttgaccatcaataggtcttacttctatgattggatctaatagccctgttggtctaataatttgttcaacaacttgatgatgaaccttatctagttcataatcacctggcgttgcagaaacaaagatagcttgatgaatcaaatcttcaaactcttcaaaaacaagtggtctattatccaaagcacttggaagtctaaaaccatattctactaatgtttctttacgagaacgatccccattatacattcctctaatttgtggaagcataacatgactttcatctacgacaagtaaaaaatctttaggaaaataatcaatcaatgtataaggtctttgacctgcttttcgtccatcgatatgtcgtgaataattttcaattcctggacacattcccacttctcttaacatttccacgtcatgtctcgttctttgatcaagacgttcatactctaatagctttgtttcatctttaaaatactgtaatcgttcttctaattccttagaaatcgtatcacaagcttttaacatttgttcctttttcgtaacatatccataagcaggataaatagtatacgtattataagagcctaaaatatgtcctgtaaggggatctacttcacaaatacgttctactgtatctccaaataattcaatacgaatcaaataactttcactatgtcctggaacaatttcaataacatcaccacgaaccctaaaagttcctttagtttgttcaatatcatttctttgatattgacgatcgactaaaaatgtcaataattctctacgatcaatatcttgatcaacacgtaatgagaaaatcatttctttatactgttcaggatttccaagtccataaatagaagcaacagaagcaacaacaatgacatcttctctttcaataagtgaattcattgctgctgaacgcaacatttcaatttcataatttgtttttgcatttttatcaatatagagatctctacctggaatataagcttctggttgataaaaatcgaagtttgaaataaagtactctactctattttcaggaaaaaattcttttaactctgaatataattgtcctgctaatgttttattatgtgctaaaaccaacgctggtttattatattctttgataacattagcaacagtaaatgtttttcctgttccagttcccccaagtaagacttgttcctttttacctgcttttaaaccatctacaagttcttgaatagcttgaacttgatctcccattggttgaaaaggagaaacgagtttaaactgagacatagtttcaccaccttattttatgattttaattaactgatcatactgtttatcattttcatgattattgatataaatcatcattcctgcaaccagcatttgtttatcactttgactatactctccatctacatttaaatgattatctgtttcaaattgttgtaatgctgcttgtgtattaactgaaaaataaccatcttctcgatcaacagaatatcctaaaatattgagcatcttttgcatagatttaatacgtgtatttacacaatcaacttttaaggtttcttttacatcttttgttgtaattcctgataatgaaacattatcaacttcttcatcaggtgttagaccctttccattaatacatgttccattaggaatcatccatttagcatacgtatactttaaaactgatccatcagaaagcgttttttgagtttgtgcacttccttttccataagttgttttaccaataagttgatatcctttttcactttgtaaagctcctgctgttaattcagaagcacttgctgtattttcatttacaagaatataaccattttcaaattcatattttttatctgattctgcatagtatttttttgctgcactatttttttctttcatttgataaattacttcatctgaagtaaagaataaatctaaaatatctgtagcagctgttaaatagcctccaccattatctcttaaatcaataactaatgtttgaatatttttctttttaaacatttctaaggctatttctacttgcttagcggtatctgttccaaaagttgataattcaatatatccaaaagatacatttccttgttttcttatttcataaaaagcagaagtatctaatgcgcctcttgtaactgtcacatcacttgttttttgattacttaaaatcgttaatgtaacttctgttccatcttcacctcgcacatagtctcttacttgatcagtacttgcttgtgctaattcatttccatccgctttcgtgataacatcgccaacttttaagcctgctttacttgctggtgaatcactatatactttagtaatcatggccccttgttctaccatagaaaaacctacaccaatgccttgataatttccagcaactgtttgattaaattcaacagcttctttgcttgttagataacttgaatgaggatcatttaatcctgcaaccattccttcaatagcagaggtatttaaatttacatcctgatcattcgtatttacccaatacttatctaaagtatcataaacttcattaataatactgctatcatttgtacttttaacaataacattcttttttgaaacatagcctgcaaaatacccaattgcaagacaaacaataatcaaaataacaattaaaacttctttgattggtctttgttttgtttcttgttttacttctttttttggcggtctaataaaatcatccatcattttcacctcaccataacatattatcatattttaaaaagcatttatatcattaatcaaaacctatttattagtttcttttttagacacattatatcgtttttttacccataagtcacgctttttgcatgagtcatttattattttgtcgtatttttttagtaattgtttccatataagattgaaaaggttttaccttttcttgatgatttccaacatattctttaaaacattctgcaaaatattctttttttgtcttttgtttgaataatgttttattttctttataaatttttataaattgtttagaagaactaaaatgatacttttcatcaaaataatgtcctaattcatgaataattaccccttcacttgtgacattctcaagatgtggatgaactaaacgaatagttgcaggaggactcatttcgcctgaaatgatcaaattatctttttttatactataattataaagctcaattttaccacctgaattaaaaaagatttctaaatattgatcatcatatgaataaccatatcctccttgtagttcttccttaatatagctatctccaaattcattcatttctaaccaactgtctttaaattctttttctacatagacatgtttttgaatttcaatcattgttgttttaggtgtacaacctattacaaataataacaaaacacataatatttttttcatttgaactccttttattgatatataaataaaaaaggtatttctacctttttataataattggtaaatcataatcatgagtggcattgtaataatactaaatataactcccatcacattcataatacttgcatatcctggatgtttattataaagctgtgcaaattgtgtaatcgttgcagccggtggtgcagatgcagctaaaattgtaatcaacaaaattttgtcagcatcaactgttaaacgagacatacctgtaaatttaaaaataagaatcataattaatggaaagacaactaatctaaataaagaaattaaatatgttctcttttctacaaaaatactccttaaatccatttctccaataagcattccaataacaatcatcgctaatggtcccatcatacttcctactttagaaaaagtatcaacaagtaaagatggtaattgtaattgaaacataaaaagacaaattccaataatgatagcaataatgttaatatttaatagaatcttttttatatcaaatgatggttcattacaaacaagacttttagcatgtgtccataataaaatagtttgtataaccatataaccgcttgaataaatgacccattcattccctaagatggctcctactaaaggaataattaaattaccagaatttgaataaataagtgttgctttttcaataggtgtaaaaccaaaaatttttccaaataaattagcaagtggaataaaaatgatatgtactaaaatagcccctaaaaaagatattcctaaaccaatcaacttatctgatgtaaaatcaatcataaaagaattgataatggcacaagggcatgcaacatataaaagtaaaatagataatactttactattttccgctgttaaaactcgacctcttacaagcaaaaagccaaaaaagatcataataaataattgacatatttgttgaattaacaaaatacttaattccattatattcacctcaagggatagtttagactaattattttaaatatgtaaaagctttcattatatgaaaataaaaaaccacttaagggaaaattcttaaaacataaaaaaaagaaggaactggcaacgagctattttcgcacaatgtactatccccttaataatttagagcgaatttcgctaaagcactcgattatttagagcgccagactttttctatttctctattaattttctttttttcttacaaataccatcacaaacatactgcttactagtagcatcattaatcctataatatttgcattatctcccgttttaaccttcttcacttctttcttactttcagatttaacagtttctttattcgttactgttggtgttactgcttctttttctttcgtatctttataaagaattgcatagtcactgaacttatctgtttcaaatgttaaactgtttgtcttttcattatattttgtttctaagatatctacttttccattatgacttcttgcgatatagtattctctcttagttttactatctttattgattagttcttctggaactttgattgttactttcatgacttttgtaagttcatgtatacttttatttgttccatctatattcttatataatgtaatatctaagtattttcctactttatatccttttgtatttgtttcaataagttcatttgtttgtgcttcttttacctctaatacgatttctattttcttaccttctgctacttcacttaattcatttgctgttatttctttgttttcaataaggagatctataatttcatctctacttatttctacatctcctgttgttttaacagtaaatgatcctgttcctatcttatcattttcttttggtaagattgcatagctatatttaaaggatcctgtatggttatttcctttagctttgattgttagaacatgttttccttctttcgttgcttgattatctaatacttcataatcttctttatttaatgcttttccattgactaaaacttgttctacttcttgtgtttgtttttctcctgtatattttaagacatttcctaatacaactgttcctttatcaatcgataatggattaattgtatatgttccatctttaaaagtaatatcataatttggatttgatccttctttttgacttacttttatcttatatgttcctacatcttctccttcttctcttgtaagaatgatacttgttaatttatcattaccaataagtttatcatttacatatgtaaattcagagtcttcatctccatatgtctttgatgcatcatttacagtaactgtaatctttttagctttaacagtaagatttatttctttagatacttttttataattcttactttctttttgacttactgtaatgatgactttacctgcgcctttgataactacattaccttcactatctactgtagctactttttcatcgctacttgcatattcaatagctgattcatgatctttactttgagcatgaactgtaaatgcttcatcaccataagtcttttcaaaatctttttgatcaactgctatttcatgattgattttattaacagttaatgttacttctttactatcactatcatagttatgatcaactcctaatgtaacttttaattttgttgtaccagcattatgaattgttacattaccttgatcatctactgtagctacatcttcattactacttgaataagataattttccatttcctttatgagatacttctaatttaaatccttgatcgccatattttttatcattcacttcttttacttttaatccagcatctgcaccttttactacaaattcagctgtatttgtaccagttaaattatagtttttgtcatcgatacttgctgtaacagtatatttacctgcatgactaggaacttctgttccattaacttctgttccatcataccctgttcctgtgtaagttaatgttacttctggatgatcgccattttctacatcatttaacttagctgtagcacctgtaattttttcaccataagtaccaccattaggtgttattgtaacagtgatatcttttggtttaattgtataacttgttgtgacatcttcaggtaacttataattttgattacttacttttgtagctgtagcttcataagtacctgcatttttgtgttgagctccatcaacggtaacctcacatttatcgccatctgctaagttattaactgtagctgttggtaattgttctttaccattgtaagttaactctttattccagtttaaatcaattgttctaggattgattttatttgtgatttcttgtacatctacatctttaaagtttttatttccttctactttgtagtaaactgtatattctttggcagctttccctgttggaattgatgttgaccagtttttattgtctaaagaatattttactgttcctccattagtagatgctgcatttactaattcttgttcacttccattatatgttagtgtttttgttgttggtttcgtaacaactggtgttgctttagtaatattgaattttactgttgtatcaacagtaccgtcttcccatctataatttgtaggatcttttaaagtcaattgaacatcatattcacctacatttataccaccattattttctttaactgtgtataaaccattttctgaaatatttgcagttaatgtttgtcctgtatatactttgctttctactgttggttttttaactttttcccagttaactgtaatattatttaatgttgttttatttcctgttttatctgttacttcgattgtatatgttcctttttttggaaccaatgtataactaccattagtaggttcaactgtttgtccatctacttttactgtatctaaattattatcagttactgtaaatgtttgtgttttcgtatatgtttgattgttttctacacctgatacttgtggtgcaatcgtatcaattacgataccatctgttgaaacatatttaatatttcctgctttgtctgttaccttggcataaataacataattactatcttcactaaatgtaacagattctccttctttccaatctactgcttgtaattgtttctctgttagtgatttttcactacctgatttatcaacataataatagtatttattaactccactaccttcatctgtagctgtaatttctgctttttgtgtttctttaaagaataaaccgaatgtaattttatttaaaatacttttccatgttttattggatacctttatttctgtattaggtgctgttatatcagctactccttcaactgtaatatctgtatctttttgaatatttttaattgtgtattggttattgttatttaattgaacagtttcaccattgaccttaacagcgaaatctgttgtttttgaatagcctttattcaaggcaaatgtaagagtagttgattcattataatcaacaactgtattactaacacttaaagtatatccaacttgactagctggaacttttactttgatttcttgtccattggctacatatacttctttatcagatgatgcataatagtttttactatctttatatcttacataatacttaccggtagataatccttctacagtatctccagtaatactatgccattcattttcaccatcttttctatattccattgatgaatcaacattatttaatttaccatctgttccacctttatatgttgttcctgtggctgttacagatattggtgcttctctttgggctttgacaatttcgaatgtaacggtattttgtgcaggtaatttataatttgaatcactcaattcagttgcagttgcagtatatgtacctacttcagtttgttcacctgaaacagtcacgttacatttgtcatctccaactgtattagtaacagttgctgttggaacatgtggtttaccatcatatggaattttaaatgtatttgttccatctagtttccatgataaagttgctgttctttgggtaatagtaataaatttttgaggagcatagccaggcttataaagatccgatcccgaattatatatacttaaataatattttcctacgtctggatattctttatctacctcaacatctgtatctcgataatagtatttaaatgaatattgacaattatttaacttacttccagggacaagttctggttgttctccatattcccattcgtatttaacaatgctaggtggagtaggttttgctttagtcacagtgaatttaagtgattctgttgttaaacgcaaataatgatttgtttcagaaactactcctctaataaaataagtaccaggttttagactatttaactcagctaatagcttatctgaacttattggtttatatgtactgtcgtcatcatcacatttcttgtattcataagaaacaactgcatttgaatctacataatttggatccataagatgaccatacccatcattgacttttacatatggaccaaattctgattgatatccttgataagtatattcacaactattttgttcattccaattcttatctttgaaatatatattatttgtataatattctgctttcgtaattgtgaattctccagaaactgaaacttgattcattgttagagttactgaataatctcctggttctgttggtctttgtgataattgttgtccattttgataatatgttaatttgtatgaatctcctgatattggaaaactagaggtattcttgccattggcattttcaacccaagcattgtctcctttcttataccctccatcttttgtttttaatactattttcgctgttgtagtatctggatcctgataatcacattcactatttctttcttcttcactacaataaccttttattgtttttccactttcatcgctgttatcaagtacatagttccatttgtgaacatgttttgctaaataaatatattgaccttcatcatcatatttaagatcaactttgtataatttaccactattttttacaaacttgattttattcaaatcagctttacttactcctctaggagaaattctatgtttctttccatcgtttatttcataatcaatatcaattgtaatagcatttccattatattctgaaagatcaatggtaccattactaccaagtttaacgtctgttccacaattttcaaacgtgatatttttaagtttaagtactgcctctttaagttctgtccctttattgtaaatacctatactatttgctttaattgtcgcatcattaacattcaaaactccctctatagagttaagtccaacttcatcagatacaatcgttccaccactaccattgattgtcattgttcctgaatttccaacaaatccgcatagactgtaaacatcatttccactataagtaaatgtatgaccattcatattaatagttacatcagtattactgtcagccctaataaaatcaaaccttccacttttttcaggattattaacaacatcgcctaatatatttaaagctatcgttccttttttagagctatcatattgtatataaacttttgtacctgcatcagcccatgtagaatatttcttagtataatacgtacctccaggtaaattatatgttcctggtgtacttgtacgatacgtatttccatcatttgaaatattagtatctgccgcaaatacatttacaggcacttgtgtaaagaccatcataaatgtaagtacgcttgctattattttcttaatttttatcttcataactttcttttcctccccttattaaaaattattatgtttaaaactacttatttatttgttaataaaaaacctcccttgtctattcatattttactatttatgatactttattttttcatttgtcgcgaaatgtcgtttttagggtgtgaaatgcaaaaagacctctttcgagatctcctaataaataattttcaatattttaaaagaagtccactagggacttctaagtagtctattttctccattgagatggagcaaataataataacattgggaatatttcaagtcgtcctgctaacatatcaaaagataaaacaagttttgatacatccgataatgatgagaaatttcctactggaccaacaacattcattcctggaccaacgttatttaaacacgttgctacagctgaaaaaagcacttgtaaagatactacaaaaatcattaagtaaatcactaaatatccttgaattgaacttatgacattactatcaattggttgattttcaaattcaattgtctctacactatgaggatgtaatgcttttcttaattctttacgagcacttttacaatacatgacgattctagaaattttaatttctccacctgttgattctgaacttgctccaacgaaagttaaaacaagaataatcacttgtgaaagtaatggccatttactataatcaacaaccacaaatcctgttgttgtaaataattaaaatgttctgttactttaaattcaacagcttctacttcaccatcaacaattttataaagtgttttaacagctgaatcatgatctttagtcattttagcacgtacatatctaataatttgactagcaacaattttctttggtgcaacaatactatcaacctttaacacatctgataaccctgtgtaattcattcttgttactttcgcaattgtctttttatgatataagctttttgcggataatgataaaacaatattttcttcatctaatcttgtaagtgccagaacagcatctgtattttcaataccttcttcatttaataattcatcatcactaccatcaccatgaataattgtgacatatggtaatttttcagctaaaatttgacaacgatttttatccttttcaataattttaactttaattccttgagtagataattgtttagataaataataagcaattttcccaccaccaacaatgataacatttttaatacgatttgtgataacaccgatatctaaacaaaatcttgataaatctcgatgtgtccctgtaatatataaatgattgcctggtttaatggcataatttccatctggaataattacatcttcattatgacttacagcacatattaaaatatttgtttttgtaattttatgtaattgatttaattcaactccatttaaacgactatgatcttccacaaagaattcagcaagatcaacttttcttcttgaaaaagtatccactttaacagctgaaggaaaagataaaacacgacaaatttcacttgctgcttcaagttcaggattaacaatcattgaaaaacctaattgatttctcataaaatcacgttgcgatgaataatcaggatttctaacacgtgcaatagtgtgtcttgttcccatttttttagccattaatcctgctaaaatatttaattcatctgaagtagttacacaaataataaggttagcatcttctgctcctgcttccattaatatatcctatgaaccgccattacctacaacacctataacatcatattggtttacaacttcttctactttagttgcattttgatcaacaacaataatatcatgatcttcatttgacatatgtttaataagtgtttttccgactttaccggctcccaaaacaatgattttcataaaaaatgaaatccccttaatacagatagatatttttaccctttttctttaattactcaacctattttacattaaccaaactaaatatcaatgaaaaaattatttttatacagtataataaaaaactccactatatcgtggaattttcattatttttcaactgcattatttacaataatacggcttgcttgcatacgagataaatctcttttaaatccttctaaatcaattttttctaaaacttgttctttagtcatttgattagcttgtgcaaccatatttaattgttcatctaaaacttcttcagtaacaacaatattttcaacagcaataatttcatcaattaaagcttctaatttagcttgttgagtagcagatggtttcatttgttctcttaatttttcttcatccatgcctgtcatttgtaagtattgatctaattgaattccttgagccatcatttgattcgccatataagacatttgtctatctaatgcctcatcaattgcatcatcatctaattcaacttcactatctgccatgaaagcatcaaaaattgtattttctttttgtgcttcatattgttgatcatgttgttgttgtaaaccttcattaatataagcttttaaatcttcaactgttttaatttcaggtacacctaaaccttcaacaaaatcatcatttaattcagcttctttttttacagataattttttaactgttactttgaaaacaacatcttgtccagctaaatcttctgcttgataattttctgggaaagttaagtttaaatctcttgtttcattaactttcataccaatcatttgttcttcaaaccctggaataaatgatcctgaaccaatttctaaatcataatcatttcctgttccaccttcaaaagcaacatcatcttttaaaccaacaaaatcgattgtagcgatatcaccattttcaacagtatctccatctttttcttctgtttgacttgattgagctaaaatcatttgaatttgttgttcaacttcttcattagatacaggtactttttctactttaaattcaattcctttatagttacctaatttaattactttactcatttatctatttcctttcattatatgcctgtttattctatcataaagaaaacttcttgtctttatttaatcttaatatccttaatattatttaaagtaattgttgaatatccagacatatctgtttcggttgtaatattttcatgatttaaataatcttcaacatttaattcaataatacgatcatcatctaaaaccaatttacatcttgacatacgatctaatgaaagtgggacattaacaatttcatcatcttcttcaattcctagatctctcataatcgtttcaacttcttcttgtgcgttataatcatcacccatgaccttcttcgcaatttccattggttttaatggtaaatgttccattactaaatcaatcatttcttttttgaccatggctgttggatcaccttcaaaaacgttatattcactatcaacctttttaacaactttattgacaatactcattttttgtttatctgttaatttaggttcacctttaatatattgttcattaagataatagcctggttttccatctatttgaaatcttttttcaattaaagaaactgtgtttttatcaacattgataataattgcttcttcaacagctgaagttttaggtggaagactttgtctattaacaaatttaataaatcttttaccatctacttcttccacaatagaaataggggtcactttataatttaacttcatgataagaatcatcttttctccatctactttacattcaacaaacattaaattactattaggcatttcttcaacatatttgctgacagcaaatagatcttgagcaatctttttagattcagcaataaattgttcatcatcaatgatcatatttctagctgcttgtaataaatgatgttcacttccgacaatgagttctttaatggttgtattcgttaaacatttttctatttttttatcataatattcagttgttccttctattaaatcaataaattgatcagaataaataatttgactatgttccatatcgagcatatgaattaatatcttatctataattgttgtattcatctttatcaccgaatgtagtatatcataattttttattttaatatataatggatgtggtgaagtctatgaaaattataattgctgatgcaaaaagtttaaaagaaaagcattttcctattgaaaaacaaacaccattgttttttaataaagcagaatctttaagaaaacaattaaaagaattagatattaatcaaattcatgatttgatgaagatttcttttaaacaatcttcattaatttatgattattttcataatgaggaaacttttgcagccataaatttatttaatggcattgtttttaaacatcttgatttaaagaattatcaaaaagaagagtgggattatttagataagcatttactaattaattctccactttatggaattttacgttataatgatgctgtaaattatcatcgtttagaaatgaaacataaattaaatgaaataaatttatatcaatattggtataaagaactaaatgattatttaaaaaatgaagatgttattctttctttaagtacgaaagaatatgaaaaaatgtttgatcttccaatcattcaacttgattttgtgataagaaatgggcatacttttaaacgaaatgccgtgtatttaaaaaaagcaagaggtatgatactcaattatttgattgaacatcatattgaagatattgaacaaataaaagaaattgtgatcgatgattatcattttagtgaagatgattcaaatgatgatcattgggtttttataaaaaatgaaaaaatgaaatacatcaaaaaataggaggttatttatcatgtataaagttggtgttttaggagcaggtacatggggtatggctgtcgcaagagtgttatgcaatcgtcatcattcagtgatggtttggtcggctttacctcaagaaattgaatatattcaaaaaaacagaacacatccaaaattacctgaattagaaattcctgatgatatggaatttacaacagatattaaagaagtatgtaatagtgaatatctcgtagttgctgttccttccatttttatgagaagtacaatggaaacagctaaagattatattaaagatcaaatcttaatcgatcttgctaaaggggttgaaaaagatagtctttatacaatgtctgaaattattcgagatgttttaggaaatcaagcaaaaatcgtagctctatcaggtccaacccatgctgaagaagttgtaagagatatgccttcaaccattgtttcagcttgtgatgatttagaagttgctgaaaaagtacaaaatcttttccaagatacatgcatgcgtgtttatacaaacattgatgtccgcggggttgaattatgtggtgctttaaaaaacatcattgctttagcagctggtatttcccatgggttaaattatggtgataacactcgtgctgcccttattacgcgtggtctttctgaaatgacacgtttaggaacaacaatgggatgccttgaacaaacattccatggtcttgctggaattggtgatttgattgtcacagcaacaagcgtgcatagtcgtaactttaaatgtggaacattaattggacaaggttacaatgttgatgacgctacaaaagaagttggtatggtcgttgaaggtttaaacgctttacctgctgcaatgcaacttgctaaaagatatgatgtagaaatgccaattactgccatggtcgatgctattgttaaaggtaaagttagtccaaatgaagcagtcaaggcattaatgaatcgtgatcgaaaaacagagctaacaaagtctgttgcagatattaattttgaaaatagtattattaaaagcaaaagagggttaggtatgaaaagagttattacttatggtacatttgatttattacattacggacatattaatttattaaaacgtgcgaaagctttaggtgattatttaattgttgctgtttcaactgatgaatttacacgtttgaaaaaagataaaaaatgttatttctcttatgaacaaagaaaaggtctactagaatctgtacgttttgtagatttagttattcctgaagaaaattgggatcaaaaaatcaaagatattaaagaatatcatattgatacttttgttattggagatgattggaaaggtaaatttgattatctaaaagatgagggtgtagaagttatttatttaccaagaactcctgaaatttctacaactcaaattaaagaagatttacatcatacagaagaaaaataaaggctatagcaatcgctatagcttcttttttataaaggattgttatgaaaaaatcataacaattctttttgatttaaatagttttctaaaaattcaaagaatctttccatttgttggtcagtaccaatcgtaactcttaaatactgatcaatcaatggtttattccaatgacgcacaataataccttcttttctaagtgctaaaaataattcttccccatcaatctttggatgttttacaaatacaaagttagcataactatctggaaccacaaatcctaattcttttagtttcgtttttgtatattctcttgtttgaattactttttgacatttttctttcatatcttgactatttaaaacagaaacaagtccaatttgttgagttatataatcaataggatacgagttaaaagaattctttacatcatataaatgagagattgcttctttatttcctaaagctactcctaatctagctccagcaaaagatcttgatttagaaaacgtttgaataaccactaaattttcatattgatgaataagtgggacacatgattgtcctccaaaatcaatataagcttcatcaacaacaacaatactgtctggattactttttaaaacttcttctataaaatctaaagaaacaagtaatcctgttggtgcattaggattaggaaaaataattcctgaatttggttgtttaaaatcttcaacatacattttaaaatcttgatccaaaataatttctttataattcatttggtaaagatcacaataaactggataaaatgaataagaaatatttggaaataatactggatcacttccattaaaaaatgttaaaaatgtaagtgctaaaacttcatctgaaccatttcctaaaaaaacttgttcatcttttaaaccatgatacttagctaaagcatgtcttaattcttctccatcactatttggataaagttttaatttttcaatatcgatttcttttaaaatatcttttatttgtttacatggaccatatggattttcattcgtatttaatttaatcatattgttgatttttggttgttcacctgctacatacggttctacttgtcttaatttatcttgccaactcattgttattccccctctaacatatcgttgatgacttcataaacataatcaacttgtttttctgtcttttcttttatttgtttttctacacgattaaaagtataagcatgatcagctttttcaaacatatctaaatcattataagaatctcctatacaataagaaatcacttcttgatttaataatgaacaaagctttttaagtccacttcctttagtacaatctactgtaatatctaaataaacaacattaagtgttgcatgaatacctacatatttttggtggatttgtttttgaatttcaagtatttcatctaatttttcttgtggatgaaaagcacatacaatatcaatatcatcttgagtatgatctaatatttctaaaaaatcacctgctatttcttgataaccattttctgttaaaatacatgttttttgatttatatatccatatgtttgttgaccatcaaaaaatgtataatttagataaggatatttttgataactttctttaagtatttctttagcaatttcattttttatttgttttcgataaagaacttgatcattttgatcaacaatcattgctccattatttaaaacaagataatcatattcaaaatgtggtgtgacaagttttgtttcttgaatatttcttcctgtacaaaatgaaaaataatgaccttgtgttcttaatttttttacagcttcttgatctttataagtaatgggtaaattgtcattagcaattgttccatcaatatcactaaataatatttttttcatatcttctccttaagctaagtctaaaaataattgacataaacgatcatgattttcatttttttcaattaaagcttcttcaatatttttagatataatttgattatctttcatacagatacataaaccactttttcttttttctaataaacaaatggcttcttctgccattttagatgctaaaatacgatcttcaggaacaggtgatccacctctttgaatatgtcccaaaacaattgatcttcctgaatatccagtttcttcgctaatacgattagctagtttttcaacatctaatattttttcacttacaataagtatcgcatgttttttatgatactcttcttcacaaattttaagttcttcaataattttattttcatcatactctgttttatctgtaataacaatttcactaccacatgcaattgcagaatatatagcaagattatctgcatgatttcccataacttcaacaacaaaacaatgatgatgtaaactagacgtatctcttaatttattaacagcatcgataatgttataaagtgctgtatgaaagcctattgtttcatctgttccattaacatcattatcaattgttccaggaatagcaatacaatcaattcctttttgactaagtgctaaagctcctttataacttccatctcccccaataacaacaagcccatctatccctctttgtttaagctgatgaattgcttgttcttgaactttatcttccttaaatgaaggtaatcttgaagattctaaaatagttccccctttagataatatctcagaaacatcactataccctaattttttgatattccctgctactaatcctttatatccttcataaacaccataaacctcaaaacctctttttattcctacacgaacaatagcacgaatagccccattcattcctggtgcatctcctcctgaggttaaaactgcaatttttctcatcgattcacctactttttccctataattatccctattatacttgttttacataaaaagaaaaagccaatttcttggctttatataaatttttctaaatttaaatttgaatcataagaaaattttaaacgatatgtatctttataattaaatattcttattgaagattgatcgtttccttttgattgtgtcattccttttccataatgagaaagtgtttcttttgtaatttcagcttcattattttttaaatcatttaatgttttttgaattaattcttgattatctttttcattaaatagtgtaatgatttgatttatttttgtaacttgttgatttaattgttgatagccatcatctaattgttgaatatcatttaaatgatattcaaactgtaattggctttcttttgataaatcataatcataagaaatactcattgtattttgtttatctaaagaaatatcatattgaacagatacataaagattattattatttgttatttgaaacaaatattctgaatccatattttttgttccaactattttttctaaagacgattccatgttattaatcttattgacatattttttactatttttaacattttttgaaaattcttttaaggaatcatattgatatacaactgtttcttgatttgattttgtatatgtttttaatgttgctgtttgatttattccactatcagataatgtattaaatgcaaagaaataagaaattcccataggtaagaaaacaaatgcaataatcaaaattggataaatgaatgcgtattttcttttaggggtacgtttcattggttgatagccagattgaggtgttccacaataaggacatacttttgcattacttggtatatttttatggcattttggacattttttcatattttatcaatcctttcttttaatcttggtatatttggtctagccaagatgaaagtttatcaatataatcctgtttcttttctttttgttttttgcttggtaatgaataataatcttcatctaaaaaagtatattgatctacaaatttcccattgatcactaattttaaagtaggtgtccatgaaaaatcaagtttttttctcatttggttatatcgagatttttctttttttgttgcttcttgactattcgcttgatctcgatattctttaatattgaaataataaagataaactcctttatttttctttaaatatttttttaaataaggttcaaattcttgacaatctttacaatcagatcttccaatatataaaacaaaatcttctttttgatttattttctttaaaacatcatcataattgatttctatgatttgatcttttgataaatctttctgtatagtatgagtggatgtagtatgactacacccacttaatatacctattaaaaatgaaatcaatatgaacttattgattattttaataaagattctccatccatttcttcaggaattggtaaacctaataattgtaacattgttggagctaaatctcctaattttccgccttcttttaatcctatatgagaattagtaacaattaaaggtacaacatttgttgtatgtgcagtaaatggatttccatctgcatctaattcttcttcagcgttaccatgatcagcagtaattaacatagttccacctaattcaagaactttttcatagacttcaccgatacaatcatcaacaacgctaacagctttgattgctgcaggaataacaccagtatgtcctaccatgtcacaatttgcaaagttaacaatgacaacatcatgaatatctttatctaattcagcaattaatttatcttttacttcataagctgacatttcaggttgtaaatcataagtagcaacttttggtgaattaactaatacacgagtggctccttcgatttctttatctaccccaccatcaaagaagaaagttacgtgagcatatttttcagtttcagcaatacgtaattgttttaaaccttgagctgataagtaatcacctaatgtatttgtaagttcaggtgaaacgaatgcgatttctccattaacgctgtctgcatatttcatcatacatacgaattctaaatctttaacttgtttttcaggtacatatccttcatagaatgtaggatttgtgattactgtagctaattggattgctctatctggtctgaagttagcgaagattactgaatctccatcatcaattgttccttcaacgtttttgttgtaaccagggataacgaattcatctaaaacatctttagcataagaatcctttacatattgaactggacattcaaaagattcaccttcttgacatacgattgcatcgtaagctaatttaacacgatcaaatcttttatctctatccattgcatagtatctaccagaaattgatgcaatttgtccaacaccgatttcttcaattttttcttgtaattcttttacgaaatcaacaccactatcaggagcaacatctcttccgtctaagaaagcatgtacatatactttatctaaaccttgttgtttagctaattctaataaaccaaagatatgttcatttgatgagtgaacaccaccatttgataataatccccaaatatgtaatttagaaccattatctttagcatgttgaattgcttttaagaatttttcattttcaaagaaagttttttcatttaaagctttattaattaaagttaatgattgataaacagttcttcctgctccaatatttaaatgcccaacttcactatttcccatttgtccatcaggtaaaccaactggcataccactagctgaaatagttgtgtttggatacatagccattaaatcatctaagttaggtgtattagcaagtcttacagcattaccattaatgctttcagaaataccataaccatccataatacataatacgataggtctttttttcatttttttgtttcctccattaatacgttatacatattatcatttttgttatcgtgtttcaattcatttagctatataaaatcagtattttttatttcatttctttttagttttttgtggtgtagcaagcaatgaaacaccgcaaaaagtaatgaataaaggccagtattcttgaatataataaacaataattgaaacaatacctttgaattcatttgttcgatctaacgttaagatgattcccaaaacaatcaaaacaataccacaattttttttaatattcattttattcacctagttttattttatcttggataaaataaaaaagatgtccaaaaaaatcatacgatttctttaaatatcttttttgcataatctagtaattgaatgatattgacttcttcttgccctttttgtgaatatacataaactttataatcttcaaaaaagtcaaatctatttgaatgaataatactattaatatcttttcttctttcttgatttaaagtaataaattgattttcacacatttttcttagaataatacacaaagaagcaagtgataattctaattgacactttgtttttaaaagatccctttcaattatataattagctatctcttgattattttttaatctatttaattgatttaaaatcatttctactttaacaacctctatatttaattgttctaaataacaacttaactttatttgccttttattcattcttaagctccttataaattgataacagttgtttagcatataaaacaagtgataataacatcaacacaatacaaacaaaaattgaaatagttgcaaaaatagaatttggaatatgtattccaattaatacgattgcgacaacatcaaagatagcagtagaaattttcccccaccatgaggctccttggacctttgctcctttttcatataaataaagtccccctaaagccagcattccatcttttaaaacaatgataagaagtaataaccacatccatgaatacgtataaactaaaacaaacgcaaccgtaaattgtgtcaatttatcagcaattggatctataactttcccaaaatcagtaatcatctggtaatgtcttgcaatgtaaccatctaaaaaatcagatagacctgaaataattaaaatagtagcacatatataataatcttctttacttccagctaaaaaatagcgatgtaaaaaaataggaataagtattattcttaaatagcataaacaattaggtatattaaataattctttaagtcttatttttttcataattttcaccttctatattagtaatataatcttacagtttaatgataaaaatttcaacctaaacaaaaaaagggagatttctcccccatgaattttaatattctttttctaataaagctgcagctgctttatcaataattacagttacatctttatgattttgtaatacactagctggtaattctggagttacaggtccttcaatcattcctttaacagcattttctttatttttaccacaagcaattaaaacaacacttttagcatccataatattttgaattcccatagagattgcttgttttggaacagcatcttcatctccattaaagaataatcttgcattgtctttaatagtactttcttttaaatcaacataatgtgtttttgaattaaaatcagttcctggttcattgaatccaatatgtccatttgaaccaattcctaataattgaatatcaattggattttcagctaacattttattatatttatcacagttttcttgaatatttccttgtccacatggaacatgaacattttcatctttaatatcaattccattgaataagtttttatacataaaataatgataactttgtggatgacttgcatctaatccaaaatattcatctaagttgtatgatttaacatctttatatgatgtatgatttttttcatgatcttctcttaataattcatacattctaacaggtgtagatcctgtagctaatcctaaaatactatttggtttttcctttacttgattaataaaaatttttgctgcttcttggcttgcttcttcataattttcaacaataataactttcattgcagactcctcctcgacaacattttatcatgtctagacaaacaattcaataaatacttatcttttttcttaaaaagtcctttcgtacaatgaaaatatctttatttttcaataaaaataggttagaattggaatgtaaatatggaggtgtttaatactatgattaaaggtattggggcttctagtggtattgcaattgctaaagcgtacaaactagttatgcctgatttaactgtaacacaaaacactgtagaagatgttgcagctgaaatcaaaaaatttgaagattgtatggctgaaacagctaaacaattagaagcaattaaagaagctgcttctaaaaacttatcagctgaagaagctgctgtatttgatgctcatgcattagtacttcaagatcctgaattaaaaacacaagttttagacaaaatcaataatgaaaaattatgcgctgaagctgcattagatgcagttgcaaatagtttcattgcaatgtttgaaatgatggatgatgattattttagagaaagagctgctgatattaaagacgtttctcgtcgtttattagctaacttacttggtaaaccattaccaaaccctgctttaattgatgaagaagttgttattatcgctgatgatttaactccttctgatacagcacaattaaataaaaacttagttagaggatttgctactaatattggtggtagaacttctcactcagctatcatggctcgttctttagaaattcctgcagttgttgcttgtaaaacaattacagaagaagttaaagatggagatttaattgttcttgatggtattgaaggaacagttatgatcaatcctgatgaagcaactgttaaagaatatgaaactaaacgtgctgaattcatcgcatataaagaagaattaaagaaattagttaatgaaaaaacaattactactgatggacatcaagttgaattagttgctaacattggttcagcaaaagatttagcaggtgttaaagaaaatggtggtgaaggtgttggattattcagaactgaattcttatatatggaatctgctgaattaccaactgaagaacaacaatttgaagtttataaagaagtattagaaggtatggaaggtaaacctgttgttgttagaacattagatatcggtggagataaagaaatcgaagctatcgatttaccaaaagaaatgaatccattcttaggtgttcgtgcaatccgtttatgtttccaaagagaagatatctttagaactcaattaagagcattacttagagcatcagtttatggtgatttaagaatcatgttccctatgattgctactttacaagaattccgtaaagctaaaggaatcttaatggaagaaaaagaaaaattagttgctgaaggtgttaaagtaagtgatacattacaagttggtatcatgattgaaattcctgcagctgctgtattagctcataaatttgctaaagaagttgatttcttctcagtaggaacaaatgacttagtacaatatacatttgcagcagacagaatgtcttctggtgtaagttatttatatcaaccattcaacccatcaatcttaaacttattaaaacatgttatcgattcagcacatgctgaaggtaaatgggctggtatgtgtggagaaatggctggtgaagctattgcagctccattattacttggtttaggattagatgaattctctatgtcagctacttcaatcttagctcaaagaaaattaattaagagtgtatcaaaagctgatatggaagctttagtagaaaaagcattagattgtgctacttctgaagaagttgttgaattagttaaatctacagtaaaaatgtaataataggctttatgaaataacatgatatttttaaaacgaagctaattagataacatgaggttttttctatggaggagacctcatgtttttatatgctctattattggtgtcttgctatagtccagatattttttactaatttgattttaacattggtaacacaataaacggtaaacctactcaaaaattagtgtattaaaagaatagctaacaactaataataatattctttaattaaaattcgaataagcaagtaattgatttaaaaatacatttaataagcttaagaatagaaaaataactatgacaagataaataaggaaaaaatttaatgaaaagagagaaattaaaaataactatatctaattctttaatagcacataacttaaaaattgtaaacagctaatccattagcgttagttattgttacgaaaaagagcaaacctcatataacagaaaatgtctgcttttattttaattattaaaaccacaagattttgaaaagtagtttcaaatatcatgacataaaataaaacctaataataaaggcctcgaaaagatgtctttttttttactaatttcaaataataattcatacaaaaagtcaagatattcaaataatttcagcaaatttataaacatcaaataatagcaacttaaaattatctctattttatatgatgcaataacacatatcagaaaaaaaagccataccacaagggcatgacctgtcaatgatcatgtaaaaacataaaaaaaaagaccccttaataatttagagcgaatttcgctaaagcactcgattatttagagcgccaaaaaaacttaatcctcttttaaagtattatgaaacatatttaaaagtaattctacaaagattacaacaatcgattgtaaatcaacaattgattgtttagataaagtatatcctggaagaataagtgtattttcaatcaataatttaggctttggatttaaagtaatcatatacgtatttttagaggcgtttgtaaggtcaaaaaaacgagaaacattattttgattaccttcaatagaaaaataaatcaagagatcatcttcgtgaattgtattataaagatgacttgcttgcatataatcataagcaaaataagtattaatacctaaatcttgtaatcctaaaactaaatgttttgctggtaaagatgaataatgaacaccaatgacatagatgtttttggtgttttttatttgtttaataagttggttgagcttattttgatcaatgttattgaattgacgaatgactgataaatatttagatgttaattcatcaaatagattttcagaatttacttcaacatgttcttgatgcaaataatgaagcatgtcaaaacgaaaatctttataacctttataacctaaaacttgacaaaatcttaaaattccagaagttgaaacctgacatagttcagcaattttagtaatcgtcgctgtttcaatagctgtagggttttgaacaatataatcgtaaactttacgttctgttttagaaaaatcatttttatgtaagtggatggtttccattaagttcatagtctcacctcatgtttattttatataaaaatgataaaattgtcaaaataatatgtaactattgacaaaagagaataataagattatgatttgtttgtaaaaattgtcaaaacaaaatgtaaaaagtaacaaggagactattatgaaacaattaccagaaggatttttatggggtggcgcaactgctgatttccaatatgaaggaggattcaatgaaggaggaagaggacttttatcacatgactttgaaacagatgggtcaatggaaaacccaagacatcatacaatggaaatgaatgatggtagtattattaaaccaagaagttcatttttttatgcagatcctgttccacaagaagcaaaaccagtgtttttagatgatgaatattatccaagtcatcaagctgttgatttttatcatcgttataaagaagatattgcacttatggctgaaatgggatttaatgtttttcgttttagtatttgttggagtcgtatttatcctttaggagatgaagaaacacctaatgaagaaggattgaaattctatgatgatgtaatttcagaattagaaaaatatcatattcaaccattgattacaatttgtcatgatgaaatgccaatgcatttagctttaaagtatgggggatggtctaatcgttttgtgattgattgttatgttaaatactgcaagactttatttgaaagatatggtaaacgttgtaagtattggcttacttttaatgaaatcaatgctgtaagaggatttgggccatgtggaacaagagaaagtgatggaaaagtgagatatcaagcagatcatcatatgtttgttgctagtgctaaagctgttattttaggacatcaaatgatgccaggtagcatgtttggaacaatgtatgcaatgagtgaactttatccagcaacgtgtaaaccagaagatatgtttaaacgtcttcaagcaagaagagaaaactggtattttattgatacgatggcaagaggttattatcatccttatgctaaaagtgtgtggaaacatcatggttttgattcattagaaatcacagaagaagataaagaaattttaaaagaaggacaattagactttgtttcattttcttattatcgttcaaatacagtaaaaaaagatgatccatggtttaatgttggaggttcttcaaatccttatttagaaaatacaccttggggatggcctgttgatccacttgggcttagacattgtatgaatgaaatttatgatcgtattcaaaaaccaatttttatcgtagaaaatggtatgggagctattgatcaagcagatgaaaatggatatgttgaagatgattatcgtattgattacttacaaaaacatttatcagctatggctgatgcgattaatgaagatggtgttgaatgtttaggatatacgatgtgggcaccaattgatcttgtttctttatcaactggagaaatgaaaaaacgttatggatttatttatgttgatatggatgataaaggaaatggaactttaaaacgtacaaagaaaaaatcatttaattggatgaaacatattattgaaacaaatgggaaagcccttgatgaaaagctctagcaatcagctagagttcttttcattattgacacttctttataattcctataatattagtaggaaaagagaggtaccttatgatttatttagactatgcagccaatataccaatagaaaaagaagtacttgatacgtattatcaagcaaccatgaaatattttgctaatcctaatgcaagtcatacactaggattacaagcaaaagaagttattgatcaaacaacaaagcacattgctgaacaattacatgtcttacctgaagaaatcatttatacatcaggagcgagtgaagccaataaccttgcaatcaaaggtattttagaaagatataaacatcgaggtaaacatgttttaatttcacctttagaacataattcaattttatcaagtcttacaaaaatgcaagaaaatggttttattgttgaaatgattcctttaaaagaagatggacaagtcaatgttgaaaaaatgaaatcaatgattcaagaagatacgattttagtaagtgtttgtagtgtggatagtgaacttggaattagacaactgattgaagaaattggagaagttttaaaagattataaatattgtttttttcatagtgatgcttctcaagcaattggtaaagtagctattgattatcaaaatgttgatttggttactattgcacctcataagttttatggtatgttaggaactggtatgttaattaaaaagaaaaaagttggtttaaaaacacaaattgatgggggaaagtcaacaactgtttttagaagtggaacgcctgaactggcacatattgtatcgattgaaaaagctttagagattgctctttcaaaacaacaagaacgagaaacttatgtaaaatcgatcaatcatcaaatgcttgaaccattaaaacaatatgatcaagtattaataaatcgtacaaaatattctttacctcatgttattaatatttccttaaaaggaatgaaagctacaaaatttgcacaaatgctcgatcaacaaggtatctatatttctactaaaacttcatgttgtcctgtagaaacaccttctaaaatggtttatgcgctttatcaagatcgtcaaagagcgatgtcttcttttagaattagtttatcgcatttaacaacagaaaaagaagttcaagattttctaaaaatctttgatcaatgttacaaggagtgctttgaaaatggaaaaatataaagaaatagaaagaagtatcataaaaacatatcgtaaagaaatttggtctaaatttataaaagctgttaaaaattatcaacttatccaagaaaatgataaaattatggtttgtattagtggtggaaaagattcttttttaatggctaagtgtattcaagaattacaaagatatgggcgtgttccttttgaagctcattatgttgtgatggatccaggatataacagttataatcgtgattttattgaagataatgcagatttattgaatgtacctattgaaatctttgaaagtaatatttttgatgtggtttcaacagttgataaaagtccatgttatttatgtgcaaagatgagaaggggctatctttatagtaaagcacaagagttaggatgtaataaaattgctttaggacatcactttgatgatgtgattgaaacaacacttctttcgatgttttatggttctgaaatcaaaacgatgatgcctaaattacatagtgaaaactttgagggattagagcttattcgccctttatatttagtaaaagaagaaagtattatttcttggcgtaaacataatgatttgacttttatcaattgtgcatgtcgttttactgaaggatgttctttaattaatgatggaacaagtaaaagaaaagaagtcaaagaactcattaaaacaatgaaacaagtaaacccaaatgttgatcaaaatatttttaaagctttagataatgttaatttagattgtattttaggaacgaaaaaggataaagcttatcatagctttttagaggattatgaaaaataaagaaattataaaaaaagcttttgaaaaatcgatacctattatgtgtagttatctttttgtatcgattgcttatggagtgatgatgaacgaggcgggctttgcttggtatgtagcaatacttgtgagttttttgatttatacgggtgcttttcaatttcttttgattactttattaagtggggaaacttctttacttacaattggtgttacagctcttttaatgaatagccgacaacttttttatagtttatcttttatagatgtttttaataaaatgaagcaaaaatggtatatgatttttaccatgactgatgaaacttatgcggttaattgtaatctagaagaccaagataaagaacaagttatgttttatgttgcgcttttttcaagatgttattggcttattggaactgttttaggagcggtacttggtcatttgattccgtttgatttaacagggattgatttttgtatgacagccttgtttattattatttttatggatcaattagagaaaaataaagatcattttcctgctgttgtaggaattgttatcgctattatttgttcgattgtttttggcagtcaaaactttatgttaccttcattgattatttcttcaatgattttacttgttaaacaaggaggaacattttatgaatagttatgtactttcagcaattattctttctgctttaattacttttttattaagagcttttccttttcttttatttaaagaaaaagaacttcctaaatggttagaaaaactagaaaagcatttaccaatgactattatggcagttcttattgtttattgtctaaaagatttaaaaatgcaattaacaactctttttattccttatcttttagcgtgtttaacagttgtttttacttataaatggaagaaaaatacttttttaagtattattttatcaactgttgtttatatgatttttatccgtctatagtttgttaaaaatatcacaagctatagattttttgctttgatagtgctataattatgttaacgcttaaaaattgtatttaaggaggaaatgtaaatgggatttttaacaggtaaaacagcaattattacaggagcaggacgtgctgtcttagaagatggaagctgtggttctattggttatggaattgcgacagcttatgctaaagaaggagcaaatcttgtcattacaggacgtaatgttaaaaaattagaagctgctaaagaagaattagaaagattatatggtatcaaagttttaacagttcaagcagatgtcaatgctggtgctgataatgaagccgttgtcaacaatgttgttaaacaagcaatggatacttatggaagaatcgatgttttgatcaataatgcgcaagcatcagcatcaggggtaacattagctgatcatacaacagaacaatttgatctagcaatgtattcaggactctatgcagccttctattatatgaaagcatgttatccatatttaaaagaaacaaaaggatcagttgtcaactttgcttcaggagcaggattatttggaaactatggacaatgttcatatgctgctgccaaagaaggaatccgtggattaacacgtgtagctgctaatgaatgggcaaaagatggaatcaatgtcaatgtggtatgtcctttagcttggacggcacaattagaacaatttgaaaaagcatatccagaagccttcaaagcaaatgttaaaacaccaccaatgggacattttggaaataatgaattagaaattggacgtgtctgtgtacaacttgctaatcctgattttaaatatatgacaggagaaacacttacattagaaggtggacttggtttaagaccttaataattaatcactcataagagtgattttttttatgtattcttttataatgaatatataggaaagagggaatggttatgaagtatgcattaattaatggaaaaattttaaatggtcatcaggatatggaagtagaaacagggaaagcaatttttattgaaaatgaaaaaattgtggctattgaaccttatcgtaatttagataaatcttatcaaattattgatttacaaggaaaatatattttaccaggactcatcaacatgcatgttcatcttgcaggaaatggaaaaccacaaaagaaacaaaaagataatgaaaagacagttaaaatgttgatgtctaatccattatcacgaaaaattacgtataaagtggtttctaatttcgctaagatcgaattaatgagtggggtaacaacaattcgtacagttggaggaattgctcattatgattctaaattaagagatgaaattttaaaaggaaaagttattggtccaagaattgttgccagcaatgagggaatttctgttcctcatggtcatatggcaggatcagtcgccattgctgctcataataatgaagaagctctagctttagtggataaagcaaaaagtcaaaatgttgatttgattaaacttatgattactggtggggttttagatgcaaaagaaaaaggagtgcctggcgaattaaaaatgcctcctgaaatggtaaaagctgtttgtgatagagcacatcaacttggctataaagtagctgctcatgttgaatcatctgaaggggtacgagtagctttagaaaatggtgttgattcgattgaacatggagcaaaattagatgatgaaatgattgctttatttaaagaaaagaaggcttttttatgtacgacgatttcaccagcacttccgtttgcgttgtttgatccaagtatttccaatgtttcagaaatagaaaaatacaatggtgaactcgttttcaatggtattattgattgtgcaaagcaagcattagaaaatgatatacctgttgttttaggaaatgatgtaggatgtccatgggtgagtcaatatgacttctggcgagaactttattatttccataaatatattggtgtttctaaccgttttgctttatatacagcaacatcacttgcttctaaatacgctggtcttgaaaatattacaggaagtattgatgttggtaaggatgcagatatgattgttgtaagtgaaaatcctttagatgatttaaaagctttaagatatgttgaaaaagtatttacacgtggtaaattaattgatcatccaaaggtaaaaatcaataaaacagtagaaacagaattagataagtatttataaggagttagttatgaacaaaaaatttttcttttttgacattgatggaacattagcagtaggaacaccaggaagacaatacatccctgaatccacaaaaaaagcaattctcatgttaaaagaacaaggacattttgtagcaatagctacaggaagaagctatgctatggctgtagatcatatgaaagaacttggctttgaaaatatggtcagtgatggtggtaatggaattaccatcaacaatgaacttattacaattaaaccattagattatcaaaaatgtatagacttaatagatgaatgtaaagaaaaaggatttatttgggctatttcaccagataataaaacaagaagattggcaccggattctcgcttttatgattttacacacgatgtttatatggatactgaggttgtagatggattagatcctagaaattatgatcaaatctttaaagtttatgtggcatgtttttctccagaggaacaaaaattagaaacgttaaaagaattaccttggtgtcgtttccataaagaatatttatttgtagaacctggtgataaatcagttggtattaaaatgatggttgatcattttaagggtaattataaagatgttgttgtctttggtgatgaaaaaaatgatttaagtatgtttagagacgaatggacaagtattgcgatgggaaatgctatcgatgaattaaaagaaaaagcaacttatgtaactacaccatgtgatcaagatggtatttataatgcttgtgttcattttgactggataaaagaaaaagattaaaagtaataaaatgacggagtgaacaccactccgtattttttaatcatagaaaaattgttgactctccccttaggggacaattcataatttgaaagaggaaaggagaatcaaatcatgttaaaaatcggagaattttcaaagttgtctcatttaacaatcaaagcacttcgtttttatgaaaaaagaggtcttttgattccgcaaaaagtagatgaacaaacaggatatcgtttttatgaaacgagtcaactaaaagaggcagcacgaattaagtcgtatcgtcaattaggattaacaattgaagaaatacaagcaattaataaaggtactaatctaaaggaagtgcttatttctaaagcaaaagtattagaaagtcaaaaagaagaaattgaaagccgtcttttgatgattcatcatcttttggatgataatgaaatacaatatcaagtaatagaaaaaatgataccgaaaacaattgtctattatagtgaagtaaaggtaaaaagttattcggatatgatgaaaattattccaagcttaaaaaaagaatgcaaggaattgaatccacatgtaaaatgtacaaagccaccatatgaattttgtgaatatttggataatgaacataaagaaagtgatatttggatccgacataatgaagcagtggaatgtatgggcgaagaaagtacacgaattatgtttaaaaagataccagaaacaaaggtattaagtatcttttataaaggagcttatgatgaaattggtgtggcgtatagttttcttatgaaatatgtagaggataatggttatcaagtatcgggacgatcaagagaatgttatattgatggtatttggaataaagaatcagttgatgagtggcttacagaaattcaaatacctattgtttaggagaaaagaaagatgatttttgatttaaaaaaagaatataaagaatattataggcctaaaaataaaccggaaattattaatataccttcattcaattatatcgcagtaagaggaaaaggcaatcctaatgaagaagatggaagttatcaacaagccattcaggtactttatgcagtggtgtatactttaaaaatgagttataaaacagattatcaaattaaaggtttttaccaatttgttgtaccgccacttgaaggtttttggtggcaagaaaatgttgaaaatgttgattatttacataaagaaaattttaactggatttcagtaattagacttcctgactttattacaaaaaaagattttgattgggcagtaaaaagagccactattaaaaagaagatagattgctcaaaagcggaattttttacttttgaagaaggattatgtgtgcaaatgatgcatcaaggatcttttgatgatgaaataaatacagtagaaataatgaatcaatttcttcaagaaaagggttaccgtaatgattttaacaaatcaagattgcatcatgaaatttatttatcagatgcaagaaaaaatgctccggaaaaatggaaaacagtgattcgtcatccaatatgtaaaatcgacaaaaaataaagattttatggatgaaaataatgtttgacattggtataaatatatagtatgatgacaaggcagtaaatgaatagcagcacatagaggattgaaaaaatgcgttaatatcaaatgattgcaaagtacctggctgcaatgggaaatgcttaatattaacacttatcaattgatctatgcaatgttattgctttatgcaaataaaacaatacggaggaaaatttatggcacgttatacaggaccacaatggaaaatctctcgtcgtttaggattctcaatcttagaaaacgggaaagaattaaacagaagagcttatgctccaggtcaacatggacaaaaaagaaaaaaacaaactgaatatggattacaattagcagaaaaacaaaaagtaagacatatgtatggagttaatgaaaaacaattccacaacacatttaatcaagcaggtaaaatggaaggtatccatggttacaacttcttatgcttattagaaagaagattagacaatgttgtttatagattaggttttgcttctacaagaagacaagctagacaattagtaaaccatggtcatttcttagtaaatggtgttaaaactgatatcccatcatacagagtaaatgttggagatgttatcgaagtaagagaaagatcattaaatttagcagttattaaagaagctttagaaaacaaagttgcaactccagctttcgttgaagttgatactaataaattaactggtaaattaactcgtttacctgaaagatctgaattaaactcagaaatcaatgaatcattaatcgttgaatactacaacagacttggttaataagaaaaacagcttttatagctgtttttttgtatataaaggagaatttatgaacgcaaagctcattatttatcgtaaggaaaagattcaaaattatgaatcattaaaacaattatgtttgttgatgaacattgaaataattttattgaatgaacagatgacacaaaataaagttaaagatattttaaataaaaagattaaaaaaacaaaaaagaataatttagaaccagcggttgttgttttttcaaacgttgcatctttacaaatggatcaaatattatcaaaattaaaaaataattcaacactttgtttaaaagctgttgtaacagcaacaaattataattggacatttgaaaagttagttttacatttactagaagaatatcaaaaaaataaataaatcgtgtagaatagaggtagtaattttggtataatagtaaaagaataataaggaggtttttatgaacgaaagtagaatttgtattgctcttgattttaagacaaaaagtgatgttgaaaacttcttaaaacaatttgagggagaaagtctttatgtaaaagtagggatggaattgttttatggagaaggaattgaaatcattaaaatgattaaagaaatgggacataaaatctttttagatttaaaattacatgatattccaaatactgtaaaaagtgccatgagacaacttgctaaattagatgtcgatatggtcaatgttcatgcttcaggtggtattgaaatgatgaaagctgctattgaaggattagaagaaggcaaaacaagtggtaaaagaccattatgtattgctgtaacatgcttaacatctttagatcaagatgttttagataatcagttacttattcatgaaccattagaaaatgttgtattaaaatgggctgaaaatgcaaaagctgcaggattagatggggttgtatgttcaccgttagaatcaaaaatcattcatgatcatttaggaaaagaatttttgacagttacaccaggaatccgtcttgcaagtgataatgtcaatgatcaaaaacgtgtaacaacaccagctatggcaaaagaacttacttcaagctatattgttgttggtagaacaattacaggaagtcaagatcctttggcgacatataaaaaagtttatcaagattttcaaggagaatagaaatgaaaaaaattattgctaaagatttattagatattaaagctgtctttttaagaccgaatgaaccatttacttgggcaagtggtattaaatcaccaatttattgtgataatcgtttaactttatcttatccaaaagtaagaaaagatgttgaacaaggacttgctcaacttgtaaaagataatttcccagatgcagaatgtttaatgggaacagctactgctgggattgcacatgctgctttagctgctgatattttagatttaccaatggggtatgttcgtggaggagctaaatctcatggacgtaataaccgtattgaaggtgttgttaaagaagggatgaaagttgttgttgttgaagatttaatttcaactggtggttcttctttagaatgtgttgaagctttaagagaggctggatgtgaagttttaggattaattgctatctttacttatggtttagataaagcaacagttaattttgaaaatgcacattgtccttttgtgactttatcaaattatgatactttaattgaagtagcaaaagaacatgactatattaaacatgaagatatggaaaaattaaaagcttggaaagttgatccaagtgatgaatcatggatgaataaataagtatttttagggaatgatggttatttaaagccattgttccttttttttgtttttatttgcaaaaaatagtggtatgatgtaaaagtaatagtaggtttactttttggaggtaagtatgtttaaaagtattcgatatgtattaaaagaaaactttacaaatttgtatcgtatatattgtatttcaaaatatgaattgctttctgatatgcgagattcaagattaggtgttttttggaattttgctaatccagcaattcaaattatgacgtattattttgtgtttggtttaattatgaatagaaagtctgtaggaaagattccttttattcaatggatgttatgtggaatggtggtatggttttttattagtccatgtattactaatggtgccaatgccatttatgctaaacgtaatgtcattacaaaaatgaaatttccagtatccgttttaccagctacagttgttggaaaagaattgtttaatcatttttgtttgatggctatcttagttgtctttttgcttacacaagggatcatgccttcactttattggcttgaacttatttattatctttttgcagcaatttgtttaacaatttcacttgcgatgattacatctgttttaaatatgttagctcgtgatacaagaaaacttattttagcgtgtatgcgtttattactttatttaacaccaattttatggccaatttcacgtttacacaaatatgggtggcaaatgacagtaagatatattatgaaagctaatccaatttattatgttgtatgtggttatagagattgtttcttatatcatcatggaatcttattttattggaaacaaatgcttttcttttgggtgtttgtcattgtgatttttacaattggtagtatgatgatgtataaatttaaacataaatttattgatatgatttaggtggtaataatggaagattatgcaattaaatttgaacatgtttcaaaaatatataaattaaaaaagaaaaatgatggtaaatcaaaaagctcagttacacaaagattctatgctttaaatgatattacttttacaattcctaaaggagaagttgtaggaattttaggaacaaatggttcgggtaaatcaacattatcattgattttagcaggtatttcacaaattgatgagggtacaatggatatcaatggagaacaagctttaattgcaatcaatacaggattggatatgcaacttacagggcttgaaaatattaatgttaaaggagcattgcttggactttctagaaaaagaattcaagaaattacggaaggtgttattgaatttgctgaaattggtgatttcttatatcaacccgttaagaaatattcaagtgggatgaaatcaagattaggtttttcaatttcactttatttaaatcctgatatcatcattgtcgatgaagctttatcggttggggataaaggatttgctcaaaagtgcttagataaaatgaatgaacttaaagatcaaggaaaaacaattgtctttatttctcactctttgccacaagtaagaggattctgtcaaaaggctatgtggattgaaggtggacgtttaaaagaatatggtgacgttgaagaagtatgcgatgagtatgccgaatatgttgatttttataatagtttaaagaaaaaagaaaagaaaaaattaaatgatgaaaaatttgaaagtcgaattgttcaaaatcctaaaattggtttttgggaaaaattattagataaaatgaagagataggagaaataggatgaagaaagttatcacatatggaacttttgatttgtttcatgttggtcatttaaatattttaagacgtgctaaagaattaggagattatttgattgtagcagtcagcagtgatgcttttaatgctcaaaaaggtaagaaagcttatcatagtgatcaagatcgtatggctattttaaaagctattaaatatgtagatgaagttattttagaagaatcatgggatcaaaaaataaaagatgttcaagaacatgatgttgatgtttttgttatgggtgatgattggaaaggccaatttgatttcttaaaagattattgtgaagtagtttatttacctcgtacagaaggtatttctacaactaaaatcaaagatgatttaaaagataaattataataaaggagagttgtatgaaaattagtgtgattgtcccttatgaaggatattatcaatatttaaaagattgtttagaaagtttaagtgaacaagaaaatgttgaaattgaaacattattagtgggaagtcaagatgaccaaaaatttcaacaattagtagatacatataaagataaaatatctttgaatgttgttccttgttcaatagaagaaggcgttgctaaaaaaagaaatcttggtttagaaaatgcaacaggagattatatttatttcattgatagtgatgattatattatgcctcaaacattatcttgtttgcttcaagatgctatgcaaaaagatttagatttagttgttggtagaagatggatcacatggtttaaaaaacaagtttttgaaaccatgggtgatgaaaaaaatgaagaattaaatttgaaggataaagatgatgatcgtaatcataaattcttagaaaaagattattctgacatagatgatagtgatgaacaaagaagaattgatttattaattagagcgaaaaaagggattcgaaatatttcagttttaaatattttaattaaacgttctttaattgaagaaaatcatttacgttttaatgaaggtttcatttattatagtgatttaccttttgtagaaggacttgttatgtatggtcataagatagatttcaatgacaaaacactctatgcaaaaagaaaacataatgatccaatcaatacacctgccttgtcgcaaattaaagatgaaactaaatttgatgaatttattaatgtctataagtatgctatttctttagtagataaagaaagtagaattcgttattatttagattctaaaatgattaaatattatagtaatttctttgctaagaaaattagacgatctaaagatgatttttggagagatgaaagatttgatcaaatgtctattttaatgcaggatgtaagagatgatttattgaaaaatatgtctcattatcaaagaaaaatggtgaaacttgctagaaatcataatctacaacaaacacaaaaagtaattgctaaacatcttgctaaaaataagatgaaaaagatattaaaaaataaaaatgaaattaataagtatttatatcgtcataaatatatcaatgaaccaattgaagaaaattgggtcatgtttgaaacttttatgggtaaaagttatgcagattcaccaaaatatatttatgaatatttagctaaaaattatccaggaaaatataaatttatttgggttttaaatgattctaaagaaaaactgccttatgaaggaatcattgttaaaagatttacgaagaaatatgcttactatttagctaaatctaaatattttgtttttaatatcagacaacctttatggtttagaaaaagagaaggtcaagttttcttagaaacatggcatggaacaccacttaaacgtctcgcttttgatcaagaagaggtgactgcagcttctccaacttataaatctcaattttatcgtcaaaaacaagaatgggattatttaattgcagctaataaattttcaagtgatattttcaaaagttgttttatgtataccaatggaacaatgctagaaattggatatcctcgtaatgatttattgtatgcaccaaataaagatcaaattgcattagatttgaaaaagaagcttcatattccattagataagaaaacaattttatatgcaccaacatggagagatgatgaatactatggaaaagggcaatataaatttaagttaaaattagatttagaaatgatgaaagaagagttaggagatgaatatgtcatcctacttagaacacatcattatattgcggatgcgttagatgttacaggagttgaagattttgcctataatctatctaaatatgatgatattactgaaatttatttaatttctgatatttgtattacagattattcaagtgttttctttgattatgctaatttaaaaagaccaatgttattctatacttatgatatagataaatatcgtgatgttttaagaggtttctatattgatatggaaaaagaacttcctggtccactagtttattcgactaaagaagtgattgatcaaattaaacatcttgatgaaatgaatcaaaaatatgctcaacgttatgaagtattctatgataaattctgttctattgatgatggaaatgcctcacaaagagcagttgaagcagtttttaaataagggggggttaccccttatttttataaggaggtttaaaatgcttagattaataaaaaatatcttaggtaaaacaattaagtttatctatcgaatgacttataagttaataccaactcataaaaaaacagtcttgtttattgccttccatggtagggggtatagcgataatcctagagctatttatgaatatatgagacaacaagatcaatttaaagattatcgttttatatgggctattaagcatcataaaaagaaaaatattactattgaaaatgctaaagtgattgaatatttttcaattccttatttcttttatcttgcaagaagtcaatattggattgcaaattgtaaattaccaatgtatgttttaaaaaagaaaaatcaaatatatttacaaacatggcatgggacaccgcttaaaaaattggctttcgatatagaagttcctgaaggaactactttttatcgaagtggcatgaatgaagaaatgatgcatgaaacatacgcacaagatgttaaaaagtataactatatgatttctccaagtgcttttacaactgaggttttccaaagtgcttttagaattaatagagaaagattgattgaaactggctatccgcgaaatgattttttaacaaattatacagaagaagatgttttaaatattaagaaaaaattaggaattcctcttgataaaaaggtacttctttatgcaccaacgtggagagataattcttatataaccaaagggtatacttttaaattagaagttcactttgataaatggcaaaaaatattaggggatgaatatgttattgtatttaaacctcattatttaattgttaatgattttgatattgatcaatatcaagggtttgtttattttgtagaagctaatgaagatatttctaatttatatattattgcagatgctttagttactgattattcaagtgttttctttgattatgctattttaaaaagacctatttatttttatatgtatgatttgattcattatcgagacgaattaagaggtttttatttagatatttatcatgatttacctggagatattattgaagatgaaaatcaactattagaagaaattaaaaaaggttacgattatcaacgtttagataagtttaatcaacgttttaataatcatgaagatggtaaagcttctaaacgagtagttgatattgtttttaagtaggtgctaagatgggattacaaaaattaatattaaatattattttgggatttttaaatatttttgttaagagatttaaaataaaagaaaatcaagttgcctttgtttctttggaatctaaatatttagattctgatatgaaattgatttatgatgttttaaaacaagataaacaattaaatctcaaaaaagttgttattgagtatgatcaacaaggaataaaacaaaactttttatatatgcttaattgtattcaacagctttttataattaatacatcaaaagtggttattataagagataataattatgttgtttctacgtttaaaagagaaggagtcaatgtgatacaagtatggcatgcttgtggtgcgataaaaaaatttgggaatgcacttgctagaaaatatccaattaaaaattatgattatgtgatagcaaatagctcttattggaaaaaaccgtatagtgaagctttttctgttaaagaagaaaatgtggttgttactggtatgccaagggtagattgtttatttgatgataattatttaaaagtatctaaaaataaattgttagctaagtatccaatgctgaaggataaaaaaattattttatatgctcctacttttaggggaaatatttaccaaggtttttcaatgcttccatttgatggtgaaaagttaataaattcttttgatgaaaatacgtatctcatttataaattacatccattgttaaaaaatgtttgtcttccgcaacaccctcgtattattgatatgtttaatgaagatacacatgaattgtttgctttaagtgatctcttgatttcagatttttcatcgattgtttttgattattctattttaaataaaacaatgtatttttatgttccagatttaaatgattatttaaaagatgttggatgttatgtaaatacagatttatttccaggaaagatttgtaaaaatattgatgagttgattcaaggaatacaaaagaatgaagtgggaaatttagaagcttttaaaaatatattttttgaatatcaagatggtaaaaatacaaaacgtgttgttgaattgatttatgatatattaaaaaagtctctttaattagagactttttaaatacgctgtaacttcagttaaatcttttaaaattttaaatgttttttcttcatattgtttttctggatatttcatatcaggaatacaaatcactttgatgtttgcatcatagcttgcttgaattcctgcttcactatcttctaaaacaatagcttcatcaacattaacgccaagtttttgacaagattttaagaaaacttcaggatttggttttcctttagtgacttcgtcaccacaaatagaatcatcgaagaattctgtaattttagcttgtgctaaaattttatctacacgatcacgattacttgaagtagcaacgattgttttataattattatcttttaaataatgtaataattcaacaagtcctttttttacaggaactccttctgtttcaaaacgttcagccattaattgatgtacatcttgaatcacgttttgaataggaaaatcatttccataaacatcataaaatctttgatagattcctttaataggtttccctaataatgttttataaaattcttcatccattgttaaattcatatcttttaatctttcttgataacattcaaaagtaacacgttcgctatcaatcattaaaccatccatatcaaatattattgctttaatcattttagtatctcctctttttattattcgtgatatatcatagcataaatcaaggtgttaaagaagcgattatcataatttgaaaaacgactcataaaattcaataggaggttattttatgattagtaggggagatatttattatgctgatctttcaccggttataggaagtgaacagggtggaataagacctgttttagtattacaaaataataaaggaaataaattttcaacaactgttattgttgctccgatttcgtcaaaactcaccaaaaatcctattcccacgcatgtcattattcgttgtgattctttagaaaagaaatctgttattttacttgaacaaataaggacgattgacaaagttcgatttcaagaaaaattaggtactttagatgattattttatgaagaaagtcaatgaggctattaaaacaagtttggatttaaaatagttttcatcaaatataatatttgttataatgcctttataggatggtgaaagaaatgaatatatatgatatcaaaaataaagcaaatgaagtattaagacaacctaatcagttatttaaagttattttatatgttggtattattcaagctttgttttcggctttatcaggattatttgatggcattttaggaagtattataagtttaattttaagtattttaacagttactttgggacatggaattattgtagcgtctttaaaggttgttaataataatggaaatttagttgatgaaaaagaagattcacttgtaggaattaaacgatttggtcaactttttccaacatattttttgtatagagttgttgttgccttagcgggtattgttgtaggggttattggaatgcttttgatgtatacaatgattacagatgcacaattttcaaatttatctcaacttgttttaatgtatgttaataaatcaacgatttctcaagatgaaattgttaatattgttgcttcattatcaaatgtgttttcatttgtttttatactcgtaattattatttcgattttatctgtttatttatcattaacatttggattatttaactacattttacaaaaatataattatactggattaacagccttaaaagaatccagtcgcttaatgaaaggaaataaatggactttgtttaaattagaattttctttctttggatggatgattttagctggtttggtttcaggtgttgtggtaatgtttgtagaaacgattatgcctattccttttttagcaacatttataacagtggttgtttctactttctttagtgcttatttttatgatgtaaagcgtaatacatgtttggctgttttctatgaagaattagattatgctgataaaaatagtgttgagctatagttgaagggatgtttatgatgactgaaagctttgcaggaaagattaatggaaaacaaaaagcaattggatttattcttttatttccgttatatttatatgttataccaaggtttgctaattttggtatttatcttttattaaagtatacaaatattacaagagatacgacagttttaggaatctacttaaatttgatttgttcattattgagttttgttttggttgtatggcttttaagagattttttgatagataatataaaaagatttaaagaacattttacagataattttgtttattctattacaattggtattgtaatgatttatggaatttcaattgttgctaatatgattattaattttgtattgggtggagggtcaaatgattctgccaatcaattattatttgaagattatctaaataatggtgccttattgatggcttttcaatcggttattttagcacctatattagaagaacttttatttagaggacttgtttttagaagccttagagataaaagtaaatggttagctatttttgcaagttcattcttatttggttttttacacatttattctgctttatttgctggtgatctatcgcaactaatttatttgttttcctatggtggaatggggtttgctttttcctatgcttatgaaaaaagaaaaacaatttgtgtacctattttaatgcatatgatcaataatttggttgctattatattattagtttttatgtaaaactccgtataggagtttttttatacttttataccttttattagataaggccatgtttttttaccaacgatgccacctacttttaaatttctattattttgaaatttcttaacagctttttcggtattgacaccaaatataccatcaatttttaagttgaatcctacaaagttaaggcgttcttgaatgagtcttgtaatttttccttgggcatctcttttaacagtaggatacgtgcgaaaaccttgttttttaatttcttgatttaaacgttgcaaccaagtatcttctaaaacaatatgatttgaagaaataattgtagaaaatggaaaatgggttcctgggcaatctgtagaagcaacatctttatgtcttttaatgctagaaaggtgatatttattttttatataagaaactaaatcaattaaggcattgagttgtaaaggattcatttcttctttcatgaaatctccttcagcacaaataccgattgaatcatgatttgcacctttagcatgcgccccgattgtatcttcaggtctaccttgataaatcgtaccatcttttcttactaagaaatgatatccaattccactccaatctttttttaaatgccactgatggatatcttctacactacatgtttttgcttgtgcatgatgcaaaataattctatttgttttatttcttttgaacaatggagaagcccagttgtattttttacgaatgatttgcatagttcacctctctatagtacttatatgcttaagatataagatgatataggtaaaataaaaaatagtttattaaaactatttttgtacaaaggtaattacatcattaggttgacaatcaagaatcaaacataatttctcaagagtgagagctgtaatattactattcttttttaatctgtctaaagttttatgatcaataccactttttagaagaacatattgagaaatctgcttttcttccattgtatgccataacggtgaataatcaatcattgttatgtcctccttatatgtataattatatagaattattcttgcaaaaatattgtgaatatatacacaataacgtataatatgatttaggtgatcaaaaatggcaatgtatactttaaaagggattggtgaaatatcaacagatgcttttgatgaaaaaattactttaagaaatctattacaacattttagtttttatgattttattattgtagatacaaaacaaaatattctttttcaatataattcaaatgatgattggtttcataatctaattagtttaaagaagttttataatcaagaagttattacaatatataaaaaagaaaatcatttttatatttcaatagatttttaagaaatttaatgattttccttgattttaaaaatagattgtattaaaatatcattgttatctctccgtagctcagttggtagagcatctgactcttaatcagagggtccacggttcgagaccgtgcggggagaccaattgataaaaataataatagattaaaaaacagattctccccctcccttttgaatctgttttttgttgtttctatataatgaaaatgataaggtagatagagagaggtacaaatctatgttatttaaagataaattaaaagaacctgttatttataaagggagtaataaggcaataaatgaactaaatcaaatacaagaatatttaaaaacacatacaagtaaagaattagaaaagaaagcaagacttattcagtatggtattgaaggagaagagaatattttatttgaattaaagaatagtcattttccaatgtatgttttacatgatatttatatggtagatcatgatttaagtgcacaaattgattacattattattacgccatcaatggtttattttattgaatgtaaaaatcttattgggacaatcatgatcgattctatgggaaattttacaagagagtataattataatgggaaaataattaaagaaggtatttattcacccataacacaaaatcaaagacatttagagttatataaaatgttacgtgaaaaggataaaggatcagtaatgaaatttctttataataagaccttttcaagtggttttaaatcacttgttgtccttgctaatccaaagtctatcttaaaaagtcgttatgctcctaaagaaataaaagaaaaagttattaaagcagaccaactgatagattatataaagaagcatgaacaaagtgcttttagaaatcaaaaagatatgattgctatggctgatggacttttatcttatcatcaaaaacaagaaataccaccaattcaagaagaaaatacatttgaaagtatagcaattaataatgatgatcatttaattgaatcattaaaaaaatatcgtatgaataaagcgcaagaaaagaatttaccaccttattatatatttaatgatattactttaaatgaaatcgttgcttataaaccaacaacaatagaagaactcctttcgataaaaggatttggaccaaagaaatgtgattggtatggagaagatattttagacataataagaagtttgtaaaaaacttcttattaatcacataattttcgacaaaacaaccaaaaaagaaacatgaaaaagtaaaataaagttcatatttcttctttatgataatagacgaaaggaggaacaagaacttacttaaacaaaacttaatcataaatttccctttttaaaaaaagataataatagattaaaaaacagattctccccctcccttttgaatctgttttttgtataataatagattaaaaaacagattctccccctcccttttgaatctgttttttgtgcagaatatataaacaacattcattgattatgatacaataattaaaagaacattttgaatatgaaagtaaattaaaatgaaagaatttttgtatgtataaaatattaaaaagatacaaaaattgcaaattctaatgactataataggaaatgttaataagagaaaatgatgaagttagagttttaaacatgatattattttcaagatgggagaaaaaattatgagtaaaaaaacagttcaaaaaagtaaaaaaagaacaacaagaacgaataaaaaaagaacatcaggtgtaaaggccaatacggttgttgaaccaacaccaatcacaagtgaaaagacaactgatgttaaaccagtagaagtgcctaaaaaaactgctactgttcaaccaaaagaaacaagtgaaaaagttgttgctgctgaatcagcaccagctgtaaaaacagcgcctgctaagaaagcaactactaaaaaggctacagctgctaaatcaacaacagctacaagtaaaaaggcagctactgcaaaatcagaaacaacaacaactaaaaaaacagcttctactaagaaagcaactactaaaaagacaacaactgctaaatcaacaacagctacaagtaaaaaaacaactactgctaaaccaaaatctgtaaaaagtgaaacacctgttgaggctaaaccaacagaagttattcaagaagttcctgttgaaaaacctcaaccaattgatttaggaccacgtagaagtgttgcttttattggttcagaatgttatccatttgtaaaaacgggtggattaggggacgttatgtcagctcttcccaagagtttagctaaattaaatatggatgttaaagttattattcctagatataaatgtattcctcaaaagttccaagaaaagatggaatataaaggatcattttatatggatttatgcgcagatggaaaacaatattatgtaggtattatggaatatcaagaagatggtgttgtttatgattttatcgataatgatgaattcttctcatggggtaatccatatactaatcttatcgatgatattcctaagttctgttattttagtaaagcagctcttgcagcacttaattatttaaattggacacctgatattgtacattgtcatgattggcaagcagctttagttcctctttatttaagaacaatctttaaagatacaaatgtaggacgtgcaggttctgttcttacaattcataacttaagattccaaggtatctatgatcgaaaaacaattcaatattggtcagatcttcctgattatgtcttcaataaagattgtatgacacaaaattggttagatgcgaatatgttaaaaggtggtatcacttattgtaataaattaacaacagtaagtaatacgtatgctggagaaattcaaacagaagaatatggtgaaggtcttgaagaacatttaagatatcatagtagtaagattttaggaattgttaatggtattgatacggatatttggaatccagcaacagataaacttttagctgctcaatatgatagtcaatctgttatcaagaataaaaaagcaaataaaaaagcacttcaagaatcattaggattagaagttgatgatcataaaattgtcattggacttatttcacgtcttacaaatcaaaaaggtcttgatcttgtcaatgatgttattccaagtattatggatgaacatacacaagttgttgttttaggtacaggagatgcgatgtatgaagatgctttccgttattatgaaaataaatataaaggaaacttctgtgcatatattgcttacaatgaaaatgtcgctcacaatatttatgcaggatgtgatgctttactagtaccatcaagatttgaaccatgtggacttacacaacttattagtatgagatatggttctatcccaattgtaagagaaacgggtggacttaaagatactgttcaaccttataatctatttgataatacaggtaatggttttacatttgatcgttatgaaagtggacttctttatgatgcaatcaatcgtgctaaaacactttattttgaaaatagaaaatattgggatgaaatggttgttcgtgatatgaataaagatgtttcttggcaacaaagcgcaaaacaatacaaagatatgtatgtagaattaacaccaaaatattaaagcaatttaaaaatgcaatgttatttaacgttgcatttttttatcccataatttttgacaaaacaaacaagaaagaaacatgaaaaagttaaataaaattcataaaacttatctatgataatacacgaaaggaggaacaagaacttacttaaactcaaaacttaattatcaatttccctttttaaaaaataataatagataatagtaaaaagcagatcttttctcttcccttggatctgtttttttgttgtaacaataaaaattgcattgtaacaatctaattgttacaatgcaaaaactgatgttacaatactaaaataccaataaaatcaaatgatacacaacaaaagaggcaagccaagcaataaggcattgtccaaagacaacaatcaatgcccatttaccattgagttctcttttaattgcagctatcgctgcaatacaaggtgtataaagtaaacagaaaataagtaaagataaagcagcaggtgttgtaagtgacatcaacaatgattgggttgaaccataaagaatagataatgtcgaaacaacactttcctttgccataaatcctgaaataagggctgttgaaatgcgccaatcaccaaatcctaatgggttaaatattggagcaatataaccagcaagaatagctagaatactatcttttgattcagtaacaatattaaatcttaaatcaaaagtttgtaagaaccaaataacaatggttgcaacaaagataactgtaaaagctctttgtaagaaatctttagctttttcccataataattgacagacgtttttagcgccaggcatacgatagtttggaagttccataacaaaaggaacaggttctcctttaaacaaggaaccttttaaaataagagcaaagataattcctgttaaaataccaaagatgtataaaaatatcatgactaatgcgcccttacctgggaaaaagacagaggtaaagaaagcatagattggaagttttgctgaacatgacataaatggtgttagaatgattgtcatttgtcgatctcttcttgaagaaagtgtacgacttgccataacgccaggtactgtacaaccaaagccaatcaacatagggacaatacttcgtccagaaagtcctatttttctaagcagtttatccatgataaatgccacacgtgccatatatccactatcttctagaattgataaaaagaaaaataaagtaacgataattggtaagaaacttaaaacagttcctaccccattaaaaatcccatctataatcaaagaatgcaaagcaacattaatttgagcatttgtgagtaaagtgtcaacataatttgtgacaacagtcaccccactttctaaaactccttgtaaaaaagctccaataacattaaatgttagaaagaaaacaattcccatgattccaataaaagcaggaattcctgtatattttcctgttaagaattgatcaattttttgacttcttaatctttctttactttcatgtggtttttttacagtttgtttacaaatatctgtaatataatgaaatctattacttgctatagcggcagaacaatcaagactactttcttcttctaattgaatacgaatgtgttctaaagtttctttttcattttgacttagatcaagttgttctaataaaagttcatctttttcaacaagtttacttgctgcaaaacgtaatggaatctttgcgtttgaggcatgatcttcaattaaatgttcaattgcatttaaacaacgatcaatcgctttattttgttgattatctatatgttgataaaattgaggtctttcttgataataagcaacatgtaaaacatggctgacgagttcatcaataccttcccctttagcagctgaaataggaataactggaacaccgagatattcttctaaatcattgattaatacagttcctccattacctaacatttcatccatcatatttaaagcgacaaccattggcatattaagttctagaagttgcattgtaagataaagatttctttcaatgtttgtagcatctacaatattgataattgcctttggtctttctcttaataagaagtttcttgttacgatttcttcactactataaggtgacattgaataaatacctggtaaatccgtaataagggtatttttatagcctttaataacaccatctttacgatcaacagtaactcctggaaagttaccaacatgttgatttgaacctgtaagttgattgaatagtgtggttttaccacagttttgatttcctactaaagcaaatgtgagtaaatcactttcatgatagatttgatgatcattcattttatgataacttgattcaccatagccagggtgatctttatattgaaaaatgaatgaatcatttttattttctgtttttttagttatttctttaatttcaattttatgagcatcttctttccttaaagtaagctcataatcatgtattttaatttccataggatcacccatcggtgcatactttaccatggtaacctctgtaccttgaattaatcccatatctaaaaagtgttgtcttaaagctccttctccgccaacagagagaataacagcactttttccaatagccaattcctctaatttcataattttccttctttcctttataaggataactttttaataaaagagttgcaatgatgaaacactttttttaacataattattccattttattgttaaagtatctcggtatattaaagtcggaggtagaaatgtatgataaaaaatgcactattaagtttaaagaaaaatataggaaaaacgattttattatttgtaattattgttgtaattacaaatctcgttattgctgatttatctattcaatcagcaacaaaaaaatcaatggatcaaattcgtagtagtttaggaaacgatgtaactctttctgttgattttagaaatatgataaaaaacagaaaacctagtgaagccgtaagtaatgagacatcattaacaacaaccatggcagatagtttaaaagatttaaagtatgtaaaaaattataattatcaaatatctacatcagctaacagtaattctatttcagcggtagaaactgcatcagataatagtaataatcaaccagaacaagcttcaaatcaagttgattttacaatcagtgccaacaccacaatgaagtatttagattcttttaccaataacaattataaacttacaaaagggcgtttacttacaacaaaagatcaaaatacaaataattgtgttattgaaaccaatcttgcaagtgataatgatttaagtgttggtgatacttttactattacaacaacggttaatgatgaaacaattactcaagaacttacaattgtaggtatttatgaaattcaatcaacaaatgaaattggtagtgctcatttcaataatccagtaaacacaatttatactgatttatcaattggacaaacacttactggaagtagtgaaaatattacatcagcaatttattatttagatgatccagaaaacgcagaagcttttgtagaacttgcgaaaaagaaaagtgatattgattttgatacgttctcattagatgccaataatcgtctttatcaacaaaatgcttcttctcttgaaagtatgcaatcatttgcaaagatgtttgtatggatcgtagtgattgctggtagtgcaattctttgtttaatcttagctctaacaattagaaatagatattatgaaattggtgttcttttatcacttggacaaagtaaagttaaaattattgctcaacaacttattgaagtagggttaattgcagtagttgcttttgtgatttctttaggtacaggacaattaacatctcattatatgggaaatatgttagaaagtagttcttcttcaaatgtcatgcaaatgggtcaaaaaggagatcaaccaaatgacaatcaaaatcaatcagatagtaatcaacaaaaaaacaatacacaaacaaaagaaaatttcttaggaaatatgatgcaaggaccatcaaatcaggaattagatgtttcgattacaggtgaaaatgtcattcaacttgctggtgttacagcagcaatctgtattgtttctattgctgtacctgcagcctatgtattaagacttacacctagacaaatcttatctagaaaggaaggttaagatggaaaagttattagaattagaaaatgtaagctatagttatcaagatggcaaagaaaaaaatcaaattttagatcatgcttcttatttgtttgaaaaaggtaaaatctatgcagttgttggtgcgagtggaagtgggaaaacaacaactctttcccttgcctctggtttagataaacccgatgatggaaaagttttgttcaaaggaaaagatattcaagaaataggtttgaataaatatcgtcgagaagatatttcaattgtctttcaatcttataatcttatttattatatgaatgctttagaaaatgttatgtctgctttagaaattgcgggaatcaaaagaaaagataaaaaagaatattgtttatctattcttgaacaacttggactttccaaagatgaatgtaaaagagatattcgacaattatcaggaggacaacaacaaagagttgcaattgcacgtgctattgcaagagaagtcgatttgattctttgtgatgaacccacgggtaatcttgatgaaaagaattcaatagagatcatgaatactttcctagatttagcatatattcatcataaatgtgttattttggtaacccattcacctactctagcaaagatgtgtgatgtgtctttaagaattaaagaaggaaaaatagaagcaaaacgttagagttttgcttttaaatagttataaaatttaattaataaaaacatctaagatcatgattgtcttagatgtttttattagttttcttgaggttgtaaatttcgcaaatgtaaatatacagtattttttgaaatacctaactcatctgcaatttttggtacagaatcttttatttgaaaaatacctctatcatataattgagaaattattgctttatttttattagaatatgaaattgatgagtcttcatatatttcattttttccataattattttttctttccttttgaatcctcggcaatagcgactgtttcctattgagatattcttatcataagtcattccataatcagttgaccgtccttgcaaaggatctttcgcttacgggtacatccaagttatcattgcaccatctgcaataagcaacatataagtcttttgacgtggcatgagtgccttttttcagtccgatatatccagttgattccaggatagaacaagttgacaaaaattattcttacataattttttctagatatcacaaatttttatagcctagacacaggttcttttgaagtacgtcaaaaacaagacgatatgccaaaatatttaaggcaaaatataacataaatagaattagcttttgtacaatatcgccttaacttaatgacatttgttttctgtacagccttttttattcatacattggaataagttttccagtatgcttaacatacgatgacatgaattattaacataataggaggtgttggaaagaattttacctactaaacgactctttctaaaacttaatagattaaattttcattcattttcaaataactcttttattaaaaaagatgatctataactataaacgtaatcctttaatatctttaatacgtgaaagaataatattacaactacaactaataacccctggtaatgtatcaatagtagtatgtaagaaatcctccatttcactattagaagcagcaacagcatgtacatgtaatttgttttttcctgtaacacgataaatttgagtaacaatattattttggtttaatatttctataacatcagtaaacgaatttgataatgtttcaatttcaaaataacaagatatagcgccacttattttttgaggattgataattgtcgtatattcttcaataaccccttttttttctaatgcttgaattctagcttttacagcaactctagaaatccctacctcttttccgatatcagagtaagaaaaacgtgcattttttattaataattgaactattttttgatctaattcatcaagtccatttaaatacataatcattcccccgttaatcatttatttaatactatcatgctccttattataagtaaatcttttaaaaattagagatattgactgaaaataaatatttaattataatacttacaaaacgtaagatgaatattacgaaaggaatataaaagatgaatagagatttaacaaaaagttcagttttaaagtctatgcttcttttttcaattccaatgattttaggtgatttacttcaacaatgttataacattgttgatacattgattgttggtcaatttcttggtaaaaatgctctagcaagtgttggctcatcgtttaccttaatgacatttataacatctataatccttggtttatgtatgggaagtggagcgttgttttcaattagatatgggcaaaaagatgaaaaaggattacaggaagatgtatgtgcatcatttttctttattgcactcgtcacgtttatactaacagtaatatcttatatttttcttaatcagctttctgtttttttacatgttccacatgaagtgtggggagatatgaaaggctatcttattgttatttttataggaataccagctatttttttatataactattttgcttcttatttaagagctattggtaattcaatgacgccacttatatttttagctgtttcggcaatacttaatattgcattagatttattttttgtcattgtattaaaattaggagttgcaggcgcagctattgctacggtgatttcccaatatctttcaggtattggcatcagtatttactcacttataaaaaatatacaagtacgagcaattacaaaattacaatattttcatttaaagagggttcataaagtaatctcattttcagttcttacatgtattcaacaatcagtaatgaatttaggtattttaatggtacaagggttagtaaatagttttggaactgtggttatggcagcatttgctgctgctgttaaaattgatgcttttgcatatatgccagtacaagattttggaaatgcattttctacttttattgctcaaaactatggtgcaaaagaaaaaatgcgtattcaatcaggattaaaatcagcagtttgtctttctatgggattttgcataattatttcaactattgtatgtatttttgctaaagatttaatgactatttttatagatgcaaaagaaacagaaattattatggaaggtgtcaagtatttaaaaattgaaggtgctttttattgtggaattggttgtttgtttttgttgtatggtttgtatcgtgctttaggtaaacctggtatgagtgtcattcttacaatattttctttaggtacacgtgttgtgttagcttatgttttatccgcaattccagcgattggtgttactggtatttggtggtctgttcctattggatgggcacttgcagatttaataggattaatttattataggcgtaaaaaaaaggaattgctttcttttaatattgggtaggagctgggcatataggaaaaatgtgataaaaattgctcaggcgttagatatggatattatggtgtatacaagaacgcctagagaagatcatgatggaattcattatgtatcattggatacttattaaagaatagtgattatatttctttgcattgtccattaactaattatatgtttgtagtttgtcttttctatattttctgctttataggaaatgcttttgtaggatcctatcgaggaatcggtaaagtagatgtcccttttaaaggaacaacgatgcatgttacattacgtattattttatcttatttacttattcatcaattaggtttagtagcagtggctttaggttgtggtattggttggatatttgtgaatatttatcaaatatttgcgtatagaaaattaaagctaaccgcaaaaggtagttaaatgagaaagttttgcggtttgaaatcgcaaaactttctagaaatatatatattgctacaataaaaataaaaaattccttataataagataaagaggagatgtgtctatgatcaaaaaagaaaacttaccagaatgtcctgtagcaacaactgtttctttgataggaagtaaatggaaattgttgattttaagagatttattaacggggacaaaacgttttggacagttaaagaaatcattacctgatatttctcaaaaggtattgacggagtctttaaaatcaatggttgatgatggaattgtagaacgtgtggcttatcctgaagtaccaccacgtgtagaatatagtttaacagatttaggagaatcaatgagacctgtgatttctgtaatggaacaatggggaaaggaatataaggaaagtatttaggtataaaaaaagcaccttttttaataaagttgttcaagctaaattaaaagaaaaggtgcaatacaattatatatgattaaaaataattttgtatataaaaatctaatatttgatgaatttcatcaaatattagatttttattttattttccattgatgtttttttaaatcaacatgatgatcatctttaaaagtaactccttctttttctaataattttttttgttcaaaccagccaggaacaagtcttccttgaaaattaacgacacgatgacaaggataatgtccataatatgaggcatttgctagtattttacctactaaacgactatttttttctctaccaattaaacaagcaatttgtttatatgttgccacacatcctttaggtatttctcctactgtttctaatacttgataaattaattcttcattcataatgatcattccttttcctttaatttattataaaaaatgaatgaaagataatcaatttatgttagtattatttaaggaaaaggaagaagtaaatgtgaaaattgttttattaaatgtaagtccacgtagaggtggaaatacagaaattatgattaatacatttatggaaaatgttaaaggtcatgatgttgttaaattaaatattgtatcaatgatgcttaggatgtaagtattgttggtcacatcaaggagaatgtgttcaaaaagatgatatggaacaagtatggacacatttaaaagaagcagatattatgatttttgcatcaccatctattggtttgatatgacagcccaattaaaaactgtcattgatcgtatgtatgcaggtggaagcacagggtttcatttccacaaaacagctttattattagatgctggagctgatcatgtttttgatgcagcgataagtcaatataaagccatgacatcttatttaaaatgggaagatcttggtattatttgtgttcctaatatggaagataaaggaagtatgaaagaatcttcaaaattaggtgaagttattcaattagctaaaagtattaaataagaggatttaaagtaatgaaaaaagttgcatttatatgtgttcacaattcttgtagaagtcaaattgctgaagctttaggaaaacatctttcattagatgaaataaaaaaactgattaaaggagtccgtattggcgataaaatcgttaatccgcattttcatttaatggataaagaagcttttatcaaggatgagggattaatgtgctatgatatttatttctatatcgatttaccacaaatagttcaatcaaccatttgacaaccatttgacaaccatttgacaaccatttgacaaccatttgacaaccaaataaaaaaacagttatttttttatgtattttttattttgtattttcactttattaagctcatttaaatgcattgttttttttgctctgtcttttctaatttgattatgcatataccaatgtgtcacaactataacacctgtatcaaatggaataacaaaaccatttttttcaagctcttctatgttttcaacttctaaacctgtaaaacgtgccacggctttaggattgcttataaatccctcgtcatctgcgtttaaatttaaataaacgtataatagttttgcgtttgttgtcatatcaataaaaatatcactatccataacttctttagaaaacattctttttgttgccattaattgctccccctttgcttatagctttctatagccttaaccctattagaaacatcacaaccacgatatacttcttgaaatcgttcaatttccctttgtgagaacataaaccctttacctgttttaatggcttgtattagtcctaattctcttaaagtagaaatatgttgttttgtagtgcctagtttttgagccacttcttcttgtgatagcatattcaagtataaagctttttctttttcttcttttacttcaatcatgctatataattctttctttaaattttcaatttctaaaggtattgtattaatacgcttattaatcttttcaaagtttaaagaactatcattgttatttgaatttaacaatctcattctttcttcgcttaaagatatgatctttaaaattaattcttcttgtttatccatgtttaccactcctttttttataaatttgaggtattgctagattgatctaattaaaatagccaaacaatccgcaacaaaacaacataatacgataattgttactagtcctcttgttgttaatttcatgttcttatacctcatttcttttgatttcgtcataattgacgattaatactacttttcgattaacttctctaaatcaacgtttaaagcttttgctactttttgtgcaatatcttctctacatgatttaccacacttgatattgcttaatgtaacacgattaacaccacttcttttagatagctctataagtgttaaatcttgctttgtcagctcagtaacaaattttaatctatcaattctcattgcgctcacctcactttcttgacttaagcatatacttaagttactattagattagcataagtataaacttaagtaaatgccttaacttaattttttgcttatgtttgttatataatgtgttatacttggtttgaggtgataaaaatgaaaataggagataacataaggaaagtaagaaaaaaaagggggcttactcaaaaagaattagcaaaattattaaatgtgagtgagcctatggtaagccaatatgaatctaaagaaaccttgaaattagaaactataaaaaaagtagctaaagctcttgaggtttcatcatttgatttaatagatggttataaagtccctgtttatcaagtaaaacatattaatattgaacttgagccatgggctttatactactctaatatttttaatacttataaagaaaaaagtgacctgttttatacctggtatcgtagaaagaaacaagaagtaagctacgagctagataagctaaaaagtgtgaaatttgattttaacattccttttcatgattatgggcaagatataggaaaagcttctaatgatttttttactgatcatataaattatttacaaggtttaataaatgatttagattatctttttgaaactttagagggaatgtatgaagaacaagatagctttttagaaaatggtacaattttagatactgttgataagaaaagaaaagagctattaaagttagttcatactccttttatagatgaaagagaacaagaggaaagctattttaattctttaagtgatgaaaaagtagaaaaagaatttaataagcttgtagataaattaaaattagaaaacaataaactattagaagaattgaataaattagaaaataaataaaacttatattatttatcacccctcctggtataacacaatcaataaaaccaataggagggaacaacaatgagcattttaaaagtagcaagtaaaaaggctaaaaatggatatacatttaaagttgattttagatataaaaccaatggcataacaacaagatacgttaagagtggctttctaacaaagaaagaagctaaagaacatgaggaagatataaaagcacaaataagactatatggacgagtaaagaagatatataacggtactttaaatatgtgctttgatgaatggttaaaggttgacagcaaccaattagcacctaatacaatcaatttatataagcaaacttataataagtatgtaaagaatactataggaaaagaaaaacttgtattgcttaaatacaaagaaatacaagcatttataaataaaagtgatataagctatgataattgcattgctattaagaaagtattaaatatggtgtttaattttgctgttaagaatgagtatgttgaaaataacccaattcaatttattaaaaatactaaagtaaaagataagaaagacaaaaacaattatattacatttgaagaataccaaacattaacgaataaaataaatcaaggttcttttaatgatcgtgcaatttctattgctattagtattgggtattatacaggtttaagagtaagtgaaatattagcattaaataaaaatgactttgattttattaacaatacgataagtgttactaaacagattgctaatagaaatactaaagcaaaagaaaccacaacaaaaaatattcttaaaacaatatcaagcaatagtttattacctttagtaaatgaactaaaagaaatattattagtatggtttgatattaacccttatgaagttgttgtttgtaataagaaaggtttatatttcaatcctgtaaacatacaagccaaagctaaagccatagcaaagactttaaatattgagggcttccatttccatatgttaaggcatactttaataacaaatttatatactaatggtgttgatgtcaaaaccactcaagaattagctagacatagtaatatcaatacaacattaaatgtttatactcatcttgaacaaaagaacaatttcaaggcattaagtagtgtttttgataagaattaccccaaaaataccccaaaaattcaagaaagagaaatgttatcataaaaaaagccttatatatcaaggctttcaagaaattatatagaatgaataatcttacaaaaatgtaagaattaagctaattattattttatctgcttatatattcaataatgtttatttatcaacactttacttcatttatattttatactattcattaaaatttacgctctttttaagaaaaatgttgctaattgaataaacaccaatatattgaaggctaatcagatgctcaaaaagaatatatttcagataatgattaaaatatcaataaaggttggtgtttataatgattactaaaaaacaagttgttcaatatttgaaaaataaagataaggacacatggtttttcaacaagatatgcacaagaatatttagattttaatattttaagaaaacaaataaaatataagtataaaagagatgaacaagcaaagaagttattcgaagaagtgaaagatagtgaatttattaaaaatgcattggtgttaaacacaccaatgccaatatcattaaaagaagcctattatgagtatcactacggaatattttcagatgcttatcttaaaaaacaacaaaattcttaaaaagagcgaatttttattatattttccctactccattgttttccaaatacttccatatctcattctaatgtatattcatttttataaaacactataactagacattccatattcaatcttttatgtaaaactgtaacaaattgcaatacattccttttttcatgaattattttgtaaaaatagctttctatcccttagtaacaatacaacataaaatactttaatatctttctataattatactatacttttcttcccaaataaaaagaagtattcaatttttttaaatttcaaatacttccttagtttattctcaatataattattttatttcaaattgataattatctaatccatcaattactgagcaaattttttcattgtaaacatgaaataattcaaccttagcattttctataatagaaatcatttcttttttcgatatgcccttttcttccatcatatctaaacatttcgctacggtaattctatcactttcatgaatacttcccataatcatccacatacattcatccatattattcttattatccatataataactccttctattaatcatataaataggtaaattgaagccataatttttccgataaaaacatttgtaaaaatggctattttttattaaaaaaagattttaattcgtttatctttgtaagtcgatttgtttcatggttattctcataatatataatcacaggtaccgtatcaaccctattaccttctaaaaaataaataaacttaacatttttcttccaatacgctgtattaatatacttaatagctacattatttgtctttaaaaatttttctaattctttttgaaattttatacaatcaatacaatctggtctcccatagtagtagtacccttgtttataatctaattctgttaaatcgcttatactagcgatttcacctgtctctatccctttatcatgactattaatcaagactattgaaatcaatatacaaaataaacttaatattaataataatttctttacggattgcatccttttgctattaccttaccaagatcagtttctgttctatgtggttctaaattccaaggatttttaagttttcctattgtcatatgatgacataaaaattgcgcttccattgatgcggtatgtttccatttagaactacttttatgttttttatacaattcttggaacgcagttttagccactgcataatttgctgcaggtaaatcattagggtataaagcagagcctttaaaatttatgcttaatgaaacaactccatttcttgtgatccatttgcttgaattaaaatacttactatagccagatgatgctctagcattattattagaaagtgccgacatatattgtctatataattcaacatctttttgagttgcatacatatgatttgaaatatcatagtcattgctatataattcaccattttgtatcaaataatagatgtttatatattccataatttcttcatctttttttgaaatattttctgatttttctaaagcactagcagttacacaattaacacctaaaagtaaagctactaaagcagtaaataaaattttttcatttgaattctcctttcaatcaacaattagttttttttacaaaacaatactactaaaactatttgaatcacacatacacaaagaaaatatatagataatatttgcaccataaatggaacaatatccagcaacgccgcccaatcactttctatcagtaatccttttatataatttatacacatcaacaaggtgattatactaatgatattgttaataaccaatgtataaatgaactgtttgcttttatttaaaaagaacataacgttaataaataacaataatatatttgcgaacaagcataatgcaataataagtatcaatattttcacctccgttaaacaacgattacttaaattaaaatattctagtcatatgtttagatatatacacaatgtcaatatgaaataaatacaattcaataaaacttgcattttgttgtttatatatttatcattttctctttgaaataattttatattatttgctttcctctaccattttcttaattttcttatataaataaagatagttaattaggctttttttaatacttcttcaactattctttctgtattattttctttttggctattaattacattataaataaaattatcaaaatcttcctcattcatcattataacttcaccattttttataagttttattggtttatttgttaaaaatattttctcaccaatttctgaatatcttaaaatagaaacacttctcattttattcattaattgcaggaaatcacttggacaatttaaaagggcggagtgtttacttatatcttgtaaaactatatttgcatcacaaacataaattctatttaatacatctcttaaaaaatagcatacaacaaagaaatctaccatttccatcggtacatgagacatccacactctaattttatcaccttgcttgattttgtataaaccatttagaaataaagaatatttattataaaaatattctttatttcttttaccgtaatcaacaacaccatatttacataattgttcatatctttcattaatactaaaattcttaaagtttcctaacgaataatcgtctggacaacaaagaatagtatcagaatctatgaatcctgttgcatataaataacgtaaatttgcttcagttgtactatcgaaacacacttctatcattttatccaatttttaaagtcattgtttgggtaattcttcctccattcaagacttccccttctactaatgaaatataacatttcgctttatttccttttttaaatgactttgttccgtctacaaaacagcctagtaaataatttggagaattactatgttgctcaatagctatggtattagaagcatacgaattttgatctttaatggtgtgtttaccataaatacttctaattcttgcttttttattttttgcttctaattttatgtgtagatcaattgttctatccgctgcaacaatttcaaacaacgtacccctttgctgagaaatactatccttattttctacaaatccacctgtctcctcatccaaatatggcacctgctctgcttcataaacaatcggctcttgctcctgaatattgtcatcttatgcataagatggtgatgcaatcagcccaaaagtaagaagcataaccgttaaaatagttaaaattctttttatctttatctcctcttgttttatatttcgaaaacgttctctaattgaatattatcatatattaaattatttgtacatagtttttctatgtattgatgttttttaaatatatattataatataattatcttaacgttaaggaagtattaatatggccagaaaaaatagtttttttaaattagatatgttacttctatgtataattgccaaacaagattgttatacctgcgaccccctggtcccaaaccaggtgcactaccaagctgtgctacttcccgttactgcccttataattatacatatattttcgttttaatcaagctttattttaaaaaaacattaaaataaattttacttttttttaatatactttaaaaaagtgtgataaaatgaatgtaatttagaattttaaggagttgaaaaaattgaacaatttatggaaaatttatgaaaaagagcatttagaatttataaatagtcttatacatgttccatcaatgcaaagacttaaagatattgggatgaattgtggagtggaatatactgcttttgacttcttttcaaacatcgtaccatattctcgttatcaacatagtataggggttgcattaattgtttatcattttacacatgatcttagacagacagttgcaggtttgcttcatgatatagcaactcctgtctttgcacatacaatagatttctatcaccaagatcatttaaaacaagaatcaacagaattagatacgaaaaaggtaattggacaagataccgtattagtttctttgttgcataagtatcatttaacgatagaagatgtttgtaactatcatttatatccgctggctgataatgaatctcctaaactttctgcagatcgtttggaatatacattaggaaatatgtatagttatggattttgtgatttagagatgatacaaatgatttataaggatctcaaagtaaatgacaagaaagatgaacttatttttaaacatgaagacaaagctgttctttttacaaaaatgatgttgaagtgttcgcgtgtttatatttgtgatgaagatcgttatgcgatgcaatatttatcttatattattaaaaaagcagttgatagaggtgtagttaaagaagatgatttttatcttcaagaaaagagttttattgatttattaataaaagataaagaaattaaacagttatgggatgattttcgacaattaagttgtgtttataaaggaaaaaataaagaatttttttgtaaacaaattccggctaaaaaaagatatatcgatgtttatgtagaaaataaagggagaatttctaagataaataaggaaatggctcaagaaatacaaatgtttttagtaacaaatttaagtgaatatttgtggggaaagtgtgaataagtgcataaaaggtgaataacttgagttattcaccttattcacatgtttgttcacgttttgatgaagtaaatgagggattataagcgtagtagttcttcttatttaattgactcttgacatattcaagtccttcagcaaaacgttgataatgcacgatttctctttctcttaaaaaacgaatgactttattgacgtcttcatttttacttaaagcaagaatgttatcataagtggttctagctttttgttcagcagccatatcttctgttaaatcagtaataggatcaccaacagattggaaagtatctgcactaaatggtataccagcactatttgttggataaactcctagagtatgatctgtaaagtaggcatctaatccaccatctttaatttcttgaggtgttagaccattggtaagttgatagaatagagtactgataatttcaacgtgtgcaagttcttctgtgccaatgtctgttagtaaagcttgtatacgaggataaggcattgtataacgctgacttaaataacgaagggcagcacctagttccccattaggtcctcctagttgagaaataacaattttagctgttttagcatcaggttttcttacattaacgggatattgcaagcgtttttcatacaaccacatgacaattctcctttcgtccatggaaatggttcattgatataattttctagatttttaccgtctctatttgtaagagcaccaccattttttaaataagtttctttcatctttaaaagatgcttcatcccttctttataatattttttagcttcttgatcatcaggatgggtatctaaaaacaaagtaacatcttggatacaaaaatccaatttacttatttgtaataatgtatcatccacgacacatcacccaaggtttatcaagttgtttaaaaatagttcctttatcaaaagcaacattcattttataaatatctttaaatgattgtattttgatagaagaaatagttaattctaattcattcatatttaacctcctcaaaattatcatatgtttattttttttacaattatagtgaaaatacctattgcatatttatttttattatggtatattaattaggcaaacccaataggggtatagttcaatggtagaataccggtctccaaaaccgttgatgtgggttcgactcctactacccctgccaggttatttgattcacatcttagatgtgttttttatttgtacaaaagcgaataaatatgtgaataaggtgaataactcaagttattcacttttttacgcacaatttatgaaaaaatgtgcataagatgatatgataaatagggtgatgtagatgtttaaacaagtgatttattattttatggctgtagtagaagaagggagcttttctaaagctgctaagaaatactatctttcacaatcagcaatttctcaacaaattacaaaattagaaaaagatttaggattttctttgtttaatcgaaaaacttattgtccaactcttacaaaagaaggaaagcgttattatgatttggctaaaagattaatagatgattataataatgaatatgaagatattaaggaaaacttacaaaaggatgtattaacgatagggataacaggcccttttgaaaaacaacatattccttttattgtaagaagttttaaagaaaatcatgatgtttctattgatattaaagcgtttaatttattaacatgtatggaaaaattaaatgaaagggaaatagacttaggctttggattaaccaataactttaaaaaatatcctgatttaatttatcaaacaatacatcatagccatatttgtgttgtcacttcattagaacatcctttaagtcataaagaatatttaacgatagaagatattaaaaatgaaccactcattattttatctaaaaaacaaggagaagaatactatcatgattatatggaatcttttcgtttagatgggatgattccttacataaaaaaagaagtagatgatttaaatgaatatatgatggctatttctttaggggaaggtattggtcttacagcaacggaagtaattaatgaaaatgatcaagttgtggctattcctttaaaagaaagtcatcaccacgcagattatgcagtaggctatcatcgagataatgaaaaaaaggcgatacaacaatttatgaaatatgtagaagattattttagactataagaaaaacttatagtctttattaatttttaaggtctattttataaaaatattcatgatataattttcacatgtggaggtatgaacgatgagtaaaattgttattaatggtgttgatggaaattttggttcattagtggctaaatacaccttaaaattgatgaacaaagaagatttagtatttacagcacctaaagaagaaagtttaaaagaatataaggatcaaggaattcaaacagctatagctaattttaatgatcctgaaggacttgtaaaagtttttgaaaatgcggataaagttttattgatttcaatgccttttgtaggtgaaaaaagaagacaagctcataaaaatgcagtagatgcatgtgtgaaagcaaatgttaaacaaattatttatacatctgttttatcagcagcacatccatttaacccaagcattgaaaatgtagatcattcttatacagaagcaattattcaaaatacatcgcttgattatattttcttaagaaattcactctttgtagaagcttttacaagtgactacttaagagcagttgaagcaaaagaaacaacaatttctaaaaatatgggtgatggacgtgtgtggtttatttcacgtaaggattgcgcttatgcagcagcttgtgctttaaataatcatttattacatcgagctgttttaaatattaatggtttagaaccactatcttatgaagatttcttagctattggaaacaaagcaacaggaaatcatatcacttatacaagacttacagatgatgaactttatgcttattttgattcaattggtgttcctagaaatacggatggagatttttcaaaaagtccaattaaagcaacatcagaaggaatggttacttttggaacaactgtcacacaaggctatttagatgttcctgttagtgattttagttcacttacaggaagaaaaccattatctattcaatatatctttgaacatgtagatgattatttattaggtgatcgtcatccaacagaataaaaaaatgagggagacctcattttttattatgcacaattgtgaataacttgtgatttatgtgcattaattgtttataagaataataatgatcaaagaaacaaataaaatcgttacaatagctgctaatgctaaaataattttattggtcttctctttaaaaatcttttttaaaagataataaagaccaacaccgacaagtactcctgttgtattcgtaattaaatctgtaatatcacttgctccaagacaaaagatatattgagataattctaatgaaatgcttaatagaaaaccaagaaatattgttcgatcactattaatatttaatgtttttaaatagagcccaaaaggaataaaaataatcagattatcaagaacttctcttatttgataagttgtcttatttggataatagaagggaattaaattaatgcttctaaaatgtggtaattgatcaatagaaacagataatttaaaaagtatgatccaaatgactaaaaatatgtaaatagtaaataatatatgtgtagtttttttcataaagactccttctatagaaataggttgaggtaatacccaacctatttgtttttaatgatgtcatatttagaaaaaatatccagtacagctgccatattttcatccttaataatataatttctgtttggattgatggtgtttttagttgtaaaactaatcgttaattcataatagttttcataaccatgataatcagcggatttagtaattaaatttttgttcataatttcgtacatacttttcatgaaattttttttattttgaattgtaatatttttcgttgttaaattctctatttcttgattatcgacagttgatggcttatcttcgtcgaaaatataacgatcagtagaaaaatagatttcttggatatccttgttttttggtaattcataaattgtattaagacctttggtattagaataaatattagaaaaaccaatgcaaccaataatcaatagaataaagagagatggaattttccagctgaaataaacttttctttttgaaaaataatacataattaaataaatgatgaaaataacagaaaacatgagtgttgtcatttttaaatcctctagatcatacacaaataacatcattgataatgtacttaaaataataatcaatggatacataaagatagattttgtgtatgtttcacttttttcgagtgtacgttttaaaaataaatgataattaatcaatgaaaagataatacttaaaataaaccaatagataataggtgtattagaaacaaatggcgataataaatagtttccttggaaaaacccactataaacaatacttatataattaagtaataattttaatgattgtgaatagtttccatatcccatcataaatgtttgggctaccttggttgcacaaatattaagagcaagaaaaacaacaaagggtatgatcatataagcaatcgaacaaattaaactatcagtcatattttgagatgaaagtgttacaaatgtaatgattgtattcatcgcaaacatatggacgatggtgataattattgctagaataaatttgtccaatggaaaagaaatcatatagttaccaataaattggcttataatttggtaaataacaacaggtagaatagttgcaaagtaagaaaataaacttgttgttaaataaagtgattctttttttattggtaaggaaaagtaaagtatattacttttctttttttgtaaaaaagaaaacagataaatagggacaataaaagataacataaatccataagctaaaggaattatttgtgcaaaacgcgttatattttcatcgtttaaaggtacataatcaaatttattgattagtagaaaaggaataatgattccaattacataaataagaataagatatttcttattttgttttattaaatatttaaaataatctttattaatcatagacaccatacccctttctttccatttcataaataaatatttcttctaaatttacaggtaaaacttctaacataattggattgaacattcttaaataatctttaatttcattgatgtctcctttaacaaccatattaatcacacgagattgtttatggaaagatagaacatctaaatgactaaattcttctttgtttaattcttctttaaaagcaatttgtattttatgaatatgatctttaatatcatagagatcaccagatgttgtcatacatccattttctaaaataccaaaactatcacaaatatcttcaagctctcttaaattatgagatgaaataatgactgtcatattttcatcaatcatttgatttatagcttttttaaaggctaaacgcataacagggtctaatccatcaaaagcttcatctaatagtaaatattttggtgcaattgcaagtgctaaagcaaacattgcttgtcttttcattccttttgaataatcttttaaaggtttattttgtggtaaacggaataaatcgacataatgttgataggtttctaaattgaattgtggataaaaagtaagatagaaatctttcatttcatcaatagtagcaaagtgaaaatagtagggatcatcactaatgaataaaatatcttttttaacatcaggattttcataaacatcttttccatcaaataaaatacttccttcatcacatttagaaatcccatttaataaataaagtaaggttgatttcccagctccattaggaccaatcaaaccaaaaatacttcctgaggaaattgtgacatttaaatgatttaaaacatttttattttcaaaagatttcatcacatctttaatttcaatcatacagtttcctccttatatacttcttcaataatttctaataatttgtctttggtaatttgatgctttttcatttcattgacacatcctttaaaatcatctaatttatcatctttaatcaattgatcagtttgattatcagcaataaaacatccttttcctttaacggaataaatataaccttggttctctaattcttgataggccttagaaacagtattaggattaacgccaatatctgttgcaagagatcttaccgaaggtaatttatcattaggaagtaaaatgccgatagagataaattctaaaatttgttttttgagttgttcaaaaataggaactttattttgaatatctattataaacatagagtcctcctaactgtattagtgtcgctagtacactaatacagtataatacatttaatgatttgtcaataaggtaaagaaaaaaagagctcattgagtgaactctttttcatgttttttgaaaaagtcataaaaataacgtacgttttctaattgataccaaggcgtgacttggcattctttagcatcaagattatatattttagcatctaaagttcctaacataaaaggagaatgagtagcaataacaaattgacatcctaaataatgtgcgagtttattaatttcatgggctaatgcaacctggttggcaggggataaagaaacttcaggttcatctaataaataaagcgcttcaggtataaggtattcttgaaaaaactgtaaagaggtttctccattggaatacttttcttgagaaaaaataatattttctattctttgttcttttttatgatccaaaatactttgagctttttctaaagataaaccatcttgcatataatcataagttaatccatgttctaaaattgctttttgttgtatttttttaatttcatagagaatatcttcacttttgatataacgactattttcaggaagatgataaaaaggaacaccgtattcattacttcccaaactataggcacattcattttcaaatctttgacaataattttctgaaccataattattgcttgcagggctttcttttccttttatctttagttttccagcaataatatttaaaagagtagattttccacaaccattatttccatagaaaatagtaataggtgcaaaagaaaagggttcaatgtatttatctttaaagacactataaggataaatattagggtttttaagttttttgttacttaatttaaagctacttaaataaatcatagaatgacctcctcgtataatttaatcttaattgatgagagttaaaaagacaataaatttatagagtattatttttattgaatattgcaggtttacttggaagaaagtatatgattcgatataatatattttaataaaagggaaaataatatgaatgaaaatcgtgttcaaaaatataaattagcgaaaaaaatttcaaatcaaattgagtatttagaaaataaaaagcatgttcaatttaatataatgtctaaaaaaatagcgggtgagaaattattagaatataactatataaatttaataactccgtataaacataactttgcaaaaacaaatgaaaaaaaagaagtgattaaagtaaatggagaacatatttacgaaagaaatgttgaatttagtgaatattatgatttgtttatgaatgaaagaaaattatatccgatgattattgaaaacatactagattttgaaattcatttcaagtcaataacagcttatcatattttaactttgaatcaattaacagattctaatcaattgaggatgttttttgatggcttaaaaataagagctgcaattttagaaaatagatataatgaacaaagaataaaacatatgaatgcacatttagaaaaactaaaagaacaaatttttaattatgcagatatttattgtttctttgatagaatgagtttaggaaatatgttaactgttttcacgtgtcttgataaaaaacaacaagatgtaatttttgaagatttaaagcgatttaatatgaatttcaatgtacaaaagataccagattttattaataaaattttttgtttggtttctattcgtaattgtgtaatgcatagtaatagtttagaaatattaattagattttataatcctaagacccatgaactacgaaaagtatctgataggaaaaaatatttaaatatgattaaagaattatgtaaagaaaaaactcatgattattcatgagttttcttccgcaccaagtgccatttacattattattatatgcaaatacagaaaaaagacaacacaaaattaaaaatgaaacaacaaaaagtaataatacctataaaatagttcaaatttttaaaaagtattgtattgaatcttataagttgtgtggtaatccaccaaaaaaagcggtgttcccaaccattaagagggagttaaaaaagcggtgtacgccaccaaatcaagttatataatttgaaaaagagcgagttaaaaaggagagagtattcctatttggaatgctctctttaatttatctaatgaataaataagctgtataaatgatatagagtaaaatacaaagaagaccttcttttctgttcattgatttatttgttttagcaaatagataaagtagaatgctacttactagtaagataatacaatcaataatagattcatttataacagtaagtggtgaaagtgtagcagaacatcctaaaataaataagatattaaagatattagagccaatagcgttacctaaagctaaaccactttctcccttttttgtagcaacaatagaagttacaagttcaggaagagaagtaccaatagcaacaatcgtaagtccgatgaaattttcgcttacacctaaatttctagcaataatacaagcttgatcaacgacttgttgtccacccaaaataacgaaagctaatcctaaaacaataaatagaatactcgttaatagagaacgtgtttttgtgttatcttcattttgttggtgacaaatcgcttcataaatcattcttccaagatagataatcattaataaaataagaaatattccttctaatcttgaaagttttccatcaaataacatgataagtaaaatgaaagtaacgatgatattaaaaggaagatccttttttaaaatcgttctatctgttttaaatgaagctaaaaaagcacagataccaacaacaattaaaccattaaaaatattagaaccaataatattgcttaaagctattttgttatttcctgtaaatgcagcacgtatacttaccgatgcttctggtgcgctcgttcccattgctacaatcgttaaaccaatgattacactgggtacttttagaaatcttgccagattacagcttccctcaacaaataaatcagcacctttaattagaaaaataaaaccaatcattaataaaatatattccatgttttcccctttcttgcgaaaaaagtcaacaaaaaagacttttatcgcatcaaaaaaattgattgataaaagtctcgttatttactcataataaccggctataagcgtgatgacgattattagaacatcgaagatgctaactactcccttttatataaaaataataattgataatcataaataaatcaattctattttaatatatgttaaaatatttaatgtagaattaaatttgaggtatttgtatgaaaaaattatatttaataggtggaacaatgggtgttggcaaaactaccacatgccaagttttaaaaacaaaattagataaaagtgtatttttagatggtgattggtgttgggatatgcatccttttgttgtaaataaagaaacaaagaagcttgttttaaacaatatctgtactttattgaacaatgatataaaatgtaatacttttgaaaatattattttttgttgggtaatgcatgaacaaagtataattgatgatatactttcacgtcttgatttaaatgacgtaaaagtaatagcgatttctttagtttgtcaaaaagaagctttagaaaaacgtattcaaaaagatattgatcaaggaattagaaagagcgatgttttaaaaagaagtatcgaaagaatggaaatgtatcaaaaattagatacttataaaatagatgtttcttataaaacagtagaggaagttgttaatgaaattatgaaagtaggggtgaaaaatgattagacatattttattttggaattatacagacgaagttaaagaaaagcatcaagaaaaagaaacgttaataaagctaaaagaatctgttgaaacattaaaagatatagaaggtttattatgtgtggaaatggaagaaaacttatcatcaggttatgatcttgttttttatagtgaatttgaaaatcaagaagctttaaaggattttcaaaatcacccattgcatgaagctcataaaaaacgttgtaaagatttagtttgtaagcgtttatgtggggatattgaaaggaaataggcttaaaatgaaaaaaagctataaggggtacattgtttggatgattttattttgtgttggcatggtattgatgatgattgttgatttgaaaaatcttaaactatttagcttgattttaggtaattatatgcttatgatgataaccttgcttacaggaatgatttataaaaatgaatgtatttattggtattcaggagtttcttatcaagaagcaattgaggcaacaagtatgtcaagaaaaaagtatgcttataaacattttatacgtttttttataacatgtttattgtatttattttattcaataatagcttattttttatcattttcatttggaatgaatatgacaatttgttgtttgttaattatggtgtgtgccctaagcacgacatctattaagttataaaggagtttttatgagttttattacaacgtatacaaaaaaatattttgatccattaaatgtagatgaaagtttattagatattaaagatattgctcatgcactttctttaatatgtcgaggaaatgggcatgttcaacatttttattccgtagctcaacatagtcttgcttgtgctaaagaagcaaagacaagaggatatagtaaagaagttattttaggatgtttgttgcatgatggaagtgaagtttatttaagtgatgttacaagaccgataaaaaaagaacttacttattatttagaagtggaagatgttttacaaaatacgatttggaaacattttattcaaagagatttaacaaaagatgaaactaaattagtttttgaaattgatgatgaaatgttatctttggaactaaaagaattattaaatgatgaaatcaattgggattatttaaagttgcaaagaaaagttgatttaagttttgtagcttttgaaacaattgaaaatgaatttatagaattttataaagagacgatggaaatttaaaattgtctttttctttaccctttccttatttctgtgctaaaatttgagtatatatttttaagggggactcttatatggaacatgttacatttgatgaattttttgattttgtaaagaatgaagatgctaattggtatattcctggcctaaaagaatattttgaaggtttgaatcaagatgaaatctatatacaagacaattttttgggaaagcttgtttatcaatttaataaatttgaaaataatttaaaggaagctgtttttgataagtttatctgttatagaaaaatgacagatgaaaaagaaataagcatgcttaaaaacagtgccaatgaaatagctaatattgatttaaaaagtgcttattcttacaatgaactttttgacaatgtttctcataacaaattattagaggatatcaataaatataataattgtggggatgttgattttgatcttggaatagaattaagatttaatgaaatatatgatgaagaaacttttaaccaaggttctttagatattataggaagtgtttcatttaactcacataaaagtggaaaagtctttgattttccatttactatgaccattggtttagattcatattattttgaaaaagatggggatatctataagatatataaatttagggagttctatgctttttctaaaatttatggtacagaagatacaattcattatagatatagaaaaaatgattttccattagaaaaatatggtacatatggtgtacatgttgatagtgatattccttttgctggtgataagtattcgatttatatgtttagaaatgactatgccccatttaaatatgctttccaatatgactgtctaactcatttagttaaatctgaacttgggaaagagcttttagaaaatgttgctaaagaagatctattaaaaattctatacaatagaatagcctatgttgttgatgaaagccttatgccagaatatgattaagataccgatttttggtatcttttttttaccagtattttttcaataatagttttattctttgcttttatgataagttttatctacaagttggcaaaagaaatgaatgataaaatgttatctttgagattaaatcaatcattttttaaggttacaaagaaaaggtgatttaagtttagaatgtctgaaaaaagggaagactagtgaactataagttcaatgacagctttctttttttgttttacaataatgttggtgataaaaatggataaaaaattaatagaccctttaaaactaggaatgaatttaaaaaaatatattaagaaaataggatataaagtcaaagatatccaaaattatttatgtttagaatgtcctcaaccaatttatcgttggtttaaaggaagtacatatccctcaattcatcatttatatgcattaagttgtttgtttggggtaagtatgaatgaattggttgaagaaagtgatgaaagaaaagaatggggaaatcgtatttatcaaataaaagagggaaaactaatcttagaaaagcaagaaattttgtaagcatatttcttgcttattttctagtattcaagtacgatatagataccccataggggtgggaggtatagtgatgaaaaagaaatatgatgtcattggcatgacatgtagtgcttgttcagcccatgtagataaagcagtaagagggttggatggtgttgatgatgttaatgtcaatttattacagaactcaatgactgttgaatttaatgaaaataaaataaatgaaaatcagatttttgaagcggttgataaagcgggttataaagctcaaaatattggtgaaaaacaggtttcaaatgttcaagaagatgaaaatgaacataaaaagaagaatttgattttatcatttattttcttgattcctttattttatatcagtatgggacatatgatgaattggcctttaccaagtattctcttaggtcatgaaaatatgatgttctttgttttagttcaattatgtttagttgttcctattatgtttattaatagaggttattatattagaggatttaagactttatggaatagaagtccaaatatggattctttgattgccttaggttcttcagctgcttttatttatagtttatatgctacttttatgatggcttattatttaggtagaatggacatggatatgacccatcattatatgatgcaactttactttgaatctgcaggtatgattttaacattaatttctttaggtaaatatttagaatcacgttctaaacaaaagacttcagaagcgattgaaaaattgatgaagctgatgccttcaacagctatcgtgttaaaagatggcaaagaagttgaagtggccattgaagatgttcaaatgggtgatgttgtgattgttaaaccaggtaacaatattcctttggatggaaaaatcattcaaggacatggttcaatcaatgaagcgatgattactggagaaagcttaccagttgataaaacagttggagatcaagttattggttcaaccaataacttagatggttatatgcaagtagaagtcagtcatacttcaaatgatacaactctttctaaaatcattcgtttagtagaagaagcaggggcttctaaagcaccaattgcgaaacttgccgataagatcagtggtgtctttgtgccaaccgttattacgattgcaatcattactttcattttatggttgacacttggaaataaagatttccattttgctttaaactgtgcaatttctgttcttgttatttcttgtccatgtgctttagggcttgccactcctacagcaattatggttggaacaggaaaaggggctaatttaggtattttagtaaaatcagcccaacatttagaacagctttctaaatgtgatacaattgttttagataaaacagggacacttacagaaggtaaacctcaagtgactgaagtttatccaataaatataggtgaaaatgatttattgaaatatgcaggttcaattgaacaatattctaagcatcctttagctaaagcaatttatacttatgtaagtgatcaaggtttatcaattaatactttagatcattttgaaatgaaacaaggattaggtcttgtaggttctttcagtggagaagttcttttatcgggaaataaaagattgatggaagaatatgatgttgatttatcttcgattgatgatttatataaagaattatcgtcgaaaggaaagacaccattattttatagttatgctggtaaactgatcggtttaattgttgtaagtgatgtcttaaaacaaacaagtaaacatgcaattgattgtttaaaagatatgcatatgaatatctatatgttaactggggataatcaattaactgccaatgcaatagcaagcgaattaggaattgaagcgattggggaagttttaccacaagataaagaaaaacatgtaagagaattacaagaaaaaggacatcgtgtcatcatggtaggtgatggtattaacgatgcacctgctcttgtaagaagtgatgttggtatcgcaatgacttctggtattgatattgcgattgaatcagcagatattgtattaatgaaaaatgatttacaagatgttgttgttgcttatgaactttcaaaagcaacgattaaaaatattaaagaaaacttattctgggcatttttctataatgtaataggaattcctatcgctgccggtgttttctatccattctttggtttattattagatccaatgtttggggcagcagcgatgtcgttaagttctgtctttgtagtttcaaatgctttaagacttagattttttaaaccacaacatcaaataattcaaataaaggaaaataggaaaaaggaagaaaagaaaatgaaaaaggtattagtagaaggaatgatgtgtcaacattgtaaggcacacgtagaaaaagcgttaaatgaaattgatggtgttcatgcaacagttgatttagaaaacaattgtgcttttgtagaaggtgaagtggatgaagcatcattaaaacaagcaattgaagaagctggatatacttataaaggaattgaataagtatgatggctgataaaaaacagatcacaagacttttaaaaacagcaagaggacaaatagatggtattttaaaaatggtagaagaagatcgctattgtattgatatttctcatcaaatcatggcaagtgaagctattttaaaaagagctaataaagaagtcttaaaagcccacatgacccattgtgttcatgatgctgtaaatagtgaagattgtgatcaaaaaatagaagaaatgattaaagtcttagataatttattgaaataagaaatcttgaaaaaggtttctttttttatgtaaaaaagcataataccgtcttatataagccggtattatatcttttgatattgtaaactacaagtataaagtaatggggttgctattaaaggaagtaattttaaagataataaaagttgtattaaatattttaatgcttgtttgtttgataaaatcaattaaagtgaaagagagtctaaataaaacaatcacttaaaataacacaactgttttgttaccttataaataatgttagaaaatgtaagaattattaaaaatatccattgtttgtatcgaatagaaaaataaaagtgtataattaaactaataagtagttaggaggaaaaatcatgagtagatatgtattaggattagatattggaattacttctgtagggtatggtgtaatagatgttgataatgatttatttgtggattatggggtaagactttttaaagaaggaactgctgcagaaaatgaaacacgaagaactaaaagaggatctagacgtctaaaaagaagaaaatcaaatcgtttaaatgatatgaaaaatcttttaaagaaaaatgatctttattttgataattatcgaaactacaatccatatgaaatgagagttaaagggttaaacgaaaaactatcttctaaagaactgtgtactgccattatgcacataacaaaatcaagaggaacaactttagaagtacttgctgatgaaagtcaagatgatgaaggaacaaaagcaacgctttcaaaaaatgcaaaagaattaagcaatggaaaatatgtttgtgaagttcaattagatagattaaacaataatcatagaataagaggcgcagaaaataatttcaaaacagaagattatgtaaaagaactcaaagaaatattaaaacatcaagatttaaatgaagaattatgtaatcaaattattgaaatagtttcaagaagaagacgttatgatcaaggtccaggtagtgaaaaatcacctactccttatggaagttatcgtctggtagatggtgttttaaaacatgttaatttaattgatgaaatgcggggaagatgcagtgtttatccaaatgaatttagagcaccaaaacaatcctatacagctgagttatttaatttattgaatgatttaaataatctaacgattaaaggtgaaaaaataacagttgaagaaaagaaaaaggttatcgcagttgttaatgaaaaaggaaatattacagttaaacaattacttaaattattagatgctcaagaagatgaagttacaggatttagaattgataaaaatgataaaccattaattacagaatttaagggttatagtaaagttttaaaagtctttaaaaaatataaccaacaagaattactagaagataaattgattgttgatcaagttattgacatatgtacaaaatcaaaaggtattgatgaaagaaaaaaagatattaaagaattatatcctgaatttgataatgagttaattgaagaattagcttcaattaaaggtgtttctgcttatcattcattatcttttaaagcaatgcatatgatcaataaagaaatgcttacaacagaaatgaatcaaatacaagttcttcatgaaatagaaatgtttgataaaaatagaaaatcattaaagggtaagaaaaatattgaacctgatgaagaagctattctatctccagttgctaaaagagcgcatcgagaaacatttaaagtcattaatgcgttaagaaaacaatatggcgaatttgatagtattgttattgaaatgacaagggataaaaattcaaaagaacaagtaaagagaataaatgataatcaaaaaagatttaagaacgaaaatgatcaagttgatgaaattattaaaaatgcaggtattgatccagaaagagttaatggaaaaactaaaactaaggtacgtctttatttacaacaatattgtaagacagcctatacgcaacaagatattgatttacatacattgatttttgatgataaagcatatgaaatcgatcatattattccgatatctatttcattagacgattcactttcaaataaggtactagcatctcgtttagaaaaccaacaaaaaggtaatcttacaccaatgatggcttatttaaagggaaaatttacggatggtaatttagaaagatataaattatttgtaaatagtaataagaattttaatcataagaaaagaagtaatttacttgatgaacaagatattacaaaagaagatgtggcaagaaagtttatcaatcgtaatttggtagatacaagttatgcgtgtcgtacagtattaaatactttacaacattattttaaagataatgaaatagatacgaaagttcatacaattagaggacaatcaacgaatatttttagaaaacgaataaatttacaaaaagatagagaacaagattatttccatcatgctattgatgctttaattgttgcttcgttaaagaaaatgaatatcgttaattcatatttgatgcattatgactatagtgatttatatgatgaagaaacaggggaagtatttgatgttttacctgataaacaatttattgatcaaagatatatttcatttatttctgatttgaaaaatatctatcaagaatcgaatcaatataatttaggttacattacacaagaacaaatgcattatccacttatcaaagtgtcacataaaatagatactaaacctaatagacaaattgcagatgaaacaatttatagtacaagaaatattgaaggacaagatatgttagttgaaaaaattaaaaatatctatgatcctaaagaaaagaaggcaatagaacttgttaataatattattaatgatgatactgataagtatattatgaagcataaagatcctcaaacttttgaaaaaataaaagaagtggtattaaatcattttaatgattataaagattcaaaagaatattatgtaattgataaaaaaggtaagtattctttaaaagaagaaagtcctttaacatcgtattataatgaaaatggagctattactaaatattctaagaaaaataatggaccagcaattacatcaatgaaattctactctgaaaaactagggaatcatttagcaattacaagtaattataatgcaaataataaaaaggtaattttaaaacaaataagcccatatcgaacagacttttatttatctcctgaaggaaaatataaatttgttacaattagatataaagatgttttctataaagaaacaattcataaatttgtcatagatgaaaattggtatcatgaagaaaaaactaaaaaaggaatccaagatggttggaaatttgtatgttcaatgcatcgagatgaactgattggacttatcaaacctgagggtaaaaagtttgtttatgatgcttcaattaatggtggtcaaacacaatatcatgatggtaaacattatgaaatcttaaagtttacagcgacgaacaatgataaggctaatatgtttgaagtaaaaccaattaacactaactgctcaaaacgattaatgccatctgtaggaacttttatcaaaattcaaaaatttgctacggatgttttaggaaatatgtatgaagttaaagataatagattgaaattagagttcgattagtctataatataggtggttgtattctagcaaaaatttatatgacctaacaaaacaagggtttatcccggactcggctcttcggagcctttttcttttataaaaatgagtcataggatcatatatattgaaaaatgtgaatgtttgaaattatatttagataatattaaagttatttacaatgataatgatattctactaccaatttcagacattcaaatattagttatagataattataaatcaagtttaagtatacccttaattaataaattaacagaaaataatgtatgtacagttgtatgtggaatagatcatattcctaaaagttacatacttccaatgaatggtcatttttcacaaagtggaaatattaataaacaaatagaatgggataataatagaaaacaaatcatgcatcaaaaaatagtaagggctaaaatacataatcaagcagaaatattaaaagtaaataataaaagtcaagatgtaataaataaactatatcaatttgaaaatgaggttcaaattgatgatgttacaaatagagaaggtctagctgcaaaaatgtattttagagaattatttggtgatgattttatacgatttgatgaagatgtaatcaatgctggattaaattatggatatagtatctttagatcattaatatcttctattattgtagctaaaggttatttacctaatttaggtatttttcatcgaggtaaacaaaatatgtttaatttaagtgatgatgtaatagaagtattcagaccaattgtagatcattatgtttataataatatgatggaagatattttatttaaacaagaacatagagaagcgttaatacaacttacagctaagaaaatagaaatcgatggaagaaaacaaacggttaataatgctatttatgtttatttagaaagtattttaaaagaattagaaacaagtaaagatgtctatttatttcctaaaccaattttatatgatttatgaatttatgagattggtattattttttgacctccccatgaaaacaaaaaaagaagtaaaaatatatacacattttagaaaatatcttataaagaatggatatatgatgatgcagttttctgtttattgtaagatttttccaaatagagaagctgcagttaaacatgtaaatatattaaaaaagaatgttcctaaagaaggacaaattagattattgttggttacagaaaagcaatattctaaaatagaaattattgttggtggggtctcgaatcaagaaaaaacagtaaatgcggattcttttataaaattatgaatctattaacattaaaaaaaggaaataaaagatatgacttacaaataaataatataaaatattgtataggaaatgattttgaagaaaaatataattttgtaaatattttaaaagaagtatttttattatctaaagaaagcgaatattcgataaataatagtggacaagcacaagttttgataaatgataaagaaataaaagtaaaagaaataagtttctatcaaataaaccatcattattcaatcacaaatgatctaaaactaacagcacattctctaattgctagatatatagaattacttatagcacaagatgataacatagacacaatcaatacaataaatcttctattagaatcttttacaaatgaattagataatgaattaatatatccaaaatttataacatatacacctaaacaattcttaaaaatattgttaccaatatttttaaaagaagaagatcaagcaaatgaatatgatctatcctatgatgaaatcattttatttcaacttaaaatgatagattatatatctaaacatcaaacaactaaaataatttgtcttatagaattaccatatctatcaaaagaaataaatgactatctcataaatatgaaaaattgctttattgttgttatgttttataaaacaaacagtgttttaaatataaaagatacttatatatttgatgatttaatagtagatttaaataatgatgaacaaatatataatatctatttaaataaaggtgtatgcacactacaggaggcaaaagaaatgataataaataatataaaagctaaacttgatatatctataactctataaaatattcaatattttattatttttaaatatatggtaacatgtatttgaggttttgttaccatatgattttttgctagaataagactctaaataactagcatctcttaaggttggagttttgttaccatatgattttttgctagaataagactcatgggttcaatattctatgctattttctgttttgttaccatatgattttttgctagaataagactcttgataatatggtattgggctgaaggacgttttgttaccatatgattttttgctagaataagacaaagatacacaccagtattttatggcgacggttttgttaccatatgattttttgctagaataagactaggcggtcgcaagtccgcgtaaatagtgagttttgttaccatatgattttttgctagaataagacagtcatgtcattaactgattttggattgtggttttgttaccatatgattttttgctagaataagacatgacgatgcaaggttcgaaaaatcgttcagttttgttaccatatgattttttgctagaataagactgtcatattgatattaatacttgatttaccgttttgttaccatatgattttttgctagaataagacatttgatagaagaagttgagctaaaagatggttttgttaccatatgattttttgctagaataagacaagaaaagaatgcttctcaacaggcagtaagttttgttaccatatgattttttgctagaataagacgaagtagtgcccaagaagaatcgttatgtcgttttgttaccatatgattttttgctagaataagactaaatattaaagatgaaacttgttccatctgttttgttaccatatgtgttttttgatagatttaatttaaatgtaaaaaaagagatttctcaaggatgctattttgaaatctctttttgcttataaaaatatttacataaaataaaaaaacaacccgaaggttgttgcttattaaatggcgtccacgaagggattcgaacccctgaccgcacgcttagaaggcgtgtgttttattttttgaaatatttaaataatcaaataaataagcattttctttttctttaatagaaaagaaataatacagcatcgacatattaagtgtcttactaaatcttcgcggtcttgtacaaaagacaacttgttcatttaatacatctataattagatttgttttatctacataatatgcatttttatcaatcatttctttaaagttttctattcctgcaggtattagcttcatataatcaactcatttctttatttacatattatatgtgatataaaccctgatttatattggattatttgtccaataaaaaagaagtctcatcaagaaacttctttttactattattattcatcaccaaatgaaataccaattgctttagctgctttaacaagttcaccatttggatcaacatgtttttgttgaccaaccttagcagcaccaattacttcttctaatgaagtatatcccatcttatcaccattaattgtaacaacattaccaaatttaccttcattaataagttcaactgcagccacaccataacgaatagataaaatacgatcatatgctgtaatatctccaccacgaataatatgtcctggattaactgaacgtacttcatgatttggaattactttttcaagatcatcagctactttagcagcaagtcctgaatatcgtactggatctggactatcttctacgattttaccaatgacttttgttccgtctgcatatttagctccttcagcaacagcaacaacagtataaggtaatcccatttcatcacgttttttaattgctttagcaatattttcaattgtaaatggaatttcaggtattaaacatacaccagcatttcctgcaagacctgcatataatgtaatccatccagcgtctctgcccattaattcacaacaaataacacgatgatgtgatttagcagttgtttgtaaacgatcaatgaattcagttcctactgacatggctgatataaagccatatgtaacatctgtacttgctaaatcattatccattgttttaggtacaccaataacattgacaccttttcttgaaaaatcacgtgcacttgtaagcgttccatctccacctaaaataactaaaacatcaacaccatcttttttcaaattttcaacagccacatcagaaacatctttctttacttttccaccatgaccatcatctactaaataatcaaataaattatctttattagaactatataaaatagttcctccttctttataaatatcttctaccgattcttcagtaagttctacataattattatggtataaacctctatagccataaacaaatccaatcacttcataaccatatttagagattgcagttttagtaattgtacgaataacagcgtttaaccctggacaatcacctccaccagataataatgcaatttttttgacagtacttcccataattttcttcctccatactatataattataaattcacctagaggaaaaaacaatacttttttgtaagcgtttacagttattttattatttgctttgtttttgcatcatttggtagataccttctaaagaaataacttgttgaacagatttaatatttgctctttcttctactgtatttccataatcaacttccatcaaaacacctgaagcataagttgccatttcactattcaaaaacactataggaccagccatttcttttgaatatgctaaacgattagcatatccacaatgtgataatagtccttcttcaccatgcgccatttctgtaaattcacttttcatacctgtatctgtcgatccaggtaatacagcattcactctgattttcttactagcaaaagatttttgtaaatatgctgtataatagttcattgctaatttagaataaggatagcctaacgtacctggtaaatattggaatccggttttcataatcgcctctactgttgcattccaacctgatgctaaaatagcatctatataatattttttattttcttccttttcccaaccatttccaccagttgaagtcataaatgcaattgtaccattttcactcatagcatgaataagatattcttcacaaatatatttattagcaataaaatctatactgaccgttgtcataaaatcatttttcatacctgatactcctgcaattccaaaatatgaatctatatggctaggcaactctttcatcgcttgatcgatagattctttctttgataaatctacatgtacatattgttttattccttttacatcacattcattccaatcaagtgcatatactttcgcacctaaatctactaacatttctgctgttgcctttcccattcctgaacttgctcctgttacaacaacatttttgttttgataaccaaaataatctttcatttaatcattcctccttaacttcattatatttttttgtagattttctacaaataaatatgaacatatttagacattatgtaaggattatgttataaaaaagataggtgatatcatgaataaatcaattaagacaaaaaaacaagtatcaaaaacacttattaaactattaaattataaaccgcttgatttaattacaataaaagaacttacagaaaaagcaaatattagtcgaacagctttttataacaactttcatacattagaggatgttcttaaatatatttaccaaaacgctcataaacaagtcttcaaagacaaatattctcatcttagttatgtctatagtgatgaacatattaaagatatgattcacttttttgataaaaacagtaaattactccttgttcttataaaatggaatcttatagaatttattgcaaaatataataccgaaatcgtgcttagttatactcaacactataaaaataaattcatacgtgaacatgctttttattttataagttattatcatggttcattgttcaatatttgtacctattggattgcaagtggtaaacaagaatcttcagatacactctttaaaatgattaaagaattcgaaaaaataaaatttgtatataatcaaaaaggataatccatatacaattacatatatggatttctttcttattgaataggtaattcataagtagcttttgttcctgaataatccaattctacaatcaacttaatcttagaactttgttgctttaaaccaaaagcctcttccccttcactttttgtccttataggtgctgtttggggataagtatttatagaagctggataagtttcacaaacatttccaccttcatcaataactttaaagttaatacttgaaaaataaatatcatcttcatttgctatattttcataagaataatgtatgataatgacttgttctggttgactatctgcaaattcattacgatcatctgtatttcttactgaatcaactgtaaaatgaatcaaatctttactatttttagtatatgttacagtttcacctatcgtatatattttttcttctttcttttcttctgtttttgtaggtttatttgtatctttttcttcactacttccacatgcgcctaatgtaagtgttacaaacaaaactaaaattatcttgattattttcttcattgttgtactcctttattttgtttaaaaattgaaataattgctagaacagcatttattaaacaccatcctgcccaaatatttaaatcactaaaacttccagcaagtcctatacctaaaaaacttgctagtaaaaataaaataacaactgcaatatttcctccatttttttgactatttcttacagcaattgaaacaatttctcctgctaacataaaaatagagacaaaaacaccagcacttcctcctacttctccatttgacgaaagtgtatttgcagttccaacaagcattgattgaaaaaagacaatcacactaaaaataattgataaaattcctgctactaatttccaaattttcatatttccccttcctttcttttttgtctattccttttctaatacctcatataaaatacataattcatgaatacctaattctaaatcatttaaaatcgtaaatatttgtgattcaacttgattaaactcttctctttcatttaatacatccaaatgatcttttatccccttaaacaatgatgctaaataaagaatcttcccagctatatctttactttggtattcttctatatccatacataacctccttatcttagaaatagactacatctataatgtatcttataagacataaaaaaaggtgccccctcggggcacaatcaaagatacattaaaagagttccaataataagagagataaataataaaataagccaagaaataatcgttgttaaaacttttacagcaatcccatgatttttataataaggtaaatagtccctaacagataaatagtttgtagaaaataaaagtgttataataaaccaagaaattaaaatcaagcgataaacaaaatactgatactgacttattggttgattttcaatcttaaaacttattaaaatccatataaataaaagataactcataatcgctacaatcatcttccaaagcttaccacttctaaatcccggtaaagctttaggatgtttgattttcttttttttctttttttcaatatgaaataattgatctaaatctttaataatttcttttacatcttgatatctaccttgaggatcaatagcaatcatcttatcaattattctcttttctattccttgtaagtcataatctctaggcaacttattagtaagtaaaacatgatataaaactcctaaagaataaatatcacttcttatatctgtttgataaaaaccaaattgttcaggagctgcataaccttgacttcctaacaccgtagtatctctttttgattttcaatataatttctagctatatcaaaatcaaaaagatagacttgttttccatcataaaagatattttcgggtttaatatcacgatgaataatttgtggatcttgttgatgcaatacatctaaaataatacataattgtcttataatttgataagcttctaaatttgaaaaagtatgttcatctaaaatatcagataatgtttgacaagctaaatattcttcgatgatttctaaaccgtcttcattttcttctattgaataaatatgtggtattccttccatatctaattgctttaacttttcccaaattgttttattatatgttttcaattctttttttatataaatatttcttttatctaattctcttactaatttgacactccccatgtctaaagacaggagattcttgctacctgccaacattgttttaatttcattgatactcataatattcatcctctctttcctaagacacctgtagcataatcttttttaatttttcagaaaagagaaatgtatacaattttaatttcattaacaaaatatataaaatgtaagagctttatttgttaatgagatttacaatagccaaaagaaattcttgaagcaataaagcaaataaacgctaaaaataaataaacataaagcatagcctgcttggaaaaaactcattgccctggcaagtcctgaaaaaagattttcaatcaaaaaaacaatgccattattgaaaataattctaaataaagaaacacatcctgaagataaagctggtataagcataatcattttatgtttatttttataatcttccaataatcctaccgataaacgtaaaaccgtttgtgatatcccataagttcctataataattccaataaatgactccccttcgctacattgatgttatgttacatcaatatcattcactactatgagagtgtctgactcctcatgatgtacctatcacttcgaattacacttatagataagtaccttgatatacaccaagtagtcataaggtctgacagggtcatcgctatttccttaatatcatgccaacagacttcacaatagaaggcctatgttatcgtctagttcattgataacacagtaaatagacttccacatttatcgcaatgttgtcacacattctactgcatatccttcacacaccgccttacgttgatgcattagattagacttttcgaatagcactagtgcgcacgatgtaggactttcacctacaggatttttacattccatgaagcatttcaagttaatagagccctatcttgaataagcatttataagtagaaaatgtcatgcccctgttgacataacatataagcgactgcctgtcgcacgaaaagacaacccatttaattaggttgtctttcagtgcgagattttctcaatcatcctattaattttgagatttaattaaagattcatatacagttcctttacaatcttctaaggctctatttttatattccttgctttttgattcattacccatatttttgtagataactgataataagaattcgagatagggagtatctgcattgtttttagtatattctacatcttctagatcagattttaattcatcataatacttaattccaccactaattaaagtatcattgaccatatccatctgtctatatagggcatgatcatttgtagtgctaaccatttccaacaaacgatcaatcatagatgcattcttcttatctacatatatatagaatactgattttgcgagagcagacttctgcttagaattcataggaacatggtccattatattgtttacttgagtatctatttgtttgttatcatttacttttagataagcatttaaaagtaaatattccctattaaatagaggaatacatatcttagctagttgagttgctattaagtcttctattgccttaatatcatttttttggagtaatgtaagatatatttttagaaatttctttctaatgatcactggaataattccaataacagcaatcactataacagcaactaacatagcattcatacttttatgcccctttctcaatcaactttataatatcatttaattcatcaataattatatctgcctggctttgatccaagccaaacttatcatcttttaaagccaataccttaataccagctctatttgcagctaatattcctttagatgaatcctcaataataatagcttcatctttattcacattcaattctttgattgtatataaatatatttctggatttggtttactttctttgaattgttcaccacttactataagtgagaaatactttcttaaaccagcctgatccaatgcattattaatagtatataacctagaagaggacgctaatgctattttataatgtttacttaagtgttctaaaacggaatagatctgaggtctaactaccgctttataatcacgatcaagtgaccgaaaatattcttgaagcatatttttaaatgtcatgaaatcagtttttccattccacattgtgtatgcttgttcataatataatttactatcaataccaataagaggaatacaatcatttacttgtatttctatatcatgctgtttaaaaaatcttatcaaatcatttatatacatggtttcactatcaaagatcacaccatccatatcaaaaataacagtttttatcataattataaacacgagcaggcattatataatgccttgctcgttattcattttagtagtctaagcacttgtaatatcttctgatatctaatggatgacgtctgttgtgttctagatgaacattaagtctcatgaatgctgatctcattacgattggagataagatacctctgaattcatctctgataccaggtaattcaaagttcttagtatcgatagttgtaacatttgcacaaatttttccaacaaagttttcaacacgatccatttctggtctagtcttatcttcacccttgattaataatactgtagtatctctttcgataacttctaataaaccatggaagaagttagctgctgagatagggcgagtgcgcatccactgcatttcttccataatacacataccataacaatgagcccagtcttcaaggttacctgaagctactaagtatgtaagtggtgagtcacagtatttatctgcatattctttcatctgagcatctgcatctttatatacctgaacgatatcttttggtaagttctgcatatcagatactaattcatcatacttatcgaactgtccagcattcttcatgaatcttaagacaactgtataccaccagtaatattctccacctactgttgtgactaattcatcaactttgtttgcgattggagtatcaactacttctacataaccaataactctagcacctacttcatgtgctttatcaatagcctgttctacttctactgtatggccagataatgaagcaacaactactactgaatcctttgtaaagtttgcatcaccttcatacaagaagtctgtagcattagttaaatataatggtaaagagcatcctaactgtctagctgtatggaaaatctgtcctgcatataatagtgttccaccaataccaactaagaagatattcttatatccatcttcacaaattttatctactaccttttctacctgaggaatcatatttaccccatttaaatgatctgcataaactttcttttcatcaaaattaaacataaaattttctccttttttatttataaatatttttttaagctgctaagattccaaattgtgcacagataataccaaagatagctgtaccaacaatcataagaatgacatttgtctttttttgcaacaacttataatagattccagttgctgctaatggtaacaatcctggcataataccatctaatacactttgaatctgtgtagctgacttaccactaccaatttttaatgctgttttagctacaacaagttcgtttgtcataccaccaatgaccataacccctagaattgcagctgctaacatgaatttttccatcaaaccagaagcctgaactttttctaaatagttggctcctaattcatatcctttaattgcacatacataacgtaagatgaaagtaggaatattgaaaattaagaagaataggattggtccaagaatattacccttaacagcaagagatgtaccaataccaactgctaatacacgaagtgtccctaagataagtgaatcaccaataccacttaaaggacccattaacgcagcttttactgcattgatagatgatgcatcaaaatcatcatttgctctattaatttcttccatagctagtgtgataccaccaatgaaaggtgagacatgagcagtacagttaaagaattccaagtttctatgtaatgcttcttttaatccttcaggatcatctttataaatctttttaagagctggacctatcatgaattcaaatcccatatgcatctgtctttcataatgccatgagaattccattggtaatgatctccagaacattctaactaaatctttttttgtaataacgccaccgttttcagcattgattggtgtatctgctttagaagtcatcatcatcatcctcctctactacagctgttgctaattgtgtttttttagttgtgaaatcaattgttgtaaaaataataataagacctaagagtgcgataccaactactggtaatttgaaatatgctgataatacaaatcctaagaagaagaatggtacgaccttcttattcatgatcatctgagctaacatagcaaacccaatacctggtaataaacctgttgcgatagttaatccgttagtaataacagctggaatagcttctacaaatttcttcattgcatctgatccaactgagaatccaaggaataccattaaaaatagtactgtacatgttaagaaccctgtagccatatgaatgacacttaccatgtgtacattacctttttcagcatagttatcagcaactttaccaagcaatggtctaactaatgagaagaagatattatcaattgctactgcgagtaaagcaattggaaacgccattgtaaatgcaactgcaggtcccttacctgtaacaatcgcaaatgctgttcctaatacaccaccaacaataacgtttggtggaataaatgcaccaactgaataagaacctaagaatgcaagttcaagcgttgcaccgatcttaattcctgcatcaagatcacctaacaccaaccctaccagcgggcctaaaataataggtctctgtaattggtttgtacctgtagctaaatcacatttccccaagaatgcaatacagcctagtaaaaatgccttcaatatcataatatttttcctcctttatagaacgtttttagctaacatctttttatctgctggaaccattcgaatttcaacttcgtcccctctttcgataagttcctttactaatgaaatttcttcatcagtcagattcactgctttagaaatattttttgtttcatttgtagcctttgttccaccaagtgttacagaatgaatatctgcttttgtcatcaattcgtaagcatcttttacgttctcaacaataacaaataacttgtatttatctgttactcctgaatttaatgctttgattgaatcttcaatattcttaataactaattttgtccctgctggctttgccattttaatagctgtttttctaagattatcattagtaactgctgtatttgcaatcaagatacaatcagcccctaatgcacttgtccaagaaaatgctacctgaccatgcaataaacgatgatcaactcttaacccaactaacataaatccaccttccttttttttagaaatcttcgtcttctgtattaacgacgacattatctttattttttaattgaattccttcttttccttcttttaaggcattatcaatatcaatacatccgctactgtttttaataactaactctaaaactatattcatgttcattcctgaaataatttctacattacccatatccagcaactgaatcatagtgttataaacgctaccacctttgatatcacataaaattatgaatttttctgaagaagcactgattctttctcttaattcagttacatattcgttaggattgcgtcctggtaataaactatatgtttctacatcagcagctaattctccaacaatcatttttactgaatcaagcattcctgcagataatcctccatgtgatgcaagtatgatttttgccataatttacactcctttctactcatcttagttcaagcaagcttcgtgccagtttatagattagttacgcttaatctgtacaactagcttccacttatacgagcaatcaaaacagtagctcaaacagcagttgcgttaattggaacgtctacagtcatgaatgaagtcaattgggcaatgattattagtgcaagttgtttatctggtgttgtttcaattctaacaagtgtcgcaggacttccagagttggaagaaattgaaagtgagtaattatgtatgaatttctaataaaaacttatacgattgttcttccagttattctttcgtatattgtgtggcttttacaagaacaaaagaaaaaagcaaaacaagatgcgattgtaagagatgaaagaattaaaaaagaaagagaaatgcgagaagctaactcaaaaggtacaatgcttttattaagggtgaaattgattgaatatcatgaaaagtatatgaagaggggttcaatccctacatatgcatatgataatttcaatgaaatgtatgatgcataccatgcgctcggtggtaatggtatggttaccaaaatgaaaaatgagatagagcttctgcatttacaaagcaaagagggtagttaaatactctctttttattttaaaaaaggaggtattaacatatatgggatatgttatgaaacaaaatttagcgcgtaaagaaaattatggtagtgaacgtagcacagctgatattaaatatttagtcattcactatacttcaaatgatggtgatagcgatgaatcaaatggaaaatactttgctagggaagttgttaaagcatctgctcattatttcgtagatgacaatagtgttactcaatctgtaccggacaattatgctgcttatgcagttggtggtaaatgtcaatcagctcaccatccatattatggcacaattaaaaatgctaactcaatctctatcgaaatgtgtgataaccataaagatggtactgttcatatttgcgatgaaacacttgctaatacttatgcgttagcacgtgcattgatgaaaaaatacaatattgatattgatcacgttgtacgtcattacgatgtcaatggtaaattatgcccaaactgtaatggtttactaaatgataacgtatggcaaacattcaagaataacattgttaactctacaactggtgcactaggcacaggcactgtagttccagctgctgctaaaaatgataacttagacagtttgattgcaagaggtcaacaacattcaatcaactttacaggtcattcaattgcaactgatggtgcatatggtcctaagactcgagcaaatattgctagatgcttccaacacgctattaatttggactatggcaaaaacaatgaaggcttagcttcagcaaatgaagaaggctggattgatgaagattcaatgataatacatttcaatgataaattcaaggtgaacaagagagagtgttcatcgaaattgcaaaaagaacttggagaaattataaaattttgtaaagaaaacaatgaacctgtttatcttgaatttaatgataaagagaatttaattattatgagtagtgagacatatgatcgcagagaaaaaatgttagagttatatgaacaacttgtttatattgaatcagagagaattataaataataaacaatatacaattgatgagttaagtaaatatcttgataatgttataaaagatatgactgttaaaaaataagaaaaaggaatagtaggttaaagtgaaaaatacaacaaaagcaggaatgtttaatattaacaaggcttatgttcgagatgctattttatattatacgattcaacaatactttaataataatgataaaaagacatgtgaatatataaatcaattagaaaaaatagatcattttaattttagaagtggattaaaaaatattattccctatttgtcatcaaaattaagtatttcagaaaaagagttttataactgttatttgagagtaaaagatagctttgcaaaattaacagatgatgtcattttagtaaaaaaaggagatggaatatattcaaagctattagctgacatacaagggacacctccatttctatttctaaaaggaaatgttcatctattaaatgaaaagtctgtatgtgttgttggaagcagaaatgctacaatagattcaatgaagaagacagaaaaaattgtaaagtcacttatcaaaagaaatcttgttgttaatgcagtactggctaaaggaatcgatacagttactcataaatcagctttacaaaatggtggaagaacaattgcagttataggaactccaattaaccaatactatccaaaagaaaataaagaattgcaattagctattgaagaaaaaggattagtggtttcacaatttccgccatgtaatccagtttatagatggaattttccaacaagaaatgggacaatgagtggaatctcattagcaacgattatcatggaagcaggggaaacaagcggtgctttaaaacaagcagattatgctctaaaacaaggaagagatgttttaataccacaattagctctcaataattcttctctatcatggccaaagaaatacattaaaaaaggggcacattcttttaaaaatttaaaagaggttttagaaatattaaataaagcgaaagtgttctataaattattgaataacgatgagataaatgcaataagaagcacagaaatataaaatattgaaattattagtgtatattgcaatgaaaagataaaattatatactaaaacagccaatcaaaaatgttgaacaaatatagaaaatcattaaataagttcaacaaacaactacgatgaaatattcaggtaataaaattatatattttataaaaaagccaataacaatcatgaatcatttgatttcttacggaacaggaatgattgttctaatagtgcttgttttatttattggagtattttctgcgttgtcagatgattccagtgcagtcatcagaatgtggatttaattaaaaatatccaagagtgcataatggaataacagatgctgattattccattaaggtaggaatacaacattatatggtagaaaaaccagcagtagagaaagcaccaagtcaactagcagtcttagggagatatgtattgacacctgaaatctttgaattgttagaaacacaaggaaaaggagcaggaggagaaatccaattaacagatgctattaaaagattattagatagacaagcagtctatgcgtatgattttgaaggaaagagatatgatgtaggagataagttcggatttatcaaagcaacaatagatttttcattagacagagaagatttacatgatcaagtaagtaaacatattcaagatattgtcaataataagtagtgataggaaggtaatttaaattggatatatatcaaactgttatttctcattatcctcattggagtaaaatagaattaattgctgtagttatagtaatgattataagctttattattttagatagattttataaaaaagataaaataaataaaatacaaatgtttttttgtattttatttattatctatttattacatgtttttggatctactgttttttctagattaccaagtaaaagaatatgtaagttagaagtattttggtcatggaaagaaatattaaattcaatgaatacgacatatccaaagtatgaattgttcttggaaaatatattaaatgttattatgcttttacctttaggtatctttttaccattagtatatggtaaaaagatagattggaaggtaggtttattgatgggtttttgtatttccttttctattgaattgatgcaattggttttatgtagaggaatgtttgatgttgatgatattattcataatagtttggtttttttaataggaatagtgattattaacaaagtattattaatgaataaaataagctagcagccttaaatttagaggctgcttttttgctatttgatctaaattttatgtttacattatttgtatcttgtacaataataagatacaaataatgactaacaaccaaggttggtagaaaggaaaaagtatattgtataaatatacagtatattagtagttaaaacattggatatatttcaaaccattatttcttattatcctaaatgaagtaaaatagaattaataactataattattgtaatgattatcagttttatcatattagaaagatattataaaaagaataagataactaaaacacaaatgtgttttagtatcttatttattatttatcttttacatgtttatggatcaacagtattttctagattaccaagtactagaaaatatcaactagaagtattttggtcatggaaagagattattcatcctatagggagattgggaactgcttctagatatgatttgttattggaaaatatattaaatattgttatgcttttaccaattggaatctttttaccattagcatatggtaaaaaaatagattggaagattggattattaataggtattggtatttctttttctattgagttattacaattagtcttatgcagaggtttatttgagtttgatgatattattcataatagtttaggttttttaataggtatattgataagtaatagaatattaagaaaaagttgtaaataaaagtaaatatatgtcgttcacgcacgaaaagtagccgttcgtgaacgaaaacagtaaatagataacacaagttgtataattaatatgtgttatctatttattttgtatagaaatgtaagcggtaacgcaattaaagaagggggtgtttgtgtggaaaatttattaggtaaaataactttatatgattttgtagcaatgattattccagggttgttagttacattatcatatgtaagtatttatgcaaaagaattttaccatttttataaagatattggtaattcttttgtttcaggaattttaattttggtagtgagttattgtgttgggtggattgtttctgaaattggaaatattatatttagtaataaaaataaatctacgaaggatgttaatacaaatatacagccagatttgttagaaaagtataaagaagctttagaaacatatttagaaaatactgttaatatgaatgatatagaaaaatacggggatatggctaatgcacttattcaaagtgattctaaatattcgagaattcataattacaattctagtaaatctttttcaaagaacttaggaagtgcatgtttatttattgtttttgctatgattattcatattattatatgtttagtttatttatgcaataaaattaaaataccatattacttatttgtgaaaatatcagcgtgtataattttaattattttttgtgtttttggttataaagtgatgaagaaaagatttcaatcttttagttctaaagtaaatatttacatttgtacatattttatagattatgttaagcatatggaaatagaaaattctaacgaagaaaataaatgtataaataatgtagcagtagaaataaatcacagtaataaggaagagaggaaatgaaattatgaatcaagatgaagaaagacatattggagttcatcatggggctagggaacttgaaaataatgtattgttacaaagtataccgggattaaaagacttgtatacaacgttagatcaatttagaagcgtagcatataattataataatcctaattatcttaataaagaaaaagatgtaaaaaatggtagagagaagttcaataataatatctctattttagcgaatagaggtatgggtaaatcatcggcgttacttacaattatcagggaaattacgaatggtcggttatttgttaaagaaaattatagtgaaaataatatagatattattaatcctatgattgatccagaagatattcaatctgatattttaggttgggttatagcttctttatcacaaagaattgatgatatggaaaatatgttaaagaaaaatagcaagcttttattctctttagaacaatcaccaaatgatttattaaaagaattaaaagaaaagaaaaataaactcatttcttgttattcaattagtggtgaagaatataatcatgttgtattacatagaagtgtcaatataaatgattattcaagaaatttaaatgatacattgactaatgactacgaattacatccagcctttgaagaatttattgattgtttggtagatactaaaagacagataaatagagcttttgataataaaccatatgaagtagatcaagaaccattaatttattttttctttgatgacttagatatgtcatcaaagaaatctataaaaatattaacggatattttatcttatttttatcatcaaaatatcgtaatttttatatctggtgattatgaagtatttgaaaatagtatcaaaacatactttttaaatgaaacaaaagacattactttgaaaatgccagatgaagaaaaatccaatgaaataactttagcaggaaatagagcagagtatttcttaaagaaagtattaccaccagcatatcgatattatatttatgaattttttgataataaacaaaaggctgaattacattattttgaagttaaaaatgatgtaatagaaagtctaaatatatttcaattattaagttatatattttataatgggtttcataatcaaaatgtaaattctatactaaaaatgtttatattaccgaatatttcactgagagaagttgaaagaaatgattctaaaaaatttgatgattatgatccaagaaaaaacaaatttactgataaatcgaaaaaaatcaccattgaagaagattattatgatttcaaaaatccagccagtttaatagataataattacaaaacaaattatttgtatgcttatttatcagtttttagtgtcaatacaagagggtttatgaatgcttataattacatgtgtaaagaggcatatactattaagaaatgtagacttaatgttagacaatattggacaagtgataaattaagtgaatttatacaaattataatcaattcaaagcatacctacttaaaatatgaaaaagaaatcaatagatttttatcaataaaacttggaaattatgatgatgttgataaagaggcagagtatacgaggttaagaattgattgtgaagaattacaaatttttattgatagattattatctgatttgaagtctaaattaaatgaatataatgatacatctcttgaaaaggaagaaattaaatcaataattatgttaccaatcttaattaatgaattattttatattattcatggaagtttgtatcaagaacgttatgagagtgttcaaaataaactaaagaatattttaactaaaacgtttattaattcattgaatgataaaataatagtattgcctactgaattgggaatgagaagaacattatgcttatttcaacaaattagcacaagaatgtcattagaatcattaattgcattgaatacaacttatgacgtaaattattcaaatccaaataacaaaaagtatattgttcaattatatttatctacattattattaggaaatagtggagcaagtataaatgaagaaaataataatatgctgtttaattataatgactataatttatataaagaatccatgtatcaaaatgaagaagaaaggcaacgtattgaaaataagatatcaatatacatgaacagtatatttagacatttagacagagagtggttatttgataaaattaaaatggctatttcgttggaaagagatattagtaaagttgaacaaagtgtgcgaaataattttttacagttggcgtcaaatacaaatattaagaatatgtatgaaaaattggatgatttatatattcaaatttgtataaataggaatagaaatgaatattatttattagatggctttaagcaacctatttggataagtaattaccttgatgatttgtttaaaacaattgaatatcaacatgaaagcgatataaaggttgaaaattatagttttcttcaattgaatagaataagggacaagttagtaaaagaatttaatacatatgaggaaaatacaaaacgtgatctttatttacaaatatttaatgaaattgttacaagattaactaatagtaaaaaagcttatgaaattggaaaagtatttaagaataataaaaagaatgagtataatcagcaacttattgaaaattcaaaaagattggtaaatttattagatgattttaaaattgaatttgaaatattaatgagcaggctaaatagtatttatgttgaagaattagattttgatgatattttagaaaatcaattatttaattattatgacgaagaaatatatgatttagcggatgaaactcttgaaacaatattaaatgagcattcatttgatattatgattgactgtttgggtagaaatagatccttgttggaagaagatttgaatagtttgattagacatatttatacggaattaaatcgttcgacagtttttgatcatggagcatgcattgaggaaataattaaaaacttattaagagcaacaagaagacaaagacgattagtaccacatgaaacaaaaataattgaagtgattattgaagaaaatatgaatagttactatatatataattttattcttgaagcttgtcgagtatatttaaataaggatacaagattttttcattcatttaaaacaggtatagaatatggaaatgaagagtaattatttgtctaatagtcatgaaaattatattagaatgctaattttatttataccatatttggattatagtttcttttttgacgatgagatagaaaaagaggtgttgaaagcaaaaataatccatgcattacaaagatatgggggatacagtaatctagatatagttgatagtttaattgacttttattatcctgaagagatatatacactcaatgatttttacataaaaatgtttgaaatttctaaaacattattaacctatcatgataatagattatgcattgatatgtttgaatcttatgatgataaatcttttgtatctttgtttaataataaggtgttagattatttagaaataagtaaactaatttctaatagtttgttaatggctttttataatgtttactatgactatgatttagagtattgtatccaaagaaatttgattaaaccaatttctgttgttaatcatcaattagatcttgttttatcaaaaggaattgctgaaacgcatacacatgttgtaggaagtattccttttgaaagacaatggaattggttggctcatgaaatatacgatggtaatgttgatgcagaaagattattgaattctattgaaaaaaataaaggtgtactatttcaaaaaaataaatatggttataaaaatagtttagtgcatttgattaaacatgcattaactataaggctaataatggtaatctatttgactaaattagaagaaggatattcattggttacttttgaagaattttttaaagaaattggaaacaaatattttaatagaaaggacattaatattctgtataggttaataagctcaatagaaaataaaaaaagttatgaagaatttaattttaaaaacattgattatgttttagatgtaataaaattaaatttttatagtaatattgatttacaaaaggaacacattaattatgaatttaatgatgaagataatgtagattcattttctaaacgattgtataaaggcttattgaaaaataattgttgtgaaaatgaatgtgatttaaatgaacatattgaatatgtttttcaacatttatcaataaaacatattaaaaatagtgatgatactctatttaagcgagtatttatgtattattgcagggttaaaaatttcatacactcatttattacacaatctacagatattaaaggatttttggaatttcaaagtttcttcagaagacaaggaacattatttgatataccttcgcatatgtttactaatatatttaaaacgtatttatatgagaatgtaagatttttagaaataagaataggtcatgttaaatttaaaaattcttctgaaaaaaatggactcaatcttatttatggtcaagaaaatgaattaagagaaatcttttacaggacaatcttaaattttgtattatcttataaaaaatatttacaaggaataagtgatgtatataaaagagaaattcctcaagtaggattaattttacattttaataaacggtatgatttaattgataaatgttggcaagaattttataaactagatgatgattctttaataagatataaagaatatcaaaaagaatgttttcttaatttaataatttttcaaagcattagggatgaaatcccttatattgaagattacttgataggaattgatactgcaagtaatgagcttttaacagagccatgggtatttgctcctatttttagaagtgtaaaaagtaagtattcggaaacattgaaaaataaagctttaaaatatggtataaagctgaagttaagaaaaaatataggaattacttatcacgttggagaggtattttattcttttattagtggattaagacatatagatgaagtaatagaatattttggatttcaaaatggtgaaagattagggcatgcaacagttttaggaatttcaatcgatgattatatagctagtcataatattgttactttaccagcaattgaattattggataactggttatggttgcatcatttaaaatctaaatataatttattttctgatatttccatttcttattttgaagaaaaaatttgggatattgttcattttatttatgatgatcaaaatggaaatttaatagggaatataacaattcatcatttatttaagtcatatcaaaaacagtttgatgatttagatttattaaaagatataagagaagggtgtcattgttcatctgttttttgcagtaataattgtatatttaataaacatgaacagttggatgaaaatatgcttttattatcaagacattgtaattattttttaaataaaatgctaagaaaaataatgataaatgttaatgacccaattattataaatatttatagagagattcaacaattcttgattgaaaaaattgcgcgtaaaggtattattgttgaaacaaatccagtttcaaatgtgaatattggtgaaatacatggaatggcatcacatccgatattaatgttaaacaattcctataataatgattataatagagtaatggtcagcgttaatactgatgatccaggtgtgttttcaacgactttaagtaatcaatatggttatatattagagatttttaaacaacaaggtgttccgatggaaaaggcattgttatggattgatcaagttagaaacaatggcttaaattctacatttataaataaaaacttaaaatctaaagaacaaattattaaagagttaaatattattgaaaatgagataaagaaaaaattatgagcactttacgtgtgctctaaaggggaagcgtcagaaaaaatagtgaataaatcattataaaaattatagtagttttagaaaactaaaattactatatcaagtatctttaggtactcagaagactatattagtgattcgagtatctaattttactatatgattatgattagagtgtcaatgattaaaattttaaataactaccaataaagatttacaaattctaatataggtaaaatgtattatataggtaaaatgtattaaagattatgtgattttaataaggtttaggaaaagcatgcgttttatttttcaaaaataagtatagaatcatttggttatgaaagatgaatgttttgattatttattttgtaaggaggagaatagatgggttataaagatgtaaaaaagattgttaataaattgataaaaaatgaagatcatgtaatgtctgaattagaaaaaatgtccaatagtgaaataataaacttaaaggcaaatattagaggaaaaatagttcattgcgataagtggatgacaattttgatacctattattgcaatagtaatttctattgttggtatattatatagtaataagcagaatgtgttatgttttgttttatatgcgtatcttatattgtctatatttattgcttttttgcatatgcttagtcaaatgaataaagaaaattatacaaaaattttaagttatattgaagattttgaaaaattaacaaaaaaaaacaataatactgatttgacaacaggtaaaattataaatcgaaaaactaacaaaagagtagataagacgatgcaaaatacaaatggaaattcaaagaatcacaaaagtaatttttttagtcaaaaagaaaataaatttattttgttaatgattgttgtattaactattgggtttatatgtgataaaatgaaaatttattttgtttgtcttgatgatattagttctttatcacttactatcatacaaattcaaacaacaattggcattttgattattacggttatatctcttatatctggtaatatggaagaaagccattatggtatatctatctgtcattattacttaaacgttaaacctcaaaaattaaattttaaaagaataatatttattgtgttagggttatctttgattagtgtaatttcctatgcatttcaattgtattcatttattttgtgcatatttatagttacgataattagtgtattgattgccgttaccaatatatattcagcatttagtggaagaatagatcagtatgatgaaattgaagattatttagaaaaacaaattgaattgtcaaatgattcattagaaaaactatttattcatttttgtgatgattggaagaggaacattttaagccaagatgaattaagctataaaaaatcgtgtaatttttttgaaaagtttattactgaaatttggaaaagaaaagattatcatgaaattgaaatattacaaaatcaatcaattgagatatgtttatcttgtttaaatacatataatccaataattcagtataggggaatggacttgatatacaaaatttattctatttctaaagatgaagttgtaaataatttaaattttaattttcaaaatataaagtttcatttatttagagaagttggtgaagaacttatagaagtactaaatggaattgataatcgttgtatagaacgaggtgattttgatttatatgatttcttttattatattcttgttttttgtgttagaatgaacgaattaaataatgattcattggaatataattctgaaattcgtattttaaagtttttagcaaaatctataggaggatatatacatgttcaaaggttaaatcgtcacattatcgatgaaccttattggattaatttttttgaaataagagaaacatttactactgctgaattagatgaaacaaagatggacctatatagtaaaaatttattagagatttattttgcgtatttctatggattaatcatgaattgtgaagaaaacatgattataaagagcatttttaatagatgtttagatcaacatatacgttttgaaaatatatatcaaattgtattctttttatctatatatgcttatttatattatttaggatatgaggaaagtatttgctatgaagaaataaagaaatgtgcacaacaaatattaaaaaatagtgatgtaaaacaagaatatgaaaatttattagaaatgctatataaaattttttataattcaaaaataaagagtgatgatatttataatttgttaaaagaattattacaacactatgagttatacaattcatatcaaccgttcaagtattcaatcatggaaagtgctcccttaagattttatatttttgtaattacatcaatagcagataaattatgggatgaaaatattgttttagaatggataacaatggatgaagcattgggatacttgtctagagaaaaagcaccataccttaaaaaaacttttcaaataacatatgatgctttgtttaatgacgaagaaaggaatgaagatatcggagataagtattatgatttgtttgcaaacccattaaagaaaagagaaaaaaataaaaaaatggaagaagtaaataaaatagatgattcttttgaccaagaaaaagtgaaaaaagaaatagaaaaaaacattaaagatgttttaaataaagaatttagaaatatagcttatgataatgacaaaagtggttttgaaattgacttggttgataatgatattgatacaaaagacattacaggagatattttatctgaatttgaaattaaaaaactatttattggagaaattgttaattatttaaaacagtataattatttggaagaaaaaagtagaaaagaagaaatccttgataacacaggattgatagaatatttaaagaatatgaaatatgattttatatttgggagaaaatcaactataaacccaataaagtatcaaaatagggcagagctagataattatacaaaagataattgtacttgttttgattattatgaaaagaatacttttgttgccttaaatagtcaaaatattaagatcattatccatagcattgatgtacaaattcaaccaactaaattaaagaaaaaaagtttctatgatgaagaaaatgatatttatatttatcctgatggcattgaccttgaatttacaaaagaaaatttagaagaatatttattgaaaaagaaaaaaaatttaaagattattgcgaacatttcaattgaatgtacaaaagaaaaaattggaacaatttttaattctggtaaataaagtgggaaaattgttataaatggcaaatcattttattgttagaaaccaagggaaaaggagcaagaggagaaatccgattaacggatgcaattagttttatgtagaggaatgtttgatgttgttgatattattcataatagtttaggctttttaataggaatatcgataagtaatagaatattaagaaaaggttgtaaataaaagtaaatatatgttgttcatgtacgaaaagtagccgttcgtgaacgaaaacagtaaacagataacacaagttgtataataataggtgttatctatttattttatataggaatgaaaggtaaaataaagaatatactaaagaagattttattaatttagtaactgattgtttaaatcctttttatattccttatgaagtatatgaagataatggaaattattttattttttcaaaggtgctgaagaattggataaagaacttgtttctaaagtacttttatggttagaggaatatcaaaaatcttataaggtatttttgaaagttattaaatcttattttaaattgacagatgaaaatgctagtgtagttgctgatttatttagaaaagtgttaaaaacatttttttagaaatttttttgcttcaacaaaattattagaaaatttgaaaatggtaaatatatgaaaacaaaggaaataaaaaatgagatatatagaaaaaatatttaagcagtattcatttatatatagtgttagtgataaaatttatattatgggattatacgtttgttaaagaactgataaaaataagtatggagatattgaaagagcgtacagttactataaagatgatttaaatgaaaaattatcacaatatgaagccaataaaatatttagaagagttttaaatgtttctaaaagaatacaacaagaaattgaaacgaatgcatatgctgaaatcatatttaaaatttaatctattaatcattctattttattgattagaatatgagatattcattatatatgtgatatataaacaagaaaggattaggggttatgatatggaagaacttataaataagaatattattgcatcatcgcacattaattttttatttggtgcaggtgtaaatggaaaagcgtttccacaattaaatggttttgagaaatctgtaaacaaaatggaggaaatactatctaagaaaatcgaaaattttgaagatagtattaatgaaatgaaaaaagaggacattgatgttgtttatgatatttttacaaatgaatttaagaattatgaaaacgaattagactatacaaatatatcattgataaatctaaaaaaaatgttaaatacaatttataagatagttgaaaatgcagaaaatagacaaagagatatgaaacaaattaatatttatacattaaattatgataatatagttgaaaatatattgaattctgagggatatatgaataattcggtttcagctagtactttgggagaaaatataaattttttggatttagttgcgtacgattatacaacatataaatatgttccaacttttatgatatcaaaattacatggagatattgaaagaccgatatatccaggccttgataagtataaaacatcgttggcttcagaatattttgaaataaactttaggatgaaagagcaattgtgtaaatttaatagtgtactgtttgttatagggtattcctgtaatgatgaacatattaataaaattcttcttgattgtataaaacatgggttggtaatctactggtttaaatttggattaaacgataaagttttggaaaattgtccagaaaatcaattaattatagttgatcaaaaagattataataatccaatagatagtacgagaatatgtgcagaatatttggagaaattaaatggataaagatattggaagaattgtagaagtcagaggaataaatgttaaagcaaaattatttcgactattaccaccatatttaattaataatggaatagtagtatctgcacctaaaataaattcatttgtaaaaacgaaggttggattagatacaataatttgtcaagtaaatggtgaatacaatgtagaaaaagaagataaagcgacagattattatattgatttaacggtaaaaggttatattgatcatggaaagtttattcaaggattaagaatgttacccattgtctcatccaacttatcacttttaaataatgacgattatgcaattatatatgattttgataaagaccattctttttttattggaaaagatttatttgaaataaataaagatatttatttgaattttaataatttgatgccaactcatattggtatttttggaaatactggtagtggtaaaagtaacacattagcaaatgtttattcacactatataaaagaattaaacgggtatgtttcaagtaatgcgacagttttattatttgatttaaataatgaatatggaaataattctatttgcaacaaacaacataaagtaatttataatttaactacaagaaagcaatcaagtaagcgaattccatttagttttgaaaatattacagaagatgagatgagtattctattaaatgcttctataaaaacacaaattcccacgataaagcatgcatttaaaagtctcaaagaggaacatgaagaagaatattatttgaagtatgtgaaaaatactataagaaataatcaaaaggatttattttttgctattcgttttcgattgaatgaatatattaaaaatataaataatatcaattggcatagtaatgcattaaatttttattatagtaaagatgatggaactcgtatttttaataatagcagtgattttgattctatagtgttaaataatattcaaatcaatctgccagctgaaccattagatagatttaaatttgaattgtgtttttctattataagagaatgtgaacatggtgtgaattctgagtttttattaccacttttaactagagcggaaaagatatttaatgatttaaagaaagtttttgattttgaagataattcagatatttttgaaaataaaaacttagcaattatacaattaggaaatgtcaataatgatatgacgatgattgttcctagcttaatttcaagtgtaatatttcgaagacaattggagaaaaagcaaggtgaagaaataaagtcaataattaatattgttttagatgaagcacataatattttatataaagaagatgatttagcagtacataataatttgttagagaaatttgaaaaaattgtaaaagaaggtcgtaaatttggagtgtttttaacagtttctagccaacgaccaagtgatatttctagtacaattctttcccaattacataattattttatacataaattagttaatcctaatgatttaaatcaaattagaaaagccgtcgcatttttagatgaaaatgcattgaattttttaacaatattagcgccaggtgaatgtatattatctggaacttccctaagtatgccgatttttatacaaattgaagaactagataatgaaacaaagccaaatagtaataatgttattttatttggtcgagatggaataatcaaataacaaatattgttttcattcttatatatgatagaaatataaactaatagaaagataattttttaaattgaattgaaatcacaaaaacaataaaggattgtattcattttaaatgaaaatatattttattttaattttatatgaaaaatatttataagttacaaataaatatggagggaaaatatggctaatataagatttaaaaatttaccatcattattaaatgatatgaaaaagaaaaagtggattattgattcgttcttttttcagtataaagatgaaaaatatattgttattttaaaattatataaagatcataaaagaaagccttcaaagtatgcaaaggcagaagttgaatttattagaagaactaatgaaaatgaatcaattacaggatatattgatttttatgaagtacatttttataatatggatcaattttgtgatttttttggcgtagagaaaggtaatggtattagaaatttatttattgatttttcaaatatattttcaaattatatcccattagaaaaaacaattgaaaaatcaaaacaagagagacatcttataggataaagagcagaaggaaataatcctaatgcgatatattgttttggtgtaagaagaaatggctcaaatgaagatgggacattgaatgtgagaagtattgaaaatagcaataaggcacaaatattaaggcctagtttatatgaaaagtatgctgatgatacaaatttaagttttttcttttctgataatccagatgatgaaagaaatgatttagaaatatttgaaatcatcgctaaaagaaagtagtgtcaatattatatttaataaaaaaatacaaaaattaataaaattgtatagttgtagaagtgtaagatattttaagtattcataaattatatttttaaggagaaaatttattaggtatgttaaaaatgctagttgattatatttttaataataatttaaacatagacaaaacaacatttctaactattataataggccaaattacaatatatggaatattattaacattttttcagtttgttgtttcatatcaagaaaataaaagagaagttactcaatatttaggaagaaatcttactagttattttataaagaagaatatatttcttattgataatttattatataaaaattactttaaaataattgtggtattagaagttttatataagccatttattacaatattttatagaattctcccaataaaattaattagttttatgaattttatttggtttgtatttgcaatcgtatattttttaatatttatagttatattttttcaatgtgctaaatgtatattaggtataaatatgatttcagataaagaagtaattaaacttttaatcaatgacattaatagaaaagtattaaagaaaatttcaaaaaataaaaataactctaaaaaaatagacatactacatcaaaattttgtagtattaggcagatatataaaattggatcataattatgaattacaagaagaatataatgaattgattattgagattcttaataattacatagaacaaaaagattacgaaatttctgaaatcgaaaaaaaaggaaaagtttcaaaaaatcaaatagcatggttatataatgcaatcttattaccagatggtggagatcgttatttatcaacacctttaattcaagattagggaaattattttccctttttttaaaaggaggatatagggatgaaaaattttcaattcaagatacaacaagaagtattagatttaggggtaaaaataaaaggtgtaagaatacatggtattaataatactgtgtatttttcatctttaaatgattatattgatgttcatgttaaacgtcttttagaaaataatacacttgatacgttaaaagaaaatcaaattattaaaggtttttatgatttacataaagaagtaggaattcctaaaagaaagaatttacctgcaagtgaaaatctattaaagaatttattaaaaaaacaaggatttcataaaattaacccattagtagatatctataatctaatttcaatggatactaaacttgcattaggggcgcatgatttagcaaaaactgaaggaaatattagtttaaagttaacaacagggaatgaaaactatattcctttaggtagcgaagaagcaaaagttgttaaagcaggtatttatagttatatagatgatgctaatgatattatttgttttagtgaaataagacaagttgataaaactaaagtcacaaatgaaagtgaagatatcttttttatagttcaaggaaataaggaaacatctgataagtatgtagaagaagtagctaaagaattgattacagttgtaacttattatttaagaggagtaggagaaattatttaagacattttagagcatattctaaaatgtttttttattttatgaaaaaaatcaaaataaaagggttaacatgataaaataatcaagtcttatccaattttacttaaatatgtcgaactcgacatattttttgttgttatttaatgaaagcgctattataatagtaaaagggaattggggagatgtcaatgaatcaagaatatcaagttcttgttgtgttagatttgttggtgacacaaatgaacaaatttgcaagtagaaaactaaaaccttatggaatcaagtttaatgaattgaatattattcgttttattgaaaaggcggatggtccggtttatcaaaaaacaatttgtcaagaatttcagctttctcattcaacagtagtgggaattgtttttcgcttagatgatttaggttatcttttaattggtaatagtcgtgtggataaaagacatacgaatgttacaattacagaaaagggaaaacaattgattcaagagacagaagatatctatcaagaaatcataagaaagatgaaagtgattatttctgatgaagaaatgaacacaattattcaatctgttgatcaaatcaaagaattatttaaataggaggttattatgggaacatttaggttttcaatgagaatgcttgttaaagactataaaaagagtcttttttatgggattacgttaatatttgcggttgccgtatgttttgtttttttcaatattattaataatccagatttagctgatcaagcgattgctagaagtggtggtacatggaatgatgtacaaatgcctttttcttcagttttgtcatttttaattatttgtttttgttgttttatgattttcttcgcaaataatttctttttatcaagaaagacaacagaacttgctattatggctatgtctggttcagggtacattaattcaacgatgtatgttttatatcaaacatttactttgttgattcttgctacgcctttaggaattttaattgggagatgtgtggttcctttttcaaatgattacatgtatcaaatgttaagcgtttctaaagatccatccattataccaagtgaagcttatctttattcctttatcttagttgccattgttttatcaatgatttgtgttttaacggcaggctttttacataaaaatgatattcaaactcttttaagtcaagaaaaagaaatgaaagttaaaaaaaatacaaaaaaaagtgtttcacttactttttttggaatctatatttttggaattgttatgatgtttatgaatccccatgaaccaactgcttatattgcaccaacgcttgtagggttatcgggggcagtaggggtgattcgatatgtattaccagatattgtaaggaatttaaaaagagaaatttttcttacaaaaagatatattcttatttcaatttctaatttaaattattcaattcaaagatcacttcttttattttctttaatgacggtagctgttacaggaatgcttgccattcttgcttctaatattcattcaccacgtgaatttacgacaggagttattggttatgtggtcgttattgttttactagttgtttcgattatttataagttatcgatggaagctatgactagaaaaacacttttcttgaatttatggaaaatcggttataccaaaaaagaacttaataaaatagtacgacaagaagttattagttattattttgttttgattttaattccgcttgtttatattgtttttatatcaggacgttttatttattatggagatatgtcacttcaatttgcatttatctatgttttatcttatgttataccaattattatttcaggatttattacttatgttcaatatatcaatgcagtagttaaaccaatcaaaggaggaaaataaaatggaaagaaaagaaatacttgttgctgataaaattacaaaaatttatggaattggaacaaaaacactttatgaagctttacatgaagtttcactaacaatgtatgaaggtgaatttgtgtgtattatgggaccttctggggctggtaaatcgaccttcattaataacctttcaactattgatattcctacaaaaggaaaagtctttattaatggtaaagaagtacgtgttatgtcagaaggggaaattggtaagtttagatatgaaaatttaggttttattttccaagaatttaaccttttagatagtttaactatttttgaaaatatcgctgtaccactaactcttgcaaatgtggataaaaaagaaattaccaaaagagtcgaagaagttgctaaaaaacttgatgtagcgcaaactcttgataaatatcctaatgaatgttcaggtggtcaaagacaaagagtagctatttgtcgtgctttagttactagtcctaaattgattgttgctgatgaaccaactggaaatcttgatagtaaaaactctcatgaaattctttctttatttaaagaacttaatgaaaaagaaggtgtctctattttaatggtaacacatgatagtaagattgcttcttattcttctaaactattatatattaaagatggcattattgatcgtacgattgaaagagaaggattatctcaaaaagaatatttttataaaatagttgatattaattcaagtgaatcacaagagttgtttgaataatgggtatcattaaacttgcatttgtttctttaaagaaagatttgtcaaaaagtatcttttactttttgacctttcttcttacaactatttttatattctctttttttaatcttacgtttaatccttattcaggcattcatttgggaaaagatgatacaacctttgtgacgcccattgcagtctttgttattgttattgctatgctttgtgtttttctcgcaaataacttttatgtttctaataaaggaaaagaaatttcgattattttgatgtcaggagcaagtatttatcaattaggtttctacttatttttacaagtttttacaatcatgctttgtgcgattcctttaggtcttgttttaggttatttactcattccaacaatcaattcattatttatgatgacttttaaatatagcggacagcttttctatttatcaagccaaacttttccagcaacatttatgattcttgcttttgaagttatgtggtgttctatgttgaatttaggttattgtgtaagaagtacgattaattctatgattcatgataaaaataaaatagatttaagtggtttaaaaggtccacaaattacgagtaaagtttttattattctttattttgtgccaatggttttattcttatttgtgaaagattcaacttcttatatgtttatagctttatttggtttaataggaatatcagggcttattaaaaaagtattaccagaatatattcgaaaaagacaaagaaataattcattagagaattcagaagatttaatttcattaggattttttcatagtgatattcaaaaaatctttggattattgctgatttcgttgctttcctctgttttacttacttgtattatcgtttatacaataaaacaaccacttgtttcaatggttgctttaatgtcttatgtttcagtgatgattttaatgtcattgacgattgtttttaaaataggaatggagctttctaaaagaaaaggtaattttgaaaatctttgtcgtttaggtttttctcttgaacaattaaaaagaatcataaaaaaagaaatgatttgtttctatggtgttattcttttacttccattatcctatcaaatcattatcttatgtaatttacttctaagagctaaaattacgttttatttatttttaattatcttaattatacaaattgttcctttgtttataagctatttattaagtatcaaactttataaaggcattttaccaacttcaatcattatggaaaaataattatttaaagaatcttttaaaaaaggattcttttttctttacttcaaaaggattacaaggagagtcggtctttaaatcataaaatgtgacttcttggtttgtggtttcaaatacacaataagtaggatgagggtactgaccgcgaggaaaagtcatacttcctggattgataaaaattgtgttttcttttttataataagttggattatgtgtatgaccaaaacaaacgacatctagatgatgattggaagcatacgcttcaagttcataaggggattcatcaatgtggaaaagatgtccatgacaaataaagaatttcaaatgatcaatatccagtgttagatcttttggtaaatcaacaaaatcattatttcctcgaacattatagaagtgatctacttctaaaggagtataaggcatatagatatcaccacagtgaatataataagatgctggatgatttttaataaattgtaatagggtttgtttggtcatagaatgactatcggataaaatcataattttcataaataacctccttaaatatgctataattattttatcataaaataagaaagtgaggtattttatgtcagcatttatacaatttaaagatgtgaaaaaaacttataaagtaggagatgttgagattcatgccagtaatggtgtcaattttgaagttaataaaggtgaatttgtggttattgttggaccgagtggagcaggtaaaacaacgatcttaaatctactaggaggaatggaccaacctacaagtggttcgattatggttgatggtcaagatgttgcgcgttatgatgaagcaaaacttacgcaatatcgaagagatgatattggttttgtgtttcaattttataatcttgtgcaaaacttaacagctttagaaaatgttgaacttgcttcacaaatatctaaagatcctttagatgaaaaaatggttttaaaaagggtagaactagaaaatcgtatgaataactttcctgcgcaattatcaggtggagaacaacaacgtgtagcaattgctagagcgattgcgaaaaatcctaaattgcttttatgtgatgaaccaacgggagctttagattatttaacagggaaagctattttagctttgcttagagaaatgtgtgataagtataaaatgacagttattgtgattactcataatagtgctttagccccaatggcagatcgtgtgattcatttaaaaaatggaaaggttgatcgaatgtttttaaatgaacatcctcaacctattcaagaaattgagtggtaataatgaaaagaaatgcttatgtaaaaaatcaaataagaattattaaaaaaacaaaagcacgatttttatctattttttgtattgtttttttaggagcttcattttttgcaggacttcgacaaagtcctttgattatgaaagaatcaatgcacgattatttacaaacatataaatggaatgatttgaactatattgcaacatatggttttgatgaatctattattcaaaaagttgaaaaagtaaaaggagtagaagctgttgattatggttttcgctttgatgctttaatgtcatatgatgaaaaagcaaatatcgggatgacagtttatagtgatgatgatttttcaaagggggtagatctacctgaattattaaagggaagataccctcaaaaagataatgaatgtttgatggattatcagtatataaaaaaatcatctttgaaattaaataatcaaattactttagaaaatgattatggtaaaaaagaatataaaattgtaggaatcattaatgatagtcgttatgtaagtgatttagaaagaggtacaaacagtttaggtgatgggaataatagtgggtttattcttgttttaaatcaaggaaatgaacatatggctgttcctgatgaattgtttgatttacatgatcaaaagactttttataatgatttgcgtattcatttaaaaaatgaaaatcatttatatgaatttgatgatgattatgatgagtatgtaaaaccaatcaataaaaaaatcaaagcaattttaaaagattataatcttgatttttacaatcaaacaaaagaagatgctttgaataaaatagctgatggtgaaaaagagtatcaagatggtctaaaacaatatcaagagggaatggatgcttatcaaaatggtatgaatcaatatcttgatggtaaaaaacaatatgatcaaggatatcttcaatatcaacaaggcttaaaagaataccaaagtggtttaaaacaatatcaagctggtttaagtcaatatcaaacagggtatcaaaaataccaagaaggacttaaacaataccaagcaggttaccagacttatttagattatgtagaaaaagttgatcaatatgatacatctatccaaactgttgaagctgcgttaagtcaatttggtggttatgaacaagctaaaaatattccaagtgattcaccttattatcaacaagcacaaactttgattgcaagctatgatcaattaaaacaaaatgaatcacaaataaatactttaaaaacacaattacctgttattaaacaagaacttgatcaaaataaaacggttttagatcaaacaaatgctcaacttgtacaaagtaaacaacaattagatacctcaaatcaaaaaataaaggcttctaaagctcttttagatcaaacaggaatcaaacttgctgattctaaaaaacaattagacgaagctaaaaatactttagatagtaacttaccacaattagaagaagctaaagtaaaattagatcaagcacaaagtgatttaaatgaagctaaacaacaagcagctgatttacaaaaaggaaagatcattaccttaactaaaaatgaaagcgcagcaatcttaagttatagtggtaactgtgattcaatctcagctttatcaattctgttcccagtgctctttttcttagtagcagctcttgtttcaatgacaacaatgacaagaatggttgaagaactaagagtacaaaatggaacattaagagcgttgggctataagaaaaaagatgtgattatgcaatatttgatctatgcttttctagcaacattctttgctagtagtattggaattgtttttggaacatatttcttcccaagtattatttactatttatatcgtattatgatgtttgatataggagcaccaacacgtattatttttgaactggcaacatgtatacaaacatatattatttcagtcgtgattattttatttgtcacttttatggtctgttataaagaattacaagctgttccagcgcaaattttaagaccgaaagcgcctaagctagggaaaaggatattacttgaaagaattacttttatttggaagagattatcatttaatcaaaaggtaacaatgagaaatatctttagatataaaaagagattctttatgtctgttattggaatagcaggttgtacagcactgatcgttgttggttttggaatcaagtattctgtttctccactagcaagtgaacaatatggcaatatgtggatttatgatggtgttgtaaattataaagatgatttaacagcaacgacaaaaaaacaagcacaagatgattttaaagggcaatctcaagtgaaatcgacaatgggtatttacaataaaacaatcacgattgatcaacaaatggtaacagttgaaattccaagtgaaacaaaagattttgatcaatatattcatatgagtgattatcaaacaggcaagactttaaatcttaaagatgatggtgtttacatcaatgcaaaacttgctgaaatattagatttaaaagttggtaatcaacttacattatcattagataataaagattataaagtaaaaattgcaggtatttataagctttattttagacattatatttatatgtctccaaaatactatgaaaacttaaccaaagatgaagttcattataatagccaatattttaaattaaataaaaaagcaagtgaaaagaaacttacaaattattgtgatcatcatgaaaatattacttctattcaatatgtcagtggtatttcagaaggattctatagtcaaatggaaagtttagatagtgttgtctttattttaattgtttgtgcaggtgcacttgcgtttattgttttatataatctaacaaatattaatattcaagaaagaaaaagtgaaattgcaacgattaaggttttaggtttctatccaaaagaagtctatgattatgtctttagagaaaacattattctagcctttattggttcgattgttggacttggtcttggtaagattattcatgcttatttgattagaacggttgaagtagatatggcgatgtttattagaacagttaatatcagatgctatatgattgctattattttaacaatggcatttacattcttgattaatctttatatgcgaagagttcttaaaaaaatagacatggttgagtctttgaaaagcatagagtaatcataaatattatttaggattacgtaaaattaaggattttttcaaaaaaaattaaaaaaaactgaatcttctaaatcccttgctatggttgacattcaagggatttactacttgtatagacaggacaaagggtggatttttagttgattttacgttataatacgtttgtatttgttgaaaggaggagacgaatggagagaaatattaaggaaagagttagtcaatatgtagatgaaaacaaagtcaaagagaagttaactcagtttttccaagaaaaaattgtcaatagaaaagcgatgtttatacctattacaggtgttgcaacatttatgttagtaggatacgctgctgctgatacaaaagcaccagaaatcacatctgatcaaattgaggttccttatggagaaaaatttgatgttgatactgtagatgtaactgacaatcgtgatagcagagatgacattcaagtaagtgctgatctggcatcattaaatgttgaacaattaggagattataaggttactgtaacagctactgattcatttaataatgaaacaacaaaagaagttacagtaaaagtagtggatcaagaaggtccaaaatttgaaactttaggttcaaatgaaggttatgtagttgaagttcctgttaatggaagtagtgatttatcaagttatgtaaaagcatctgataatgtagatggtgatgtaacaccatttattgaagcagataaaactttagatacttctaaattagggacacaaacaattacattaaaagccacagatgtttcaggaaatgaaacagaaaaaacaattgattttgctgtgactgatgatgatgcaccagtagttacattgaaaaatggtgcagatgttacattaaattatgggtcagattttaatttatctgattatgtagatgttacagataactttgatggtgtcattcaacctcaagtagaaggaagcattgataaccataaagaagatggtgtacaaactttaacaattaaagcaactgattcatctggtaatgaatcttctgctcaattgaatgttgctgtaaaagatacagaagcaccaaaaatttctttatcaaaatcagaagtttctgtaaacgtaggagcaagtttagatttatctaactacttatcaagtgcaactgataataaagatggagatgtaaaaggaaaagtatcaattccttctgtaagtacttcaaaagctggttcttatacagctacttatacagtaagtgatgctgctggaaatcaaggtagtgcgtcattaactgtaaaagttaatgcggtacgtacttcttctaagaaaggttctgtagctactggtactacttctagaccaaattattacggaacatcagttgtaggtgctgcctattcaagacttgggtgcccttacgtatggggtgctgaaggaccaaatacatttgactgctctggtctagtaaaatggtgttatgctaaagctggtaaatctttaccacattcatcaagtgcgatgaaatcatctggtactgtaatcagtatttcgagtgcacaacctggggatatcttatggagaccaggacatgtagcaatttatattggtggtaaccaatacattcatgctccacaaactggagatgttgtaaaagtttcatctggtgtaagtagctttacatgtgcaattagaccttaatattaaaaagtcgtggaaaaatcacggcttttttttactttaaaagaatatatttttaataatgaatgaaactaattattgattgtttgggtataataaaattgaaaaaaggttgataaattctacaaatttgcatttttaaataaaatgtgttataataataaacggttaaaaaattcaaaaggagaacattatgaaaacagacatacagaccaagctcaaaacattgtttgatgagaaaattaaaaacagaaaagcaatgtttattccaatcgctggggtagctgcatttatgttagtaggttatgctggtgtggatcatgaaaatcctgagattgtatcaagtcatattcaaattccttacggtgaaaagtttgatacggatgcaattgatgttgttgataatcatggtagtagaagtgagctgttagtagaagctgatgatgattccttagatgttaaacaattaggaacatatcaagttgaagtgcgtgcaacagatcagtttaataatactgatgttaaaacaattcaagtagatgttgttgacgaagaagcaccaaaattaaaaacgttaggtgcaaatgatggatattatattgaagtaccagtttatggtagtcaagatttatcttcatatattaaagcagtggataatgtagatggagatgtgacaccatttatcgaaagtgataaacaattagatacttcaaaacaaggaacacaaacaattaatgtttcagtaagtgataatagtggtaatacaactgaagaagcgtttaagttctttattgctgatatgcaagctccagaaattactttaaaatcaggaagtgatattacagtagattatggtagtgaatttaaatggcaagactatgtatcaattagtgataacttagatacaaatattcgacctaaagtagaaggaacaattgatactaaacaattaaatcaacaaaaagaaatgacaattattgctactgatggcgctggtaattcatcaaaagtaacattgaatgctactgttaaagatattactggaccaaatatcgttttatcaacaaataaagtatctgttgataaagaaagcaatgttgatttaaaatcatatattacatctgccgtagataacttagatggtgatatgaaagataagatttcattcaatacaattgatacttctacaacaggagtaaagacagtcacatatacaggtgtggatttagcaggtaataaatcagaagtacaattacaagtggaagtaacattctctggagaaagaattgttaatacaggtctttctaaaaaaggatgtccatatgtatggggatcaacaggccctaattcattcgattgttcaggatttacacaatgggtatatagacaaaatggtatttatattccaagaacttcatcagaacaaaaagctgctgctaaaaaagtagtaagtttatctgaacttgaagttggagatattttatggcattcaggacatgtaggaatttatattggaaatggacaatatgttcatgcaccacatacaggagatgttgttaaagtttcttctggtgtaggtaaatttacatgtggacttagatatcaataaaggtttcgatttgaaacctttttttttgcctttaaaaacgatataatatacctaaagagggtgatttttttgtatattgcaacaagtagtcaattaaaaagatatgatcaagcattgttggattatggctattcaattgagcaattagtagataaagccagtgattgtttattgaaacattttgataagtatcaacatattatgattgtttgtgggccagggaataatggcgctgatgggatttcattaggaattaaattacaccaagaaggtaaagaggtattactttgcttaacgggaaaagaagaaaaactcagccaagcaaatagatattatcttgatcaagcacaatctttatcgatagagtgtttatttgtaagtgaagaaacacttgaagaatttcaaaaaagtgttccacattttgatgtggtagttgatgcattatttggctttggacttaatagtgatttaagaggaattgttaaatatgttgttgatcttataaataatatagaggtagatgttattgcgatagatattcctacaggtttaaatcctgatacaggaaaaccttataatagctgtatttgtgcgtatcaaacaataacgttaacagcttataagcttgcttttttaaatccagagagtgaaatgtatacagggaaagtcattttagaattattagacgctaaatcttttcatgaagaaatgctattttcacaaccagttgattttaaatgggccaaatatcatataaaagaacgtttatatgatggacacaaaggaacttatggaagaattatgcatgtaacagggtgctatcattatcgaggagctgcacttttagcagctaaagcagctgtttatacaggaagtggattagttacggtttggtctaatgaaaaagtaattgatgcattaagtttgttttgtcctgaggcgacatcgtgtcaaagacagtattttgatgaacatttattacaaggaaaagaggcaattcttataggaagtggactaggtttaaatgatgatagtgaacgctttgtctgtgaacttttaagtcatacacaagttccagttgtgattgatggtgatgccttgaccattcttgcaaaacacccagaattattagaaaatcatcattcctcttggattttaacaccacatcatggagaatttaaaagatttgtgaattttaaccaaacaagtgaactggtggatcaagcgaatgcatttgcaaaaaaatatcatgttaccttagttttaaaaggtccacatactcttattagtgatggaaatgaaacatatcgtattatgtcaggaaataaaggaatgtcatctgcaggtatgggggatacacttgctggaattattagtagctttttaggacaaggttatttgccaaaagatgcggctattttaggaacgtatttacatggtttatgtggtgatgaagtctataaagaaaattatacggttgttacttcaaaagtaattgaccaaattcctcaaatgatgaaaaaaatgaaaaaagattgattacgaaacgtgttcgtttcgtaattttttttacctttttaaaaaataaaaagaaaaacatccaaaaattgtctatataatagtaggaaaaattatatggacaaagtactagaaatcacatcaaacgatcatattattatgattaataaactctgtaaaagaatattaggacatcctgaaatcttaggaagaatcattaatatgataaaattgagatagattatagaataaaggaagcgatacaaatgcatgacagatatatatcttctgatgaatcataccaagaatatctagatcgtttggataatgagatattacttcattctcatgatagaaagatttaggaagcaaataaaaaatttgaaaaagcaagtaatgaaatagatagtttgcttagtaaagcaaatgaaaatattattaattatattaaaatgcaatttcacgaagatatcagtaattttataagcaccctttctaaacaacaaattcttgatattcaagatcgtttatttgattatacaagtattgaagaattaaaaaagagcttaaaaaaacatcaataacaaaatattgatgtttttattttacttatctttccaaaaatcaaccggttcatattcttgtaactgtgcaagaaatccagctttttgaagttcttcttgaatttcatcaagaatctcttcactgtctgcatgaactgtatgataatgatatcctgatgtgacattttttagtaagcttgaatgtcctgtttgtagatttgtcatataatttttaatatctcttcttgaggcaatatttaatgttgcttttacaatattataaactttatgataaacaaagacatcttcaacataaccacctaagtcaacaattaaagaaagttctttttctacttcattatcatcatgatgtaccttaaaaatacgtttacaaactttttgtgtatttaaaacatatcctttatgtgttgaataaatatcataatcaccagcacgaagtaaagcaatgtcttgaacaatgacttgccgacttacttggagggttttcgctaaatatgttcctgatacaggttgtaaactgttttttaaaatatcaataatggcttgtcttcttttatttccatccataactcgccctccttaattgatattatatcacatgtaaattcttcaatgaaaggtctaatattggtgcagaatgtgttagagcaccacttgaaacataatctactcctaaatttgtaagtcttgcaatgttttcttttgtgacatttcctgaaacttcaatctcagcacgatgatcaatataagcaatagcttcttttaacatatcatcatccatattatctagcatgataatgtctgcacctgcttctactgcttctttgaccatttccatattttctacttcaatttcaatttttctaacaaatggtgcatattctttagcaagcataatggcttctttgactccaccagcagcaccaatatgattatcttttaataatacaccgtcacttaaattatatcgatgattatgtccaccaccaactcttactgcatatttttcaaaaatacgattatttggtgttgtcttacgagtatctaataaacgaatagaagaatcttttaaatattcttgaacattcgctgtataagtggcaattccactcattctttgtaaataatttaaagcaacacgttccccacttagtaaaacacggacatcgcctttaacacgtcctaaaagttgtcctttttctacgtgatctccatcactcgcaaagaattcaacatcacaagcttcatctaacaattcaaaagtgcgttcaaaaatttgtaagccacaaatgataccatcttctttacaaatcaaatcaacaactcctgttttagaaaaaggcatcacactattagtagaaacatcttcactagtaatatcttcttttaaagcactgataataagtggatctacattaagttttaatgttgtttgatcaaacatataatgatttctctcctttaaacttttttcaatacgtttagccgctcttttagcaaaaacaagactttctaataatgaattacttgcaagtctatttttaccatgaacgccattacaagctgtttccccaatagcatataaatgtttcatactggtatgactatcatagtctactttaataccacccatgaaataatgttgtgcaggtacaacaggaataggttctttaaaaacgtcatatcctttttctttacaatgttctacgatatgaggaaaatgactttcaatttcttctttaccaattggccttaaatcttcataaacataatctgtttgatccttttccatctgtttaaaaatagcttctgcgacaacatctcttggaagaagttcattaacaaaacgatttccatttttatctaaaagaatagccccttccccacgtacagattcagaaatcaaaaagcttctttcatgatctgttgtatataaagtcgttggatgaatttgtacataatctaaattcttaagttcaatttgatattttttagaaagttcaatggcatctcctgttaaatgaggataatttgtagaatgtttataaagtccgccaataccacctgtcgctaaaacgacttttttagcgtatactttttcttcttgattatttcttttaatgataccaccaagcgcaacatttcctcgaacaatcaaatcaacaaggggtgtattttctaaaagtgtcacgttctttttttgtcttactttttctaataaatgacgcgtaatttcttttcctgtaatatcttcatgataaagaatacgtttatgactatgagctccttctcgcgtaaatgcaagacttccatcttcatttctttcaaaatcaacaccataacttattaaatcttgaataacatcaggtgaagatttaatcatcaattctacagaatacacatcattttcataatgacctgctttcatggtatcttcaaaataactatcataatcttcttcatttctaagcatacaaataccaccttgtgctagaaaggaatcacttaattcagcttctttttttgttaccattaaaatatttaaattttctggtagatgtaaagccatataaagagctgaacatccactacctactattaatacatctgttttcattttttctacctactttgcaagttctaacattttttctaaaggacttaatgccttttgcataaattcatcatttaaaataacttcatttgtttcattttctaaaacgtctagaattttttctaatgttacttttttcatatttggacatacttgaacatccataattgtatgtaactctttatttggtactaattctttgatttttgcgaaaacaccatctactgtcccaatgataaaatcttttgcatcactttggacaacataatcaataatggcagaagtgcttcctacaaaatcagcagcttcaacgatttctcttttacattcaggatgaacagccacttttgcttctggatatttttcttttgcttcatttaatttttctaaagtaatatttgtatgacgaggacaatgtccataatttgttatcacatttttttcaggaacttgtcttcttacaaaatctcctaagttttgatctggtataaagaaaatatttttttgtggtaatgctttaacaatcttaactgcatttgatgaggttacacaaacatctgcatattgtttaatttcagctgttgaattgatataacataccaccgctaaatcttcatatttttctttcatttctttaatttctttaattgtaatcatatgagccattggacaatctgcaaaggcatctggcataaatacctttttttcaggatttaatatttttgcactttcccccataaactcaactcctgcaaaaacaatacgatcagcatctgtttggctggctactttggctagataaaatgaatccccaatataatcagcaatcttttgtacttcttcatctacataataatgagctaaaataatcgcatttttttcttcttttaactttttaattttttctatattatccatataacttctcccttttctcgaggagagtatactccttttgtttacacctgacaagacagttgtcaaaaataaatataaaaaagatatcttttttcaaagatacctcttacatttccttaaggcctaaaataatacagccaatcaacatatactcttttaaactttctatcttgattaaatctggtaaataactttcaggcatatatttttccatttcctttttgacatcatcacttttagaaatcaatttattataaataataatagcttcaggagccaccatcgaagtaattcctaaacaatactttgttgtccattccagtgctccttctggtgtttttttcatttcttgataattttcactaaaagaaataggtaaatattgaatttcaccggcaatattatgtctacccttgattaaatgttcacgatgaatatggccaacgccacctgttccaccaatacgtgcttgatataaaaatgaaatagattcatattcatcttgagaagcaaaatatcccatgacaatcgtattgacatcattattaataacaatcttttgagtatatttttcttcaagaaacgcttgtaaatgacattcttctaatccatatttctttaatgttacaatgccattataaaccacaccaggaagtgataaactaatcagttgaatatcaggatattcataaagaatcgtattcaataaatctacaatatcatctactgaaatcgtatttttatagacttcaaaatcttctaaaatcacatcattttcatcataaagtcgactgacaagtcttactttttgatccagttgaataaaggcaagagctaagacttgttgatgtttttttaaggtttgtttaattggtaaaggactttcttgatgactttggattttcttttctttatataactcttcttctaaaaaagcaatcgtatttccaacatcatatttaccaaataaagcaggtgataaagcataaacacgtttatcttttaaaaccccttctacttctgataaacgaaaagaaacttgtggggcaagaagaatcacatcatagtctttggcttcatcatagagattgccataagaaaccgcattaaattcaaaatctttatttaaaagttgtactccttcatttaacttttgcgcaaagaatccagttgtcaaaccacttgtacatgataaaagaactcttgtttttttagtagttgttaaggtttgtaaacaaactcgcatatcataaagtaaacctaaagcatgatgaaaattattcatttggaaatgaataaaaaaaactttttctttggttattttattttcaacatctaattcaatcatacaatcaggataaaagttaatggctccaattccatattttgtttcaatgataatattatcattgacttctttaacatcccaattctcttcattttgattaagcaaccatctttttaataaagctgtatctatttcttttaaaaaagaatccattgtctcacctcgcctctattataacgaatttaaactttaaaaaaaacaataattcttgataaacaagaattattgttcaggtacaactgcaaaataaacaagatcttcttcttgatcattaaccattgtatgtttatgacctttaggacaataatgaacacttcctttatgaagttcttctctttgtccatcataaataacataaccattaccagagattacataaattacttcactatttgtttcatgaacatgttcaccaacacttccaccactaggaacatgaccaatcataaaacggtttaaaccatcaaaatacatcttagcttcaatgtatttttctccgcctttaaagttttcatatttttctaaattattttcatcatattcaaaaatcatttttatatcccccattcgcttttattataacataccttacataaatgtaagatgacgaattaaatatttttctatataatatttaaagaaggtgattttatgtataaattattaattgtagaagatgatttaatcatcgcccaaggattacaaaaacattttgaaaaatatcattatgaggtttcttgtgttgaaaactttgaaaatgtcttagatgattttattcaatataaacctgatcttgtcttacttgatattcatttacctttttttgatggctactattggtgtcaagaaatacgaaagatttctcaagttcctatcgtctttatatcttcagcaaatgaaaacatgaatattgttttagcgatgaacatgggtggtgatgattttattaataaaccttttgacttacaagtcgttcaagctaaaattcaagcacttcttagaagaacctatagtttttctaaagaatttcatcttttatcctatcaagatgtctatttagatttattacaaggaaagataacttatcatcaaaaagaacttgttctaacaaaaaatgaacttaaaatattagaatttatgtttgaacacgctgaagtgattgtatcacgcgttgatttaatgaatcatttatgggacgatcatcagtttattgatgataacactttaagtgttaatatgaatcgcttaagaaagaaacttgaagatattggactttttaactttattcatacaaagaaaggtttagggtatttattatgcttagagaatatttaaagaaaacttctactgtttatcttctttatcttttctttatgctaacaaattttctgattttacttctatgtcaggttttacaagatttgatgatttatatcttgattgtcgatttagtaatcgtcttgatttactttattattgattatacaaaatataaaaaccatcatcgttatcttcaatatttacaagaagacagggaacttcattttcctaaaatacgttatcttgaagaaaaaacatatcaagaatatattcaaagacttcaaaatataatgaatgatttaaaaaaagaaaatcaaattaaatataatgaaatgatggattattatacaaaatgggtccatcaaattaaaacacctatcgcaggattaaaactcattattcaaaatgattaccaagatgaaagaatgctcgttgaattattaaaaatagaacaatatgtcaatatggctttacaatatatccgtttagatcacattcatcatgatctttcttttcaaaaaatatctttagattatctcgtatcacaagagataaaaaaacaatcccttttcttctttgaaaaagatataaaagtagattatcaaatcaaagatatacaaatattgacggatgaaaaatggagtgcttttgtcattgaacaaatactttctaatgccttaaaatatactcaacaaggaagtattaaattttataatgatcatgaaaaactttatattcaagatagtggtattggtattaaagaaagtaatcttcctcgtgtttttgaaagaggatttacggggtttcaaggaagaaatgataaaaaagcgagtggtttaggtctttatttatgtaagaatatttttgataaattaggtcatctaatttctattgaatcgactattggtaaaggaacaacggtatgtcttgattttactaaaaaagaaatatttattgaataatcttacaaaaatgtaagagagagttatatataattaaattttgtaattagaacgaccatgtatgcaggctatgattgttttttcgacttgttcttgtcgtagatcgtatgttttgaagtcgctctaatttgattactgatacgtcatgagtttttgctatatttacgatttcacgacttagcttatgatctatatctttcattgttaatttttttctttcatataatcacctttgtcattataacaaaaaagttcactttaaataaagtcacgttccttcaaccatgttgtaattccatcatcattgacatctggacatatttcatcagccacaaattttgcttcaggaaccgcattatccattgcaacacctgttccaacagtttctaacatttctaaatcattgcgtccatctccaaaagcaatcgtatctttgatatctttatgaagtgcttctactaatttttggattcctacagctttagaaacaccttttaatgttaaatcaaacgaacatcctgtttgatgtctttgaatatcaaaatatggagataatgtttcaactaaaagaggaatatcttcttttgaattgacaacgatcattccaatatatgtttcaatttcttgtggatcaaaatcatcaataattgtttcatctttcattccccatactctagcaaattctttatgttgtgggtcatttttatctaagacataaatataatcgctactttcaaaatagaaactaaaatggtgttctttagataatttaattgtttcttctattgcttttgctggaacaacagctttataaatagcatctcctttatattctacatagcccccattacaagtgacatatccactaaaaggataatccataacaccttctgtaataaagcatttgcatctacctgtagctagaaatacatcatgacctttttgttttaactgatcaaaggaatttctatttattgttgatataccataaagtcctttattacaatctatcaatgtaccatctatatcaaagaaaaataatttagacatctttacctccataatataaaagacaaatgtgaatacatttgtctagaatgttttttctaatgctactaaatcaatttccataggggtttgattacctaagaaatcaataagtactttagccgtttctttttcaaaatcaatcgattcaacagttccacttttaccagcaaatggacctgaaataacatttacttcatctccaacagcatagtcaatttcgattgctgaagtactaatacccatattctttaagattggatctaattcatgtttttgaagcgggaaaggttttgctcctccaccagaagaaccaatgaatcctgaaacccctgaagtattacgtacaacataccaagcttcatctgtcataaccatttctacaagaacatatccaggaaacatatttgttactttgttgatttttttaccatctttaataactgtttctacatgttctggaataataatattatataagcaatcttgtaatcccattgattcaatacgtttttctaagttttcttttactttattttcatgaccattgtatgtacaaacaacataccattgtcttccttcatcattcattcctgccataattaattcatccccaatgctttcaatataaatgcaataacggcatctccaccaaagaagaataaccccattacaaaagtaaacactaatacagttaaagaattattaaataattctttttttgttaaccaatgaacatttttaatttcagctctgattccttttaaattgaaccactctttaaattttaattcacgttctacttcttcaacgacttctgtttccgcctttttaccaaacacgacatagcctccttattttgtttctttatgtaacgtatgctttccacaacgtttacaatatttatttaattctaatctttttacatttaatcgtttatttttagtcattgtatagtttctcgataaacattcactacacactaaaatgattttttctttcatcttatcaactcatttctatgccactataatttagcataaaagctagctatagtcaatcttatttagatttgtccatctttttttgtaagcgatatttcgcattatagacacaacgaatatcaatattcaacaattcagcaatttctttactcttatatcctttcataaaacaatcaaatatttttctttcaagtgaagagcttgctttttctattttatttaaataataacttttgttttcatttaaccgtaattgatattccggtctattataactcttttgatctgcaataatattttcaatacgcatattacttccatagatttcttgatctaaagaaatcgtagaaattttattacctctattaagtatccttttttgtaattttaatacatcattaatcgcatatgaaaaatatgtatttatagaagcattcttatcatagcgatagcgatcaaaaattccaatcaaaacaagtaacgcctcttgactataatcttctgcagaagttaatgctgtttctctacaataacgtttcacaaaaatttcaattttatttttatactcatctaacaacaatttatacgctattgaagaacctaaatgatataaatacaataattcttgttcattatacgctatcatagtttgtctctcctttcttactataaaggatgacgtgagttatagacttgatataaaagaacagatgcagctactgatgcatttaatgaattcacatgtcctaccattggtaaaacaacattaatatcacaacttttctttaccaatcttgacattccaaatccctctgaaccaataactaatactgtaggcatattgtaatcaacacttctataatcttgactgttttctaattcacaaccaacgacccaaaatgccttcttttttaaatcttctaatgttcttgttaaatttgttacctgtgctacttttacatgatgaatagctcctgttgaaactttcgcaaccgttccattcaatccaacacttctattttttccaataataacaccatcaacaccaacagcatcacatgttctcaaaatagcacctagattatgaggatcctccaaaccatctaacataagtaatagaggttgtttattttcaggaatatcttttaaaatttcatcaattgtataatagcgataattttcaatataggccatcactccttgatgaacaacctttccaaccttcttatcaaattctttcttatcaacaaattctaatggaatttgatttctcttacaaatatcaaaaattttaggatccttatgcccatttaacatataaaccttataaacacttgcaccctttaacgcctccatgatagggttctttccatatatatattgtttcatatttttctccatttttcgtctcaaatttgtctcaaatttgtctcatttacatatcttttgaattcatcaaatatctcataaattctatctttacattcatttaaatataaatgtcctattaaacattcaaatcctgttgaataacgatgttctttagtatctcttttagaagtttttgtatttctccctcttttaaaaataccaacttctttttcagttaaaaaatcaatttctaataaatgtaaaataaatttttcatgggacaaactactaacaaaatgagttgcttcttggcacaactcatttactttttttagttcactttcttttactaaataatctctaactaaaagttctaaaacactatctcctaaataagcaagaactaatggattgataaaatctggattcattaaataatccccttttgaattaattctgcacgatattgatcagctttttcaaaatctttaacagctttagcgtctaaccattttgaatataattctaattcatcttcatctaattgttttggtttaaaaacaaatccaatgacatctgtcatcttaagtaaagtattatattcttttaaaattaaagtattgtctttttctttaacacgcattgcttgatttaatactttaacttgatttaaaatttcagttaaagataaagaagtatttaaatcatccgctaaagcatctaccatatgatcaacagtgtctttattaaagtcatcaccatcaagatgatttacttgtacataaagagatgtttgttttaaaacgttttctactttagctacttctttttttacaccttcaataatctcatttgtcatatttaaaggatttctataatggcttgataacataaaccatttataaacattgcatccaagttctacaattaaatctttagcccaaacaacattacctaaagatttagacatcttttcattattaatattgatcatttgattatgcatccatgtatctgcaataggatgtccatttaaagcccttgattgagcaatttcattttcatgatgtggaaattttaaatcttgacctccaccatggatatcaatacgcccattttcaaaaatatcattgatcataacaacacattctgtatgccatcctggtctcccttttgaccaaggactatcaaattgaataccttcatctgttttcttccataaagcaaaatcagttgtttcttctttaacacctttatcttcaacacgttcacttgcacctgctacaaggtcttcaattttaatacccgataattcgccatattcctttactttagaaactctaaaataaacatctccatcaactacatatgcataacctttatctactaatttttgaataaaagaaataatttgatccattgtttctgtaactctaggtgcataagtaggaaattctaagtttaatcctcttctaacatcttcataagccttaatatatttatcagttaattctttttcagtaataccttcttgtttagctgctttaataattttatcatctacatcagtaaagtttgaaacaaaggtcactttattccctaaatattcaaatgttcttcttaaaacatcaaaaacaatcattggtcttgtatttccaatatgaacatagttataaactgtaggtccacatacataaatacttacttcaccttcttttaaaggtttaaattcttcttttttatttgtaagtgtattaaataatttcataatgttcctcctcctaataaaaaaagcatacactatctagacactgccgtgttcttccaccagatagacgatgcttatcatgaccttaacgcaatcaacgttctttcttttcaaaagactcaagtaagtgcatttctattcaatcatttagacaatttccaccagcatgccctctctataaaatatcatcaatatacttctcttacctataatttttttattgaccttattctatcacaaaatatttattttacaatccagaagacttcgtaaaagactctaaataaacaatcattttctttaaattctttctaaaatcttttcgatttgcttcataaccataaacatacgtattcttatcatcaaaatatactaaatgaataaacttcaatccagtttttacataacttcccttatattcataacatttaagtccactttctaaagctggccttttaacttttaatgatgaaactcctgaagcctctaattcacctttataaagttcagataattgatcagtatcattatcatattcgttttcttctactttataaaataatatttgattttctttagtaaaacgtgtaactccatcatttggattaccctcacttaattcaaaatcagaaggataataaaaagaaacccctacacctgcctcatataaaacaccatctttatttgctgaaacagttgtatcttttcttccacaagcaactaatgaaacaacacaaacaaaaaccaccattaattttattatgcttttcatatcatcacctcgtcttcttattattctacacgactttattgattttgacaactctatggaaaagaccattttgttcttcattttgttctaaaaaaaaatgccagtttaaactgacattaattgcttttatttcttatatcattccaaaaaccaggaacattatcagaagcattagattcacctttaatataagcacaatacaattgtactttaacatcttgtttggtagaatcctttacacctttcatacgattatagttaatgccattttcagcctttgtatacattgcacgccccacttcttctttagcatttgcttctccgcttttagaccataaatatttatgagaccatattttaccatcataaaaccatggcttactatcttttgtttcttgatagataacacagtaaacatgatacattttttcttcatctgcacttcctttataagaagtatgccccgctccaaaaatcaatatatatggatttttttccaatcctgcttttgattttaaatcagcagcctgttctttagttaattttttatttccatttttagagccattatcatcaccaaattcaccatcagtcccataagttctaatcaaagttgtttgtgatgcaatcaatgcatctcttactttatataattgttcagattcttttgcttgttcaacatatcctaatactgatggaactgcaatagctgcaagtatagcaagtataacaagtacaacaataatttctactaatgtaaacccctttttgtttccttttttattcacgtcaacaactcccttatatttcatataatacccttattatcaatacttttcaagataataaaagaagtaccaccaagtgatactcctctatttttaaagtaatgacgcaaataaacgaatgtattgttctgcacttgcatcccaatctaatttttcagccattgcacgttgcactattgcatcccatgcatctggataatcatagaaagtatgcaatgcataatcaattgtatccatcatctcatgtgcattatagttagaaaaactgaatcctgtaccagtttgttcaaattcattatatggttgaacactgtcagctaaaccacctgtttctctaacaataggaattgttccatattttaatgacatcatttgtgacaaaccacaaggttcaaataatgatggcattaagaacatatcacatcctgcatagatacgatttgataatacaaaatcatatttacattggaatgatactttatcttgatgcgcccatgctgcaccttttaaagcatcttcatacatacgatctcctgaacccaagataacgatttgaacttttctttgacacattgcttcaaattgattaataatcaaatctaatcctttttgttcagttaatcttgttacgataccgattaaagcaacttctggatcttctggtaatccaacttgtctttgtaatgctaatttattttccaacttaccatttttaactgaacgagctgaatattttttaacgattgtttgatctttacttggattgataacatcataatcaacaccatttaaaataccatataaatcatgttttctcatttcaagaatagattgtaatccttcaccatattgatcagttaaaatttctttagcgtaagtcggagacactgtcgtaataacatcactgtagaaaattgccgctttcatcatatttaaacatccatcattacgacagttcccgttataatataaataactatctaacgcaaagtattcttccaataattttggatcagcttttccttggaacaaaatattatgaattgtgaatacaattttaatattttgataataatcataataacaatatctttctttataaagcattgcaatcattgctgtttgccaatcatttaattgtaaaacatcaggtttaatatttaaatgactaattaattctagaaccgcaaaatcaaagaatgcaaatctttcataatcatcatcataaccatataatcctggtcttccaaaatattgttcattatcaatgaaatagaaagttacaccatctacttcagctttaaatataccacaatagcgttttctccatcccatatagatatcaaaatttgttacatattcaatttgatctacaaatttcatatcttgatatttaggaataacaacaatactttcaacatctttttttgctgtttcttttggtaatgaaccaataacgtcagctaaaccacccgatttgataaaaggagtcgcttcactggcaacatacataactctcattaaacacggtctccttctttaatataaagtggacttgtttctgttccttttaattctaatttcttttcaacttttgcacgtttatcaataattacgttttctaatactgctccagaagcaatcttagatccagagaagataacacaatttttaataactgcaccttttccaattgtaacttcacgtccaagaatactattttcaacagttccatcaattactgcgccattagctacgaatgatttttttacattagcgtttgctaaatattttgttggaggtgtgtcgtttgtatttgtataaattggccaatttgatttaaatacacgtgatgaaatatcaatatctaacatttccaatgaatatttgaagtatgcttctgtagaatctaaacatctagcatatcctttatattcataagtatgaatttgtttttcatcacataaatatcctagaatatcttttaaatcatagaaagcagaaatcttatgtgcttttttcatgatttctaataattcttttctattgattacataagtttctaatgaaatattttgtctttttcttgtacctttattaattgttttaccagttaataaaccatctttatctatttctaaaacatcacaaccaacccaagcaacatctgcatcttttgctttacgataagtcattgtgattgttgctcctgatttttcatgagctgtaatcacatcattataatccattgtggtaacgatatgagcaggtgcaatcacaacataatctgcattacttgtttctaagaaatgaatattttcaactaagttgttaatatcatgattgtatttaggatcgttagcatatttttcattataaagtaatgaaacaccaccagctttttggttaaagttccaagaattaccatttcctaaatgtttaaataaagaacgtggtttcttttgaatcataaccccaattgcatctattttagaatttgacatatttgataaaacaaagtcaataattccataacgaccaaggaagcttacagaggccactggtcttctttctgttaatcccgtaaattctatatctgaatgtaagtttactaaaccaataacttttgccatctttacttccccctcttatctactattatcgctcactaattcaacttctttagcttctgaattaatgacagttccagctttaacaactacattttcatcaataatggctttatagatttctgccccttcttctacaagaacaccaggcatcaatacagagtcaacaacttttgcgccttctccaacattgacattattgaataaaacagatccttcaacagttccgttaaccatacatccttgagtaacaagagagtttttaacttctgctttttcaccgataatttgaggttttcctaaagtgtcttcagtatagattttccaatcttttttgatattatataaatctaaatctttatctttaagtaaatccatgttagcttcccataaactatctacagtaccaacatctttccaatatccatcaaattcccaagcataaagctttttattatcatttaacattgctggaatgatattcataccaaagtcatgtttactatctttatcttttgcatcagctactagatatttacgtaattgtttataagtaaagatataaatacccatagatgcaagagttgattttggatgttctggtttttcttcgaattcataaatagttccatcttcatgagcgttcataataccaaaacgactcgcttctttaagtgatacatttaatactgcaattgtagcatctgcaccacgttgtttatgagctgctaacatttgatcgtattccattttataaatatgatctcctgataaaatcaaaacatattctggatcataacgatctaagaaatctaagttttgataaatggcatctgcagtacctgcataccaagtggctcctacttcgtctctttcacgtgctggtaaaatagcagccaaagaattagctccatctaatccccatttagttccagctccaacataagttccaagtaaaactgattcatattgtgtaagtacacctacaatatcaatacctgaatttgcgcagttacttagtggaaagtcgatgatacgatattttcccccaaagtgaactgccggttttgcgacttttgctgtaagttcttttaaacgtgttccacgccctccagctaaaatcatagcgacaatttcttttcccatttttaactcctcctatacaaaatgtaagcgctttaatctacatctttatcttatcatatttcactttataattcacggaattatttaagtttttaagcaataatagatcaaatacttaggctaatattattgtactccttttttgacataaatttaaaggataatcataaattattttgaggtgaaaacatggctcgaatttcatataccgaaaaagaagtcgaattattggcgagattgataaaatctgaagctttaggagagggcgaagaaggcatgctccttgtaggaaatgtcgttgtcaatcgtgttgtcgcaaattgtgacatttttagaaatgtcagaactattagtgaagttgtctatcagacaaatcaatttgctggagtaggacaaccgctatttaatgaacctgtgagtcaaaatgaaaaagacattgccttaagatgtattaatggctatcgaaatgaacccgccacgaacgccttatggtttaaaaatcctggcacaaatgttgattgtccagaaacgttttatggaagactatctggaaaatataaaaaacattgtttttataacccagggttaaaagataattgtgacttataggaggtctctatggattattttgatgatttaaacccttacttagtaaaagaagatgataatgaaaatcttaccaggcaacaaactgttccccctactcagcctgtagaacaaacatatgttgaaaatatcttacgtgttaacgttggtaaaaaaggaacattctattttagttataccggttctaaaacatggaatgataagatttatacaggaacattgcaacaagctggtagagatcattttattatcgtaactgatactggtaaaacagtaatgttattacttgtttatttattatgggcagaatttgatgagcctttagattatcaatataaagtaaaataagtgcttacgcacttattacatattttcgtactgttgatacaaaatgtaatgatcctgttacaacaatattttgatgtttagccttcattatttcaatagctttttgatagggaatatgtcccccttgacttctttcatcatcaaaatcagcaatcacaacatcaaattctttcaacatatctaacatcttttgacaatctttatccatcaaagcactaaaaacaattccaacatcttccaactttctttctttgattgtttgaattaatgcctctattccactgatattatgagcaccatctaaataaagatgtccaaattgttcaaaacgacaaggccatttaaaatcatcgatcaccgcttgaatatcttcaccatttaaatcacaaagataatcaacaacatttaaagcaagcgttaaattacttacttgatatgttggtaaatgtaatacatattctttttgatgaaaatatagatgataaggatactgatattgtttttctacttgtaaaggataaaaagtactttgatgttttgtacaataatctttaaaataacttaatatttctttattttgttcagttgtaaataaaggaacattttctttaacaatacctactttatgactggctatttctaacaaagtatcacctaacataaattgatgatcataaccaatatttgttatcactgcaacattacttttaatcacatttgttttatcatgaagtcctcctataccacattcaataatatgataatctaaatctaattcattaaaataatacaacataatcaacgtatctatttcaaacattgaaagatgttcttgttgtattaaaggcagtaattgattaatgaatcttaataaatcatcatctgatataggttttccatcaactgaaattctttcatgatgtttaataatataaggtgaagtaaaagtacctacatgatatccttgtttcattaataaatcttttataaatgtaacagttgaccctttaccatttgttcctgctacatgaattacattttttaaatcaataggtatttgatatctttctattatcttttgaaaatcttcaaaagagcgtttagctctttgagattctataaaatgaatggcttcatctactgttttaaacatctggattactccaatcaattggtgtcataccattttttattaaaaaagcatttgttttagaaaatggttttgatccaaaaaatcctctataagctgaaagtggtgaaggatgtacacttgtaagaactaaatgtctagaatcaatatattttttcttttcaatagcattctttccccaaagaataaaaaccagcggcttttctctttcatttaaataacggacaacatttaaagtaaaagtttcccatcctaatcctttatgtgaattagctttacctctttcaacagttaaaacattattaagtaatagaacaccttgtttagcccaataagttaaatctccatgatgaggaataggtaatcctaaatcatcatgtatttctttataaatattaacaagactaggaggaatacggacatctttagttactgaaaaagcaagtccatttgcttgatgaggttcatgataaggatcttgtcctaaaataacaactttaatatcatcaaaatcacataaattaagtgctctaaagatttgttgttttggtggataaattgttttagtttcatattctttttcaatgatttgatgtaacttttgataatattctttttgagattcaatttctactattgttttaaatctattcatgatcttctcctaatacaaacttttcaataacttcacttactgccccttcatcataatccttctttgttacatactgtgccaattctttaatatcatctctcgcacaagcaacagcacatcctaatttcgcagttttaatcatttctacatcattataattatccccaataccaatcgtttcatccatatcatagcctaaataatcgactaaccaacgcattccatatcctttatcaacacccttagtattcatctctaaataacgtccactagaaaaagctatactacatgtatcttgaatactttgaggtaattttaaagctagtacttttaaataatccatatctcttttttcatataaaatcttagctattttttcattctttaaaaaagaaatatcaaaatcatcaatcacttcaaatttagctttttgagcaatctttctttgaatttcatcttcatcagcatgaaaaatataacaacaatctaaagtaaatactaaaacacaaacatctaaatctcttgcattgtcaaatatttcttttgctttttcaaactctaatcctttgaaatgaagaaccttattatttttattttcaacaatcaatcctccattaaaacataaagaatactctcctgcttgatcatatgtgcctatttcttttaaaatatctggaatcatattaaaagctcttcctgtacaaggaacaaactttaaaccttcttttctagcttttaaaatagcttcttgatttacctttggtacatgatgatttactaataaagtttcatctaaatctgaaaacattaatcgatacatacaattatcctccataaaacatttctaaaaaaagtggtactctttgtgaccaatcatattcactatgctttccatttggaaaaaaatgatattgataattttgtaattttccctcgatacattcttttaaatgttcattacttggaatataccttttatcatcttcttgaccaccaacatccatatacaacatattatgacttattgaactgactttcaataaatttacaaattcttcttcataaatccaaaatgctgttgataaaatagcacattttttaaagatcgtaggatactttaaaaaagcgtaaaatgaaataagagctcccattgaacttcccactatcccataatcatctattttagtaggaaagttttgatctaaataaggttttaattgcgttgttagaaatgtcacataagcatttccttctcctcctacgagtctatgtgtaccatattctcttgataaatcttgattcatcatccatggcccatattcatcttctctttttaaaggttcaaaattacaataaatagctactaaaatcacatcaatatttaattgctttaccgcttgtaaaaacccccaactttttcctatataagattgctcatcaaaaaaagcattttgtccatcattaataattaaaacaggatatcttttttttgatgtttgataatcatctggaacataaatatctatttttcttgttctttttaatgaacgtatatacatttcttcttgaataatcataaaaaatctcctaaaacaaaaataagcaatctttgcttatttttcttgatctatatctggtaagatgacaacttgttccccatcttttgtgaaaacatagttttctcttgcataacgcgtcacataatcatcatcatttaaaagacttacttcattttgtaaatcattcttttctttttttactattgcgacttctttttcgagtttatcaatttctgctgttcttgaaaaaacagacatggcttgagataataagatgtatattaaaaagcatccaataaaaatataagccattggtttatacactttttttagtcttttttttgtcatcttttcaccctcttttttatagaccctattataccatcaaacttcaaaaaaacaaagcgcacaggtttaaatagtcgtgttaatttttggtttattttaacaatcacaatatacattttttcatgcatcaaattttgataaacaacatatcccgctaaaacactcactaaaaaatacgctcttaaaataccttcattgatttttaataagcctataaaatagattgcagcaaaaataataccaaaacaaccttgcataataaaataaataaatttgattttaattttgatgagatgactataaataaaatgatatacaaaggtaaagataatcccgtatacaaaagaatatcctattccttgtatttgtgtaattaaatccattattttaataatttatttaaaacactatctttactctttgttgttcttttattcgataagtaagaaatcgcatcaatatttcctttaatactgacctcttttttctcttgatcaaaacgcacaagtgctaaatcgctacctttaatatttaaatatcctaaagatgtttcaattaaaaattctaaagaatcaaaactttcaatttttttaatgcctgtaagttccaatgtcttacgatcttttaaatacacatgatgataaggtgtttgttcaaaatgtatttgattatccataatatccctcctctatatcatatgaaaaaagagaatgttcatgacattctcttattcatttacttcttttcttttttcatcaacaatatcataaagcattgtactttcatcttttaaaacatgttccttaagaagtttaactttaaccgttaatatcgttcttccaaattcaatttcaatcaaatctccaacatttaactttgttgaaggtttagccactttaccattgactttaacacgttcgctttgagaaatctctttagataaagttcgtcttttaataattcttgatacttttaaaaatttatctaatctcatcttattcactcataacagcagtaattgctggaactacttgttttttacgagaaataacaccaactaatgttccttgacattctgttaattgaacattaaatgctttttctactaattcaggacgtggtccaccaacaaagatttcactgttagcgttgataatatctgtaagtaataataatgtgaattccaaattattatcttccgcaaatttattcatataatctaacatatcttttttgtatggtaagaatccttcaatatccattgagtttacttgagcaacccctacttgtaagttatcaaaactgaattttttgaagtcttggttaaagatttcatctacagttttaccaactaaagaagttcctgctttaaacatttccattgcaaattcttgaatatcaacacctgcaattttagctagtttcttagcaatcttagtatcaactggtgtacaagttggtgatttgaataataatgtatcagaaacaaccgcacctaataataaaccagcaatatgacttggcatttcaacatctaattcatcaaacattttagttacaattgtagctgttgaacctaatggttctcctctaaataataatggtcctactgtttgaatatcagccactctatggtgatcgacgatttctaaaatatcagcttcttcaataccaggaatagattgacctctttcattgtggtctactaaaataactttttttcttaatccttttaataaagcaaaacgagaaatacttcctacacaacgattatttaaatcaataactggatatccacgatatcttgtttcagacataacttctttcatataatctaaagtatcatctgtagagaaagttttaatatcccctttgatcatgacatattcaacaggaattgcttgaacaatttgttgagatgtttgataagtattaaatggtgtagaaataattgaaattccttgttcttcacatttttttacaacattttcatcagcagttaaagaaccagttaatacaattaaagatggtttaactgaaataagttcttctaaatcatcacttctatctccacctacaatcacaacatcattttcatgaatacgttttttagcttcactacctgacattgctgcaatgtgaatatcaccttcaacaacttttaaagattcatttaaataaatcacattagcttctaaagtatcaataacattttcaacaggagttttagctttctttaaaacttcactatcccattgatccatatatccttcaataatattagatgtagataataaacctaataattgaccatgttcatctaaaataggtgcagattttaaattttgttgttttaataaaaaccaagctgtttttaaagttaaatctttagaaaaaacagttactttatcataatttaaatcttcaactttttgtttaactgttttaagtaaaacagggtgttctactccaaaacgttttaaaacatattcagtttccctattaatttctcctaaacgtacaggaactgcattatatttatttgttgcatttaataaataactataagcaattgccgaacaaatactatctgtatctggatttctatgtccacttacataaactaaatcactcattcatattctcctttatacatttttcttcaaataacgataaactgttggttcagataccgctaatttttcagccactaatacaatagcacctttaaccttaaaagtccctttttcttgtaaatattttacaacttttatcttttcatctacatttaatctttcagctaagaaataacttgggaatcccatcttttctaagcattctttaatatacatatcaatcatttcatccaatggagatgataagatttcaactggattatccattttaaattcaatatctttttcttccttaatccctaaaatctttttaattgtagaagttaaatattctaaatctgaaatattcacattaatacataacattcctacgggcatttcacgaccttcttctttaataaaataagtcgctgctctcattaatttaccatcattacctacagttttataattcatgacaaagtcatgatttaaatattgtttttcttctaaataatgtaaagataaatttgataattttgctccaacttctcttcctgaaattggattatttgaaatagctacaatttcttgatctttagatgtcaaatcatgtaaagctatttcacaattgtcacctaatgcagcacttaaaaaattaactaattttgcataaggttctaaacttttgtacatactattcttcctcatttcccttattattatgataataattcatatctatatattatcacgataataattcataaacaatgattattattataataaaaaagaagtctatagtttttcacaaagacttctatttataaatattctttttagaaatttctcttaaagaagaaacacctgtcatcatcatcgtattttctaattcttgacctaactgttgaacataagcttcaacaccttcatctttaccaccataaatcatattaacaaatggtcttgctataatgactgcatccgcacctaaagcaagggctttaaaaacatctaagccactacgaataccaccatcaacaataattttaacttgtcctttaaattgatcagcaatttcttctaaaacacatgctgttgcaggagtcccatctaaaactcttcctccatgattggaaacaacaatcgctttggcacctgcatctactgctttttgtgcaccttcaactgacataatccctttaacaataaaaggaacgtgggcataatcaataatctcttttacctcttctacactctttctaccagccggaggaattcttccttgtaaaaaaggaagtcctgcagcatcaatatccatagcaatcgcaaaagcatttgattcattagcaagatctaattttttaaagcaagtatctttatcccaaggtttaatcgttggaacaccaatgccattattttctttaatataatgtgttgcatgcatcatgatttcttcatttaaaccatcccctgtaaaagcagcaattccacttttagcacaagcacgtacataaatttcattaaagctattatcattgtataaatcactataatgttgacttactgctcctactggtccagcaaaaataggatacttaaatgtttttccaaacatttcaaaagttgtatcaatttctttattttcagcaagagtatccattttaacttctatcttttgccaagcctcataatttttaatagctactgttcctgttcctttagagcctggtccagggattttattcgaacaagcttttccattacatactggacatgacttacaataaggtccaataacacttctacttttttctcttatttcatttacattcattttccttcatcctttattacgctaaaagattacacctgttctttgataaaaatcaagcttttcattaaaaaacttgtttgtacaagttgtacaaacaagtaatcctttctatgaaggtacatacaattctggatctccattaatcacttcaaaatcatctttttctaaagatagttcttgaataatcgtttcttctaactcttcttttgtttgtaaacaaaaacctctaaatccttttttagaataataactccagtttgctagttggttaagagattcattatttctaatatctgtatatttttcctccttaaagataacaatcaaatcatatcttttttcttcatatttcttttctttatttttattcatataaaaataaagacctacaataataacagcaatgataaaaatataaatattaaaacccatataaatcatctccttttatttattatatcttagtccaacatcttttgcatttcctttgaattaatacttacaatttctttaaaatattcttgttgagtcttatcacctttaaataattctttttcaattttaccatcttttaaataaagaagtcttgaagaataagaagcaatcaatggatcatggcttaccataatgatcgtaatatgattttcattcatctttttaaagatagataatatttcatgtgaattttgactatctaagtttcctgttggttcatctgcaataatgattttaggatttccaattaatgctctagcaatagcgactctttgttgttgtcctcccgaacattcatgaggatatttattgagtagtgattcaatatctaattcttttgtaatttgatggactttttcatcaataacttttttattttcgccaatgagttttaaaggaatcataatattttcataaaccgttaaagaatttaataaattataattttgaaaaacaaaacctaaatattgatatctaaattttcctaattgattttcagacatttgtttcacttcttgatttaaaatatacaaactcccattagtaggaatatctattgttgaaatattatttactaaagtagatttaccggaacctgatggtcccataacaacaataaactctcctgttttaatttctaaatcgatattttctaaagctgtaaatggttgtttgcttcccataccataaatctttgtcatattttttgcttgtaaaactgtttccatattattgtcctcctagttgtacttttcctacacaataatttaataaaagacaaatcaataatgtcactacataatagataaataatccactatagaaaaataacattgttgaattcattaaaataaactctctcgccataaagattaaataaggtaatggaattactaaaacacaaataaaataaaggatattttctttcaaaagcatcttctttaaatcactataaacataacctactttatttaaagtattaaattccttcattttatttttcttttccatattcatcttatataaaatagaaataattaccatcgctacaataaacaaataactgatcattcctgtcacaaattcattactttcaatattttgtgacgctaaaacaggtaataaaactgtaatcaataatgtaagtaagccaattaacgaagctgttgatttaatcatcaatcccacatgtgataaacaaatatatatttgttctccttttaaattctttttattttttaaaaagatttgtggtaataaatacttatataatccatacattcccacaacacctaaagctgttggcggaatataatttattaaatttccttcaaccgttataattgaacaaaatcctatcaaataaataagtaaatacatcatcatttttttaaaacttacaaaatgaatagcttgtaccttattttcatcattcattaaagtataaatatcacttttatgaagttgccctattaaaaagatgatcacaataacaactaatacacataaagctgaaatcgttgtaaaaaaggtacttggcataatggtataaattgaataattgatttgtagataaggatatatctttgaatgaatgaaaaataagctaagaacacctaaaataaatgaaatcggtaaaacaaagataaaaacaatccccatttgaatcaatgtatatttaataaaatctaacaagttaaatccacaagtaaataaaattccaaattcttgatgttttttattgaaattatattgactggcataaataatcataaaccaacaaaataaaataattaaaaatggtaatcccattgataatggtatatccgctccaagaggatcatctattcctctagccctatctgcttctattaaatagggattgttgataaattctgaaaagatcaaatgaatgacaattgcaaaaataagtgtgattccataaatcatatattgttttttattcctttttaatgttaacgtagctagtgaaaaaaccttcattgctcccacctcctaactccatcataaactttccatcacaccttacaataaaagtggcaccaacaacctagaaatgacacaaacaacatcttaaataaatctacttatgatacaatacagttaaaggagggatagcatgaagtacaaagtagggaaaccccattataaattaagttttatttattcattcatcattattttttgggctgtttttttaatcatttatagtccattttcaggaatgaatatttgtggatttatgcttatttttttgattatctttatctttcttccaagcatggcattttgtaataatatttgggaagtggatgaatattatcttaaatacactttttataataatgtaatcgataaatcacaagcattttttaaaacaatttttactagaaatatggaatatcaaatgaaaataaaactagataagattatatctatccaagtcagttatgaagcagttccaatgcttttttatggaaccaatggttataatgttatttttaaagtattgatgaaagatggttcttctttttcttttcaaccaatcgttactagaaaaagaaaagaagttatcgatgcaattgaatttttaaaaagtaaaggcattatctttaaagatcgttatcatattctagatcaattagataaacaagaagctttatcttattatttagaaaaaatacatggaggtaaaaaatgatttctatagcttgtaatatacaagagtgttattttgaaatcatcaaaaaacactttacctcaaaagattactatttagaaaaattcaatccagcatcttatgatgatatctattttattgaaatcaattcacttaatgatttagataaaattcatcaaatcaatagatatccagaaactttaatttatattattggtcctaatgactttcatttacttaatgaatgtttaacattaggtattcatttatattttgaaaaagatgatttagaaaacagtcttcactctaaatcagaaactattcatcaacaaatatttactagatttaaaacatatcattataaaaataaacaaatgtcttttgaattaagacttgctcaaattatgtatgtagaatccatgaatcataaacttgtaattcatcatgataatggtgattttattgaaagaaaaaatttatctttatttataaaagaaatcaattcttctgactttattcaaattcataaatcatttgtcgtaaataaaaactatattcaagaaataaaagctaaagaactcattttaaaaaattctactattctacccattggtagaaacttcaaagagagtatttaaaaagtaaggacacacaatccttactttttacaataatttaatacattgcttagaacaaatttctttagatgttgattaataacaagtttttgagtaatatgtggacaaacactataacataatttacaccctatacatctattttgtacaaaatactcatgtttattttctattgttttaccaataaaaatagaatctcttaccatatgactaagaacactaaatcaatatattcttcacttgcttcatataaccaaaaacttctaaagcacctcttgtatcttgtgagtaaatttcttccaccaatattttaataatccattaatcaatatttctttattaaaacatctcttatttttagaaataaatattataatgtatattcttttggtgattgtccattatcagcaataatacttgagcatcagctaaataaaacacttcaaaaattggattatccatatttctttttcagctttattatcttcaaatacagctctacaatagttaaatattgtactggcgtatcatttaaaagttttacgaatcattcacatttacttccatcgttattaatcattatgaaataattatttttttcatcttcgctattataataactttacacaaatatatgcactctaaagtgctatatactatccattttaaaattattgtttaatataagcattttgaaggaaataaaatggaaaataatgaattacctgcttgtccagtagaaacaacacttacccttattggaaataaatggaaagtattaattcttcgtgatttaatgcctggttctaaaagatttgggaaattacaaagaagtattgggaaaatcagtcaaaaagttttaacttctaatttaaaagaaatggaaacaaaagggattgttcatagaaaagtttatgctgaagtaccaccgcgtgtcgaatatagtttaactgacttagtaaaaagcctaaaacctattcttgattctatgtggaattggggagaaaattataaaagaactattcaataaaataagcgccagcctatagcgacacttattttttcattttaataatcacatttaaagaattattgacatcactagccttatataaagcttgatcaagctgttctaatggaaattcatgagtaatcatactttctaaattccacttaccacaagccatgatttcttgaacatcatcaacatcttctttcatataaccaccagagccaataatactttgttgtgcatatgtcatatgcaataaatcaatggagcgtggttctttattgaccgctactgaaacaaaacgactttctatttttcctagttttaaaaaatcatcaagaatacttttagcacctgctgcatctaaccaacaatcaatatttgcagttggaccatttaaagaataagccattccaaaatattctttggcatgatttataaaatcatctacttgtaggttacatgtttcaaaacctaattttttagcaatttctaaacgataagctgaataatcacaaatcatcacttttttcatcccaaaatatttaaaagcaaccgctgcagcaataccaatcgttccactgccaaaaacaaccgcattttgttctttgacatacccttgaccacttggaatcatgcctcttctagcccctcgacagcctacagtaaaaggttcaattaaacttgctagtttatctgaaatacgtttgtctacttgaaatttttcttagcatttggtactaatatatactctgaaaatccacctagtgtccccgctcttgaagtatcatctttagcagataaaggataaggataaacacggtctcctactttaaaatccttaacttcttttcccaccttaacaattcttgaaattgcttcatgaccaaattcaccaccaacattcactttatgtcctgtatttggaccatgcataaaaacaaccacatctgttccacatatacttgaataaatattttgtattaaaacatcataatcacccacttcaggaagaggtaattcttgtatttttactttttcttttcctaaataaattcctgctttcataaattcccctttagttgtttgatacattgttgaatcacttgcatcacaaattctatttcttctttacaatcatcttttagctattgagtaataattgctataatgccttgtatataaaaagacataatgtattttctttcttcttgaggaacttgataacaatctaagattggcattaaaacatgttgaaataattgtgaataactttgattaagttgtagcacttttgctttttttatagctgttaaaaaaagacgtttgttccttttaatataacttaaataaggttttaaatatttgggtgtaattagataaagttcatcttttgaacaatcattgatcttattcacaaaatttcgtgaatcttgtcccatatgctcaagaaaatgacaattcatatattcaacactttcctttaataaatcatctaatgtttcataatgtaaataaaaggtcgaacgattcacacctgcttcatgacaaatctctttaaccgtaatataagcaaagtctttcttttctaaaagttctagaaaagactgatccatttttatcgctgtattaaaatatttactttcatttttattcataatctttaccctttgttttatttatgaaattttacttccatttaaactatttatattatcatattataagtttaatcgaaaaaatgaaccttaattaatattaattaaatattattaccgttattcttcatcactaatttctttagcaagttccataatttcaaaagcatacttttgttttccacgaacaagtattttcttataaaccggataattaattcccattccaattaaaccaattaaaccaataataacacctaaaacaaacattcctgttgttccactaccaatgacattcattgataaacacattccaacacccatcaataaagctgaaataattcctaaagtataagtaaaaatattagctggtaattttgcctttgcatctaatttttgaagagccactacctttgatgtatcctttggcgcatattcattagcaagttgttctgcataaattttatctgtattcattttcatttcctccatttcttacaggtttattataaaaaatagaaaaatgaaaccaaacaacacaaataaagaagaatgttgatttaaaaaagaagctattcaaataataacttctactttgtattatttttaagataatctaaaaatgcttggattcttttttcactacccatttgtgataaattaaaataatgatgatgatctaattcatcaggcatacattttttacctgaataatgattaggaaattgatgaacattatctaaaccaacacctcttcctaatttataagcatttttataacttgcatcttgtaaaaatgctggaataggaacacccgttgttttgtttgcttcatccattgcttgataaataccattagaaaccgttgatgatttaggcgaacaacaaacatataaagcagcatgtgctaaaattgttgtagactctggcattcctattctttctaccgctagaaaagcatttgtcgctacaacaagagcttgtgaattagccaaacctatatcttcagatgcacaaacacaaattcttctagcaatatatttaacatcctctccagcaatcaacattcttgctagataataaagtgttgcatctggatcggtatgtttcatcgattcaataaaggcagaaatagtatcatagtgattatcaccatttttatcatatcttatggcctttttttgaatacattgttcagctacttctaaagtaattgaaattatcccttttttgtttctttcagttgtaagataagcaagttctaaggcgtttagaacacttctggcatctcctcctgcttgatctgcaaggaagcttttagcattttcatcaattataatcttttctttacctaaacctttttcttgatcttttaatgtacgatcaattaaggttattaaatcatctttttctaaaggttttaattcaaagatacgacatcttgaaagtaaagcattattgacttcaaaataaggattttctgttgtagctcctattaatataacaattccatcttcaacaaaaggaagaagataatcttgttgtgttttattaaagcgatgaatttcatcaataaataaaattgttcctttttgataagcattttgattaaatttagcttcttcaatgattttttctaaatccttgattcctgcatttgttgcatttaatttacaaaagtatgattttgtcgtattcgcaattactcgagcaatcgttgttttccctacccctggtggtccatataaaataatagaacctaaacgatcagcctttattgcacgataaagcaatttatctttccctatgatatgaagttggccaactatttcatcgagtttctctggtctcatacggcttgctagtgggagttgtcttgtattttcattcatatcaaataaattcattttcttattcctcttttatctttgtcattagtttttcaaatgattttgcatttaatattgtattcgatataaattcacctttataaaaattagcccaattattaaagatacaaggaacatttttagccttttctaatgtatctattttaataaaattaattatcaaattattttctttagcataatttgataattctttaactccatattcaacataaggacattcataactataataaactgtaaaatcttgttgttctattttcatagttcttgcctgttcattaaagcgtggtatttcatgattatcaaattgaagtgccattaattcatattcaccaattgtatcaactactttaaagccataatgttcaaagaatttcttttctccaagaaaaggcttcttctttttagaaacaagtgtacataccccacttttagctttttctttagaatcgttaatcacatattccaataattcattagctattccttttcctttaaaacttcctgccacccataaacaataaatatattcataattacttccactaataggcacccatgctgtttctatagactcgtattcaacaaacactttacctctagcatccaattttctaaatacatgtccatcttttattttatttttaatccattcttttttttgtgtgacacctgcttgatgttttttatctcctatagcgcaacaaatatgttctttttcaatattttctaatgtcaaatttatatactgattcatattattcagtcccttctaatgttttaattccatttattataatttctaatgataaatcaaaactttcttttatagatactggattaccaaaagcattgttatttacaagcaaagaaaatccttctaaaaaactgcgcagtgttcttatgatatgattgatattttcatcacttatatttactgttttcatcactttaaaaatcatttcaaataattttctggttgcattttctttttcaatactttcatatttgttataccaaagcatcgctgtaaagattcctttattattaattgcataatcataaaatgcataacacatgttttttaatgcctcgtatcctgtcactccaacagctgcttctatcgttaatttttcaatttgtttccagccatagagcattaattgtttttttatatcatcaaggctagaaacatgattatagagagaaggggattttatctttagctcttcagcaatcatctttaatgataaattctctaaccctgctttatttgataaatttgctgctgtttcaataattcgttctcgactaatattactcatagtatttctcctaattaattatattattattttaactaatcatattagttttatcaattattaaaaaaatgtatccaaaccctttcaagttcaaatacattttttatattatctagctttctttcgatgatataaataggaataaataattggtaagattcctggtacaagagctaaagtaaaaagcataaacatatccataaaaggtaacagcataataagtaggaccccacctaataccatacatttgccactaaagcgatgagtatgataccaattatcttgatcgtttaaagtccaaggaacacgtattccaactgtataattaggctttacagttggaagataattacctaaaacaatatacaacgttcctaataataaccctgtaataaagccaatatttttaataaaacctaatgtatacccataaatacaattacaaataaatactgaaaccaaagggcaaatccacaaaacaattgaatacatcttgtcattaatatttttggattttggatctgtacttacagcaaagatacaaaaaagatgaatcacaaatataattaatggtaagacaaatactgcaaattcttttgatgaataaccatcaggttgtccattaaaaccaaaatgtgtagcaacatcttttggtaattgattccatataagcaaaccaataaccattggaagtaaaacaacaatagaagataatattactttatttttatttcgtttcatcataatcattctccttttaactcactcatccataacataatttcttctaataccgttgtattaagctcataataaataaattttccctctcgctcatcacgaattaaacctgcttcttttaaaacagaaagatgtcttgagattgccgctcctgatacagaaaagtttttaacaatatcacctgcagacattcttgattgcttaagcaaattaagtatttctcttcttgttggatccgccaaagcatgaagcgtatcttgcattgccatattcatcatcctttacatttaacatttaacttaattgttaaatttattataacatactaaaaaaataaataaaagaccatttttctcatatattcaaattttctttaatttcaaaatttagaatttctattgtggtatatagacttaatatgtttgaacatattttttcatgaaaaagtttacctttcatttaaaaataaaaagcatttgaatttattcaaaaacttcctcataatttggaattgaatcaacagcatttacttttagtgcttctacttttatatcttctttatctgttaaaactctgcttccttcttttcccattgtaaaaagaatgtgggtatgaggatatttttgttttaatgtttgaataatcttttcgtaatcttcttcattacttaatgcagctccttctgtttcattaacaacaagccaagttactttttcaataggatagtttttaacagctatatcataaggagctgcattgaaaaagcttttcatttctttttcataacaacgctctatgatataaggaacattatttatttcattttgtaatacaacaatatcaccctttgaaaaatgagaaagtacctcatcgatatattcaaaatcaatttctttatttgttccaccatataaaagaatatgattttgtccactttgatcaacttcaataattgcatgccctgttggtttattagaaatcttcatataatcaatatgaacacctttatctactaaagcatctttcaataagccaccatcactaccaataattcccgcaaaataagtatcattaccagcaaatgccatggcaatcgcttgattaacgccttttcctccacatttaatattatattcaagacatccttgagtttctcccggtaccgtaaaatgatctactttatatacatgatccaaattagcagatccaaaacacaatactttcataactcctccataataaatctttattcattcacattataaacggtattctcttttattaaaaaaaaagaaatatttgaacatcaagtttaattacttctaaattcataacattccggaaaagacgtttgttctatatatgtatctgcttttgactcataaacatctttcattattgcatatggtaatttattcacctttttataaaggtgttcctgtactgatatttaaagtaaatattcttttagtttcagccaaaacttttaatttatcctttggtaactttataatataaacatttcctaaatcactattatcttcttcttgaaactccctacatccttcatttatccatgttcttaaatcaaaccattgttcaggtttagaaattccaatggaacctacatctaaaaaatcacaaaaagttgctcctttttccgcctttataacaagtttgtaatccccattataaaacagcaattatcaagatgtaaacaaacacatcacaatactttcattaactaaaacaccttaaatttaacttagcatttcatattcattatcgacaatattttatataattactttgttatcgtcctcccctgaaaggaggtggtgtaagttgttctcagatttagtaatatctgtcgtggcatgtttttagtttattacatatgcaaatggttggacaaaagatttaaacgataaccagcctagtgctaagtacactctaaaatactagaaaaggtaaggaatggcactccttaccttttcgtttgatgcaattattctcagatttgcaattagattatagcatctaatattttaatgtgcaagttgatttcaaaatccaatttgttatacaaggtacataacgaaaattcatttcagttttatatattgtcaaggaagaaaaattataaaactaatctagatcttcaccatttgtttcaattacttttttataccaatagaacgatttttttcgatatctattcattgtcccatgacctttatcgtctaaatccacataaatgaatccatatctttttgacatttgacaagatgaagcacttaataaatcaatgcagccccatgttgtataccccattaattcaacaccatctataataacagcatcctttaatgctttaatatgttctcgataatattcaatatgtctttcatcattaatttctttgcctttgacatatacttcatttgttcctgtaccattttcaacaataaataatggtttttgataacgatcataatacatattcaatgtattgcgtaaccctattggatcatcttgtcttttatataaaatttcacctaaatatggattttttaaagtagcaagaggattattttttatctcctcatttattctctcgtctccactaacaacatgagttgcataataagaaaacgaaagaaaatcaaccgtattatttttaagaatttctttatcatcatcttcaaaaggaatagtaataccttttctttctaattctcttaatttatacgaaggataataacctctcgcctgtacatcacaaaaaaagaatgcatccctattttttgtaattgctgcaaatatatcttgtggatgacaagtatatggataccatgtgcctcccgcaaacatatttccaattttatttgttggatcaatttcgtgaccaatttttaccgcccatgcactcgctactaaaagatgatgagttgcattgtataactgttgttctctactttcattttgatctataatcactcccgctgatagataaggtaaaactagcgtacaattgatttcattaaaagtaagccaataatgaacaacgcctttatatctcttaaataaaactgttacatactttttataaaaatcaatcatatttctatttttaaaaccaccgtattctttcaccaaataaagtggaaagtcataatgagatagtgtcactaaaggctcgatatgatatttttttaattctttaaaaatgtcatcataaaattgcaaacctttctcattagggtgttcttcatctccacgtggaaatattcttgaccaagagatagataatcttaatactttaaagcccatttctgcaaatagagcaatatcttctttatatcgatgatagaaatctattccttttaaaacagggtatttttctttttctttaaaagaaagatcttttacattcccaaacatatattgaaaacgattttttccacttggaaccacatccatgttagctagacctctaccatcttcattataactgccctctacttggttagcagctattgctccaccccacaaaaagttttttggcaaagtctccattttatgcttcctcctcagctaatttcgtagcttcttctttcttgcataaagagtgatcatatgcaataaagaatggataccaaatagctaatgttaatggaatcatcaatgctacaaaaactaatactctccagtctagacaataaacaaatatacttaaaaaaataggatacgttccactaatcaataaataaggagctgtcactaaaccaaatgaacatgctaaccaataaagaatagcaacaattaatccattggcaataaatggaatcattaatacaggattaaacataattggagcaccaaataacgctggctctgaaattctaaaaatactaggtacaattgtagcttttccaaaagctttcaattgttgtgattttgctttccaacaagataaaacacataatccaaatgtgtttcctgttcctcccaaaaatccaatacctaatgtcataaaaacaggatgaaaaatcggtgcttgtccttttgcaactaatgctgcattagctgtaaaagctgctgttgtaataggagcagtaagcgccattgtaaccatttgcccatgtacaccacaacaccataataacagcataaatgcacataagaataatgatccaggaacagagtcaacggcagcaattggagttgctaaaactttttcaataagcgctggaatcgatactcctaaataattactacttaacaaacttaaaatataaaatatagaaacattgataaccataggtacaattgttctaaaagaatttgttaatgctggtggacaaatttctggcaaacgaattgtaatattatgtatttcacagaatcttgtaatttccactgttaataaagccacaataatagcagtgaatagtccttgtgcacctaaatatgtacaattcattaataatgaagttgttccgtctgctaaagctaaataattagcaggtgctgcaactaataggaaaacaacaagagctgttaaaccactagtaatacctttcattgaatatgacgttgctaaattatcagcaataacaaaagcaactgccattgctagtaatcccattgacatattataaggaactaaaattgtcattttatattttgttgcaaaattaagccacccagaaaaaatagaccaaattcctcctgattttaccatatctgcagttaccggtggattagcaataaccataaataccgctccaacaaaaatcaatggcaatactgtcataaaacctttttgcattgcagataaatgtctttgttcccctaatttatcagcaattggagacattttatcttcaacaaagtgcataaacttatccatttatttttcctcctttatcattctttttatttcttttataatattttcaacattccccaaagcataatctgaaggattaataacggccgaaggtcgatcagttactgctttttgaacatctttaattttatatctcatttgtggtcccactaataagacatcataatctttataaacacttaaataatcatcaattggaattgcttttacctctaaatcttcgttattttgttttgcccattgattcatcttattcattaaaatgcctgtcgacaaaccattagcacacattaataatactttcataaatcttccctctctttaaatttggtagtgtcaaagtaaattgaacactcgatcgatcttttatttctttttacttaacaactgtagtataaaatgtaaccgcttcttattcaaataacctattttgcctattttattttatttatacactttttttaaaatttatacacttttttcttcatccctatttatttcttactttaatttatatttctataagcaataaatttttatctttttattactattaaatattttttatacactttatacactaataaataaaaaaatagcttactttacaataagctactaaaataagtattaaatttctttgataatcataatcaaacttgcaatatcagaatcagaaaatcgaatatgaaaaggttcttctattatctctaatatatcatataaatattcataagtttttttatgtgtcaaaattatatttttataattaaattttttaggaattggaatattatcaaccaaactacagataactccactaagatgcataataatccctatctttttatcataggacaatttatactgatgatccaattcctgaataaattttggcaatacttttttcaagatatcaatatcaatattaggtgcttgcttctcaatattattaaatattaatgaatattttattttcttttttatgacaatatcttgatcagaacttgaaattaataaagttaatttatctaatggcgtattgaataattgagttattgaaataaatttaacgccatataattgaggatcaaatggtcccattgtgcataaaatattatataacttttttaattcattaattttaaacagtaattctttttgattgctcattgataatggaaaaatatcaatatcttgtaattccaatgaatcttctaaatatttttttatttgaatagcaccaccttcgccattcatacataaagtgataataatatttttctttttttggcgataatagttttcaacaatagtaggaaaataatgttgataactttgttccaatccagacataatatcatctaaattatcgttacaactcatcttttttacagtttccaaggcaagtattgtggagggggcagcaataaaacgaatatctatacctgtttctttagatattaatttacccatagtttttacagaacccatatcatatataagtaatacaccctttcctctattaattttctctatcaatgatttcatttcttcataagcgacttgcattttcttttctaataaaagatcgtatgagtaaacactattactatttgacatttgtttaacaacaccagcaagagaatttgcaacgttctctccatgcatagcaatcagtaatactggtttattttcagtttctttcagttgattcaaaagtaaaattaaaactacatttatcgcttcacctaatggaatggatattttatatcttttcccaatattttctattaattttaaacttaatatatattctttttgatatttatttattacctgatttaaatcaaagtttatatattcattttgattattatttattatttttgtcaaatgaagtgataaaataagaaagacatcttgagtaaatattctttttaatttttgtgatgagttatctaaaaattcttttactatatctataatatcttgtgaaacatattttccaatggtcaactcatctattttttctttatcaatatattgcctataatatgatatcaattgttcatatctatttttcaataaaagagaggtatcagtttttcgtgtgccttgtttttcaagatgttcataaacagtataattactttcttttatttttactttttcaatagtgtcttttgaataataatataaaaaatcatgtgaaataattttatttagttctatgtccttttctttataaaaaataaatcctttttttacatagattggaaaatcgtcaagataaacataaacatttgaatcattatctaaattcttcaaaaaagcatgtgaacatgcactagaaatatcatttataagttgttttatattatttttacaatgataaagcaataaacattctaaggtttcaggttcaacaacaaacgatttatcgatttttcttgcttcatttttaaaacattcttgcactatttctagtctttcaaccaatcctcttttatctaaagaaggtaaatcaatttttattgatatattatcaagagcattgctttttaaatcattttcattaaagtaatcagatgacaaaacaaccataaaattattttcttttattgaactcatttcaattaaatcatatataattgatttatatttttccggtattaaatgaacgttatcaaaataaatcattccgttttttgctttatctatagtagattttctataatcaacaaatatatttttaatcatagtttcatcattcataaagtacttacaatttaacttcactaattgcccactttgactaacaagccctttttctttgcaaaattcatatatttttttagcaaataaactcttacccgtaccactttcccctgtcaataaaataataggttttttcccaggatataagagcgttgatttaatatcttgaatgggcttagcgaggcttccattaacccctataagttgattaaagattagatcattttcatctaatttattatgtattttataaagcacaggtctcccagatattttttctaatttgttttctctaactaactcattcaaaatagcagataaattagaacgttgaatatttaaataacttgctaattctttcgttgaaaataacattttagagggattattttgatttttttgtgtagatagtttatcgatataaaaaagaacttcatatttctttttcataaaatttctccttttctaaatatattcatattataaaacaaaaaaataaatatgcacacttttataaaatctatattttttatacgcctttcaattctataggtactttaactttcgcataacgtacttttttaccactttcttgaaaatagtaatttggataagttgctgttgcaattccacaagatttaatattgtgttttttcaaataattaaaaatatctctaaaaatttcagtatttgggtattcccaatcttcattaataacaaccgtatttaaacaatgtctccttggcataacttttgcatcttctaaaaattcttgaggaatttgattataaataatttctggtattacaaaaaaccactctgttacactttgtggagaatcacatatattttctacattagttacttgtgcttggttaataaacggaagatattcaaataattttgcataatatcttggattatctttagtaaaacatatttctgattgagaaatttttgcatatggcaataaatagcatttaggttcaacagtaatccaatagtttccaatattataaaagtctatttctgactccatttttaaagttgttaaataattaataagatttttagtttcttttacttctagctctagttcatcaatttttttatttaaaatatctgttattttagaaactggtataccttcaacatattctaccgattctttcatagaatagccaatttttcgattatatatacaaatcaataatgaaataatatctctattgtctagatcacgataattatttttacttgttctttttggagtaataactccttctttttcataataacgtattgtatctgtagagattcccaacaatttagctgcatcactaattttcataatctaaactccttaacatttaagttactcctatgttttattgatatagaattatatcatacaaaatttatttctgcaatttcatgtatatttagaagcaatcatacctaaattagataaataaaaccttccttgactatagagttactccataaattataatttatatataatcaaatttggaggtagaaaaatgaaaaatcgtattgtattaattactggtggagcaagcggaataggaaaagctatggttcgcatgtttgctgatagagggtgtcaagttattatttttgatgttcaagacgataaaggagaagttttggcaaaagaattatgtaatcaaagaaaaaaagttgtttataaacatgttaatttatttgatattgatgaaatcaaaagtgcctatatatggataaaagaacaatttggaaaactagattacgctatgaataatgcaggatttggtattccagcaaaaccacttgatgaatgtactagtgaagaagtcaataaagtaattggaatttgcttaatagctgttacaaactgtatgattgaagaaataaaaataatgaaagaaaatggttttggacgtattgtcaacactgcatcaggtgctggactattaggggtcaaaggaaattcaatctattgtgcagcaaaacatggtgttgtgggtatcacaaaagcagctgcacttgattacgcaacatctaatattaccattaatgctattgccccaggtactattgaaactgaattagtaaattcacttaaagaaattgcgcctgaagcttataaacaagcagaagaatcaaacccagctggtcatttaggaaaaccagaagatattgctaatgcagcactattcttatgtgaagatacatcatcctttataaatggtgttatacttcctgttgatagtggttgtgtagccggaaaataataatatagttctaataaaaaaaattctaacaattgtattgtaaaccatattatatttataaatgactattttcctacaatagctaactcttaaaaatagaaaaggtaaggcgtaccattccttaccttttcgttttgatgttaattgcattccaatttgcaattggattatagcatctaatattttaatgtgcaagttgatttcaaaatccaatttgttgcatatttgataactttgttacataatagtcgaattgtcaaaacaatgcaaaataacttattacacattatattttttctttacctaaaaacaaatcaatagcatttatatgatgaacaccttcttgttgatcacgaaatctatctaatgaaacaatatagcgaggataaccatcccttatttttctaaatggtcggtactctctctccttaatccgttctgtggcttttatatcctcaccttgcatggtataagtaacttgaatatatgcgtaatcaccactcgtattccgtgtaataaaatcacattccaatttacctattttaccaatgctaatttgataatcttggctcgctaaatataaataaaccatattttcaagtgaaggtccataactcaatctattatccgtattcatagcaaaatatatagccaaatctgataaataatatttttgttctcttcttaaagattttttacttttaagatcaaagcgattacactcatatattatttttgctttttttaaatcttcgatataacctctaactgttgttgcctttgttttatatccttccttttccaaacattcaagcagattacttagcgaaaatggtgctgaataattatttaaaagaaaagattgtactctttcatatactggaacatttgaaattctttttcttgttttaacatctttttcaaaaatttcagatataattcctctagtgtatgtttgccttgcttgaatatcatcaaactctatagtttttggaaagcctccatttaaaatatattcttcaaactcaacatatatatcttgatctattttctttttaaagaatcgtttcatttctaaatactctgaaaaatctagtgtaaaagtttcaaagtttagatacctacctgtaagttttgttgaaatttcatcacttagtaaataagaatttgaaccagtaaggaatattgaatatccttcttcagcatatgcatgaattacactttcaaacccaaaaacattttgcacttcatctataaataaataataattttcatcatcacctagcatagattctatttttgtttcaagttcttcagaagtttttatatttttgtaccctcttctatctaaaggaatataaataatttgtgtttttgggattcctctatcaatcaactcattcataatagcttttaaaataaatgattttccacaccttctaatgccggtaattacttttataatatccgaatcataaaacggacggattttttttaaatacttttctcttggatacacattattaaacatgatttttcctccaatctttaccactatcatagcataaatcctaaattcatggtactattttataaattttgttatttaaagtaccgtgagaagcacttttattatcatagagtatattgatataatgaagcattttcacacgttatcatttattatacctacacaaatataaatttctttcaaatttacattctactatattccaatatttcaaccaacatctaggtaattctattttctacccattgtaataatattattgatttcttatgataatacaaagtttcaaatttaaccattctttactatattcattattgtcagtatatccttattttaaaaaaaagaagtattcaaacttcttacaaagttaaaatacttctttagatatctcataaaagttattactaacattttgagaattacaaaacacgataaattaaggaagatagcgtaattttgttgcatataagttgcattgtcaaaacgctttaaaactttattaacaaacctaaaaatatattattaattttttatgttttcagggaagaacaatatcaataattaatctatacaaaaaaataaatatattgtatatgtatattttaaatttaacttagcatttcatattcattatcgacaatatttgatataattactttgttatcgtcctcccctgaaaggaggtgatacaatgatttctaacttaataatatctgtcgtggcaggtgtattagtatactacatatgcaaatggttggacaagatattcaaacgataacgagcctagtactaagaacactctaaaatttcaaaaaaggtaagaatctgacacattcttacctttttgcattgatacaatgatctctaacttgcaattagattatagcatttagtattttaatatgcaagttgttttcaaaatccaatttgttgcataattgagaatatttattacacaccgaagaaaataaacaattcaaatatagaaattactatgatagctattttctcccattaatggtacaacttggatttgatcaaacacctcattgttgtagacatacctgtatttcattattagctgaagcgaaagtatctcctacatatcaaaaaatgattgttggacataaaggagcaatgagcttgaccgaaaaagtttatacacatattgatattaatttgttgattgatgcagttaatagtatttactatccagaaagtataaaaaataagtaatatgaatataatgtataagtcaatattaataattgacttgcacacttaattgtgtataatttatttgaaggtagaaattaccgaacagtacggctcctaccgccacaagtgtagggcgttaaagtgtggaaggatacaaatccttccttttattttacaaaaagggaatgtgattaaagtgaaattttatactatagatatagattatattaaatacttatattcttatgattctgaagtttatttgaataaacaacgtcatgattatgaaaataaaccctatgtaggaatcattatatacaataactcaattccttattttgttcctttaacttccgcaaaaccaaaacatttaaaattgaaaaataatggtgctgattacttggttatttacgaaaacataaacaaaacagaagtacataaattagatattattaaagatataggcaatggcgaaatcaaaaaactattatctgttattgatttaaaaaaagcaattcctgttgcaaataactgttatcatgaaattgatatacgtaaccataaagatcgagacttacttgcaaaagagtatgaattttgcaaaagaaagaaaaaaacaatttttgataaaaccataagtattatcaattatcaaaagaaaacaaacataattaaatttgcttattgcaattttaatttattagaagaaaaaatgaacgaatggaatgacactcattaggtcattccatttttatttgttgcatactagttgcataccatttttattttacaaaaaatgaaaaaaacccaaatcgagttttccccataaatataagggttttgccgatttgagtttctttgaatttctctgaataaacgtataaattaacgttttgagaattgtggagcacgacgtgcttttttaagaccatattttttacgttctttaacacgtgaatcacgagttaagaatcctgcagcttttaatgttggtctataatcgtcaccagcttgtaataaagctctagcaacaccatgacggattgcaccagcttgtcctgagtaccctccaccataaacattaacagttacatcaaatttgtctttagtgtttgttaattctaatggttgattaacgatcatgtttaatacgtctgatgctaaatattctctagcttcttttccattaataacgaagtttcctgtacctggtgttaagataacacgtgctacagaagattttcttctacctgttcctctatattgtacgtttgccattatctttcaccttaccctttcactttcatttctactggattttgtgctgcatgaggatgtttatcaccagcataaacaaataatttcattccttgttttctacctaaagtgttatgtggtaacatacctttaactgctgcttcaacaaatcctgttggattttgttctaagaattgtttagctgtcttaactttaagaccacctaaccatcctgaatgacggtaatatttagtgttttctaattttttacctgtcataactactttgtcagcattgataatgattacataatcaccagtatcaacatgtggtgtgtaagtaggtttatttttccctcttaacactgtagcaacttctgaagctaaacgacctaatgtttgtccagctgcgtcaactacataccattttctttcgattgtggcagcatttgccattgttgtttgtctcatctttttcttttctcctttgtttatccttaccggggactttaaaaggtttttgcctatgaaacctttttaattatatgaaatcacaatatcaatgtcaacaaaataatgcgacaaaatcgaatattttttattctaaaactatcttggatctacaggtataatacacgctgcaacaacataggcaagaagtcctgttcctgcatataaacaaagcaaaccacaagcaagtcttacaagtgttggatctacatcaaaatattctccaagtcctccgcatacccctgctaataccttatctttagttgaacgatataactttttattcattattattcccccttaaaatgaattgtgacatttcccatatctgtatcgatatcaatatttttatttcctattacttgacttgcatcacttatatgaatagaactcatacttccatcttttgtcactttatattgatctcttgtatctgtcatcactaaagatacatttcccatatcattttctaaatctaagttatacgtatctaaatttgaaatctcaagatcccccatatcattagaaatatcagtatttcctttaacaagtaaatgtttgattgttactttacttgtatcactttccatttctaattgattgcattgtaaatcttcaattgtaatctttgaggcatcaatatctaaatcaatgtgattaaattgaatatttcttggaatatataaagtaaggttacttgtttcttttttatgagtaacacccgtgaaagaaatatctgcaacttgtccattatatttaaaatcataatctttattaacatgatttccttctactttaattgtattcccatcataataaacgattttaccatttaatgctgataattctaaatcaaggttacaatgagcatcaacacctaattccaaattaacatcttttgctttaccaaaagatttaaatttaacataattcgttactttttgtgcttcaccaggtaattgatctaagccattcatcaaaacaccaccaacgcataaagcaagaccaagaattaatgttacaagtgcaatacatttataaattttcatattaacccaccaccttattataaatatctttacctaaatcaatgagtgctctaaatgcttggggtaaatatttaaaaatactgactgtcattaaagaagttaaataacttaaagaaaataataataaaccaacacctaaacaaataagaccagcagcaattaaaccatccataaacattttaatagcaacaacaactaaagcaactaaagcacataacaatccaaatgtaccaaatataccgatacatacaattgaaagaaataaaccaaacgctgctactactaaaccaccaacaccaccaattgttggtaaaataagtaaaactaataaaacaacaatgattcctcttaatatacgtgtatttctttcattataatgatgaattacttcttcattttcttgctcatttatatcaagtccctctttaattgtttgtgcaactttttcaggtgttcctaattcatctataacttcttgttcatgttcacttcctgcatcttcaaagtaatcacgataataattaagtgcttcatctctttctattgaatctatatcttgtaataatttttccaattcatctaaaaattgttccttattcattattatcccctccttttaataatgaattaattttttctgtataacttatccattcatttctatacatctctaatttattctttccattatctgtaattctataatatcttcgatttctaccatcaatttgtttatcatatgtctctaaacaatcatctttttgtaatcttctaaggacaggatagagtgtcgattctgaaacatcgattccttttctcacatcttgtgtaattttataaccataggttccttcttcttttttagcgacaacacttaaaacaatggcgtctaacaaagcagcccctgtattaaatatcatatttgccctcctattctttttacaataatattatataacgtatagtattatattacaacaaatttgttgataaaaaaataatgtgctaaacacattattcaaaaaattctaaagttaattttaaaacttgtttaatatcagatagtttatcaaaattatgattgccatcttctatcgaaacaaactttgttcctttatgaaatagtttcatgtatttgttactgatttcataaggaactgttgtatcttttgttccatgaatcacaagtaaatcattttgataagtatctaattcttgataaaaatctctttttaaaatatcttctacaaaatcatctgatatttcatacccaccatgatcataagttttcgctctttcaacttgtcctgttaaataatgaagcgcatctggtaaattgaaagcaggtgcccataagaccatctttttaattacatctggataaagcttagcaagttcactagcaatagcgccacccattgaatgacctaaaacatagatttcagtacaattttccatttttaaacattcttctaaaatcactcttgcacaagaaagttcatcttgaaaagtcatatcgacaaaattaccatcactttctccacttcctaaaaagtcaaaacgaaatgatgctattccttttgattctaacatacgggataattgaacataagaaaactttgttcctgttttttgtcccgtaaagccatgaaaaatcaaacaaaccggatgtttatcttgattaggtttatgaaaaaaacctctaagcgttccttttggtgttggtatttcacaataatgttgcattttaaataccctcatgtgctttcttgattcttcgaatgccacccattgtgacatattgttttgtaatatcgatgatattttcttttttaaaatctccaccaataaataaacatgtatccataatttcatttgttacaattgtaagcatttcatcagataattcctctggtatttcatttcttacaatttctttacattcatctatatattcagttttatcaatttctgtaataccttccatattaatacctccatgtatttttcattataacaaataatatgtctaaatgatgaatttatcaaaaaaaagaccaaattgttccattacaacaattctaattaatctttccatataatgaaaataagaacactccatactccgttgatactatgattatagcgtgttagtagagaaataaagaaaggtaaaaaatgactaaaaagaagaaatatatttatattaatttaaaaaataccagggaggataaagatttaaaacaaaaagacatagctaaattgatccatgtatccccgcgtacatactctcactatgagaataacgaaagagaaatgtccctcgatacttggaaattactttctaaacttttagaaaaaagtattgattatctaagcattattgaagaaaaaaagaaagataaggagtaaaatctccttatcccttattcataatcacaagtataacctttatgatctaattctaatttaataacttcccaatcatttaataatgatccaagttcttcttttaagcgaacaacacccattttatcttcttcacgaataactgccattaaagtaggtcctgcccctgataaataacatcctaaaacattttcatcgttttctaaaacattcataatttcatcataattatgaatcaacttaccacgataaggttgatgtaaacgatctttaaatcctaattttaaaccatcatcataaccattaatcaaagaagcaacgacaagagctaaatgggaaacatttttgattgcatcttgacgatctaatgtttgtggtaacactttacgtgattcttcagtagataaagtaaatggtggaattaaagctacaaaacgatattcatgttttacaggaacatttaatgtaagtacttgttcttcttccatgaccgaaactgttaaaccaccaaaaatagctggtgcaacgttgtctggatgtccttcaatcttggtcgcaagttcaagaatttcttgtcgatcatctgttttgtctttaaaagcaaatgctccaacgattcctgccacaatacatgttgaactacttccaagacctcttgtataaggaacttgactttcacaatgaatattgacacctttaaaatctaaaccacagctttgagctgcttggctaaaagcttggtatgttaagttttcttcattacaaaattgtgttggacaacctgtaatatttaatccaccttcatttaattcaaaagtaaaggtattatataaagttaacgctaatccagcaacgtcaaatcctggtcctaaattggcacttgttgctggtactttgactttgactttcattctttaaagtccttccatttctgatttaataaaattaataatttctgttttatcaatatgtgttttatgtagcacttctctatccttaattccagctaatggtttaggtactgctacacctgttttttcatttaatttttcaattgcatcataaacatctaattcttcattgaataatgctttataaacagattcagggaatttatatggtgaagctgttgaaagtaagattgttttagtttgatctccagtttccttttgatattgttttaatacaccataaccacacgctgtatgtgtatctaaaacataaccattatcttcataacaatctttaattgtttttaaaacttcttcttcatttaaatatcctgctttaaattgatcttgaatatgtgcaaatgtttcatcatcaacttcataaataccatctgcttttaatttttccatgtattctttaaccttatcaccatcttttccagacatataccatacaagtctttctaagttacttgatactaaaatatccattgctggtgcatttgttttaaagaattccctattagcatcatatttacctgttgtaaagaaatcagttaaaatattattcttattagatgcggtaataaatttattaacaggaagacccatatttttcgcaaaccatcctgccaaacagtttccaaagtttccactaggcacacagaagtttacttgatcacccatttcaatttctttatttcttacaagttcaaaataactatggaaataatatacgatttgtggaatcaaacgtcctacattaattgagttagctgaagataagaaaacatgatgttgatcacttacttcttttaacattttatctccaaacgctacttttacagcactttgagcatcatcaaagttaccatgaattccaacaactttaacattttttccttcttgagaaaccatttgttgttgttgaatcgcacttactccatctaatggataaaatactttaatacatgttccttcaacatctttaaatccttctaaagcagctttaccagtatcaccacttgttgctgctaaaatcatgacttcacgatcttcttttaattgttttaaagataaagtcattaaatgtggtaataaagataatgccatatctttaaaagcagctgtttgtccatggaataattcagctacataaacatctcctgctttttttacaggaacaacaatttctggaaataaaccttttccatatgcatttaaacatgcttgatggataagttctttaccatcttcaggaacaaaagttgaaatcacctctgttgctaaatctacataatttaattgaactaatttatttaaatctaatttttgaaaatcaaaattaggaactaacaatcccccatcatcaccaattccttgtacaattgcttgatagaaattgatttgatcttgatgattacgcgtacttacatatgtcttattcatcgctatatcctccaataattgaatttattatattgaatattgtatacaaagtcaacaatccaagattttattattaatataatataaggaaagaaactatgagaaaaaattgactactgtatacaatcatgctattatatcaaaaaagtaaagaaagcgaggcttaactatgataaccattaaaactattattgatgcatttaaaaaataaagctcaagaataatggtttgtttatgttaagttttcaatagaccatttggtctatttttattataagggggactatcatgaaaataggtgttattggacttggtactgtaggatatggggtcattgaaattcttacaaatgaaaaaacacgtttagaaaaagaaatgaaacaagaaattgttgttaaatacgggtgtggtcttgaagaagtagacttacctaaggaaattatctatacaaaagattatcatgatgttattaatgatgaggaaattgatgtcgtggttgaacttattgggggaacaacaattgcgaaaaacattatcttagaagcattaaataacaaaaaacatatagttacagctaataaagctttattagctcattatggaaaagaaattttccaaactgctaaagcaaatgatgtacatattttctatgaagcttctgtagggggaggtattcctgttctagcaagtcaaaaagaaagtttgattgcaaataataccaaagaaattgttggtattttaaatggaacaacaaactttattttaactttaatggaaaatgaaaatcttgattttgatgaagccttatcaattgcagatggtttaggatatgttgaagctaatcctgctttagacttagatggaattgatgctgctcataaaatttgtatcttagcgcaaaatggttatcaaaaatttgttgattttgatcaaattcaagcaagtggtattcgtaatgtgacaaagcttgatatggactatgctaaaaaattaggttatcgttttaaaatgattgctcaagcaaaacctgttaaagatggtttaggaattgatgtttccgcaacacttgttaatttaaatgaacttgttgctaatgttatggattcttacaacgttgttgaaatcgataacgattatgttaataacatcatctattatggtcgtggtgctggacgttatgtcactgcttcagctgttgtcagtgatatcatgaaaacacaccaagtagaaagatggtcacatgattatgaagattgtaaacatgtttaccctatttcttcttcacgctattatgtaagagcatctaaacctgtagatattccttatgaaacatactatagtgaaaaagatgatcatatttatataacagaagaaattgaattagctgatttaaaaaataaattaaatgatgaaaatgctgttattttcaaagtaagaggataaggagattataaaaatgaaaaaatttaaaattgctattgtaggtgctactggtgccgttggtcgtgaaatgttaagatgtgttttccaatttaactttccttttgaaagtattaaattattagcttctgcaagaagtgctggaaaagaaatcgaatttgaaggacataaatttgttgttgaagaattaactgaaaatagttttgaaggtgttgaagttgctttctggtctgctggtggaagtatttcagaaaaatatatgaaatatgccgtagatgctggatgtgtgaatattgacaatacatcacactttagaatggatcctaatgttcctttagttgttcctgaagtaaatggtgaagccttagtaaatcatcatggaattatttcttgtccaaactgtacaacaattatgatgtgtagtgctcttacaagattaaatgatgaatttgatattgaaagaatcgttgtttctacttaccaagctgtatctggtgctggtgttgctggtatggaagagctttatcgtcaaagccaagaagttttagatggtaaagaacctgttgctaaaacattaccttgtgctggagataaaaaacattttccaattgctttcaactgtattcctcaagttgataaatttgatttatcaaatggatatagtaaagaagaaatgaaaatggttaatgaaactaaaaaaatcttcaataaagatattgaagtcaatgcgacttgtatacgtgttcctgttttacgtggacatagtgaatcaatctatattgaaactaaaaaaacaatcgatatggataaagtctttgaattattaggaaatagtacaggtatcgatttatgtgatgatttagctaaccaagtatatccaatgccaacaagctttattggtgatgaattaactcacgttggacgcgttagaaaagatttatataaagataacgctttaagtttatggattacaggtgaccaattaatgaaaggtgctgcttataactctgtagacatcggattaaaaatgattgaattaggtttattaaaataaaaggcaatgacctccaatggaggtcatttttattgttcaattgttttaatgacttttgctggaacacctgcaatcaggctattgtctggcatatttttagtcaccactgctcctgctgcaatcacacaccccgcaccaatggtaactcctggcatcacagaaacattggccccaaaccaacaattattccctactttaattggtaaagctttttctagtccttgatttcttcttgtataattcaatggatgattcgctgtataaaacccacaagaaggaccaataaaaacatgatcacctatttcaatggatgccccatccataaaatagttattaatgttcacaaaaacattctttcctaattttatattttttccataatccgctgtaaaaggacttaacaaaacaagattctctggaaaatatcctaaaatcttttcaattatttcatttcttttttcaccacttggttttaattgatttaattcaaagcataaatcctgacaaactaatctttgatctatgagttcttgatcattattcgcatcataccataaacctgcttccatcttttctttttcagtcatattcaacactcctttttcaactattattatcttttaaataaaatatttcaacaaaaaatataaaatttaccacatgcttttcatcgtcaggaacaaatgctttttccatatcatatttttgagacaacttgttataacattctttacaaatttgtggtgctacaatagcttctctaatttcactaggaatttcccaacgcccaagtacaacttgatcttccttttttcaatttttttcagacaatttccataataatcttcataaagatactctatagtttcatatttattcctatcatatctacatgaactatcaaggcatgcattaataattttcttgcaagtatttacgcttatctcagatttttaaaacatggtaactgctgtttctacaacctcattcattccatatccaataacatgattactcatcatcttcatcttccttctgccttattttatcatcgttctctcactatttcattgtctggattgcccaaacagttgacaaactgttttatactgttatatactgtttatagatggaggaggacttatatgcgcataattattaatcactcatctatgattccaatttatgaacaaattgtcgatcagataaagaaacaaatcaataaccacactttaaaagaaaatgatgctttgccttctgtaagaagtcttgctaaagaattacaaattagtgctcttactgtaaaaaaagcctatgattttttagaaaacggaggtcttactaaaacaattcatggtaaaggaacttttattcttgctgttaatgaagaaacacttctagaagaagcacgaaaagagatagaagattatttagaaaaagccattcaaaaaggaaaacaagctggtgtgagttatgaagaaattaaagaaatgctagaactattaatggaggagtaatatgttaaaagttaatcatattcaaaaaacttattcacattttcatttagattgttcattagaaataaaacccggttccattactggaataataggaaaaaatggttcaggaaaaactacactttttaaagttattttaaatctcattcatatcgattctggtgatattacacttttagataaagattataaagatgttgataaaaataaaattggttgtacactagctaatatttctttatgtgaatatcttaaattgaaagatttaataaatcttttaaataacacctataaagattttgatttagattactttctacaaaaatgtaaacaatatcaatttcctttagataaaaaaatcaatgaattctctaccggtatgaaagcaaaactcaatgttttaattgccttatcacatcatgcctcatttcttattctcgacgaaccaacaaatggtttagatgttcttgctcgagaagaaatcattgacttaattcgagaatttatggaagaagatgaaaaccgttcagttttaattagttctcatatttcttctgatttagaaggtctatgtgatgatatttatatgattgatgatggcaaatttatattccatgaaacaacggattgtttattagatcaatatggtttgttaaaattaacagaagaacaatttaatcaagtagatcataattactttataaagacgagaaaagaaaattatggttatactgctttaacaaatcaaaaacaattctatcaagaaaactatccagaaattattattgaaaagaataattttgatactttattttctatgatgttaaggggtgaataaaatgaagggactatttattaaagatttttcatatatcaaagaaagcaaattactctttctctttcttgttttatttggttttggctcttcttatttctataagaaacccacctttgttttaggttatttcagtgtatttccaggtatcattttaatgagtacaattagttatgatagtatcaatcatggctttacatctttatttactttgcctataaaaaaagaagattatcttaaacaaaaatatagcttaggtattttattaggattactttttctattctttgcgatttgtatttcaagtataggttactatcgtattcaacaatcatttcattttctaaatagtgatttcctacaaggttgcctactaacacttatgttttcttattttgtgattgcaatcataactcctgtaggggtctactttgaagcacaaagaagtcaacttgcaatgatcattgtttttggtggtatcttcttatttgtagctctaatttattttctaacaaaattcattggttttgatttagaaacaattattgattcacttatagaaaatcatttatctatggtaacacttgcaactgttatattcacattcatctgtaatataatttcttatcacattagtttaaaacttttaaacaaaaaagaatattaaaaaatgctccgttcaaatgaacttgagcatttcttttattataaatcacaaatccctttaccttctccataaacatcataccaatcactattgaaatcattcactgcttaagcagtgaatgatttcaatagtgattggtatgatgtttatggagaaggtaaaggaatttgtgatttataagagaaaactgtagttcgtgaggactacagtttttggactatctgtctaatgaaataacaaaaatgagatgttaaaataaccctggaaaggggttgttaaagtgagttgtcatcgtattggtctaggaatgaattcagttgttgaaaaatcaattgaaatgtttgaaaatgaagaaataagcttaaatgcttgtaagaaaattattgttgcctgtagaaatggtgtttattggtgtgatgggaatgaagatgaagctattgcctgtattattgattgttattgtggcaattgtttaagaaagattcatcaagagcatcggattcgtgttgatagaaatcggtatgatgttgtgactcattatttatgtgaggattgttatcaacatcttgtttatgaagaaagtatattaaaaaagcacgtatatgttgaaaaaaaggcataataaaaaagtcagattttctgactttttattttgaaataatttccacaccatcttctgtaacaaggaaagtatgttcccattgagcagaaagttttccatcatctgtataaactgtccaatcatcattataatttaagtgaacatgtcttgttccttgattaagcattggttcaattgtaaaaaccattcctggaacaatcaaaacagtatcttcttttgttttaaaatggaaaacataaggatcttcatgcatggtcattccaataccatgaccacagaattcttcaacgacgctatagccattaatatgtgcatatctttgaattgctttaccgatatctccaatatgacttttccatggcttgatagctttcatcccttcatacatcgcttcttttgtgattttaacaagttttttagcttcatctgaagcgtttcccatcatgaacatacgtgaagcatcagcatagtaaccatttaattcacttgtagcgtcaacgttaataatatccccatcttttaaaataacatcagaagaaggaattccatgacaaacgacatcattaatagatgtacaaatacttttaggatagccttcataatttaaatcagcagaatgtgcattgtgttcctttaaatattctcttgtaagtacatcgatatcttcagtcgacataccaatttttatattcttttcgatatgatctaataacccattatttacaacagctgcttttttgattccttcaatttgttgttgatttttaatcattgattttggaggtgtcatcactcctctttttttgtaataattaatttttttgtcaaattcgcggtgacaaacttcatagtccaagccacttccgcaccaacatttattcatttgttctacctcttttcgtatctattttaaacatctcgttttataatgtaaagaaagatgataatatgattttaatggagatgataaaatggaaattttagatatatgcgatgaattaggaaatccaacaggaaagacagtagaaagaaaaattgcacatcaacaaggaatcttacatcgtacagctcatgtttggatcttaagaaaaaaagaaaataaaatacaaatattattacaaaaaagaagtgaacaaaaagattcgtttcctggctgttatgatatttcaagtgcaggacatattcctgcaggggataactatggccaatcggcggtaagagagttgaaagaggaattaggaattgttgtaagggaaagtgaattgattgattgtggaaatcgtagatttcattttgaagaaatttttcatggtcgtttatttaaagataatcaagtaagtaaaatatttgttttatggaaagatttagaagaaaaagattttgtttttgttgatcatgaagtaagtgaagttaaatggttggattttgaaaaatgttatcaagatgttaaagaaaataaaataaatcattgtatttatattgaagaactagacatagtaaaaaaatatcttcgtgttcaataatgatcctttttaagtctatataaattccttctaaggcgttttttggaaaaaacataaagaatataaaaataaaaaaagatgcgggggggggggtaaaatatgctataatttatagtgaataaaatatgtgtagtaagggtgtgtgaatatgtattttacgattatggatgatgatcgagcgtttggcgaaactttaaaaaataaattagaaagtgaataccatgctgttgtagatgtttatcatggaatgattgatctagatcagataaaacatgtacccgatattttatttttagatgtgatatttgaaaatgggacaggtgtggattatgcgaaaaagtacaaagaaaagtttgattcacaaattgtttttgtttcaagtaaaagtagtttgatttttaaaacccaaggattaaaggcgttatgctttattagaaagagtcatcttgataatgactttaaagtctttaaacaactttacgatgaagaatgtaaaaatgaaatgaaattgatttttgaactgaataagggaatgaataaaaatcaaatggcatatataacattaatgagtgatgatattatctatgcagaatgttatgctcatgaattgattatccatacatatgaacatgaatatgctgttaaaatgactttgaagaaatttatggaacaagtaaaacaagcacattgttttattcaaatacatagaagttatgcaattaatatgaaatatatttatcgtatagataaaaatcatattaatatggttaatgaagaaagtaaaaatgaattagaaattggtagaaaatataaaaaagaagttaatgaggcctttagaaactacttgatggataaattttagatatcatgaaaaatcatgatatcttttttttgacatataatacaacggtgatgttatgaaaagaatttttcttataatgattgcttttggtgtgtgtttctttgagattcctgtagatgcttatgaaaaatctttaaaaaatgtaaaagtggtgattgatgcaggacatggtggttttgataatggagctattgaatatggttattatgaagataatattaatttagaaattgctttgaaaatgaaagatgaattagaaaaaagtggagctaaagtctatttaacaagagatagtgattatgatatgacgaaaagaaatcatcattattctaaacaagatgatatgtatttaagagtcaagaagatagatagctataaatgtgattatttattaagtattcaccaaaatgcttctggtaatagaagtgcatggggttcacaagttttttattattatagaagcaaacaaggaaaagcattagcttttgatattgatcaaagtttaaaacagttaacaaatagcagaaaaccaattagtggatgtggttttagagttttaagagctactaagacattaggagttctaattgagtgtggttttttatcaaattataatgaatgtgggcaactaagaagcaaaaattatcaaaaaaaactatgtcaaaaggtaaaagaagggctcattaaatatcatttaagaataatgactcaaaaaaagaaaaaaacagcaaaaattttacaataaaaaaagcgttgattttatcaatgtatttttatttttttaaaaaaatgtaaaaaaatatacaaaaaactgttgacgtattcttatatgcatggtatattatatgggcagttgattgatgggcctgtagctcagttggttagagcgcacccctgataagggtgaggtcgatggtttatttgtagagtttataccggtatttcttctacatctttatattaactgcttttccaagcacttttgtgcttattaaattttttctatacaattttttgaaattgctcccgtaacttgaccgtttactccaattactaccctatcacctttaatttgaattacttcatatttattattaaatacaaaacttgctattgattgaccttcataccattttgaacctactttcacacgtacactatctccacattgtaaattagttattgtttctttttgtttataaaatgtttttattaaaccatgatcataactacaatccaaaaattttgaatttattccttttatacttttcaatacacctttttttgcattagaagtaaattgatgtaataagacatttccaaatggattgtattgaatcttattatcccagttattatatccattatttgatccataattagcaatccataatgtccatgcagaaaagccttgatttactaatttagttttaaaccaatcttgattagcataaataccaacagcatattctgctttttcaatctcatcacaaaatgactttgcaattttataatacatttcattactcaaacttccttgataatcagaatattctaaatcataataaataacactcacgttataattactacatgctttcaatgctaaatttgcttctttttttgcttcactttcatttctcgcatagcaaaaatgataagcaaacaatggaattcctaatttattagcctgtgatgcattattactccattgtttatcaatatttttatcactccaaccataagaacatctagctattacaccagaaatactttctttagctttacttaaatcaacctgtccattatggtatgaaatatcaataatcaaattattcattttcattaaaattatcaatcttttttgaagcaacttctaatcctttaactaaaacttgcggaacatcgcatccagcttcaacaagattttctaatatactcctatattcatttataattaatgaagctaaaacataccatccaagaaatgccaatattgataaatcaatattaattacagctcctaattctttaaaacatactggaataacaaaagacaacaatactaaaatccattgtactaattttttcataattccttttaatcctgccattgaattttccttattattaattcttgattttatccatcctgttaatgtatcaataatatttagtaataaaaataccataaataaaatccaatgctcacctaaaaaaagagtcaaaatggttaatataatagaatataagttacctatatgttcaataaatctattcattattcatttttctcactttatctattatttttctatattttcttataattgaactatgattagcataaccaacatgtattgatataagatcaaaggacattttttcaaaatttcgtaaagttataatttctagttcatctggtaataactctttcatccaattatcaacaatagaaacaatatgtaaataatacaaataatcatttttctcatatttattaaaatcttctaatctttcaatttgctttttttgatttaattcatttatatgtgatttagcaatagaatataagtttagagtaagctcaatttcttcattagaataattcatttctcacttactcctctttttgtaatttgtaaaacgttttacaattttaatgtattacattttctaagcacaattgtgcttttctaacataaatttctattgcaaattgatgtcaagactattaataggaatttttactgatataataactaattgaggtgattgtattcatggaaaatactatatatttcaaagatatttcaaattgtgacaaaaataattatcctaataagatttatcgagttgaacattcaaaaatgctaatagaaattttagatgatcagcacattcaaggtagtgctcaatattttagtagcattcgttcaagaaataatttcattgatagcattaaaaataatattttaaaaatcagcatagatgaacttaaaaaaattcaacattattggaaaataaaaaatgaggctatagattaaactaacatttatattagttttctatacctcttttcttacttactttaaaaaagcaagtaattattttttattttacaacataaataatactattgaaatctcttaatcattaaagttttatttcttttctatacttattacagatatatactatttattttaatattcatttcctaaaattaatattcctatctatattcaaacattaaattgtcataaaattttttagaatataacacatcacattcctttgaaaaattatatagatttgtatcaaatgtaacaaaaataatatcatttgtgtttatcatattatttgttttatttataactatagattcgtccatacatgttactatagaataatctaatccatcatttttctttatttttgccccactataaacacatcttcgacacattctaatccaatatttcatgcaattttttgacattcccattttttctaattcttccactaatccttttaaatgattatcatatttttcaaacactgttttatcatctttttttaatttacaaaatagtttatgaacatattttgtcccttttacattttgtattttgggaaatttatgtccattttcttttatttgtagctcaatatatgaaatcatattttccaaaagaaaattaaataggtcatctatttctttatcataccattcattttttaattttaaatccgaataatatttatatgaaatttcatttagttttatttcacatattacacctgctacataataaaaatttcttaagagtaaaataccataatattctgcgagaaattctgttattgaaaagcatactttgattaataactcatttatttttttcacttcgtactctcttttacgttcaataaaatgattaatatcaactttattatctttatattgatcttcaaataacctcaattcaaactcaccatctgtatcattcaatatagaaaattttacattatacttatttttaaatttaataatttgatcataataataagcaaattgatcaatttttttgtttttttaatactttgccaaaaaatctcatataatgtttgagatgtaataaaaagataattcgcatttttacattcatcataaaacttactttcgtttatttgtctattttctaaagaaatagtattactacactccttttcattcctcatcaaataaataaaagcatttgtatctaataatatatttttatttttcaatatattccctccacatctttaaaaaatattatcctttcctccttactatagatatatatcatatattataataaacaaatacaataaaatataaaatcttataaagggtataaaagactagaaatctaatttctagtctctattgatacatatatttgttataattttgttttaatactttgcaattattttaggaaatgtaatcaattaaaccatctaaaaaattcaaatatttaaagagtttatctaattcttcattacaaaaaactaatacacctatttgattatataacattttagatatattttttggacattcttcatattgatgtatcaattgcaatgtaactatagcagattccagttgtttctttattcctttttttaacaattctattgtatctgtcatttcatcaatatctttcataattcattttctcccacaggaacaaaataacatatactgataaatattataaaaaatagaacaaattggtctttaatcttaataaataattctttattacttaaagaatcatttgattattaatttgacccactcaatttctttatcatatcctctgctgaataacttatatctgcatcattctcatcataatattcaatatcatcaaatatttctgacatttgataatttaatttttcaaattcttttaatgacactaaagatgtatttactttaatttgaggcttaaaatattttgggttcttgattataaattctaagtttggtttaatttcatcaacatgttcgtactcgttaatgcttccattcatttcaacaataattccaacaggttcaacacctacaattttaaatgcattaataaaatattcattgaatattttattgtatttaaattctttttttatattatttttattgtcacaaactatattgtttccgttcgtacataattcaataaaaatccatttgtattctttatgaacatactcaatgctatatgtttttccatatcctgcataacctcgatgatactgatttcctggtacagttaaatcaacatcagatataatcttaaatttcttatactcttctttgaaagttctttgaatatattcataaaacaatgtcctcatttgttcttcagaaacactaggagtagaaacatatacaatcaatagaacaaaaattgaaataaaaagaataattattcttttcatactaatttggagtatttataatcgcctttaaccctgaaacattttcccagccatttgtgtcactgctaacccaagcatgataattctttgtatgctgtgcaattttgaaatccctgtaattacttttttgtgagccaatagctgttacaaaagcaacatgattccactttccatcagcttcagaatcatatgcaataaactttcctttagaaactttatttgaaaatgttttaaagctggttgtagagtaagcaactttccaagttttgacaaatgtatccgcccttacccaagacgttgaataactttgagtagaattataataccaattacttcggttactaattcctcccgctctagcaatttgagaagcaaaatttgtacagtccccattaataaagcatgcataagaatagttatagctacttgcccatttatcagcataatttatcgcattggtaacattcattgtagtacaagtatttattgttgcctttctttcatactctttataatatgggcttgtataaggcataagtactgccaattcatccattgaataatcatctgttttaactatttgtcttatttcattattaagatcacaattatcacaaacattaaaaaaagttaacaaacgttgtgtatggaaagattcacttatatgatttaaactaatttcattttctaaagcatttttataatctaaccaattacttttttctaggttatctagattataattcgttgacaatatacttattaaatcatgttctagactattaattgttttaaaagcctcttcattatcagaaaattcccagtaagtatcattccttttttcattaagatataaaacaggacctttttttagttcgataacatctgctatttcttcataatatgggcattcttgattttctattgcaaatacgcaaacagtagatgaataaaataaagttaaacttattagtgctgcaataatttttttcatagttattaatcctttcttgtaattaaagtaagcgcttccctcaattaaagtatatcatttaacgagcgtatgtcaactattacttattttatataggtattgaattaaatatggtatacatttataattctatataggtgatattaatatggcaaaaaatacaaaaggtttttttaaaatggagatgttgctattaaaaataatcagtgagggagactgctacggctatcaaatagtccaaactctagataaaatttcaaatggcacaatacatatagccgaaggtacaatgtaccctattctatatagattattagatgaaggcttaatcagtgatgaaaaaagactggttggtaaaagacaaactcggatttattatcatattgaggataagggcattacacatatgcagaaactatatgaagaatatttaataatgattaatagtattgaaagaattatggagaacaaatatgaaaatgaatagaaatgtaaataaatatatcaaagattgtaaacatttttttccatttttatcaaaaaatgaaaaaatttttttaaaaagattaaaagtaaatattgttgaaaatatcgattcaactaatataacttatgatgatttatgtaataaatttggttatccttctgatattattatttcatattttgaagatcaagacgctaattatttaatcaagcaatctcgaataagaaatattttaaaaaaaacaatcattatatgtactgtagccattttagtatgctgtttatggcgtggaatacttatttataaaagttaccatgattcaaaaaattcaaaagtaaaacatatagaatatacaatagaagaggtgaactaattataaaaaaaattattacattattaactatagtaagcagtattttgtttttatcattacctgtatctgcattggatcaaaaaaaagaaataattaaattagataacggatattatctagaaacaattatagaagaaacatccatggcaagagcagctaatcaaaaaactgcaagaaaaactgcaaattacaaaaatgctcaaggtgcaataatgtttagtgttactgttacaggtacatttacatatactggttcttcgtcaacatgtacaaagtcagttgctgaagcatcatctaaaaataccaactggaaaatttcttcaaaaagtgcttccaagtcaggaaataaagctactgctaaagcaatagcaaaaagatatgtagatggtgtagcagtcgaaacacaaaattgtaccgttacattaacatgtagttcaaacggttctttaaaataataaatatatataaatagcatacattttttacatatttaaaaatattttgtactttttaagaggaaaagcaagacagttcaagtcattcttctcctcttttttattttttgaattctatttaaattttaactttatctttattttatatatttcctacttattctaagaaagtctaattttatttctcgctcgtttgaaaataaactatataaagttttcctttgcatacacatttatgccttcatataaccactcttcaagatatatctatccactattttcgtaaaatatttgaaaatttataattaaaataaccaagtattccaacaatacttttttcatatacaataattttaattcaagtactactagcttatatagtttgaattaaaaaataataaattatcattctaccttaatttagagactacttacataacaactaaaagtatacttcaaaattatacgatgctaacaagtcatattcttatttattattttataatattacctattttatatatgtatttattgacaaaaccattctttatgctatatttaagatagaaaacgttttcattaatatttattttataggaggggtgattaaaatcaaaaaatatgtatctttatttatctttttattagttctattaatacctatccaagtttttgcagaatatcagcagtttgttagaagatcagatacttttaaagtaggacaatatggtcaatttgaacaatgtgttgttattaataaagatctcagtactaaggtaatatcctttaattcatggggaaattatgcagttaaaaacaataatggatatagcatcacaatggtttcaagaaaacacgaaaaaaagaataataaattatacatttaccttacagtaaaaggttatgactttaatacaaaaaaatatagttcaaattataattttatttttacaataagttcttaaaattaataaagtgactggatctgtaacaaaattctctgaaaaaaataaaaaaagaacaatgaaatagtcaaaactgtaacattgttctttttgttatataatgagcacattacccgcataattttaatagtcaacgattaagagatgaatttcttaatactatgaaaaataatattttacgtattaactttaaaaacttctaaaatataatcttaccaaaaaaatcatctcaattttttccaaatgaaaaagtgattatagaatataacaataaataaattagtgacagaaaatttttttaaactccatacccataaatagatttgctacttaaattataacttttttctctattttacaacgtcttgatttactgtcttggttttacgtttaccttttggacttcgacctgttatgcagcctcatccaccatttagcttaatatcaagtttctgtttgtacgctcaaaagaatcactacaccacttcctccatcattgtcatcactgacaacgacttgtagttcattacacttggcggtaaatacctgtgattggtttatttccaattgaattataccatgctcggtacacataaaaagggcacagaagccaatcggtttctgtgcccgccattttttcctaataccccaaacaatctagaggggttataaaatctaaaattttcacaattactaaactcaaaaatccaataacggtactcaattcagaaatcatagacacacctccttgaatgttagctatcatattacagcccccattcacttatcactaagttctattagcaacacaacctctcgattgtgtggggcggggcatttatattgtaccgcctatttcaaagcttttcaactggcgttccaattttttataggttgtgattttcttcgttgaatgattgactaactccattaaaagtagcgtcaatgctttggctgtaaaacgttgttggagcaagaataaattaagttcgttatattttttgtcagaaatatgtaacaacttatatgtgcgcaagtttttgttggattttaaaaattcaagggtagcctttaattcttccgacaaaatacactttggataattcttatatatcgttgttctttcggcaagagatatatttttacattccgctaatgaagtattgactatcgttgtgtagttgatagttgtagcagtaaaattgcaattgctgaatttacaagccatgaatacacaatctgaaattcttgctccactgaaatcacaatccttaaaggtagttccccaaaaatcacaaccagttattgtactattattaaactttactttcgtaaatatagctccgcgaaaattagcataaataaaactttgattttgagcattgcaattaatgatatggctcttagctaaatagcgacaccgtacggactttaccattttttttttgacatttatctgtaatcagatttattctgtctattttgtaagcttgcataggtttttctccctttcttacaaattatcttgttttgtatcttaaaacttaaacaggtgaaagttctttatattcagcctgcgaatgaggttctgcgcgttgactatattgtcatgatatgagatataccatcgacaagttaacgaaacattctttttgatttcagcaaaatagtcaaagtctatttccgaaagagaatgaccaaatatatacacttcattaactatcgtcaacgagttaaaaaaagattgataatttctaataattgaagcagtatctttgtaagtttttctaaaatagccttttataatttcctttgcttcttgcaatctaaaatcttcttctatatcttccatatagatatcatgttcttctggcgcattaaaagcggtaattgtttttccttgaaaaagtgtagcgtcatggtgccctaatatgagattgtctcctcgcaaggcattaccatgaatatataaaatattagaagcaggaataccatacactttttctaacgtatccgtatagttgaagttcagaaacaagcagtttctattgagtatatttgatgatacaatgggcgatacatcagtattaatgtgtaaaatccactctgaaaagtaacgtgaaatatcttttgcaaaagccaaatcttccttaatcatatattgaaaatcgtgatttgcactatcacgccaattatcatctccataaccaagaagatagcaagaattatcttcttgtatctgttcataatccaaaaaacttaatgcttcttcaaatgaactccataaatcctgttcgggtatgtatttgcttattgcttcataaaaatgatgtttttcttggtctcgtggcgaaatactatcaagacgaacaaatctatcacatataatttccggctctttttcataagaacatagatattccataaaatcagaatactttgtatgcaagccatgagctaaatcaaatccattacctatgattattaacctcgacaacacatattccccctttctttcgaagtattataacaaaaaaataagaacttttccaccattagaccgctatccacgctctgtttccttttcccgttccggatctttatcttaccgcaaaacactgtcaatgttgcgcatgataacgttatattccttgacttgttttttcagcttcccatagtctgcatacagtactttagattcatcttgacatagtaccaagtccttgatgatttaaacgaacaatttttctctttagacataataaaaaatcctcatttcgttaaattataggcttataacctacataattattttaatgtaagaaggatttaaatattatgattaaattgttcaaatatatgttgtcattttcattaatacactgtcgtcgcttaattaacataatgtaatcattggaataaaatatccacaaattaagaaaattccaaaatgttattcatagtatattaatacattgagtaaatatataatttaaaataaagagggatttatcatattttggttatcaaatattgtgaggattagttcaggctctgtgtcaataatgaagggtgcctgagagatagcgaaagctatctctttttctttattcaaattcatatgagaacctaagatgaagaagaatcatctttcttaaattataaaaatatttgtatccataggcatttcgttttacaagcttgatcttgttgttcttgttcatggttttatataatgtactttttatgttttatgtttcttattaagaaagagtagctttgaaaattgatattaattaatttttttgaataatataagttatattaaagatgattattagatctagttaagtttaataaaaaaagaggattatataaaaatgccaatgatttaaaaatatttaatatgttaaagaaatgttattatttatgctttactataatctttttaaatttttgaatgatattatttaatattaataaagtaagttatgccatatttaggttagatatgcctaaataaatatataaaatttttcttaatgtataattaatttgaagaaggaagatggtataatgaatggctatattataaatagattagtaagaaatggctatataaaagaaaaagaacgagcgagttatcaatatggaatggatgttttaattttaaatttgataccaatttttataattctagttatttcagttgtaacaagaaatattaaatttggtgtaatattcctattattttttattcctgtaagaataaatattggtggatatcattgtaagaaaatttctaattgtacattattgtttgttttattatatatttttgttttaaaactaagcacattatcaatacaattgatattaaaatattttggaatcctttgtatactttttattatgcttttagatcctatatcgtacgatgttatagaaaataaagttgaaaattataaaagatcaaaaaaaatcattaaagcagtcagtattttaatgatagtaatattatttttattaaatgataattgtttgttaagtgcaacaagcatggcgggaattttaaatttttgtctttattgtatgggacgagttgatttaagaagaggaaaattattatgaaaaatacaccagaaatatatttaataggtcaaagaattaagagaaaaatattaatgataatgattttaataagtgtcttattaggtgtcattgtaggtaatgaatgtaaatcattaatatttggcttatttttaagtgtagtattagcattttttcaaattgtaatgacaagaaaatattattggataataagtaatcaaggtatatatactccattaaattttggaataaaaaattatttaattataatgcttaaatatttattatgtggagatgatacaggaaatatagtttttgttaactatagaactattgcatatttaaatttgtttgaaagaaaaaacaagttatgggtacaaattattcgaaaaaatggagattttatttctataactattgagtcgaaattttttaatcaagatttggtaaatgcagtaatttatataaaaagaaaaggaatagttataaatggtttagaagtattaacaataattaaaaataagataaattaatagtaaggagctaactatatgaaaaaaataattattttatttacagttttattacttacaggttgtggagtagggactactagaaacagtaagaataattctcaacatcataatatttatatgaatacagattcaaaatgtgcaggaataaaaagagtaagtaaaaaatacaaagaaacaaatccaaaggatatgttagaaaaagttgattattgttttattggaaaaataaaaaattttaaagacgtagaaatatatgaaaatgggaagattaaaacattaatgtcaatttcaattgaatcaaccattaaaggtgatgtaacaggtgatatagaaatatatagagatggtggaagaagtggaattaatgaatatgttaattatccaaaagatacatgtttagataaaaataaattaaaatctatccctgataaaatgaaagaaagttgttatatagaagttgtaccagatgcatatttccaagcaaaagaaggggaagaatatatgttttttgtgaagaataaaaaacaaatggaaatttataatgatgcgtatggaatgttgaaggttttagatgataagaatctagaaaatgtttatacaaataaaaaatataaaatttcagaaatttcttaaaagtaggtgaatatgatgaaatttgcattaaataatctttttaaacaaaagaatttaatgataatttacggattgacaattacattagttgcagctatatgttttgtttttctggctatgttatatgatccatatttgcaattagacacaacaagtgttgataaaatgtatatgggatcagcaacaacattattagtactaatttttagtgtttgtctcatgatttatacaaatatgtatgttttagaagcaaaaaataaagaaatgtcgttgttggtttttcatggattgacattgaagaaaatgattttttatcaattttatcaaagtatatttatgtatatattatttggaacgttgggaattgctttgggatataaattaacaccagtaatatttaaaaacatatattataaattacattatgtttatgatattaaaattatcaatcaatcattttatcaagctatttatatgttattgatgatgctttttatttctcttgttttaaatattggatatgtatatcgtggtaggttgactagtatgatgtcaaatacgagacaaaagaattataggaaaaagaatgtttttcaaataacgagtaagatatatcctgttttatttattttaggacttgtaatgatgtttacaacagagcatattgcgtcgggatatatagtatttagtgttattggagcacttggtggatatggaacagtaagatattttttcccagaatatattgaaaaattaaaagcatccaaatggttaaataatagtcaaagactagtcgtttttggagaactatatctaaaatttaaatatataggaatatttttagagttattgatacttatttcaataataataacaacattaatttgtttcaacttaaataatttaatcgaaatgtacagaatgattattgcctacattattatgatgccaatgattgtattttgtatcacttataaaaatttaattatttcaaaaaagaatgtaaagaatcaaaattgtatttataaattaggaattacaaaaaaatatcaaaaaaaatttataaaagaagaaacactaattatgtatggtatattatttattttaccaatgacatatatgatatccacattgggaagattttatgtatatgatggaatttcaattttaataattgcctttattattggttattttatattaaatttacttatttcaatgtatatatcttacaaagtaactaatcaattttttaggggggtctagctatgaatgaaattataatagaggtaaaaaaaattagtaaggtttatgatgaaatgacagataatccagtaatttcactaaataatatttctatgtcaatagaaaaaggagaatttatttgcgtgatggggacatctggatcaggaaaaacaacttttatcaattgcatttcaacaatggatactcctagtaagggacaagttatattatatggaaaatcaacattagaaatgagtgatgaagaaattggcaattttaggagtaaagaaattggattcatttttcaagaatataatttattggattatttaacattggaagaaaatattgcatttccattatcaatgaacaaagtaaaaaatagtgaaataaaaaaaagagtacatgaaattgctaaaaatcttggcatcgaaggtcttttaaataaatatccagatgaatgctctggaggacaaaaacagcgtactgcaatagctagggctctagttaatgaaccaagtattattattgctgacgagccaactggaaatttggatagtaaaaatacaagtgaattattggcaattttgaaaaatttaaatgaaaaagagggaaaaacaatcattatggttacacatgatgttatggttgggtcgtttgcttctagattgctctacattcaagatgggactattaaagaacaattaagcagaaaagaatttaagacacaggaagattatttctataatatttcaaaaataaattctaaagagcaactcatatcattgaaaaaataaaattacagtaaatattaaatttaataaaaaatcaatatttaagacaatattcgttcaaatttaatatgattataggaagtaaaataattgagggggagcaattatagacactaattgttctctttttttttaataatccaaaaatgataaaatattgttatttaaattagaaaatatattccaaatattaatttttgaatttactctgtaaaattttcttttgaacaaatcaataagaatctttgaaatttctaaaatactataaattcttgagaatatttttgtgttatatgacatatgattgttagataagacaaatttatatatataattaaaaaaatatatatactgaaattaagttaaatggctaggaggaaataaatgaagtaatataaaaaatatttaaaacaaatgattagattactatttttaaaatgcatgaataaaaaaggaggtaaaaataggaacatataaataaaaaatattagagtttataaaataatattatcaaaagaaaataaagaaagaagaaagttattatggaaaatatattaattgtaggtgcgcatcctgatgacatagaattaggatgcataggaagtttaatgaaattaaaaaaagaagggaaaaagattgtttatttagtaatgacaaatggaggaaattgggaaaagaaaacttataaagatagggttgatgaaataaaaaaagctttaattcatatagatgtggatgaagtcatagttggtgcgatacaagatgggtatttaaaacatgatcctgatacaatagattttttaagtaatattataaaaaaatattccattgacacagtgctttgtcagtattataaagacacgcatcaggaccatgttaatttaggattaaatacactatcgattgcaacaagctgtaaaaacttgattttttatgaatcattaacaagtacagaatttgttcctaattattatattgatatatctaaatatgaaattgataaaaaaaatgtattaaaagagtatgtttcacaaatagaaaagtataaaaatagaaatcaagatttattatcttatattgatgcaaaagataaaataaacggaataaagtctcacgttgattatgctgaagggtttattattaataagatggttcaataaaaaaggtgttattgatttgtagaaaaatatctaataaatatcattttctataaaataagaatatgtttttctatttttaacagtttgtaaaaaatatttggttgttattaatatttaagaatttttgttcgtataaattaaactactatttaaatatattgatgcatttgaacaataatcaataatagacaagatatatgagaaagttatatttttatagatataataaacaaaattgatttaataaaaaatatatttataaaacttttttgaaaataaaaaagtttatataaaaattgaaatataaataatattacagtagaaaatgaaataagcaattattaagttttttttaaaaggaactctttttatctcatttgtattcaaaagtctttagcataatatatgtatgatttatttgctcttacatgaaagattagtaattctcttcatttattttaacttgcatcaaaatatatcttaaattatgttctaatcgataaatatcctcagccattttagaaagtactttttcattttctttcttatatcttatttcttcattttttaaacgaatacgcgtcgattcttcgttttcttccaaaatttttccatagatattaagaattaatattatagctataaaaatcaaagctgtacaaaataagtttacaagcgtatcaacattatcaaaaacataacttgtaaccaaaatatatgcaacaataaataatattgaaataactattattaatgttagccatcttttagaatttaattgacttttataagatgtttttttctttaaaaaagcaagtacagctattaaatacaatatcttagataagacagtcatagcaggcatctgaataaattgagtgcctataaaataattcgcaattcgaccaataatcaaagaaacaacattacaaacaatatctataactaatgataaaaaacatatgataatactttcaattcttattttttcaccaaacatttttaaacaaacaatcaaaacacttgttacaataattaaaagtgcactactctcattaataaaagaattacacaatgttattgaggtaaaatcaattaaaataaacaaccataatttttctataaaagaacttgttgaacttacacatttatcaacatctaccatttcccatcgtattggtattttagaaaaaaataactatataattagaaataaaacaggaagacaaatctctttttcattcaatttaaatgcattataaaagacaagtcacttcacatagcgacttgtcttttagttaaaaccatttcatcttttcacagatatgataaataccatcatcaacattgttatcagtgatgtaggttgctttttcctttaaagcatcacaagcattccccatagcaacacatgtccataagtctttatcaaacatatctagatcattataatcatcaccaaagacgacaacatcttgtaaagaagcttggagaatttccatcatctttaagataccgccttttttattatcaggttggaacattaaatattctttttcaaatcttaaggaaccaagttgatctttgtttttaaaagaagcttcttctttttcatctaaagcaagatagattttataaaagttatcaacttgtttataatcaaattctttatcaagaatatacgttgttggttctttacgataacctacttgttgaataaataaatcattttccccataaacttcttgactatcattaatagcaactaaatacccaattcctttttctttagcttcttctatgatttttaaagctccttgtttatctaaaggaatattttcaaccagttttccatcaagaacaatcccattacccccattacaaaccatatgttcaaaattaaactctaatctagctttttccgctttataatgcgctcttcccgtatttaaacaaacaaaatgtcctgcttgttttagcttttctaatgcaatcttggcacttggtacaatttgatgtgtttttaaatctgtaagtgtaccatcaatatcaaagaaaaaatattttttcatactattttaaatcctttactcctgtttctaacatttccatttgtagaattgtttgccatggttggatgacttgttccttaccataaacaatactgtcatagataccatcatacacacgtgcatagtcgccgtcaactgttggaactttttcttcatgataaatgccttcatcatcataataagtaagagttccataatgttcaggaagatcttttccaaaatcactattagtaggcatatggaaaagttttaaatgttcttcttgtcgatctttactatatttttcaaacattccttttttaccataaacgataaaagaaggtcttgattttactctaaagtaacttgatttaacggatacttttaatgttccataataaagatcaagatcaaaataatcattcatacgccctgttcctaaaagttgtcttacatcatagtgaatatcatttggtttaccaaaatatgaaatgacttgatctaaagtatgacatccatgtccataaagataagacattgctggatcaaaatgatctacgctttcaggaatttcaggacgatagtaatcaaaatgcatttcaagttctaataaatctcctaatttccctgattcaatcactttttgtactgttaaaaaatcactatcatatcttctattttgataagcagaacaataaagtcctttttctttcgctaaagcaaagatttctttagcttgctgactattttccataaaaggcttttcacataaacaatgtttattatgttcaagtgcttttttagtatattcataatgataatgatgacctgtacaaacaaccaccatatcaatttcatcatctaagaaaatatcatcttgattttctgtatagttaataccttctattttatcccatacatcatgatgaatatgaggattataaatcgttttaactataaacttgtcttttctttgtaagacaaatggtaaatgataacggttggtacttttaccatttcctatatatcctaaaacaattttattatttatcattatcaaacacaatcccttcttgcattctaccttcttccattaatttagaaatcaataaagaaagttctaacatttcttgttgttttttataatctttttcttccatcattttcataaatgctttaaattcataaattaaacgatgtttcttttcaaaagattttacttcacttgtcccatcgttatagcagatttcatattctgtcatttgacttaatggacatttaacaacgattgctcctaagtttccttgaatcgtattcattaaaggcgctttacaatctttagccccaatacataaagctttaaaatgttcaaaatcaaacaacatcatcccacttgtatcaatatttctttcaatatttgccatatatttatgataaacaggtttaccaaataaatcgattaaagcatgaatattataaacatttaaatccattaaagcaccaccagctttatgaaagtcaaaggctggtaaaattgttccttctttaaaagcattatatcttgatgaatattgcgaatagttaaatgaaacaattttaatatctcctaatttttttaaatcttcttttaatgaaagaaaagcaggtatgtaatgtaaattcatagcttcaaaaatcattaaattctttttattggctgtttcaattaaatcttctaattctttactattcgctgtaattggtttttcaataatgacatttttatcattttctaaagctttttttgaaaactcatagtgtagatgattaggtaaagcacaataaattgtatcaacatcactttgaagtaattcatcataatctgtataaactttatctaaatgatatgttttcataagttctaatgcttgtgattttgatttttttgttgaaaaaagataagtcttttcaacacctagctcgtgatacatggtaagaacatctttaacaatcattcctgttcctaaaattcctagtttcattattttgcttcctctcttattctttcaattgtttcttgtaatttttttgaatcttgtaatgtatgtgttgattgattatgattaatcaaagcttgtatttctaaagtcatatcgtctccttcaattggatatgtttttttcataacttcattttctaaatgaattgtatattcaaccacacggttaaacattggaacatagatttctcccttttctcctttaattaaagcataacgttctttattataattaattgaaccttctacttttccttgaacttcatttttaaaatttaaagttgctttaaaattcatttcaatctcattttctttttcaatatgagattcaacactttcaactggtgcatccactaaagcaaggacaaaaccaacgacataacttcctacatcatttaaagcccctccttgttttggatcaaacaagtaagaatcttttttatctgtcccatcaaaacaaaagtttgcttcaattgattttaattttccaatcagttttaaatcttcttttaaatgattaaaaccattattaaactttgttttaaaagcttctaaacaatagccttgatattctttaacatattgattaatttcatcaatatcttcactttttaagacaagtggtttttcacataaaaccgctttatgatgtttaatggcttcaataatccattttttatgttcgtagtgaggtactgcaatataaacggcctcaatatcttcatcttttaaaagttcttcataatcacgataaagtttaactaaaggatgattttgtaagtaactatcgttttcatctaaagaatgtgaggcaatggcatgcactcttcccccactagtataagtaatacttttaacaaacttacgcgctatgtttccataacctataattccaaaattcatttttctacctccaataacgctattgcttctgcaatatcattaacacaataatgtacttgtttttttatttcttgaggggatgttttaaaagtaaaggctgtatctacgactttcaacatcggtaaatcattataggaatcccctattcctgctatcttttctaatcggtaatgatctttaatgattttaattcccgttcctttagaacatccttttcttacaatatcaacagagtttctattttgaaaaccttcgatctcatgatatttttgattaatttcaaaacatgctttcttagtcgttttgtcatctttaaaaataagcgatataccatagatgatttcatgctctacttctttaaaagaagaaatgacttttaatttaggattataatcttctttaagggttgtataaaaaacatctgcatttcctgtttgtaagatgatttgtgcatgttgatgatattcattaaagatttgttgaacgatttcttttttcattggaaaatcttgaatgatatttaaatctttatctaagatttctgctcctgaagaaagaatataaaaatctaattttagcttttctaaatcaaacagggcacatcgaggtcttccactacatactccaaaaagatgttctttttgatacttttcaatagcctttctatcttgtttttttatttgttgattaaaaacaagtgtgccatctatatcacttgcaagtgccttcatcttttattttccttaagcaatcaacaatgacttgatgatcttcatcatggacgagccctgaaacaagaatgcttcctcttaattcaccacgaataattaaaggaaaacctcccccacaaataacaagactttcatctttttcatcttcttgatacgttccattttcttcattttctaaatagatgtaataactactatgtccatatttttcaactgttttttgtttacgatcaagccatgtaactccttttttaccatccattaaatattgaaaaacaatatctttatctaaaacaatacggattctaacattttttaaatgattcttttcaatatgatctacaatgatttgtcctaattgataggcatcatgattattgaattcttgaaaagaaagttctttttctaattgtaagacttcttcttttgtcatctctttcacctcaattttgttataacatatcttctttctctttttaagagatgcatctcattatggaaataaggttcaaggtaaatgaaaaaaagctcagttaaactgaacttttggttcacttatttttaagatgataaataagcgcatgtaaattatttaagatgtacataaaggcaagttgagaatagaaagttgcaattttattttgtttttcatagtcaggaatcataatttgatattgactataaacaacaagtggactttgaagattagcagtaaccaaagctgtttgaattcctttttgatttaagattttcatacattctaaaagggatgtattttctccactataagagataaacaaagcaaaatctcctggctgtaattgcttggaaatatagatttcttccccatattgagttgctaagacaggaaataaattaagctttgctagtttattaataaagtttgctgctgttatttggctatcgccataaccataaataaaaactcttttcttttgtaccatcaatgttgctattttatttaaggtctcaatagataaatgatgatagacttgttgaatactttcttgataaagagaaaacatgttttgaatgatttgttcacttgtttcattaacttgaaatgggattgtatagtctacttgactgaccatatatttattagcttcaagttcctgtaataaagccaatttaaattgtcgatacccttgatagcctactttatgacataaacgaataatcgtggcatttgaagtatagctcttttttgctagatcattgattgaaagtaaagttaaatcttctaaatgatctaataaataatcaatgacttgttgttctgattcagtataatgattttctttaagttgttgtaatattttcattattctttcattaaaatatcaagcgcttcttccacactatcaactacatcatcaacaatcgatgttaaactttctggtgatgttggaaaagtaaaagaatgatccacggtttctaacataggaatgtcattatacgagtccccaattccggcaacttcctctaaatgcagtaattcttttaattttaaaattcctaaacctttagaacatcctttttcagtaatatcaatatattctttattttgatgtgctgttaattcaggaaaatgttcttcaatatcaagacatacttttctcgcgtttccatccgttttcgcattcatggataaaccataaatatctccttctacttcatctaaagaagtaataacttgtctaaccattgaacctaagtcttcttttaaaaatgtataaatttgcatattagcttgaataaaaatatcataatttttttgataacgatcataaaatttatgtaataaatgtttagaaatcgtacttttataaataacttctctttctttattgagtacaagtgctcctgtacataaaatatagaaatcaaaatcaatataaggcttacaaaattcgtaaatacctttaaaaggtcttccactacataaaccaaataagttgcctactttttgaaattccttgattttctttaaatccccttctttaaacttttcattaaataataatgttccatcataatcacttgctagtactttcataataatcctccaatgcctttattgtagttgattttgtaaaaaaagaaaatcattttcatcgattttcttttttagaaacatcttcttattttaatatttcttttattccctctaaattttccacaaaataaataccttcttgtttttccttagatgataaatcaaaagcaatcatcttatttaaaagtttctttaaatcatcataatatccatttaaattataaagcatacaaggtgtttttaaatgtttcaatgagactttagacataacttctgtaatctcttctaacgttcctgttcctcctggaaaagcaataaacgcatctcctaattcaatcatctttgcctttctttcactcatatcttgcgtcacaattaattgagttatttcaggataatcaaaaccagcatcaatgaaaaactgtggttcaactcctatgacttttccttttgcctttaatacactttcagccaattctcccattaagccacatttagaacctccataaacaagtgtatgtccattttcaccaatccacttaccaagttctcttgatgctaaaataaggttttgatcatttccattacttgcccctaaataaactgttatattcatgtatacctccaaaatttataaatcttttttatccttttggcttattatatcattttctgtataaaaaatgcgtttttgtttcataataaagcaggtgattttatgaatgaatcttattggcaaaagacaagtcaacatccttgttttaaacaattaaataaagatataaaaaccgatattcttattattggtggtggtctatccggcatttcatgcgcttatcaattaaaagaaacagataaacaaataactgttgttgaaaaggatcttttaggttgtcataccagtggatgtacaacggctaaaattactcttttacaagatcttatttatcaaaaacttgttaaacattataatattgaaacagcttatctatactatcaaagtcaaaaagaagcaataaaaggtattaaagatttaattgaaaaagaaaaaattgattgttgtttaaaagaatgtacgatgtctttatatactgataatttaaaaaatgttgaaaaacttgaaaaagaacaacattatttacaattctttggtgaaactgtttttgacaatcaaaaacatttaaaaacaatcagtttgcatcatcaatatatctttcatcctttaaaatatctctatcatcttgtgaaatgttgtcaaaagaaaaatgttcaattttatgaacatagtcgtgttgataaaattataaaaagaaaaaacggttttcttgtctatgtacaaggacatcgtattatctgccaagatctcattcatgcctcgcgttatccttttataaaaaaaggtttctactttttaaaaatgtttcaatctttagaaagtattgatttaaaacaaagaacaggaaatcaatgtaccctctctatcgatcttacagaaagttatcgtcctttaaagaatcatgctttagttattaattctaagagtaaagattggtttgcacaagatacgattcccttaagaggtattccttacatggggcgttataaagaacatgaatattttatttatggttttcaaaaatggggtatgacaaattcttttttagcatctaaaatcattaaagatctttatttaaataacgataatgcctatctctccttattttcatgtcattattattctttaagttattctaaaatatatttgaaacaaatgcttcatcatctttatcttggttatgtcaaatttcattttcataccaagaaaaatttacaaagaggtcaaggaggattaatgaaaatcaatcataaactctatgctgtttatttagataagcaaggtatttatcattatttttctccctactgtcctcatttaaaaggtctactttcttttgatgaaaaacatcaaatatggcattgtccctgtcatcaatctatttttgattgttatggaaaacttattgaagggccttgtttaaaagatatgaataaacaaaaatgatacccatttcattccttctattatataataatatatgggaggaagtttatgaaaacatatttaacattagatgttggtggcagtgccatcaagtatgcgttaatgcaagaagatttaactattttagaaaaatcaagtgtaccaactcctatggatacccttgaaaactttattgaaacaattggaaaaatctatgatcaatttcaagatcaaatcaatggtatggccctttctatgcctggtatcattgatcctgaaagaggctatcaatatactggtggtgctttacgttatattgataaattagaaactgtagaagttttaaagaagcgttgcccaacaaatattacaattggtaatgacgctaaatgtgctgctaatgcggaaattggttttggaaatctccaagatattcaagatggcgctgtggttattttaggaactgggattggtggatgtttgattaaagatcataaagttcatacaggaaaacatttttcagcaggtgaattttcttttattaagaccaataatctagaccctattagttggaatcatgcttggagtacgagaaatggtatttctgggttattacaacgtgttcaagaagcccttgaaacagacaaagaatatactggaattgaaatctttgaaatggctaataagggtaatgaaaaagtcattaaaggaatcgatgcttttgctaaggaagtcgcaactcaaatctttaatgtacacattatttttgattgtgaaaaggtggctattggtggcggtatttctgctcaacctttattaattgaattgattaataaaaatttagatgaaatctatgaacatttaggttttgatgtttatcatcctgaaattgttgcttgtaaatttagaaacgatgcaaatttaattggtgctctttatcagcatattcaaacttttaaataattctttttcaaaaagaaaaataagtgtaaaataagattaagaggtgaccgtgatgcaagttgtatttgttgttttacataaaacagaactattacaagatttattaactaaactaaaaaaagcaggagtaagtggtggaacaatcattgattctcaaggaatgatttcttatattcaagaaagtgatgaaagttatattttaggttcattgagactttttcttgaacaagctcgtcctgatagtaaaacaatgtttttcattattaaagacgaacaagttgatcttgtttttgaaaccattgataaagctttaggtggtttagaaaatcataacacaggtattgcttttgctatgccaattacaagagtagaaggagttgttaaataaaatatgttgatttattttagtcaaacaggtaatacccaacttttagctcaagctattaaaaagaatgttgaaaattcagatattatctatgtaggattttggactgataaaggtaacgctagtaaagaagctttagattatttaaaaacattacatcatcaaaagattttcttatttggtaccgctggttttggtaaaagcgataattattttaaaaaaatcattgataaagttaaagaaagtattgatgaaagtaatgaagttataggaagctttatgtgccaaggaaagatgcctgaaactgtcttacaaagatatttaaagttaaaagaaggaaatcatgctccagataatataaatttattaattgataattattatgaagcactcaagcatccaaataatgatgatattgagaatctaaaaaaggctatcgcttaagatagtcttttactttactattaagtttagaataaatattttcaacaaaccatggttcggtagatgcttttaaagcatcttcaaaactaaaccatcgtagtcccttattttcatcttctttaatctttaactcatcttgatcatttgcttccattaaataagtcacattataatgaagatgacttgaaacatattttcctcttttaacatgtccatctactgttaatacttctaaagaaaataaatcatcactcataaatgatacattttctaatccactttcctcttgtacttcctttaaagcaacttttttaaaattcttctcaccatctacgtgtccacctaaccaagaccaagaattataaactttatgatagcacattaaaaccttattatgattttgatttaaaacccaacaagaaactgtaaaatgccctacttcattttctcttgtcaaaacatctttttgtttaagaacttttaataaaagttccttgtcttttgcttcttgttcattataagattgataattagtgatttgttggtacattttcaatatatttttgataatacatcacgcgtattaaatcaaaaattgtcattatttgataattgaaattaatgccatcaaatcttcctggtacttgaattgtatcagttgtgagtttctttcttgcataggttggattttgagtaacaagtaaagaagttgtattttgtaaagagagatttgttcgcgtatacataaaaccttctaatgatcttcctgatgaagaaataaagataacatagtcattttcattaaaaatcatatctttatcatacgtatgatattggagtactgttttaccaaaagaaatcatatctgtttgaaattcaaccgcaatagacatcgggtaaagagcacctactaaaattacacgttttgaatcatgaatttttgtacatacttcttcaattttctttaagaaagcttcattatcattagaaactttaatacgttcaacatatgaagaaacatgtatatttttcatacgttcttgaatttgttcaaaacgtacttgtttatgtcgttgataaatttctataaaagaaagataattatcaaaacctaagtattttaaaaagtttaaaatactttcaggtgttgtttgtaattcaccagcaatatcttcaatcgtataactgtcaaaatcttgataatgaaggataaagaatacacaaaaacgataagcgtcatctaaaaataatgttccatttaaatattttaatattctagaaagtagtatattcataagctcctcctttaaataaaatgatattttttataataagtaacacgcataatatcaaagattgacatcaaacgatagttaaaatcaatactatcatatcttgaacttgctacatatatcacacgttcttcgccaatttgacttttatactttttattttgggtaataagtaagaattgtgaacgattaatatcaaaaccttgatgttgctccataaacgcatcataagctcttcctgttgctgaaacaaaaatgacataatcatctttatttaagataagttgattatcaaaagaatgatatcggaaaactggttttccaaaagtaatcaagtctgtttgaaattcaacagcaatcgatattggataaagtgccccaataataaccactcttttagaagtagaaatatcatgacaaatatgatccaaatcacaaataaatttatcttgatcatcacataaatgaatttgtttaaataaatcatccatctttaatcctaacattcttgaacgaatttgatcttgtcttaaaataacatccgcataaagttgatcttgaaaagaagcatagtcatcaaatcctaaatgttttaagaagtttaaaattgcttcttgagaaatttttgatttttcaaccacttcttctaaagtcattttataaaaatctatatagttttcaataaagaatacacaaaaacgataattatcatctaaaaacaatgttccattaaagtattcaagtattcttgctagaagtacatttcccatacgtacctatcctttctttattaaacctagtttttcaagacttaaagctatcccatcttgatctggatcaataaaagtatcataagaaatatctaataatttttctttagcaccttcaaaaacaattcctatatttactttttctatcatttgatagtcattcatactatctccaaatgcaatcgtatcttccatacttgcatgataataatcgatcactctttcaatagcatctgcttttgtacaattctttgaaataatttccccattaataaactcatcttctggctttgaaaataaaaccacattaaaatctttacttaaatgaggaactgtatcaagcaatgcatatttatcatatgcaataaaaacaattttagtcactttatctttaccaggattatattctgtaattggtttaaaagcttgatttcttttttcaaagaaacgtgcaagttctggattggcttgtgtatctttgatttgtcttctttccatatattctctagcataacctgattgaaaaagttcatctttggtttcaagtgtaaaacctacctgcgcattagaaaataaaacaatggcttgttgaagacgtttactatctaaaaagttttcataaatatattttccatcaatttgaataaagcttccagccgctgaaatcactccatcaaagccaacatctaaaatgtcttgagtaattgaaacaggcgctcttcctgtacataagaaagctttatgtccattttctcttagcttacaaatggcttctctatttcttttagtaatctctctacttttaccacgaattgttccatcaatatcaaaaaatacatatttcattgtgcttacctctacttcatgaattcttcaatcaaaataggtttttcaacaaattcatcaacaattgtataactttgataaatttcatctaacaattctggagataaatcatctcttgcataaacagttaataatttttcaccaatatctacatgatcccctatttttttatttaaaacaagtcccactgcatgatcaatatcttcttcttttgtcatacgaccaccaccaagtttcatcgaaacaattcctaatttttttgcttctaatgcttgaatataacctgttttctttgaagttaattctattatagcacttggtttttcaaatagttcagtattttctatatatgaaacatctccaccttgagctttgaccatttctttaaatttttctaaagcttttccattatccatcacttcttgtaaagcttgatacgcttcttttttatttggataaagatttgcttgaacaagcatttcactaccttcatttaaacaaagttctcttaaatctccagggccatttcctttcaaggtttcaatagcttcaataacttctaaactattcccaattgcatttcctaaaggttgtgacatacttgaaattgtcgctctcgtatttttatgacaatgctttccaatagaaatcattgtttgagcaagttctttagcttcttcaatagtttgcataaatgcaccatttccatatttaacatctaataaaatcgtatcagccccactcgctaattttttagacataatagaagaagcaattaaaggtatacaagaaactgttcctgtaacatctcgcaaagcatataactttttatcagcaggtacaagtgaagcactttgaccaataatagctagtcctatttcattgacttgattaataaaatcttcttctgaaatattaatttgataacctggaattgattcaagcttatcaagcgtaccacctgtatgccctaaacctcttcctgacatcttagccattttaccaccacaggcagccacaataggccctaaaacaagtgaagttttatcaccaacaccacctgttgaatgtttatcaactttaaccccttctattttggataaatctataatatccccgctttcttccataacttttgttagtaaggctgtttcctttaatgttaaaccttgaaaacaaatagccattaataaagcagacatttgataatcaggaatacttccttcaacataaccatctataataaatcgaatttgttggtgattaaattcaccattattttttttatattctattaaatcaaccattctcattgttgttttcccctttatttcaatctagttctattttactatattttgttttaatttgaaaacactttcattagttcaataaaatcttttcaataataattaaaaaaatcttctttttttgaaaaattaatcctttttttgttagaatgtttatggaggtggatttatgaaaatcttaatatgtgccccattacaagatgctgaaatcaaaaaaattcaagaatattttataaatgatactgttcttattaaaagaagaccaactcaagaagatattgatcaagttgatgtcatcgtgggaaatccacatcttgatttaaatttaaatcaagaacatttacaagctctcttacttaatagtgcaggaagcaatcaatatattaaagaaggtattttaaataaaaccactaaacttactaatgccagtggaagttatgggattgccattagtgaacatgttattggtatgatgattactttctgtaaaaacttaaaaacgtatgctttacaaatgaaagaaggaaattggcttccttcaaaacaaggaaaagaaatttatcatagtcgtgtttgtattgttggctatggtgatattggctatgaaattgcgaaaagactaaaagcctttgattgccatattaccgctattaaaagaagagtccaaaaggagcttccttatgttgatgaagtcgcaacaatcaatgatttagatacaattttaccacaaagcgattttgtgattttatcacttccacaaagcaaagaaacaattcatatttttaacaaagataaattattaaaaatgaaaaaagatgctatcttaatcaatgttggtcgtggaagtgccatcagtaataaagatttaatagaagtattaaatcaagggcatctttatggtgttggtttagatgttgtggaagaagaacctttaccatctacttctcctttatggacttacgagcgtgttttaatcacgccacatagttcaggtggttttgtttggcaaagtgtcagaaattattatacagaactcgttattagaaatattgaacatttaaagaatcatgaaactttagaaaatgaagttgattttcagacgggttatcgaaaagttgtcacatataaaaaatagcgcctcagcgctattcaaacttttgatcaacttcaaagatattatgcccgttaagataatcttttaccagcatacgttttttaccttctaattggaattcagtaataatataaaccccatcttgtacctttacaccaatagcatctttaaaaatcttcacgattgttcctggttcttgatgtgcatgatgtgtcatagcatttggacaattatgtacaagcccttgatagatttttactgtttttccttgatacgttgtataagctccaggccaaggatttaatcctctgacatgattataaacttctactgctggcttattgaaatcaattttttcttgttctctagaaataacaggagaatatgttacttttgattcatcttgaggaatggattcatttgtcccctcaataatagcaggcattgcttcaataatcgcttcagctcctaaaatagataaacgatcataaagttctcctactgtttcctcattagaaataggtgtttctttttgataaatgatatttcctgcatccatcttttttaccatatacataattgttattcctgttttttcatctccatttaaaatggcataatgaacaggtgctcctccacgatattttggaagtaatgacgcatgaacgttaatacatccaagacgtggacaatctaaaacttcttgtggaatcatttgtccataagcagctgtaataattaaatcaggttgcatatctataatggcttgataatcatctttgatacgttgtggttgaaatacaggtatatcatgttctaaggccacaactttaacttcaggcattttaagttctttttttcttccaacacaacgatctggttgtgaaacaacttggacgatgttgtaatcatgttgaattaagttttttaaaacagcttcagagaaagttgctgttcccataaatacgatttttaattgattcattcttttcacttccttctataagatattactaataaattgagagataagcaagacaattgtttgaattatttggatacaaatttgacttatctttttaacaattaaagaaagtgtattatctttttgattatcatagagaccttcatctgaattaacttctttttgtttttgtacattttgttcaaaagcaacaatatttttagaaaccatttcattttgaatataatgattattcaacaaaccattcatacaaaataataataaaccgaccattgtaaaatcaattaaaagttctttcattgtaaatactccttaattacttgagacatcacttcgattgtattttggacttcttctttcgtattattttgtcctccaaattcaattaaaatcgtatgatcacaaatcccttgattataatgatttttctttaccataattcctttagataatcctggcactttctcatttgccctgttagaaagttctgtagataattgattgaccatatcaaattttccactactttttcctacgacaaacaaaatcttagcataacttttttgattataaaccagtgtagaatattttttatcaaggctatctcgatgaaaatcaatgactaaatcatatttcccattttctcttaaagaattttctaaatacatctttgaaacaacataagattgattatatgcaattcgatgtatatttttatagttttcaaaatcattttgttcaacatcacaaaaataaccttcttttgttaaacaatcctttaaataacttgctccctcttttacattatatccaacatattcttctccttgatgtgtattatatagatgaattttcttacttgaggtaactggtacgcttgtctgcaaggcttccgttgttaaaattgctttaaaaactttcacattttgatgactataagaaggtaaatagataatcattaaaacaatgatcattattttgaaaataatttgaatagatacttttattttcataggcgctctccttgtatttattcaaatatatgaaataaatcaagaattataccttaagtcattcagagcctttgctagaagagcactcatcctttcaactgtttcatcaatttgtttatcagacatcacaaaattacgatcaaccggtgtcaatatttcttgtaataaagattctaattcctcttgatcaagactcccaatatgacctaataaataacgttgttgacttgatgaaagagtcccttcatatttttctcttttcccaatttttaatctattttttatatcaatagcatctccaaaataatctttcattaattgaaaaacatctttaacaattgaactggcataaataacagtcggaacccctatcgcaatgactggacagcctaaggtttcttcttgaatagcttgacggtgattaccaattccactaccaggatgaatgccgacattattaatttggataacatgccctaatttttgataatcttttgcacataaagcatcaataacaatcactaaatctatttgaaactgctcgaccattgcctggatcacttcaactgtttctactcctgtttgatacatcacacctggtgtaagtgataaaatatcataataatgattttctaatttaagaccatcatctaaataatgcgtgacacgaatatctcttaaagtacgtggtccaattgcatcactggttaaataaggattaccaagtcccgtaactaaaatacgaggatattcattttgatctatcatttcttttaatatttttgttatttgttcactgatattagaaatatgatctttaaaaaaaatttcaatatactttcctttttttaaatactccgtatcttctaaaaactcatacgtttcaattgaaaagtcctcctttttttcaatctttctttgataatgttttccttcttttaataaatccaatgattccttcgctaaatcactatgtgtattatacttattcatattctcacctgcataattattcccttatttccaacaaattacacaaaattgttgcaattccttgactttttatatataatgaagtggcaaattgcaaagcgaggtgaaaaatcatggcaaatatgaaacaacaaattaaacgttataaaaacgataacaaaaaaagagctaaaaacgcttcttataaatcagctttaaaaactgcaatcaaaaacgtaagagctgaagttgaagctggaaataaagaagctgctgaaaaagcattagtaatcgcttctagcaaattagattcttatgtaaacaaaggaatccatcataaaaattacgctattagacaaaaatctaaattagctaaattagttaactcaatctaatcattgaaaccagacaaatgtctggtttttttgtttattctttcttttcttgattataatgttaatagactttgaaataaaataagagtaaaatatttttacattacaaggagatgtatttatggaaagaaaagatatagaagaaaaatatacttgggatctttctaaaatttatcaagatcctcaagagttttatcatgatatagaagtcagtcaacaattacttgatgaattgacttcatttaaagggaaaatgactgaaagcgttgatatccttttacgttttttatcaaagcgtgatgaaatgtcaatgcttgtaagtaaagcttactgttttgcgcatttaaactgtgatgtagaacctaaagaacaagaatatcaaaaaatgcttgctacagtgatgtcactgattcaacaatcaagtgttaaacttgtatttgttgataatgaaatcgttgaaaacgatgaaacagtaagaaaatatttaaaagatgaacgtttaaaatcttatcggtattctttagaaaatgctttagcttttaaacctcatttattagataaagaacaagaagaattggttgcaaaagtagacaatatctctgaattagcagaacaagtttttgattctttacgcctagaatttgaagatgttgaagtcaatggtcaaaagaaaatattaaatcaagcgacacttaatgaatttttaaagaataaaaatagagacgttagaaaacaggcctaccatcatttctttaaagaatatcagcgttttgaaaatacctttgcctcaactctttcaggggttatgaaaaaagatgctttttatagtgatattcgtcattttgattcaccccttgcggcaagtgtttttaatgatgatgttcctaccgatttattttttaagattttagataaagcaaataatgaatatcgttatttattccatcgctataatcatttaaaaaaagaaattcttgggctagatgaactttataattatgatttatcagttcctcttgtaaaaagtgtttctaaaaaatttacaattgaagaatgctttgacatcatcaatcaagctttagctccttttggtaaagattatttagctattattaaccgtgctaaagaggaaagatggatcgattactaccctactactggtaaacgtggtggtgcttatagtagcggaagctatttaacacaaccttatatcttaatgaactttattggtgactataattcattatcaacaatgatccatgaattaggtcatagtgtgcatacgtatttatcaagccataatcaagactatattaatagtaattatcgtatttttgtagcggaagtcgcttcaaccgttaatgaaaccttacttatcaactatatgatggatcatacttcatcaaaagaagaaaaagcctattatatgtatgaacaattagaaaactgtgttggtcttatttttagacaaccgatgtttgcggactttgaacatcgtcttcatgaaatggctaaaaacaatgaacccatgtcttctaaaatcatgactgatctttatgcaaaattgaatcaagaatactttggtgaagatgtaaaaatggatgaacttgtaggttggtcttgttattatgttcctcatttctattatgattattatgtttataaatacactttaggaatgactgttgctttagctatcgttaaacgtatattaaatggtgacacgcaacaagttgaacgttatttaaacttcttaaaatcaggtggaaaagaatctcctgttgacttattaagtcatgcgggtgttgatcctttagatgacgctatttatgatgatgctttccattattttgaagatttgttaaatgaatttgaaaagctggtaaaataatttataatagtattaggtgatagaaatgaaaagagaagaaacaagagcgtttcaagtaggaaatttaacattaggtggtaataatcatgtcattattcaatccatgacaaataccaaaactaaaaatgtggaagcaaccgttaaacaaattcaagaattggaagatgccggttgtgaaatggtcagaatggctgtttttgacaaagaagatgcatatgcgatagcagatattaaaaaacaagtgcatattcctttagttgccgatattcattttgactatcgtttagctttgattgcgattgaatcaggaattgataaaattcgtatcaatcctggaaatattggaagtattgaaaaggtaaaagccgttgttgaatcttgtaaagaacatcatattcctattcgtattggtgtcaatagtggttctttagaaaaagatatcttagaaaaatatggtcgtcctactgctaaaggaatgattgaaagtgcaaagaaacatattgatattttggaaagtctagatttccatgattattgtatttctttaaaatcttccgatacaatgcttacaattgaggcctatacacttgctagtgaaacctttgattgtccccttcatttaggggttacagaagcaggaacaaaacttggaggaacaattaaatcttctttaggtattggaactttattatatcaaggaattggaaatacgattcgtgtttctttaagtgattatcctgtagaagaaattaaagtagcaaaaacattgcttaaagaattggggttaattaaaaatgttcctacccttgtatcttgtccaacttgtggaagaattcaatatgatttgattccagtcgctaaagaaattgaagatttcttaaataatatccatcaagatattaccgtagccattatgggttgtgcagttaacggtccaggtgaggccaaaaatgccgatattggtattgccggtggtgttaaagaaggattattgatcaaaaaaggaaaaattattaaaaaagttaaacaagaagatatggtacaaacgctcaaagatgaaattttaaagatggttaattcataataaccatctttttttcatatatataactatggaggcgtaaaactatggaaaatttattcattgaacattttttatcgtatgaagattttagaagcaataaggaaatacaagcattagagctaaatgaagaagatttgaaggtgatctatcaagtgatagatcaaaaccgttttttactctgtagtgaacattatttacctattctatttcaatcaattatgaaaaaaactagtgtttccactagtttaaaattgaaatctttgtttcaaaatcatacttcaatatttctaaattcttgatttttcaacatatctatttcttctttataaggagctttaccatcaatataaggtgtttctaaaatcttaggaacatcttttattctttcattatgagcaatcccatttaaaatatcaaaaccaatctcacctaagccaagatttgcatgacgatctttatgagctccttgaacatttttagaatcattcaaatgaacaacaagtaaacgatctaaatcaataatacgatcaaattcatctaaaattgcatcaaaatttgataaatcgtatcctgcgtcatgaatatgacacgtatctaaacaaacacctaatttttcaggataatcacaatgagaaatcaaataattgatttcttcaaatgtctttcctaactcactgccttttcctgccattgtttctaaagcaatctttccttgataaggtgtatcttttaatacttcatttaaacctttaatgatttgttgaagacctacttcttctccagcttttacatgacttccaggatgtaaaacaagaatcgatgtcccaatatcttgacatctttggagttcttgttttaagaagttaacagctaattcaaaagtttcttctttaaccgtattagcaagattaatgatataaggtgcatgaacaacaacattttttaaatcaatgttattttccttcattaaagcttttgcctcttccacctttaattcactaatggcttttcttttcgtattttgtggtgcacctgtataaaacataaacgtattagaaccataagataaagcttcttttactgaacctaaaagcatgtcttttccagacattgagacatgactaccaattatcattgccttcctccatacgtttagcgatttgtgcttgacgggcacgttctttcttttgacgacggatatcatcacgaatcatcgcacgtttttgtttacgtacaacttgttcaacttgatatttacgtttctttttatatcctggttttacttttttaggtttacggataatcatttgaacttgtttttcaagttcagtttgttgacgaatacgttttttacgtttttctctttgtcctaaatccacaaattgtccgtttttaagttgcatattcttaaattcaattccttttctttcaagaattgcaatatttttttcatctgttgtatcatacatactataacaaatacctgtatagtttccacgccctgaacgtccacttcgatgaatataaaaatcaggttctgttggaaattgcatattaatgacatgagaaacaccatcaatatcaattccacgtgcagcaatatctgtcgcaacaatgtattgatattcattgttattgatttgtcgcatcattttctttctttcacgaggttctaaatctccgtggatttctccaactttataaccatcttctcttaattgtcgcgtaatctttgatacttctgttcttttattcgcgaaaataatacaaatataaggatcaattgttgccatgatcttctttaaaacatcataacgatcttgatgctttgttgcgagtaaaatatgttcaacattggctgttgtagcaagtttactattgatttcaatagtaattggactttgcatatatttctttaaaaatggtcttagattttgtggaatcgttgctgagaaaaccatcatttgtagatcatcagccatttttcctgccacagcatcaatatcttctaaataaccaaattctaatgtcatatctgcttcatcgactacaaaagtttttgctgttgtaatttgtaaagcttgcgcatctaaagataaatctttgatacgtcctggtgttccaataaccacgtgtggttgtattgaaagtttattaacagctctttgacggtcacttcctccaacaattaatgaaacacgtaattctggtaaatattttgtaaatgttttagcgttattaaataattgagaagcaagttctcttgttggtgctgtaataacagcttgcacacaatctttattgacatcaatacgagacatgattggtaataaaaatgcatgtgatttacctgtccctgtttgtgaaatcccgataatatctctattttttaatacaaggggaatgactttttcttgtattggggttggctttttaaaacctaactctttaattacttgattacaatattcttgtaatttaaaatcttgaaaagttgccataaaatcctccttttttcttttttagtcacgttattataccatatttttgatacatttcaacaaatattatggatggatttttataattattctataatattcttgttggaggtgattagatgatcttaaatactggtaatcgtacagatattcctgccttttttagtgactggttttttaatcgtattcaagaaggttttgtctgtgttcgtaatccctatttccctcatcaagtcacaaaatatattttagatcctcaaatcattgatattatttgtttttgtactaaaaatcctaaaccaatgctttcacgtctagatttaatcaaagactataaacaattctggtttgtaacaatcaccccttacaatcaaacgattgaaccctatgttcccaataaaaatgaaattattcgtagcttcattgaactatctaaaaaaataggaagtcgttgtattggttggcgttatgaccctatctttttaaatgattattataccattgaatatcatcttcgaatctttgaaaaaatgtgtcaaaaactaactggatatactcatcaatgtgtcattagttttatcgatttatatcaaaaaacaaaaaagaattttaaagaagttcaagaagtaaatcaaaaagatcaaatctatctttgtcaaaaatttgtagaaattggaaaaaaatataacattgaaatctatacatgtcacgaaaatgaatttttaaaaacaacaggtgttcatacaagtggatgtatgaatcaacaaattattgaaagagctctaggtcattcattaaaactacctaaaataaatgaagctagacaaggatgccgttgtttattaaataatgatattggcgtttataatacgtgtttacatggttgcctttattgttatgccaattacgatcgtgtaactgttttaaaaaatgttaaaatgcataataaaaagtccccttttttaattggagactttcaaaaagacgatattattaaagaagcaaaacaggttccttatattgatcgacaactttccctattttaagggatgtgcgtggcgataagcaacacctctagtaatacgtaataaattatcttctccaggaaatttcacaggtacaactggattttcttgatacattttcattacatcttcaatatcgacaatgatttcatcaaatttcatgagtccatacattttaggtggaagtaaataaagtggtttatcaattgtttgattttttaaagctctatctaattctaccttcaaatgtggacataaaataacaacatcaaaacggtctaattcttttaatcctaaaccaaatggtaaaaattcaatactgtatttatcttctaaatttttttctttaatttctttttccatccttgttgcaatagcacttgaagaaaagcccccaccacaacataataatattctaatcattttaacacctcactatttgttagtataacataccctccatttcaatgtaagggcttttatttttctttgtaatttttatcttatctttttaagtttcacttttttaccttttcatcatattttatagtaggtgattttatgtatccttatcaaaaccccaattattattactatcaacctcagatgtatccttattttcaaagaatacctaaaaaatttaatttacaacatactcttcatacaacgatacgaggtattcaaatcgcaaatcaagttattcctattatctatcaagtaaaaccattaattgataataccaaacaaggtttgactttattaaaagcaatgaatcatttaaatgacatagattttgatgaaatagaaaaggaattaaaaccaatttctaaagaaaacaatgaaatatttgaaaatatgttataatcatctttgaggtgataaaagatgttagtaaaaggtattgttcctagaggttattgtaaaggcgttgttcgtgcaattgaaatagctaaaaaacaagcacaccaaacagcacctgtttatattctaggaatgattgtacataatcaatatattgtaaatgctttagaggatttaggaattcaaacaattgatttcaaaggaaaaacacgattagaactattagatgaaatcaatgaaggaaaagtcattattactgctcatggagcaagtcaaaaagtatttgataaagcgaaagaaaaaggtttagaagtaattgatgcctcttgtttagatgtaattaaaactcatgatcttattcaagataaattaaatgaaggttatgaaattttgtatattggtaaaaagggacatcctgaagcagaaggtgcaatttcaattgatgaaaaaagaattcatttaataacaaatatagacgatttaaaaacaatagatcctactaaaaaatatgttatgactaatcaaacaacaatgtctctttatgatgtttatgatttatgcgaaaaagcaaaagaaattttaccttttgtagaaattgaaaaagaaacatgcacagctactaaaatacgtcaagaagctattaaaaacattgaagatgatgttgatattatctttattgttggtgatcctcattcaaacaacacaagaaaacttgcaagtattgctcatgattatcatacatgtgatgtttatatgattgaaagtattgaagatttagaaattgaatggttaaaaaataaaagatatgctgctgtaagctcaggagcttctacaccaacatatcttacaaatcaagtaattgattatttaaaacaatttgatatcaacgattctaaaacatatcaaaaacctatcattgataaaaataaaatattaaaccaaaaagatgcctaggcatctttttcttgtggtaaccattgtactttgaaaaaataaataataaaaatcaaactacatacgacccatgttgtaggccatcctaaaaagacataaacaatatcacttgttacttttgtaattaagaaaagataaatttgtcttaagaaaacaaaagagaatatcatcacatacattggaacagctgaacgtccagctccacgtaaaactccattgataacttgattaattggtaaaacaatatagaatggtaagaatgttaactgcatcaatcttccagcatcaatcacatctttttcttgattaaataaagcaataaaatcacgaccaaagaaatacataattactacaaaacaagcaatggtaagtgttgctaatgctgttgtaatataagctcctttttttacacggtcatactgtttagctcctatgttttgaccaacaaaagttgtaatagccatattaaaagcttgtaaaggtaagttaacaaaaccatctattttaatcgttacagaataacctgctataacagaggctccataaacattaatataagattgaacaatgacatttgataaagaaacaatactttgttgaaaacctgtaggtaaaccaatttttataatttttaataaaatttctttgtcaaaaccaatttcctttaaaacaactttataatcatcctctgttttcattaaaacatacatgaccataattgctgaaatagcttgagcaattaaagtcgcatatcctgcaccagctacaccaaaatgaaaatatttaacaaataaaaagtctaggataatattaacaacacttgaaaaaatcaaaaaataaagcggtcttttagaatctcccaccgaacgtaagatacctgatcccatattatagaccattacaaaaataagactccaaaaataaatagataaatacgttgaagcttcagaaaacacttcactaggaacaccaattgcttttaaaattggatcattaaataataaaccaacaatcgttaaaacaactcccataacaagagttaaagcgatactattatgaattgctcttttcattttacaagtattactagctccaaagaattgagcaataacaactcctgcccctgttgaaattcccataaaaaaaccaatcaacatattaatgattggtgtacttgcaccaactgccgctaaagcaacttttccaacataatttcctacaacataagaatcgactgcattataaagttgttgaaataagttacctattaataaaggaattgaaaacaaaataattgctttgacaatacttccttttgttaaatcctgtgtatttcttttcatacattcaccttccatttataattttactcttattttattgaaaacaaaaatatttgcacgaaatgaaaaaaaataatttcaatacattcttttcgctataataaaattaagttggaggttagttatgaataaaaaaattatcttttttgatgttgatggtactctcgttgatgttagacctgcaagagaatatgtaccagaatcaacaatcaaagcagtaagagaaacaagaaaaaaagggaatttatgttttttatgtacaggaagatcacttgctgaaatctacccacatattttagatgtcggttttgatggcatcattggtgctggtggtggctttgtaaccattggtgatgaaatgctttatcataaaaaagtatctgacaaagatgtaaatcgtgtcgttgatttctttgaagaaaatgattatgactactatcttgaaagtaatggtggattatttgctagtgaaaatttagtatctcgcttagaaatgattacttatggcgatttagaaaatgacgaaaaggctagaaagaaaaaaactgaacaaccaagtcactttattacatctttaatagagggagaaagtatgtatcgtagtgatgtcaataaaatttgttttttagaaaataaagatattccttttcaaacaattatagataacttttctgatgcattcaatgttattcattgtaccgttccttcttttggagatgactcaggggaattatccgttgttggtgttaacaaggcaagcgccattgaagcacttatcaatcatttaaacattcctcaggaaaatacttttgcctttggcgatggcatgaatgacgcggatatgttagagtattgccatatcggtatcgctgttggtaacgctaaagaaggtttaaaagcaattgctgatgaagtatgtgatgatattgctgaagatggtatttataaaaccatgaaaaaatatcaacttatataaaaaaacattggctttttttccaatgtttttttattagagtaaatgtgtcattaaaatggtcgcaagtcctaaaaacgcaaagaagccaaacatatctgtacatgttgttacaaaaactccactagcaagggctggatcaacatgaaatctatctaaaataactggtacaaaataacctgcaagtgtggcaacgatcatgttacaaatcatggcgagtccagctacaacaccaaaccatggattaccagcaaagaaccaagcccctactgaaactaatgccccaatgacaataccatttaaaataccaagtccaatttcttttaataaaactttgcgagcattttctttatctaattctcctagtgataaaccacgaacaacaatagttaaagtttgtgttccggcattaccacccattcctgtaataatcgggctaatcgttgcaagagcaacaactttcgcaattgttccttcaaaaacactaacaacacttgaagccataattgctgtaaaaagattgacaatcaaccaaggaatacggtttttaaaagattctacaagtgttgaatctaaacgttcttcagaaccaacccctcctaataagttcatgtcttctgttgtttcttcttcgatgacatccataacatcatcgatatcaataacacctaataaatgatgctgttcatctataacaggcatcaaaatatatccatatttactaaaagtcttcgcaacttcttcttggtcttcataataataaacagctttaacattttgatttgtaatctcaagcattggtgtatcaaaggtacttgtaacgatatcccctaaagaaacaaccccttttaatacattttctttatctacaacataaagataatgtctaggttcttcttccgttgtttgcaaaaataacaatgtttctttgactgtattatttacatgaatatctaaatattcagttgtcataattcccccagcagtttctgggttatattgtaataactgtttgacatcttctttatcgtcatcttccaataactctaaaaaagcatttttttcatcttcatcttcgattgatccgataacatccgtaataacgtcatgacttacttcatctaagatttgtttttgtttgtattttgaaaataaattcaaccattctaagataagttcttcatcatcttcttcatctaaaatatcaccaataacttcatttggtaaatgttctaagatttcttttgatgaatcttcatcttcatgcaaaatatcaaggatatctgccgggtgaatattttctaaaacttctttaattatttctttattcccatgaagaattaaattttttaattcttcagaagtcatttgttttatcatttattttccccctcttatttaaagaggaactttaccgacggtggtaaatgatcctcactattaccattatgtccaccggataacgggtctactatcattattaccacctccaccttgttcattttatcataatgttcaaacttttaaagaaaaaaatcattttttacataataaaaagattgattttataaaaaaagaagataacatttggtatcttcttatttagaacacatatttctttgattttcttgatcataatcaaacaaaccatcattcttttcttcaagtgctttaatcatatgataagtatattcattataaggtgtaggaatatgaagctccttccccattttaaccaacgctccagaaaacatatcaatttcactatgacgtttagcatctaaatcttgcaatgttgaataacgagcacttgctggtacagcacttcctcgcgatgaagaagaatcagctttacttaaatcaattcctttagcgtgtgcaatagtttcaagttcatgacgtaaaccatcttgaataaatttcatatgttcactatctcgataacaacctactcctgcgcctaaaatagcttgaggtaaattattacaaacatttaaacgaaatttactccaaatttcttcttgaatatattcgcttgcacgaaagtggattcctgtattttcaaataatgattctattgcttgtacacgtttgctttgataaggtgcttggagttctccaaaaacaattccaatagttgtttcaggatcaaaacgataaccattttctttacgtgaagcaatcttaattaaagatggcataagatgttcttttccaatggcttctccaatgatttcttcactatctacgccattcattaaagacatgacaattgtatgatcatcaacgatcgtttgaatagattttaagacatcttttaaagcacaatattttaaagaaacaatcagtaaacccactccatgtgcttctgtcggtgaccatacttcaggataatacatttgatcattgatcaaacatcccttttgtaaacgtttagcacgttccccttcgccaataacacctaattttacttttttatctagtccccaaataatatatgaacctactgctccagcacctaaaacagcaactgtttttatttccattttttcatcccccatttatttttctatattgtagcacaaaatttataagttaaaaatgtgtactgcaatgttgaaataaacaagaatagaacatgtatctacaattgttgtaataagtggtgaagccataattgctggatctaaaccaatttgattggcaactaaaggaagaatacaaccaattaatttagataaaataactgttacaattaaagataaagcaatcacaaaagcaatattaatgtcttgatacatcacataaattctaagtccattcgcaattgctaaaatcactcctactactaatgcaattctaaattctttaaacatcactttaaatatttctttaaaacgaatttcatttaaagcaatccctctaataattaaagtagaactttgagagccacaatttcctcccgtatccattaacataggaataaatgagactaataaaggtactgcttgaaaagcattttcatatcttgtaataatacttcctgtaagcgttgcagaaaacatcaatacaagtaaccaaataatacgatgtttagcatgttcaaaaacagatgtttcaaaataacttttatcatgtggttctacagcagccattttagaaatatcttcacttgtttcatcgaccataacatccatgacatcatcaactgtcacaattcctacaagcattttttcatcatctaaaacaggtaaaacaactaaatcatattttctaaaaatattaacaacttcttcttgatctgtatgagtataaacatattgaaaatcttctttcataatttcctcaatacttttattttcatcatttaataaaatatctttcgtcgaaacaattcctattaattttttatcttgacaaacataacttgtataaatgcttttacaatgatttccattttgtttaatataatttaaagcatcttcaagttgagtttctttctttaaagaaagaaattcagtagtcataattgttccagcactatctttaggataactcaaaagttgattgatgacttgtctttgattttcatcaacatgttttaaaagtcttgttactaaatttgcaggtaattcttcgattaaatctacaagatcatccatatattgattttcaatcaacgattctaactctttttcactaaacaattctacaagttgactttgcattttaatatccatatttgaaaatacttgtgctgctttctttttagaaagtaaacgaaaagcaatagcacaatcatcaatttctatttgttgtaaaagataagctatatcgacagcattgttttccattaataaagtatgtaattgtttgtattgttttgtatttaataattctagcattaattcttttttcatttttatatttcctccttctttgaatttgcctttgacaaccctcgtccatataactcacctcctcacaaaaaaacatcgctgcttgagcgatgttctattcttcatttcatccgttcaagctttagtatcacagggcatatcaattacattaaacaaagcctttgcgactttatctgctaaccagcgcattgtgtctccacaattttgcggcagtaatcttaggatatccaaatccctgcggtaacctcacctaccgttgtttattcaattcatatttattatatttattaaaatacacttgtcaataaaaatttatctttctcttttgattttaatacttgcagcaacaataaatcctattcccgtcattagtcctaatgctagatcaataaaatccatttgactttgtaaatctatccatttacctagccatattgttactaataaaaaacctaatattagtaccaaataccaaccctttttattcacaagtatctccttaaattagaataacgatctaataattattgattatttaattcttctaagcataaattttgattatgcatcttttgcgcattttctttgccaacatatctaaaaatattacaactttctttttgtgtaattgttactttatcacttggataccttaaaacatatccatattcataactatgttctaaaagccattgataaacatctgttgaaacaaattcaacatcttttatgccatttacttttaaagaaacagatgttcctaattgaaattcactatatccagcttgtgatgtattttcttctaaatttaaaacatcatagcttttataagcacttgtcactaaaaatctttttttagtatttttatataaatcatcatacatttgttttaaagcattataagcttcttcatttaaatacatagaataagataatcttgaaatattttcaatcattgtcatatgtttagattcataaccaccaataaaagttgtatcatcaattacttgagacattgtatctattttatatagtcgagaagcattcgcttttaattctgtattcatcaaaatataaagaccttgtgcatcatacgtacttaccatttctttaaagagcttatatgtatcatctttttcattttccaaagtatttacataattatttgtaagtataatataactataatcatcatcactataaagtgtccttaacaattgataataacgcacattatcaaaatcaaaatacgtacttttttgataagcataaaataaatcatttttaattagtgttttaaaatatgtatctgtttgcgttccaaattctactgtaagacgatcaacaacactattgacatcattaattaaattttctaatgaatcatattttttagcttcttttaactcattataatattgataatattgtaaatgaaattgatcatatgtaatataatcaataaactcatctactgatattccatgatcaattaaataatcctgttcttctttatctaaatacttttctattaaagatcgattatcattatctataccatttactcgataaaaacgatcatatttcatatttaatgatgtaaaagcaaatagaaaacataaagttgctagaacataaagatgccagctttttaatttcatcttcatcaccatccctattatatagaattatagaaaaaaaataaaggaattagctaaagctgtaattcctttaacctaatcaattcaaatactgcttgtatacgcgattttacacctaatttttgaattacatttgatatatgatttctcaccgttttttcactaatatttaactttctagcaatatcttttgtagaataattcttgactaataaatgaaatatttctttttctcttggggttaatataatattcatagtccacttccttaatagtagtatatgaaaattatattatttggtgttttgtaaaacagtaaataaattttttgccacttctttaggtaagacttcttctaattgttcaagcgtcgcttcttttaattttttaacagaaccaaaatgttttaataattcttttttacgttttggtccaataccttcaacatcatctaaaatagactgaaataaagatttagaacgaacatttttatgaaatgaaatcgcataacgatggacttcatcttgcatacgtgttagtaaaaagaagagttcactttttttatcaatactaatttcattaaagtcactatcaattaaaacagcagttgaatgatgatcatctttggctagcccacatactttaataccaatatttaagctatcaatgacttcttttgcaactttaatctgtcctttaccaccatcaacaataatcaagtctggtttttttaatccttctacaagtactcgataatatcgacgataaataacttctttcatactaccgtaatcatccggtccttcaactgttttgattttaaatttccgataatcttttttagaaggtaccccatcaacaaagcaaaccattcctgcaaccgcataagctccttggatattagagttatcaaacaattcaattcttctaggagtaatcatatttaatttttctcccaattgtttaatagcacctaccgttgccttttgattcttttcaatcaataaaaatttcttttctaaagcttcttttgcattatttgttgccatttctacaagttttgctttttgacctttttgaggtttaatgatcttgcattcaactatttcttctaacaaagttgtatcaatatcctctggtaatagaatctctttaggatatgtattttcttgataaaacccaacaataaattgtgtaatttgttcatggacatcttgtaaaggtactagatttaaatctcttgcgagtaattttccatttctcataaagaaaagttgtaaagaaagataccctttatcttgataatagccaaaaatatctcgatcaatttgatctgcaaattgaacatgttgtttacttgtaacatgattgatatgctggatcaaatcacggtattctttcgcaagttcaaaatttaagctttctgaagcttgcatcattttattttgtaaatcatcgatgatttctttggtatctccttgaataaactgtgtaatttgtttggttatttttttatattcttcttcatctacttcattgacacatggccctaaacattgattcaattgatagtaaaggcatgtttttttaggaatgtgattacattttcttagaggatacaaacgatttaataatttaaatgtttctctagctgctgtaccatctggaaaaggaccaaagtgtttatgttttttatctttagcgtttcgaacgatttttaaacgtgggtgtctttcttttgttaattggatatatggataatatttattatccataaaactaatattgtatttaggtgcataatctttaattagattgatttctaataaaagggcttccttttcactatctgttacaatatattcaaaatcaacaatttcttgaacaagctttgttgttttataattatgacttcctgcaaaataagaagaaaccctattttttaatttttttgcttttccaacataaatcaccgtaccatctttatctttcattaaataacagcctggttgcattggtaaaagtgataacttatctttaatatattgaagatccattattcaaaatataccactgttgcacctaatccaccttcatttggtccaccatcttgataagattttacatatttatttttatccaataactttcgaacaccttttcttaaaacacctgttcccattccatggataattcgtactgttgaataatttgatacaagtgctccatcaataaatttatctactgcattcattgcttcttcataacgcataccaataatattaagttcataactttgtttattagctcttcgtaatgaacggatattagatgtttctttcttttctggtactttttcatgcatgaattgaacttctgtttttttagcattcaattttaaaccacccattgagatcgtcaacattccttttttattgatgtcaacaacttctccttgtcgattgacagataatactttaacaatatctcctattttataatcatgattttcatgattttctacttgtttcttttgatgttttaaatcacctaattgttttttagcttgaataacttgatgcggcttaatttgtccttgtaattcttttaaaattgcatctgctttattttgtgcttcttcaagaatctcattcgcatcactttgagcctcttcaatcattttttcttttttagattgataattatcaatcaattgttgataatgcttttctttatctgctgtttctttttgtaatttttcaagagcttctttttcttgtaaaacagctgataattctgattgtaatttttctaataacttttgtgatgttgtcatactttcatctttgataatgaaagcatgttgaataatgtcttgatttaaacctaaatgttttgaaatttcaatagcataagaatttcctacgctaccatctaataaacgataagtaggttgcattttttcttgatcaaattcaaccgaagcaatcttaatataatctgattctttcgcaaattcttttaatgcactgtagtgagtagaagctaaaatataagcaccttttttatgtaaataagttagcatagcttctgctaaactttcaccttctttaggatcagttcctgaacaaatttcatcaattataactaaactattttttgtcgcatgttgcgtaataaaaaccaatcttttcatatgcgatgaaaaagtagaaagcgattgttcaatagattgttcatcccccacatctacaaaaacatcatcaaataatggaagttttgcttgagtgactggaattggaagtccacaaatagccattaaagaaagtaatcccgctgtttttaaagcaactgtcttacctcctgtgttacttccactaatgagtaaaatatcttgtggtttctttaatacaatatcattagcaacaacttctttttgatcaatcaaaggatgtcttgctttaagtaactcaatttcctgacaattttcatcaacaattggcatcaccatatctaactttttgccatattcactaatagcaaaaacagcatccatttctatcatgatttctaaatcttcatttaaaacacgatcataacttcttaccttttttgttagttctaataatatacgatgaatttctagttgttcatcttgtttaatttgtgaaagttgattgttgtaagaaacaatttcttctggttctacatatgttgttcttcctgaagaagaatgtccatgatgaattcccttgatttgatttttataagaaacattgacgggtaaaacaaaatgatcatttcttgttgaaatgacatcatgagataaataatctttattttgtgctcttaatgcttcaattttctttctcatattggcttcaatcgctgaaatttgtcttcttaaacgataaagctcatgacttgcatgatcataaatatttccacttggatcgacgcattttaaaatttcattatataaatctttaggtaaataaagtaatgaaagtatttcaagtaaatgactttgttcaatttcttgatccaaataagcttgtacctcttgtacattttttaatatttgtacgatttttaataaatcttgaggataacaaacaccacctttttgtgctttttgaagtatttctttaatatcttcataaggggctaaaggaatacgtccataagcatagatgattttcatagcacttgatatatcatcttgatagagttttaaatcatctatatcttgaaaaggctgtatttgatcaattcgctttttagccatttcactaaaacaatagtttttaatataatcttgaataaatgaaaactccaatgttcgataactctttttcatttctaatgtcctttcgttaaaagattgatatcaatatcataattttgacataaagaagatattctttgataatcttcttgatctactgtttgtaaatctatttcactataatagttataaataaaatcttttattgtttcatcatctaaccatttattttgacttgcttcttctataaaatttgtcaccatagatacttgtttttcatcagataaagaaacatctagatgtgttaattgatttaaatctttaaaatcagcaatagatgaaaaataatgaggcatggtatcaattataaaagagcctatatacgtttgttcaattgtttcttttccttgattgataaaaggaataaaaatcattgaaataacaaaatatacaataatgattccttcaataattgataaaatcaaacctaataaacgatctaataattttgtcatttttaagaaagaaacaattttctttaaaaacggttttaataaaacaccaattccttttaaaaggaaatagataacaataaataaaataacagcaactaacaattgatttacctttataccaattggttctaataaaccttctaattgataaagtataatcaatttagataaaggaaaagaaaaattaattgttagaaaataagctataaaaagactaaaaaagtcataaagtcgaataatgaatccttttagataaccaataaatgcatatataataaggaatagacctataattatatcgattatgtagggattatttaataaagccataaatacctccttgcaattattgtatcaaaacaaaaatatagtgtcaaaatttgaaaaatatgctataattaatatatatggtaggaggaaagaaatgacatgaatgtagcaaataataacaaaccaatgaatattatagatatgcatgttgaaaactacgcccctttaagtgatggtggtccatcaaaccaagaaaaacaatattatccttattctcacattggttgtgatgaaacaggatcaggtgatttttttggaccattatgtgttgttgcatgctatatcgatgaacgcgattatgattggttagcgagcttaaatgttcgtgatcctaaactcatgacacctcaagaagttattgaaattgctagagagatcaaagatcgacttgtttatagtttgttgattcttgataattctcactacaatcaaatggcagttgctggtaataatctagcaaacattaaagcaaaactttataatcaggccgttacaaatgtaatgcaaaaagttgcaatgaaagttgataaaaaagtcgtaaatcaatttgtttcacctaaaacgtattataattatttaaagagtgaagtaatcgttgttaaggatttatcttttgaacaaaaaggagaagaacaatactttgcaattatgtgttcgtctattctttcaaaatatgccttttaccaatattttaataacatgtctagaagcttgaaagtaaaattgcctcgtggtaatacaagctcagttgtcgatcatgttgctgtaagtattgctaaaaagtatggtaaaaaaatgttacttaaagtaacaaaaactaatatgactaattataagcgtattaaagatgtaatttaaggtcttccaaagaagacctttttattttataaaatatttaattcaaatgctggaatttttgtgtatttgacacctgcggcatctaacatacgttttgcagcgcgatcactgtctgttccattatatttatcatcttcataaataatttctttaataccactttgaataatggctttcacacattcatgacatggaaataaagaaacatagatcgtacatccttgtaaatgagaaatactatttaagatagcattcaattctgcatgaacaacgtaaggatattttgtatcatacaaatctccttctcttgctgcccatggaaactgatcatcttcgcatccccatggaagtccattatatcctactcctacgatcttattttctggagaaacaatacacgctcctacttgggtattaggatcttttgaacgataagctgaaagcttagcaactcccataaaatattgttgccaactaataatctttttagacattttattctcctttcaattcatcaagttttgcttgaaaataatcaggtaaaggacattcaaactctaaatattcacctgtagtaggatgaataaatcctaattttttagcatgtaagaattgtccatgactctgatcatcttttttctttccatacttaggatctccataaactggataaccaatataagacatatgcaccctaatttgatgcgttcttcctgtttcaagtcgacattcaattaaagacatatcatcatatctttctaatactgtaaaattagtaattgcttctttactgttgttttttgtgacagccattttttgacgatcattgacatctctaccaattggcgcattgactttaccatgaacatgtggaataacaccatgaactaaagccacataacgacgtgtaacactatgttcttttaactgttcactcaatgatttatgagctttatcattttttgctaccattaataaaccacttgtttctttatctatacgatgaacaataccaggacgattcacaccattgattcctgataaatctttacaatgataaagtaaagcatttactagagtaccactataaattcccgcacttggatgaacgatcatccctgaaggtttattgacaacgatgacatcttgatcttcataaacgatatctaaaggaatatcttctggtaaaacatccatctccttattatcaggaatcgtgatttcaatagcatcattcattttaattttataacttgctttttcaatttttccatttacaagaacatgcccttctttaatatattcttgaataagtgttcttgataaatcagaaattgaattcataataaacttatctaaacgtacattttcttcattaatctctaattttcttttttccattaatataatcctcaaatataatctctaaaataatcaatcctactcctattactactgccatatcagcaatattaaaaataggaaaatcataaccaaaaataataaaatcaataaaatctctcacatatccaaaataaagacgatctgttagatttccaacaagacctgcaaaagttaaaacaattccataacgtgttaatctttgagctttggttgtcttactaaagtaataaaacataaaaattgctgcagcaagcgaaacaactacaaacaaactaatatgtcctgataacattccccaagctgctccttgattatgcgaatatgtataataaaagaaattatcaataatcgcttgcgattgccctagcatcatcgaagaagacactaatatttttgtaagttgatctccaataacaatcaccaaaaaagtaacaatatataaaacccaatttttcttacttatatttttcatctaatcaccaaggacattatacaataaagctttttaaaatcctagtatgacttttttaaatatgtagtatttaaaaccatttcaaatagtttatattgcaaaaaaatatgataatctataaaataaatatgaggtgaaattatgaataaagaaacactagaaactcttgttgaaaaagaaagtcaaaaaagttctattatgtctaaagatattcctgatttagatctctatatggatcaaattatgactctttttgaaatccatctagcaaatcataaaaaaaatgaagatgataaattacttactaaaaccatgatcaataattattccaaagcaaaagtcattacgcctgtaaaaggaaaaaaatacactaaggaacaaattattcaaatgttaatgatttatcaattaaaaaacaatctatccattcaagaaattaaagatttacttattcctatttatgaaagtaatactgatttatcaaagttatatgatcattttattgaaatcaaacattctataaatcaacaactgcaaaaaatgattcaacaaataattaaagattatcaattagatataaatcaatatcatgatttatttttacttattgcttctctttcaacactaagttattctttaaacaacattgctgaatcaataatagaagaaaaatagttatagatttaagctataacaaactacaattatttaatcatttactatttattcttttttcaatataataatcaataaaagtgaggtagctgtatgaaaattaatgaattattaaataaaagacctacattgtcttttgaaatattcccaccaaaaaacaatgaaaatgatatcacatctatttatgcaaccattgatgaactagcaaaaatgaatcctgatttcatttctgtcacttatggagctaatggttctacatctaaaaatacatgtaagattgcctcaaccattaaaaataaatatggtattgaatctgtagctcatttaacgtgtatgaataatacaaaagatgaaatcaaagaaattctagaagaacttaaaaaaaatggtatcgaaaatgtcctttctttacgtggcgactatcctaaagatagtgatggtattaatcatggtgattttaaatatgctagtgaattaaatgaattcattgaagaaaactttcctaatgatttttgtttatctggtggatgttatccagaaacacattatgaagctaaaaactttgaagaagatcttttaaacctaaagaaaaaagtcgatgctggagctaaatatcttgttactcaaattttttatgacaatcaatattattatcgtctagtcagagaagcaagaaaaattggaattcatgtccctattcttgcaggaattatgcctgctcataatccaaaacagttaaaaaatatcgcaaaaatgtcaaattgttctgttccgtttgatttagcagcgatgattgatcgttttgctggaaatcctaaagcgggaagggaagttggtttacactatgcaacttatcaaatcatcgatttaatgactcatggtgtagatggaatacatatttatacaatgaataaaccagagattgcaaaagaaattttaaaaagaacagaatatattcgtgatgaatttttcaaagattaaagaaaatgctttaaagtatttaggatatcatcatcaaatacttgatgaaaaaatgaatgttttgattgatgaatgcatagaggaaattgaaaaaatgagttcttttagagtaacttatcgtaaatttcctctttcttttcatcctttaagaattgatgaaatttctttaaatctcgattatccagacttgaatgatttatttcaaaattgtcatgatgttgttattattggctgtactttaggattacaggtagaaaaaagatctcattattacagtcatattgacatgaccaaagcgacgatttttgatgctgtcgcaagtagttttttagaagtgaaatgtgatgaatatgaaaatgaacaactgattggtaaaagaacgtttcgtttttgtcctggttatggtcatgtccctattgaactcaataaagagcttgctttcattatcgaaagttctaaaaaaattggtttgactgttcaagaaagtaatattttattaccacaaaaatcaatgattggtttgattggtttaggtgataacagaaaagaaaaaacatgtcagaattgtttacatataaaagattgtaattttagaaagagaggtcaaacatgttacgcgaaagattaaataaagatcttcttatttttgatggtggttttggttctcaacttcaagaactaggaatgaaggctggagaaattccagaatattataatattgaacatcctaaaataattattgatatccatcatcgttatttaaaagcaggagctgattttattacaaccaatacatttggcgcaaatcctcttaaattagaacaacataaatatagctatcaagaagtgattttagcagctatccaaaatgcaaaagaagctaaaaaaatcaaacctgatgcttatattgctttagatattggacctattggtaaacttatggaaccgatgggaactttaacttttgacgaagtttatcaaagcgttaagcaaatggtagaacttgtaaaagaggatattgatgttgttttatttgaaacaatgacagatatttatgaattaaaagcgagtattttagctgtcaaagagtgtagtgatcttcctgtttttgcaacaatgacctttgaaacaaatggtcgtagtttatcaggctgtgatcctcttacaatggtcaatgtcttagaaggattaaaagtggatgctttaggaattaactgttctttaggaccaaatgaaatggctcctattattgaaaatattttagaaagtacctctttccctgtgatgattcaaccaaatgcgggtctccctcttttagaagacggacaaaccgtttatccaatgaaagtagatgaatttattgaggcaatcgttcctcttgtcaaaaaaggaatcgctatcgttggtggatgttgtggaacaacccctgaatttattcaaaaattaaaaaaaaactgcccaacaacagtgactccaagagaagtttcttcgttgacacgtgtctcttcaggaacaacaactgttgaatttggaaaacatgttgttgtttgtggagaaagattaaatccaacaggaaagaaaaaattaaaagctgctttaaaagaagaacgttatgatgaacttgttgtagaagccatcaaacaagaacaagcaggagctcatgttttagatgtcaatgtcggtttacctggtattgatgaaccaaaagtgatgaagcatgttattaaattattacaagaagttattcaacttcctttacaaattgatagttctaatttccaagcaattgaagaagcttgtcgttattataatggaaaaccacttattaactctgtcaacgggaaagatgaaaccatggaagccgtcttccctgttgtaaaaaaatatggtggtgttgtcattggtctagccttagatgaaaatggcattcctccaaaggctgagcaaagatttgaaatcgctaaaaagatcattaacaaagcaaaagaatatggcattgacaaaaaagatatcattattgactgtcttgttttaaccgcttctgctcaacaaaaagaagtcatggaaacaatcaaagctgtttctatggttaaaacattgggtgtccatactgttttaggagtaagtaacgtttcttttgggttaccaaatcgtcctttacttaataaaacattcttagcaatggcaatgtcggcaggacttgatttaccaattatcaacccattagatcaagaactgatgaatacaatcgatgccttcaatgtactttataattatgaccaagatgctacaaattacattcaaaaacaagcacaaagccaagtcgttttaccaaaacaaacaacatccttttctttaaatgatgttgtcttacacggtttaaaagatgaagtcaaaaaagcaacagaaacagccttagaaagtcaagatggactaacaatcgtcaatgacattttaattcctgctcttgaccaaattgggaaggattatgaaactggtaaaatctttttacctcaattgatccaatcagcagaagcaagcaaaattgcctttgatgtgatcaaacaaacatttaaaacaacgaaatcttctaaaggtcctgttttaattgcgactgtccatggtgatatccatgatatcgggaaaaatattgtaaaagttgttttagaaagttacggttatcaagtcattgatttaggaaaagatgtgcctgcagaagtcattttagaagcctatcgtaagcatcatcctaaagctattggtctttcagctttaatgacaacaacggttgtttcaatggaagaaacaattgctttattaaaacaagaagaaaatatgtgtccaatttttgttggcggtgctgtattaacagaagatatcgctcaagatattcatgccgattactatacaaaagatgccatggctgccgtcaatttactcaatgaaattgtacattaaaaggaagtttattaaaaacttccttttactatatgatttaatatttgtccacaaacataagcatcatcataagcacgatgcgcattttcattcttgatatgtaaataatgagcaatcgttccttgtttataattataaggtccatgaatatactttcttgacaattgtaaggtatctacgtaacagatttttcctgttaattgaagtcgatcaaatgtttcctttaaaaacgacatatcaaatttcgcattatgcgcacaaacaatcactttgccttcaagagccactttcataaactcttggaacatctcgtatgctttttcttctcgcggttgattttctaacatctcattggtaatatgtgtcaaattagaaataaactcagagacttctacttcagcattgacaagtgtattaaatttttgaacagcttgtccattttcaaaaagaacagctcctaattcaataattctttcctcttttggattcaaacctgttgtttctacgtcaaaagcaataaatcttttttctaattgatttttgatatcttgatcatattttactttaataagttctaacatcttataatctctctaaaaaatgaattaatctttgataacatttataaaatgaattcatatttaatctttcatcaggagtatgaatatcaaacatatctggccctaaagtaataatatctaaatcttgaagtgctcctttgaaaatacctgtttcaagaccactatgtgtcccttcttcttttaaagtgattccttctgtttcttttacaaaatcaacatattgttttctaagttttgaaccttcatcgtaattccatcctggatagttattatctaaaacatattttgccttaaacattgatgcaattaaactcaatttgtttgataattcatctttagccgattccattggagaacgaattgaaaaataaatattgaatttttcattcatttccactacacccatatttaaagaaatattggtaagatccatttttaaagatttatgcataaagccattaggcattaaatacatcattgaaataatatcttggctttctttaactgaaatcacttcatttaaagaatctactttttctaaacaaacaaatacatgttcatcactttcttttaattcttcttttaaatcattttctacttttaaaacaacttctttgatttttttaaaatcatcatttgaagcaaagacactgacacattctctaggaatcgcattatcttttaaaccacctttaaaacttcctaataaaaattcaatgttatttaaagaaagatggtaatagacacgtgtcataatcacattggcgtttcctctttctaaatgaataacgcctcctgaatgtccaccttgtaagccacccacataaagttgataacaaggtgattcattttttagataagaaagttctttttcaacaacagctcttcttcctccagaacagcttacagtaataattttttctttccctctatcaagtccaatcatctttttcgcttttaaaatacttttatcaagacccattgctccattaagtcctacttcttcttgaacagtaaaaacacattctaaagctggatgttttaagctttcatcatctaataaagcaagcatataacaaacaccaacaccatcatccgctcctaatgttgttttattggcatgtaaaaaaccatcttcttcaataagttcaataggatcttttgaaaaatcatgatcactatcattatttttttcgcagaccatatccatatgtccttctaacatgactgtttcatgattttcatagccttttgttgcttctttaaaaagcacgatattatgcattttatctcttacatattttatatttctttctttagcaaagttttccacataatcacaaattgctttttcattgtaagatcctcttggaatctttgaaatttctctaaaataatattctactttttccatataattctcctatactaacgttctattcatccatttattggatttatatctaatcataaaacaaattgacctaaaaatccagtcaacaatcatagcccaccaaacaccaatgacacccatgcgtaaatacaaagcaaaaacatagcttaaagcaaaacggaaagtccacattgaaaatgtagaaacgatcattgtaaaagttgcatcattggctgcacgtaaggcatttggaaaagaaaatgccattggccaaacaaagaaatcaaaaacacaatgaagtgaaaccattgaaaccgccaaattagcagtatcttgtggtaaagcataaaatcttaaaatatatctaaccccaacaagtaaaataccagctgctacaattgttgataaataagcaataatcatcagtttctttgtataatatttagcttgctgataatcattagctccaatacattggcctacaactgttaaaatagcaagtcctaaagccattcctggaacaacggcaatggatgttaaactaaaggcaacagcatgggctgcaatggcagctgttccaaaagttgaaacaagtctttgcacaaggattttccccatttgaaacattccattttctaaaccatttggaataccaatttttaagattcttttgacagttgaaaaatcaaacttatattttaaatacgtatctatatgtacaatatgttctttatttaataacatatataaaataataaatgaacagaacattcttgaaagtaaagtagcaattgctgctcctttgactgacatatttaaaataaaaataaagaggtagttcaaaacgatatttccaatattcatataaaatgaatttgtcatagccactttactatttcccattgatctaaataaagcagccccaccgttaaataaaccaataaaaggataagataaggctgaaaagaaaaaataagttcttgcataagccatcacatcactttcaatatgtccaaaaatcaaattcaataaattcccattgaaaatcatacataaaaccataataacaagtgataaacctaagatggtaaataagagctgtttagcactatggcaagccatctcttcatcttttttaccaatatattgcgaacaaacaacagctcctcctgtagctagtgccgaaaagatattgataatcaacacatttaacccatcgacaatactcactcctgaaaccgcactttgcccgcattgggaaaccatcatcgtatcaaaaatcccaattgtcaatgctaatacctgttcaataattaaaggtattatcaatttttttaaatctctattactaaataacaaaataatcacttcctcgcatctattatatacctcttatttattctcgttttatgctttcaaaaaatgaaaaagatctaatgcatgttgcgatcacgccaacaatcattagatctagaactcccatcattataaataatatagggaacatcccttcttttttcataaccttcttcattttttaataaatcttgaataatagaaagacgtttatgtccatctttacaataatatttaccattaataatattcactttaataggaaaagaaagtcctattctttttatggaatcatacattgattgaggataaggacaatactcaaaatttatttcttgaaaatttatttttctaattctcatttgattttaaattccttttcaaaaaaatcagcaataccatcttcatctactgttaaagtcacagtagatgcatgttttttaacttcaacatccgcattacccatcgcaatagaagttcctacaagatgcaacatttcaatatcattttctccatcaccaaaagcatacgtattttctttaggaatatttaatttttgatataaatattcacacgctattccttttgtgtaaccttgaggatggacatccatacgaatatgtcctgtatcataagcattgatagaccattcttttggtaacatatctaaggcttcatgtaagtcttttgcattatagaaaagagcggttactgtattagctttaacattttgaaagcgccagttatcatcataatcatcaggaagcttatctgttcctgtataaagtcttaaatgttttttgataagttccccattcatgtcactgaaataactttgattcctttcactgattatatattgtccatttgttgcttcataaatactattttgtaagtttaaatctttcacactaaaaacattatttaataaaacttcttgatggaattcaatatagcctccatcacaaccaataaagccatcaaaaggaatttcgtctaaacattctggtttaacgccacgagcacttgctacaacaatataatttccttgtttttgaaattcttttaaagcacgtatcgtcttatctgtcggttttaataattgatgaggtacattaatcatggttccatccacatcaaaaaatgcaattttagtcatgtatatgctcccttatatatttttctacttcttcttgatcagaaaaatgaatcttttctgttccaataatttgataatcttcatgaccttttcctaaaatcattaagatatcattttcttttaataaactcattcctttagcaatggcgagatgacgatcattgatgacttcataatcaccactaaccccttttaaaatatcattaatgattttttgaggatcttctgttcgtggattatcatccgtaataatgacatgatcgctatgtttgcaggcaatttcccccatgattggtcgtttggtcgtatcacgatctcccccacaaccaataatcgtaataatttttccttttttaaattcttgagcactttctaaaacattcaaagtggcatcaggggtatgggcataatctacaaagataccatttgtatcataaacgattaactccattcttcctttaggtgctttgagttttgtatttaaggctaaaatagcatcaatttcatatcctaattcatgaattaaaagcatcgctgtaagatagttataaacattgtatcttcctaccatttgaatatgtgtttgatattctttttcttgatatttaaaggtaaaggttgtccctaagtgagaaaattcaatattttgaatgagaacatcacctttttgatcagaaatcaaaagattttgatttccttctaattcaaaatgtgaagcatgtggatcatcaccatttatgacagcaattttctttcctcttgtctttttaaataagaattgtttagcattcgcatagttttctaatgttttatgaaaatctaaatggtcttgtgttaagtttgtaaaagcaacttcatcaaattctaagccatgaatacgatctttcgcaagcgcatgtgaagaaacctccatcacaagtactttacaccccgcatcttttgctttaataaaataatcataaagtacatctacatcaggtgtggtattaaccattttaataaagttcccacaataataaaaaccaattgttcccatataagcacaaggaatatcaagcatcgtcatcatttgatacatcatataaccaattgttgttttcccatttgtacctgtaacccctattaatttcatatctttgaaataaggataataatgttcatacaaataatcttttaaatatgctcttgtatcttcaacaacaacagtttcaacatcataatttccttcttcaacaattacttttgttgccccatttttaatagcttgaggaatataatcatgtccatcgcgattaacatttctaatcgcaataaaagtatctcctggttttactttacgtgaatctgtttttaaatctatttccatagtaatctccttaataaactaattgaatttttttatgtaaacattttaagtgatatgttcctggttcatatttttcaccatcaatattaacatattgattggttttgacccaaacatcatcttctttaaaatgttgaaatttttttgttttatgtaacttattggtaatgagtccttttaaataatacggtaattcttttttagaaatctcacccactacagacatatcaatcatcccatcatctaaagatgaataataccctgcctgatagcctccaccaaaataatgaccattacaaaaggtacaaatcaaaacattaccttgataaatatctttattatatgtataaatatcggttggataaaattttaaatgaaagatcttatttaaaatcgttaaactatattgcataattcttggaaataaggttgtcttacgatttgtattcactagatttccaacatcagcatctaaaccacaacaaaagacattgatacaatataaatcttctttgcattgaatcacatcaattgctttggcttgcttatttaatgactctttaaaaatctttatcgcatctaaatttttgtagatgcttctagcaaaatcattacctgttccttgcggaatgacaacgagttcatgaaaagaccctaccatgccattgaccaccttatgaacaaagccatcgccacctatcgcatataaacgacaaacttccttttcatcttgataagacaaggctatctttcttgcatcatctaaatctttggtatagcgtaattcataacgttttccttgcatcattgttactatacaattaatcaaacttttagaagtatctggttttaatataaagatatgtttcatgtttatcaccttattcattataacataaaagagaatgtctttgacactctcccaactatcttcttttcttattctttctataaaaataacaaataataaaaacaataattaaaatagccaaaataacaactttattagatacttctactggtttataaaaaacaccaacacttcctgataaaaaaatcattcctagtaaacataagataatagcgataataattccttttttcataatgacctccataaaaaacgattgacctatgattaatttatcataattcaaccgttctttcattaaaaatcatatagctttattgcttgtttttttaagtactcactgattaaacgcaagctttttcgttcattttcataaccttctaacttatggtattcttcaatacaattaagttcaataccgttgtaaagtttacttctaatgatcaaatatagatagtctttcatattgcttcgcgtgtcacctcgccattgccaacctatacatttttcacatatttccatatatgaatcatttgatatttgagcacataaatcatcttgaccatatcgcaaacaattttttattattaaatcttcaatttctttttcttcttttacgtatacatatggctgtatcttatcattacaaaattcattccataaatcttccctaatattaggttttaattcaggatgatccaaataatattgaataatttcatcttgtgtgatttctttttctataactatttgttctgctttaaaatgttttgaacttccaatcacacaactatcaagtgtatcgattaagaataatctttcatcaactcccacaggacttcttccctttaggggagcaagaatattcatacaatcagcaacttcttctatcgtgccacaaaaactatacccattttcactaaaagcaatgtcttctttggtctctacttattgtttaggaataccaacttcaaaaatatcccttccattttttaaaagaattttagagcgtaaaataccattttcatattgaagtgccttatatcccttcataatatatccttctatccttattctcttattttatttaaataaccatatatgatcatcaatttttacttatatgaattaaaaaagaaaaccacttattaaatttactataatacctaaaattatagttaaaataattgtaacaaatataaagtttcttattttttcatttttttcttcaatacgtatattttgtcctatgcgaaactctgtgcatggaaataaatttcttttaatatttctaatacttgataatgatatagtaatccatattccacaagtccatatactcattattgaaatttgtactaactcaggaaatataatattttttacattagtatatacaacaataaataacatgccaaaacctaatagaaaagtcataattggcaaacgagataatatccgataatttaatttaaaattgcttaagcataattctattttattttttaataataaataatcatccccattatcaaattgaaatttaatttcagtatttggatgtgttccattgtcaaaaatcaatgttacttgattatctttaaatttaccagttattgacatttttacaattcgataagtctttttttcaaaatattcaaaacattcatcaatatcctcaaaaaaacatgccgtatcattagtacattctgttttaatttcaaaaaacatatgctcatcatattgtaaaaatatatcttttatactgaccaataattgcttatctactttatgtcctaacggatatttatgtatcttaaatacttcttctctcattttaatccctttctatattatctttttagaattatttgctgatatttattatttaaatatagcttctaatcctattgagctttcatttcttactattttatcatagtatttaatttatattatccataattacttaaacactcgagaaattcttcttccatcaatagtaaaccctaatttattgaaaaaatgttctttacgatcagcatgttgatcatctataggagaggttcttccatagattttcttaattaaatttgtttgtcttatataattgaaaagaagattaaaagcatttttacctataccttcattaatataaagaggtgcaacatcaacaatatataacttatcatcttcaactaattcaaaatatactactgatttccaaccattatcatctacatataatacatcataattagaatctctttctaataaaagtaaacagtacttatcttctttatgttttaatcgataatacttttcatctaagacctttattccttgtcgtacagtacaatcataaatcgcttctccaacataatatttcaagcgatccgtaaatttatactgttcatattctttttcttttctttcataacaccttgtattacatcttgtagtaattggtggtatttcagcatctataaatatgataggaatagttttttgaatcattttcttttcatcttcaaagagataaacatggtgataacttataagtacatgtattccatctttggaaactacagtttgaatatcatcaatagcttctataatatattcaaactgataattttcatctagttttagattcaaacacagcgtcttgtttctataatctaatttataatcaatgatttcatattgatatttcttagtgtcataatttgtaataatcatttgtacacatctatattcttgttccaacaatgcatttaataaatcaaaatcttgtaagagtatatatttatcttcttttttagttgtttgttgttcttcattttcttttgatatgtgtttttttaaaaaatcaatcatacttggttaatcctacatatattttaagatgatatacaaaatggagatttccaatagtaccttcatactactgatatatccccattttatgggcataagtttttttaatataaatgtaaatctacttctatcaatttataaataagtggatctcttaaatcgccttctacttcatatgctaaattacgaagttccttaagtatttgtaataacttctcattagacaaatttacattatgaatatagttttgagtagccgttcttgcaacttcacttttagtcgtttttaattgttttgcttttctatctaatagattaaattctgattccgccatgtagactattaaaacattattttttgttataacattctttcctccgtgtaattttttaaaaaacatgcataaatgtacttctttcaaaaaatacctttttagatattactgttttatttattaatgacccattctaatatatttctagcaccagtattgattataaattcatattcaatgttatcataaatggctatttcttcataaactacttgtccatcatcatattctaactgcaaaaaagatattttcttttaaattgttaatagttgatgcattatatgattggtcatatgatttatgatagcctgttattgctataagcagcacaaataaaacaatgaatgatctaatcactttatccataaaagtatcctccgctttatctatttaaaaactattatttcttttctataacaactttttatgctttttctttccttgatacataagcttgtctgcatacgcgagagcttcatcgatgttgtttatgttatacataccaccaatagaaacagagagctgaacatcatcatcaacaaagatgttttgtacatgatcagaaattctattaagtaacattttaaaatcaccatattcgatatcttggaaaacaagtataaattcgtctccaccataacggataagataatcatcttttctaatgcaatctttaatggccttagaaagtttttttaaagcctcatcacctgctgcatgtccaaaatgatcattgatttctttaaagccattggcatcgattatcgctaaagtgataatgttattcatatttctaacgtattcttcgtaatatcttcgatcataggttttagtcaaaacatcttgataatattgtttgttgtaattgcttattttatctatgaactgtgattttccataagatgatagaagaatattttcttctgtatgacaaacgatttctaaaacataaggttgacggttgatctcgatgtattctgcaatgattccataaacattacgatctacaaattttaatttaacaacttgtccttttttctcgtaagcttttcgcgcaatacagtttatacatgattctcttctttcccaaaacctgaaacatttttctttggtcttttctaatccatgttttgtagcataaataactgaataatttcttacatcggtcaatcgtgcactgtcaaagatctcactgaggtatttaatggcatcatcgatttgttgatcatcatattgaagcagggtatttttttgagtaaatttaggaatacgacttgccttttctatttgtccaatcgctccaacatattgaccttcttgccataaagaactagcatgcgccctgtaccatttcttttcatcattttcttctatagaaaattcaacaaaaatatgaagtatcttaataaaactattcttcaggattatttggatttatttcattacgaggattatcagtccacaatgaactaatattatgctcacgacaatagtctgccacctttttaccaaaataaaattccgttttgtcaaaattacgtgctcttcgatgatctcttgtatgatcattccaaccacagaaatatattctctccgcttcatctacattgcgatatggaagatatgcacgtaaatcagtatattcaacgccttgtctattagaatgtttaggtgctttttcagagagcattttaagaaactttgaagaattaaaaccatcttcagcatagtttaatttcagtattctacaaagttcaaaatatttattatctggcatatcaacaataaaatcatcatccatttttaaaacacatccccaattatgtgtatgaattgcgacaaggatttcataaccgcctgtaacaatagataaaatagtatcaaattgaaaaccattatacacaaaggaataatgttctttatcaatctcattttttttcatatctttaattaaactctcaaatgcaggacatctcataaccatttcctcctttataattttattaaaaaattctttagtaaaagtacttatttgataatacagtgtatattatatacttagacctcgtgtctcgttgttcatatttcaaaataagtgttatataaaacaaaaaagtgaactttaatttgttttataaaatacaaatactaaacttataaataataatacattaaaaaaagaaaaaactgcaacaaataattagaattatttgttgcagtcatttttatataacactcctatcacttttatataaatgacattctatctattaattgatgaagcaatcttatgatatgtatgtcttttaccacgaatagcaattgataaagccataatattttcaggtaaagcaataccacagaatcccgcatctccgatatgttgaatatcaataccacaacgtttatttaataaagcaatttcacgaatagtaccttcatctgccccttcttgacttgttccaatagcacttaaagataaagcaccatgtgccttaatataacgacaagcttctgttacttcttgttcagataaaccaggaacagtattaacagcaggcattaaaataacatctgcacccgcttcaataaattctttaatactttccatatcaacgattggttcatcaattcctgcagcatgcatttttccagcaataattaatcctttaaaatattttttagcttctttaattgcttcacaaattgaatgatttgaaacaccaactcctggatttcctgttaaacaaataaaattaaatcctaattcttgagctttaatatatgtttcttttgtagcttgtcttcctgtagaaataacacgtctttcttccattaaatcagcatctaaatccacaggttccaagttacatccaattggtctaccaacaatttcttttaatttatctactggattatcacatgctggtaatcctttaatttctggatgattacaatcaaaacagtttaataaaaccatatcacttccaaatgaaactgcaagttcagcatttgtaagatctcctaataaaggttcaatcgcaacaactgtttctgtcatcacagttcttccttcactagcaagaattgcttgttttaattcttgaccatccattttcaacatttcactacttgtacaacttaataatcttttcattcctcaaaccttccttttcatatctctattatcctacatgtatatacaaaggtcaattattgattttcaatttgttcttgtaattctaacaaataaagataacgttcattcttttcatcaatttgattttgaatttcatctctttgtttagaaagctcatcaatttctttaaaatcagtaacaccattcatcttttcttcaacttcatttaattttgtttctaaatccataatgacatcttcaattccttcaaattctttcttttccatatatgtcattttgattttattttgcttactttgtttataagccaaagccccttgtcctttttctttttcttctttagtagaagtatctagattttgactataacctccattaacataacgaatatgttgattttgtaaaataaataaaccatcacaaatacgatctaagaagtaacgatcatgactaactgtaataataattccttcaaaatgatctaaataatcttctaatatattaagtgtatcaatatccaaatcattcgttggttcatctaaaacaagaacatttggcatcatcattaatacacgtaataaataaagtcttcttctttctccaccagataaacgagaaattggtgtatgttgtaatctagcgtcaaacaaaaatctttctaacatatctttagctgataatccttgtccatccaccttaaaatcattagaaatttcttgaatataatcaatgacttttttattcattggtaaatcatcatatccttgtttaaaataaccaaaacgtacagtttctccaatttcaacataccctgtatcactttttaaacttcctgtaagaatatttaataatgttgatttacctgttccattatctcctaatattccaatacggtcatgttgtttaaacatataagaaaattcatcaaatagttttctttgaccaaaacttttagaaatctgattcagttcaattgttttctttcctaaacgagaaaaagtatgaatcatttcaattttcccattcacttctatatcttttacttttgataattcttcaaatctttgcagacgatctttacttttagttgtacgtgcttgtacgccagcacgtacccattcaagttctttctttaaaaagagttttctttttctttgactagaaagttgtgtttctaatcttaattgtttcagttctaaatattttgaataattggcttcatagttataaacttgtccatgatctatttcaacaatacgatttactactctttctaaaaaataacgatcatgagttaccattaataatccttttgaccattttattaaaaacttttctaaatattcaatcatactattatctaaatgattggttggttcatctaaaattaataaatcacaaggcttcattaaagcaatcgctaaagctactcttttaagttgtcctcctgaaagttctttgattttttgattttcatcataaattccaaacttacctaattgagcctttatttcaaaatcatgaatatcttttgaatcaatttgtttataaactgtttccataattgtatccatttcattatacaaaggtgtttgtggtaaataattaatacgtaaatccttttgataagtcattttcccttgataatcttcaatacctgaaataatcttcaaaagcgttgatttgccagtcccattaactcctaagattcctattttatctttatcttcaatatgtaattctatttgatctaaaatacatctttctccattatactttgttatatctgtcatcgacactaacattttcatcacccacgctatcataccacaaacaaaaacaaaacgcgactaatcgcgttttttcatcacatatttaataaagaataaaagcataacagttaatgaaagacctataagtgtataccaataatccattggtgttgtatctcctgttttaacagcttgtaccttgacagattctgtaggtgttatttctgttttaatgtcttctttaatgattccatgtgcggctttagcttctaaggcatgatatgtttgattcttttctatatttacaagatataatcgatctaaatgttctccatcccatctgtgttgtaacgtatcttgataccaaccatctattttatgattacaatcatctaaaatccaattattacctaccgtactcaaataaactgagcctgtttcttctccataaagatcatcaccagctaaacgtgcatgattgttatataaaactgtactagataatgttaactttccagcattataaattcctccacctttacctacacgacatgtatcaagtggattacctttttgataacctccatttgaagtaataatagtttgattaccaagataaagatttccataattagaaatacctcttacataattatgagaaatatttactttggcaccatcttcaaaaataacatcatctgaattaggataaaaatatattttttgtgctctttcataccatccataaactccaaaatttaaagcagatgtttgagcataatatttagattcatcatcacttgcttgatactgacttccgttatattgagcttctagctttcctccttttttaacaatcattgtacgtttttgtttaccttgacttaaaagggcacaatttttattttcattcatttttaatgaagatgtttcatctacataaagttgattaccactatacatattataaccaacttcattatttaaaagtgatacacttccttgatttgtaatatttaaatttcctttaacaatagcttgatttgtacaattttgaataacaagactagaatgatctacatttatatgaaaacctgttattccatttggttcaatcgcatcctctatgttatacttagcattattattaagatttaaaataccatatgattcacccatcattgaagtatacttcatttgttttaatgaaactactgaatgatctacattaataatcgcaccattactcgcatagataccataatttacaaaagaaacatgcgattgattgattaaatctaaaacaccagttgaagacataacaaccgaccatgtattatttccagatgaatacatattattaaattgtacatcacattgattaaatgttaaatgtgcctgtatatttaaacgtccttgactttcactatcatttgtttgactttgacagggaactgatatttgatgatgatttcctataatttcaatatctttattaatagttcctatatctaaaataacatcatctaataaataaatcggtcctttttgtttttcatctaaaatatccttgatagcttcttgaaatgattcataataatgatcttgtatttgtgcttgataattcatagctttaactgtatgcatatttaaaattaaaatcatcaaacaaatacttatttgtattaattttttcataatcttcctccttctttgtttaaataataaaaaggagatattataaagtttgtcggattttttcttattaaaaataaatacattttcatttataaaatcgatggaaaaacttaaaaacaactgtcaataaagatataaaatcaaagaaaaaagaagattattcttctaatcttcttttaagcacagatacaattgaaattgttagtagagaaagtactatataaggataaatcatttgttcatcccctgtttttacactttttttagctgtttgtatctttgtttcttgtttaggattctcttgaatttttgtattttgaacactatagcttactgtcggatttaaaaaatcttcaatttctaaagcatttccattactatctacaggatgtaaagtagctcgagtattcgtctttaaattatctttatttaaatgaccatcttcatcatagtaaccatattctcctgcttgttcttgaggatttgttagtataacagtataaataagttgaactggatcaaattgtgtaacaggaacattcattttccaaataaaatgttcctctactccagaataatagtaaagttcataatcataaccatcattttgcttattaaatccataatgataacatgtatcatcttctatcatttctggtgtatatttcttttgaccaaccatcatataaaattgattaacttcattaacaaaatcaaaattatattcatttccaaattgatcttttccttgaccaatataatcttcaacataacttcctttatctaataaataataaatatcattttgaatagcatcaaaagaaacttcttcattatttgataagtattccataaaagaagttgcccaaggataatgactttgaccattagccttcatcacataacaatgatacccttcttctttcatattttgatacgtatcattcgtataataaagtgctttatcaactgaatttaaatactgattcgattctaatacaggtgttgaaactgttggtgtttgtccataaatataatcatatttattaccttgactttctaattgattctttacatttttaaaatatgtgttccattcaggaatggaatcactatatttagatttaaaattatcaggacctgcccaatttaaaacacttccatcattttcaaaagaccaagcggtaactgttggttcttgattatacatataagtaataccatcacttacaaaaaccatatatttcctttgagcttctacttccttgtcattatccaacaattccttaccagctaataatcctgcatgactatttgttccagaagtaatttcttgttgaattgcttctttgatttgagacatttgacttgtaagattaaaccatgaagatacatgtgctgttttattaaaaataacaattcctacttttacctttgcatctgttttttcaatctgtgctttaagttgttctaacatttctaatgcttgattttcaatttgtgcactagttgacttatctaaaacaaaaacaacatcagaaactaagttttcgcttttcgaaggtagtgaaagcgccacttgactttgataatttgaatctagttgagtagctgtttttgatttagaaatttcccattttaaaccagttgcttcaacaggtttcatcataaaaaacaagcttagaaatgttgttaaaagacatattaattttttcatttctttctcctttccactactaccatagaaagaaaaagttataaaatatgtcagttaatgtctttttaaaatttctaatctattttcatttaaaatatttattttttatcatcatattctgtcatagaaaatcaaaatataatgttttttagagttcatgtttaatacacaattcaataatataatctcctcatcaaagtgaaggagatgtttttatgaaagaaaagttaatccgctttatgcaaggaagatatggtatagatacattaaacaatcacgcattatttctagtgattgctttatttatcgtcaatatatttttcaacaatagaattataatgtggttaggttatttaatttggttattagtaatctatcgtatgttttctagacaaacatacaaacgttatcaagaaaatgaaaagtatctaaaaagcattaaacctattcaacaatggtttaatttacaaaagaaaagattgtcagatagaagtcataaatattatcgttgcccgtcttgtaaacaaatggtaagacttcctaaaggaaaaggaaaaattattgtgacttgtccaagctgccatcaaaaatttgaaaagagaacttaaaaatgtttggttatgttgttattaataaacccgaattaaaaataaaagattttgatcaatatcaagaatattattgtggtttatgtcaatctttaaaaaagaatcatggaagattaagtcaatttactcttaattatgatttaaactttgtaggtattttactttcaagtctttatgaacctcatgaaaatcattattttatccattgtcctatacatccttttcataaaaaaagagtttgtacaaatgaatgtatggattatgtaagtgatatgaccattatattaacttattataaattagaagatgatattctagatgaaaattctttaaaaagtaaatcccttattcaatttataaaaaagaaatttaaaattgttaaaaataaatatcctcaaaaagtagaaactattaaagaacacttagatcaaatccattatttagaacaaacgaattgtatggacttagataaaatagctggtcattttggccatattatggctgaaatatgtgtttatcaagaggatattttcaaggatgatttatatcaaatgggattttatttaggtaagtttatttatttaatagatgcttttgaagatgttgaagaagatttaaaaaaacaaacatacaatccttttaaagatcaatttaaagaagataattttcaggattattgttttaaaatattagaaatgatgatttctagaagtagttattattttgaaaaacttcctttaattaaaaatattgaacttttaagaaatattatttatagtggtatttggacaaaatttgaactaatcaaaaagaaaagaatggaggaacaatcatgaatccctatcaaatattaggtatatcccctagtgctagtgatgatgaagtaaaaaaagcgtatcgtacgctttctaaaaaatatcatcctgacgctaatattggaaaccctcatcaagcagaatacactgaaaaatttaaagaagtccaaaatgcatataaaactattatggatgaaagaaaaaaaggttttagacaacaaagttatggtggtcaaacaactggtggttatcaatatacaggtaatgatcaagacgcttatcaagaagctcaaggatttattcaaggcggacgttatcaagaagcacttaatgttttaaatcaaatacgtaataaatcaagtatgtggttttatttatctgccattgctgaaaatggtttaggaaataatatacgtgctcaagaatatgctcaaacagccttacaaatggaacctatgaatatgcaatatattcttttagtgaaccaattacaaggaaatacgaatcaatatcgtcaaacaagccaacaatatggaaatcctgcaagtatgatgaattgttgctattcaattatgttattaaattgtatgatgtcttgttgttgtggtagcggatatcattatcctattttatgttgttagaaggagaaaattatggcaaaggttattggaattgatttaggtacaacaaatagttgtatggctttttatgaaaacggaaaagctaaaattattgaaaataaagaaaatcaaaaaacaacaccaagtattgttgcttttgataaagatggaaagaaacttgtaggagaacttgcaaaacgtcaacaatcgatgaatccaaaacgtacaatttcttctattaaaagagaaatgggagataactatcatgtggaaatcgatggtaaacaactatctcctcaactcatttcttctatgattctacaaaaattaaaaacggatgcagaagcttacttacaagaagaagtaacacaagccgttatcacagttcctgcttattttaacgatgcacaaaggcaagcaactaaagatgctggaagaattgctggtttagaagtattaagaattattaatgaaccaacagctgctgctcttgcctatggtttagaaaatgcttatggtcaaaaggtaatggtttttgacttaggtggtggaacttttgatgtttcgattattgaaattggtagtggtgttattgaagttttatcaacagctggggataatcatttaggtggagatgattttaataaagccattagtgactacgtccttgatactttttcaagacaagaaggaattgatttaagaaaagatcaaattgctttatctcgtattttagaagctagtgaacaagctaaaatagaactttcaagtcaatcaagtaccatcattaatttaccttttatttatcaagatgtaaatggtccaaaaaatttagaaatcaccttaacaagacaaaaaatgaatgaactgacaaaatctttaattgatcgtcttgttttaccaatgcaaacagccttaaatgatgcaagattaacaccacaagacttaaataaagtcattttagtgggaggttcatcacgtattttagcagttcaagaaaaagtaaaagaaattactcaaatggaaccaagtaaatccttaaatcctgatgaatgtgtagctttaggagctgcaatccaagcaggaaaactaagcggtgaaatggttttatatggtgaagataatgatgttttattattagatgttacacctttgacactttctattgaaactgttggtggtgttgctacaccattaattccaagaaacacaacgattccaaccagtcacagtcaagtctttacgacatcagcaaactttcaaacacaagttgaaatcaatgttttacaaggagaaagaccactcgcaaaagataatcaatctttaggtaaatttaagcttaaaaaaatcaaacgtgcgatgcgtggagttccacaaattgaagttacttttgatattgatagtaatggtattgttcacgtttctgctaaagacttagcttctggaaatagtcaaagtatgataattgaaggttcttctaaaatgtctgatacagatattgaagaagctattaaacaagcgaaaatgtatgaaagccaagaccaagttactaaagaaaatatgcttttaaaaaatgaagttgaaacattgatgatcaatgttcaaaatggtcttgcaacgcataaaaaagaaatggataaagctttaagaaaacaaattaaaggtgaacttgcttctttaatgaaaataactagaaaattcaattatgaaacagcttcgccagatgaaattcaaaaaataaaagattctaaaaatcatttagaatctctagctcaaaatatcatcgagagataatttatctctcgtttcttttttctaatatttcatcatgtttaataaaaccataagttgctacaattaaagagcctcctaaatcaagagctaaatctttcattgtatcctttaaagcttcatgtccttttaaaggaatatcttttttagaaacaagtgttccttttgtagaagccatatattgttgagcattggtatgaaagagcccatcacaactatattctaataattcccaaaaagcccctattcctagcgaaaacacaactaaaaataaacatgtaaaatatttattcatataaatatatttgcttttttcagccatcatcacatgaataaaccataaggctacaaaagataaaattatacccgaatggaaatgtaaaaaagaatcccaccatggatatcttccataaaaatcaagtccatctcctaaaactaaagcattaaaggcaaaaaatgcaataactatataaagtgttaaaggtacttgcatcttaaaccatttttgtaaaattctaggtgctgataatacaagtaacatcgcactaaattgaagaatacgaaaaatcatagttgtcacatattttatgtaaacatcaccaatatgatggcggaaagcaataataaaaattgtccaacctacatgataaatcaataataaaatcgttaatataaatagtatttttttaataagcaaaagtcttttttctgttaatttcttatttttcataaaaaaaccaatcccatcctttcttcattcttagttcactttcaaaaaaatgatttccattatttttttgaaagaaacaatcattttctttttgatagattttataagcttctaaggtgtttttcaacacatttttcatcaatgcatttcttgttttatgttccttacttcctaaacttaaatagattcttttgttttttataggatgattctttaaatactctaaccacccttcttgccataaagacccagatacactgatagccccatctaaatcaagttcatgaagtgaataaagactaaataaacctgctaaagaataaccgctaatataacattttaaatatttgttttttaattgtatttgcttaattttttctaaaagaatttttcctttttgatttgttaaagaaagttcattttgccaatcatcaatttcaattacttttaagacataagaactcttttgaaaataggctttaacttcttctagccattcattttgtcctttcatgcacaaataaatcatgattccttctttatccatcttgaacctccacaaagattgcttgatgattaatggctggtaaaattttatcaaaaacatcttgcattttaatttttagactacttgtattaatgcatggatgacaacctaggtattcatcttctaataaatcttgatccattaataattgaacattgtttttaacgtcgttcattagtcctaaaacactaacagaaccaggtgtaatatctaaatattcatgcattttttcatcacttccaaaagaaagacgggaactgttgatttgtttcgatatattttttgttttgaattttttatgtccttttaacattaataaataatattggcttttattggaatttactaaaaataaatttttgcatatcgttgcttgtaaagatttttctatttctaaacatatttccatcgtatctgctttttcatggtctatgcgttgataatcaatatgtagtttttctaacaaatcataaactctttcttctttagctattcttttttcttgtggtctgccttgttttaattccatttgttattcctcatttaaatctatttgatctttgattttattaaattcaataattggcaattgattttctaaatgttcccctataaatttttccatccataccatatcataccaacgattaaatttatagccacattgatgaaacttacctatcatttgatatcccaaatgatgatgataatcaatactattagtatccaaatattcatcattttcaataggtgaagaaatacacgcatttaaatttgtaatatgttgtgcttttaatgctttttctaaggctaaataaagttttttaccaatcccacatctttttaaatcataattaacataaattgatgtctcaacacaccaatcataagcggccctatttttaaaacaacttgcataagcataaccgacaatttgatcattctctttagcaatcaaatagggatatttttccataacatgaaccattctttgtttaaattcttcaacagatggtacctcatattcaaaagtaatcgctgttttttcaacataatagcgataaatctctactaattcttgtgcgtcttctaaagatgcaatttcaattttcataactcattcccccgttttccttattatctatcaaaataaaaaagatgtccacctaaatgaacatctaagattaagcttctcgcatttcttttgtatatgtaaaaccatttccactaacttcttctacatgagaaacaataataaatgctttatcatcaatctctttaatcttatcttttaaatcaggaagtttacgatatggtaaaattgttaaaacaacttctgtattttcttttaaaaaccctgttttaccatctaataaagtcactcccgcatccatatcatttaaaatcattgttttcatcttttcaatttcttttgtcatgacaagaacttgaacacaacctttacctgatgataataaataattcatcatataagctgtaatcaaaattgtcataatcccataaacaatttcaggaacactatggaaagaaatttgtaaaataagaattgtcgcatcaataccattaacaagtaaagttacgggaactttaaaatgtttttcaacaataagcgctaaaatatcaaatccccctgttgatcctccagcttttaaaacaagaccaattccaagtcctaataaaaaaccacctaaaatacaaacaagaagttgatcatctaataaaccatgtaaataagtttgttgattaaaaaactctaataaaacaggaaataaaaatgttgaaatcaatgttttcattgcaaatgtctttcctaaaaaacaaaggcctattaaaaataaagcaatattaataattgcgacacataaagaaacagaaattcctgtataaaaatgaaaaactgtactaataccagaaacccctcctgccacaatagaatgatctaaaattaatgcgctaaccgcaaacgccattaaaacatttccaataataatttgaatcacttttttcatatctctcacctcgcaagaaataataacagtttttcttttatcagaatgtaacctatgttacaatttaacaaagaaggtgaaaaaatgaaaattaatgaagaactatttgactactttaaacaagtaggaactattaaacattatcaaaaaaatgagattatttatatgcaagatgattgtgccgatgagttatgtcttgttttaaaaggcagagtacgagtttatcatattaaaaaaaatggtgatgaaatcaattacgatgttcttgataaaggacgtatttttggggagtcttccctttatgaaaatgcttatcgtcctactacagtttccgcaattaatgatgttgaaattattacttgtcatttacaagatctttatccttatttatcatcttcactagatttaacgatttctttattaaaaatgttaaatgataattgtaatcatttaacgcaattactcaaatgggcacaaacctataatcgttatgaaaaagtagccgcttttctttatgatttatcaaaagataataataaagaaaaaaatttactttttggtcgtattccttatacgcatcaagaaattgctgattctttagctatatctcgagtgaccgttactaaagtacttaatcagtttaaagaagaaggactcattgatattcaatacggtcatattcaagtacttgaacgtcaaaaactctataatcattatctagcaaaactcgattagtgaataattaaaaaaagatatgttataataaattatgggagggataatatggaaaatcatgttggatgttatgaaacaggatcactcgatttttttggaccattatgcgttgtggcttgttatgttgatcaaaaagatgaattttggttaaataagctaaatttagaagttacaagcaatgaagaaataatacagcttggaaaagtgttaaaagaaaaacttacttatagtttacttttattagataatagccattataatcaatatgttagtgaaggacaaaaactttcttgtatgaaagcaaatctctataatcaagcaatgatcaatgtcattcaaagaatcagtcatcctatttcaataaaaacaatcgatgcttttttagcacctaaaaaatactatcgttatttaaaacacaaaaccattgtagtacgtcaccttgaatttaaaaaagaggatatatcaccagccatgatgtgcgcaaaaatcttatcacaatatgcttatcttcaatattatcaaaacatgtgtgattccttagaaatcactttaccaagaggctttaatattcttgcaaatgacgctggttgtcttttagtaaaaaaatatggacaagatattttagaaaaagtatcaaagactaattttccaaattataaacaaattttagaaaaagtttagactctttttctttttaagaaaaaaccatttcttatcatctattttttttataatagaactatggaggaaatgaatatgattaaaatgattgtcagtgatgttgatggaaccttattatctcatggttacatcaatcctaaatgtattgaaagtataaaaaaagcacaagaaaaaggaattgaatttgttgtggcttcaggaagagattattatggtgttacaagtattttagatccttttgatattaaatgctcaatgattttaggaaatggagcccaatattgtaataaaaatggagaagtattaatgaattgttatttggataaagaaaaacttaaagaaatacttcctattttcatagaacatcaaaccccttatatgatttttacaacaaatggtttttatagtactttaaaaccggaagtagttagagatcgttttgcttatcgtggtaaggtacgctttggcaataaaatggaagattttttaccaggaggtccaatgagtgattcccctgcctgtcaaattcaacaatttgattctattgatgaatttattaaaagagacttagaaattattaaggttgaagctttttctcatgatgcagatgaaatacaacgtgttctaccttattttaaagatatgaaaaatattgcttatttatcttcatatcctgataatgtagaaattaccaacgaatatgctcaaaaaggattgattttagaaaaagtaattgatcaattaaaaatcaaaaaagaagaagttattgttttaggagatggcatgaatgatataactctctttgaacgttttccttattcctttgcacctagcaacggtgaaaaagcaatacaagaaaaagcttatcaagttgtttgtagctgtgaagatggagctgttagtgaagctattgaatatgctttagaaaacttataaaagattcatttattttgaatcttttttatttgtttggaaatttctaaaatactacgataacttttaacattatcaccattataatttatcccataaaaagttaaattaaaatgttttgctagtaaataatcaacatgactatcccctatatagatagagttattcatatcaattaaaaaatcttttttagcttgttctatcatccctggttttggctttttacagtgacaatgatctttttcattatgtggacaaaagtagatttttagaatatctatattttcttcttttaatttttttagaaattttcctgtaaactgttgataatcattcaatgaaataattccatcattaataagatattgatttgttataatgataaaatcatatcccatctcttttaatctcttgagtccttctattgaaccttttaaaaattcaggttctttaatttctctcaatttttcatctggataatctttaataatagttccatctctatccaaaaaagcaatttttaaataggatggcttcattttaacttcttgattcatactttacctccaaagcttctatttctaaaattttatcatttatttttactaaaaagaagaaaactcctcaaaaaaagacaatatatatatggaaggaatctatatgaacaaaaatagagagaattttataaaaattcaaatgatttatgttttcatcatttgcttgtagaaaacgaaagaataaggactcttatttgtcaagaactcgtttcagacaggaaaattatttctattaaattaaagaatgcgcaacattatggtaaaagttattacgaaaagaaatttattttagctattgatgatatcggtgatatctacaacattgaactacaaagctatggtttaaacgaagagatacttgttcgttttgaactttataatgctgaacttttaagacaacaagtaaaacagggagaagattatactagtgctcatgttgtaagatcattaattattagttatgggcatattttagacaatgctcctctttataaatatcactttagaatagttgatgacgaacatcatattgtctatccctttaattgtgctgagataacaattattcaacttgaatatatcaatcaagcaatcaatgaaatgacgagttttaatcagttaatgtatctctttaaaaatgaaaaaaccatatgataaaattgagatagattatagaataaaggaagcgatacaaatgcatgacatgttttattttcattagtattttgattactcgttttctcttgagtttgcacatcattttttacagattcttgatcttccagaatcgtattttcttctatttcttgtttggttgtatcatttacaatttcatcactttcattggtttcatctttggatacatcctttttctttgttttcttttttgatacctctttttgtgaaataactgctgcttttttattttctacatggctattcattggtagtgcattacaaacaaccaacagtgtagataacgctaaaactataatattcctttttttcatactttcttcatctccttttattaattgttatttatttcatatacagtttagacttctgtttacttattatcaaatttactatttcctttattaatttgtaaaaagcacattgtgaaaacacctattagtgcaccaatttgcattgaaacaataataattattacttccttcataatatccaccttccttcaaaaaaagacctacagtcattgctataggccttttaacatatttagttctgatgttaactattaaattatttcattttatggtcttggttttaatccatagtagatacccaatctttctgctttcctcatttgataagaataatacaagcctgcaagcgacaaagtaggtattacatttgcaagtgtatcaaaatagtaaacaactccagataaaactgaagaaaataatccagttgctgctcctgaaccacttaatttatctaatatatttttcacaaatccgaaatacgtactagaaatcatcccttgtaatccaggttccaattggctgttcatataatctattatttcttcttcttttgtttttccattatctaaagcaccagtaaatgcattatacattttggcacttgttgctaaaatatcagtactatttgttattccagctgcatcaagagctgttatatattttgaatactcatcatccatattttcttttattgatccaagcaattcattcataagtgtataattagcaccattttcaataaaattctttattccacttgtataagttctaaatgctttataaatagcgacacctgcttgtgctttataaaattgttcatatgcatctatatcattttgcgaaataatatttgcatatacaggatgtccgaaatttttttcatctgaaaaactcttatcatagtttatattttcaatataatgagaggtatacaaatacaaaatatatatgctttcatcatgatttccatcgttatattcattatcatatacagatctaatatatttcattcgatctttttgttcccctttagatgcaggtgggtttccatcatacaaatctccacttcgtgatgattgtatatttactttttttggtatagatgtatcgaataaattatttttatctaatgataaagtatctaataattcatcatccgtttgagttagtgtaattaaattcaataattgtcccgatgtaataccagctgaattatacttatctgaaatatcgattatttgatcagtcacttcatttaatgtaatttcatcttccgcatttactgttggaatagttattaatatcataccagccgtaacaattccaataagtatttttttaatcataagttttctcctttcttttctcttaatcaacatctaaactaaataatgtaaactgattataattattaaaacggacaatcttttcctttttattttgtaatcttattagataactattttcttgattaacttcatatgaatctatttttccaataatatcttcaataactttaaaatcttctccaatatcattctgatttttcatcataaaagttgtatatcccttatttcgacgaacgagcgaatactcttttgtttccaaaacattacacaaaaaatagaaagttatgataaagaagaacaacttatgatatacttaagcaaagggcatagtcctaataataagtatgaaagctatgatgaaatactaatgcctataggtgcattattgaataatacattgaattatcaagaaaagaatgaagtaataaaagaatatggcttagatgatgaagaatttaaagaaaggatgagagatatgtgtaatttaggagaagcattggaattagaagcaagacaagaagaaagcaaaagaaaggatgtagaacatgtaagaaatattattgatgaatttcattgttcacttgaaaaagccatggatattttaaaactaacagaaaaagaaagacaagaaattatgccttattttcaagcatagtgcatgttttatgagagtggatatgtgtaatttaggtgaaattttggaattagaagcaataaaaagtgagagagttagaaatatcaaaagtattatgacaaaactcaaaatgtcttttaaagaagcgatagcttttttagaaattcctgaagatgaagtattagaattagaattagaagatgcatttaataatgatttaaagaataagaattaaattatttgaataaaggggacaatgctaagcattgtcctcgatttttaattaaagagtttttgatcttttccagaaggaactttaaagaggataacaagaacaaaacctactacaataacaattaatgataaagcaaataagatttgataagaagaaatatcaagtatttgtcctgcaatgttttgaaaaataatagaacttagatttcttaaagtttgtacaaaagcaagtgctgtaatttgatgttctttaggaacaagtgtactaacaatttttaaattaatcataataaataacatacctgaaggatgttttgtaattaaagtaataatgactttaagtggtaaccaaacatttaaggcataacataaaaattgaatagtaatcatactataagcaatgataagtaatcttttgttagtaagtttatccatgaatttatgtgaaaataaaactagaggtgcttcacataagacagcaaaagataaaatagtagaaacaagacttacttttaaaccatcattttgaaacatagctggaatataagtattagccatatttgtaattccttggaaaatagcagcaatgattaaataatataggtatttatagttatgaaagagtgtacttgtttttgttttttcttcattgttttgaccaagttcactaggtgtttgggtacctagtaggccaatgatacaaagaatcattgtaatgataaaacaaataaagatggctgatggtgaaataagttgataaatcattcctgcaagccatgaaccagtagcatatccaatggttccccaaattcttatttttccatattgatatggagaagaggatgcaatcttttccataacaggatttgtaccattaattaaagttaatacaaaactataaccaattgtaatggttattaaagaagaagcaaacataaaggcaagaccaccaatacctgctaaagtaaataaaacgaagttgacttttttaacatcataacgatcactaaacataccaatcactggttgaaatatcatagatgttaaaaaagaagtagaaacaactaaagaaacttcacttgctttaaaacctttatctaataaataaatagaaattaaagcagagaagatagcccatgataaataatagaaattatacatgagaaaataacataaataactatttttataacgttctaacataaaatcctcctaatgaaatacttttgaatctttattggttggtactttaaaaaagaaaacaaggaccataccaataacactacaaataaataaaacaaaataaaacatttgataacctgtaaaatcaatcaaataaccagcaagcatttgaaagacaatagatgcaaagcttttacaagctgaaacaagagacaaagcggtgttttgtctagcattatcaacaatggttgaaataattcttaaattaatcattacaaaagccatagtagcaactgtttttgtaagaaaaacaatcatgatttggataataagtgaggatagaaaactaaaagtaaaaaattgaatgcatagtaaaataaaaacactcattaataattgtttatttgaaaaacgattcatataaaaatgagataataaggttacaggaacttctgataaagtagaaacaaagataatatttgagacgttattgattggtaatccactctgttttaacatagctggtaaataaagatgatgaacattggtaataccataaaataagcaaacaataattaaataataaggaatatgtttaatcttaaaaacggatgacatcgaaatcttttcatttgtcttttcaacaggaggtagaatactttgcgtacctaataaacctataacacataaaagttctcctatcgcaaagaaaacataaagactataagctccaatgtttttataaatatatcctgatatgattgttgcaatggcatagccaatggtagcccacacacgaatagaaccatatttgaatcttgatagaacagccattctttcaatgattggatttgttccattagtaattgataaaacaagactataaacaagtgcaattaaataaatattttttaagaacataaaaataattcctaaaaggcctgcaattaataataaaacaccattaacatattttgattcataaacatcatttaatttaccaataaaaggttgaacgatcacagataaaataaatgaacaagaaacaacaaaacttacttgtgaagcactaaagccttgatccattaaataaacagatagaaatcctgaaaagaaagcaagactgaaaaaaaagaaaaaatacattaagaaataacttaaataactatttttataatattttaataaatacattttttcctcccttaattttttatataataaataaagaggtgatggcatgcttttacaagaacaaatgaaacaagatattttctcgtataatgaaaaaacaatcattaatttcatattagaaaaacaagaacaaataaaagactattctactaaaatgattggtgatgaaacctatacagccccttctaccatcattcgaattgcccataaattaggttttcaaggatggtcagattttaaagaagcttttttagatgaagtcatctatttaaataatcattttcaagaaatagatcctaactttccttttactaatcaagatacgatgatgcaaattgctcataaaatcacacaattacatattgaaagtgctaaagatacggcatcacttattcaacatgatactttacaaaaagctttgcgtattatggcaaaagcagatgttattaaagtatttgcggtagctaatttgaattttattggtgaagaatttgtattcaaacttaatcgtattcataaaagagcctatattgaacctgttcaagataatcaatttcaagatgctattatgacaaccagtaatgaatgtgctatttgtttatcttattcaggagaaacccctactcttttaaaaactgcacaatatttaaaggagaataatgtacctattattgctattacaagccttggtaaaaatagactttctgatttagcggatgtttctttgaatatttctactcgagaaaaatcattttctaaaattgcaggatttacttcttgggaatctatgaatattgttttaaatattctttattcatgtttgttttctttgaattatcaagcaaatttagactataaaattgaggttgctagaagagtagaaacaaatcgtaaaatagataatgaaattattgaagaacttaaagaagattagttcttcttttttatttcaaacagtcatctaaaatagtaactcccatttttaataaatcactacagcatcttttcttctctttattttcctttaaaagagtatggcaacataaacttcctgcctgttctttaaaatccatagctaaacatttaccacaagcataacttttaagtttagattgaggattttccacattcccatcacatgttttcaaacaagaataaatcatagcaattaaaataggaatacaacacatttcttctaaaccagcaacacctcttccaagtccttctgtaagtttgaagagttctttttcttcaaagggtaaaatatcttgatagctacaaattaaagcttgagcacagttataaccatgcgtatgtaaagataatactttttcttctctttgactcatcacttctcacctcgtttactagtttattgattttatttgtttttgaaatataaaaaaatgtaaatggagcaccatttacatttaagaaatatttaatttgtttttttgtaaataaaatttacataaggcataagtaaatgaaataaaacatataacaaagaagcataacaataccacaaggtttccttaattcttgatgtttcattgtaccaaaccatagaattaaaccagcaataattgcaatgattgtatcaaccaaaaatttactttcaaaaggaacattacaaattagagaagttgtcccaataacaaaaagaatattaaaaatattacttcctacaatattaccaatcgcaattccagcattaccacgttttgctgcagtgactgatgtaacaagttcgggcagtgaagttccaaaagcaacgattgttaaaccaataaagcgttcactcataccaaaataacgagcaatggcactggccccacttaccgcaaagtcacttcctttaacaacaaggattcctccaatgagaataaagagaagacatttccaaacaggaatatctttttcttcttcttgagtttcattatttcttgccatgataaataaataaacaagataagcaataaaaagaatccaaaggaaaataccttcaataaaagtaattttcatatccgtcataccacagatcatgagaatgattgttataaaaatcataaagggaatttcataacgaatggttgatttttgtatttttacattggtgatcaaggctgtaattcctaaaataataaaaatatttaagatattactacctaccacatttccaatagtaatccctgcgttttgttgcatggcagccgtaatactgacagcagcttcaggcatacttgttcccatagcaacaattgtaagaccaatgattagttggggaatacccagttttctagcaatgcttgccgccccttctacaaaccaatcagctccttttactagaaaaataaaacctactaataaaataataacttgttgaatcataacgattactccttccttatattttgcagtaggtataaaaaaagcggactcctactgcattgcagtaaaagtctcgctattcaatcactttccgagttataaattttataactgtactgacgaagaagtgaaccaagtgcttggcaagctactcccttttatgaggtcattctatcaaataatattaatttaagcaactttaaattaattttaaatatttaaaggcattgtataaaccatcttcatttacatcatcagtaatataatcagcggcttctttaatttcaaagccaccattacccatcgcaacattataagcgcaacattcaaacatcgataagtcaattttagcatcaccaaaagaaatcgtatctttagcatctgcatgtaaataatctaatagaacttcaatagcatgtcttttagtaatacctgtaggtcctaaatcaccaaataatgcaacttctcctttacctccccaagtattcgcaactaaatgagggaagtctactttagaatctaaatgatcttgatatgttcttaaaatgaaactgattttattaacatcgtcacggtataactcatccccttgtaaatgaatgaaaccatcaataaaatgttgagcagaacttttggcattctctaagcttgcccctttgcctttagcgtattttaccatggtttcaggtccttgttctaacatataatcattacaatacataccactattcgcttctaaataaaaaccaatatgtctttcattacaccaatcaacaatattttttacatcttctttagataatccttgatgcataacaacatgtccgttatcttcaacataagcgccatttccaccaatcataccatctaaatcacacaaatttctttgtagaatttcagctttcgaacaacctgtacaaatatacactttatgtccattagctctagcttgatcaacagcttttgcggctgaagcaggtaattttgcttcataatcaattaatgttccatcgacatctaaaaatacaattttactcataagttctctccttaaattaattttaaatatttaaaagcattataaagtccgtcttcatttacatcattggtaatataatcagcggcttctttgatttctggtccaccatttcccatagcaacattgaaaccacaacattcaaacatcgataaatcaactttagcatcaccaaaagaaatcgtatcttctttacccaattttaaataatccaacaacacttcaatggcatgttttttattaattcctgtaggacccaaatcactaaataatgcaagttccccttttcctccccaagtattatgtgctaaatgaggaaaggcagtaattgcatctaaatgatcttgataatcacgaataataaagtctattttattaacatcttcacgataaaattcatctccatgaattaacgtaaaagaatcaataaagctttttgccttttctgttgcatttgaaagatctgcacctttaccttgaccgtatttaatcatgacagctggtccatctttaatcatttgatcattacaataaaccccactatttgtttctaagtaaaaagcaagatttctttcttgacaccaatgaaccaccttttttacttcttctaaaggcatcgcttgatgcataataacatgcgcatgatcttctacataagtaccattacctaaaatcattccatctaaatcacataaatttctttgtaagatttcatcttttgaacaacctgtacaaatatagactttatgtccatgagctctggcttgatcaacagcttttcttgctgaatcaggtaactttgtttcatagtcaattaaagttccatcaacatctaaaaatacaattttactcatacttttctcctttttcttataacttcattgtactaaaaataaaagggaaagtcatgataatcttaaaagtcaatactataatgttgatggaattaaaaggcacaaacatcacttggttcgctaacagtcttattatattaaagtcttttactcaatttgtctcaagtttaacaagtgatataaaagagatacacaggagaaatatctatatgagaaaagatttaggagataaaatgcaatttatgcctttacctgttttaatgcttgcaacatatgatcaagatggtaaagccaatgtcatgaatgctgcttggggtggtgtttatgattataatcaagtttatgtatcactttctaaacataaaacaacagataatttagaattaaagaaagcttttactttatcttttgcgacaaagaaaactgaaaaaatttctgattatttcggtgttgtttcaggaaataaagaagataagattgaaaaaagtggtgtccatgtaacaccttcaaaacatgttgatgcaccaattattgaagaatatccacttactttagaatgtactgtagaatcttttgaagatggaaacttaattggaaatgttgtgaatgtttctattgatgaagattatttagatgaaaatggtatgatagatgtagataaaatggaaattattgcttttgatatggtcaataatacgtatcgtgttttaggagaaaatgttggtaaagctttcaaagatggttttgatttataaaaatagtgcatcgtttgatgcactatttgtagttatgatagtagcgctctggtaaaggagcatgttttttatagttttgaatatataaaggaagataaataagagcttcttttaaggtttgttggtagattttatcaagaatatcattatatttttccatttcttcattatgatggtaattaatgattaaaccttgaagtttatgaaaattgaatgtgagatggaaacatccataaataagccctctttttataaagttaggtgcttttaataaatgatcaattctttttaatcctttaagagctttttcaatatctaaataagatagttcaggaaaaaaggattgaatagtacatatttctttttctttaaagcgaatatgttcatagatttctttatgcaatggatcttgatgatttctttttaaaagaagacgatcataatcagattctatttcaaaatgatccatatttgtatttttaatcattcttttaatataagggtgcatttgactatctaataaataatgacaaataaaaccaagaatataagcaagttgtgcttcactttgaataatatcttgtgccttttcaaagaaagtattagctttttcttgatgcatctttcttgctattttattccatctttcataaaagaaaatatctggaccatgaagaccaattaaaaaacaattttcatttctaagtaataaatctttaatattttgatcatcaagatgtttataaacatctttaccaaaacaataatgtgtatatccagcaggcattagagaagttccttatattgatcttctttaaaaccaacaagaactttgtcttttgtttcaagtataggtcttttaacaagcattccattagtagaaagcagttctaattgttcctcttcacttaaagtcggtaaaatatcttttaaatgtttttctttataaagattacctgatgtattaaagaatcttttaagtggtaaaccactttttaaataaagtgcttttaattcatctttatttagtttttcttcaacaatatgtctttcatcaaattcaatttgatgatctaataaaaacttctttgcttttttacatgtagaacattttggataacaaataaataacataaatatccctcctgaaactatcatatcaaaattactactaaatgaaaaataataaggcttattattgtatactatttcaagatgtgatagaatttactcaaataaagatagaggcgcaagatgttatgagattattattatttgatgcaacaaggtaatgaaggaggagcacttgccgaaagattgtatctattgcatgaggtagaatcttgggtgtctaggaaagacctattcaactgtcattatctaaaggtaatggggagctatcattgataacgaattttttgttgcaatgatactcattgcaattttttatttgtcactttttataagaggatgaataaaatatagggaggaaattatgaacgatattattgaagctataagttgtgaaaaagaaattattcaacttaagttattaaatgtaccaaaacatcctaaaatgattgcgaaaatcttttctatattaaaagatgaagaaattaatgtagacatgatttcacaagttactgttgatgattttgttcaaatcgaaattactttagatcaagaatttcaattaaaactcaatcaagcgattattaagttaaaagatgaatttaaacaaattcaaatttatcaaattagaaaatacgctaaagttgctgttgggggaaaattggtggaaacaacaccaggtttagcagctgaagtatttgatgtcttaggacaagctaatattcacttttatcaaattacgacaagtaaaagaacaatttctttagttattgataaagagaatttagatcaagcaattcaattattaaaagaaagatttcatattgaggaggataaataaatatgacaatttttgaaggaagtgcagtcgcacttgtattaccaatgtttgataatggagacattgattttgaaggatttaaaagacaagttcaaagaatgatcgatggtggtgtacaagctttacttgtaaatggaacaacaggtgaaacagcaaccattacaattgaagatgaatttaaattattagatctaacactagaacttgcgaaaggaacaggtgttaaagttatttgtggagctggttcaaatgatacacaaacagctttaaagaaagcacgttatgctaaagaaaaaggggcagatgcgattcttgtcgtaacaccttactacaataaaacaagccaaagaggcttaattcaacattatacaacaattgcggatgccgttgatattccaatgattttatacaatgtaccaggaagaacaggattaaatatttcggttgacacagttgttgaacttgctaaacacaaaaatattcaagctatgaaagatgctacagacaatattgcttatgcgatggaagtattagctaaaacagctgatttagactttgatttatattcaggatgtgatgataatattcttccatttatggcagctggaggaaaaggagttatttctgttacttctaacttatatccagaagcggtagaaaaattaacacaattaattttaaaaggaaatattaaagaagcacaaccattagcttatgctttagatcctatttcacgtttattatttatagatgtaaatccaattatgccaaaagctgcacttgcgaaaatgggagtatgtggtgaacatttaagattaccattaattgaaacaacagaagaaaataaaaaagcattatttggtgcaatggatgaatttgaaaaattggggtattaggatgaaagtattattatatggatatggtttgatgggtaagaaagttgctcatcaattaagagaaaaagatgaatttgatttaattggtgtggtttcttatgaatttgatgaaaaagcaccagaagcaatgtatagtaacttaacagaagtccaagatcgtgcggatgtgattattgatttttcacatccaaacaatcttgatgatattttagcttacgctaaaaagaataaaacaaaagttgtttttgcaacaactggcttttctaaggaacaattagataagattgaagaagcttctaaagaaattgctatcttccaatcttataatacaagctttggaattcaaatggtcactaagatcttaagacaagtagctaaagaattctatgataatggttatgatattgaaatcttagaaaaacatcataatcaaaagattgatgcaccatcaggtacagcaaagcttttatatgaagtaatggaagatgaaattaaagaaacaacacctgtttatgatcgtagtgcacttcatgaaaaaagaaagaaacaagaaattggtattcaagcacttcgtggtggaacaatttttggtgaacatgaaattatgtttgcaggattagatgaaattattgaaattaaacatacagctttatcgaaagatgtctttgttcaaggtgcgttagctgcagctaaagccttacaagataaggatcatgggttgtttacgttaaaaacactttattagggagaaaagaaatggttttacaaactgaatttgcacaaattaaggaaaatgatttatacatagatgatgtgaaagcaactgatttagttaaacaatatggaacaccactctatgttatgtctgaaggacatattagaaaacaatttaatacattaaaaacaaaaatgattgataaatatgaaaatacattaccattatttgcatcaaaatcattttcatgtaaagcaatctataaattagcaatggaatatggcgtaggaattgattgtgtttctgcaggagaaatcagtgttgcgttaaaagcaggatttgatcctaaaaagatttatttccatggaaataataaactaccttcagaaattcaatacgctttagaaaatggtgtagaaaactttgtcattgataacttctatgaaatagaacttgttgaagaaattgcttcaaaattaaatgttaaagtcaatggacttgtcagaatcacaccaggtgtttatgcgggtggacatgattatatccgtgttggagcaaaagatacaaaatttggtttttcaagtcatgataatacatacttaaaagccattaaaaaggttatagatgcaccacatatcaattttgatggaattcattgtcacgttggtagtcaaattgaagaaattcaagcttatgtacttgcaatgaataaatttgtagatattgcttatgaaatctatgatatctttggaattgttattaataagttaaatgccggtggtggttttggtatccaatatacagcaagtgatcatccactagaatttgatgacgttgtttccacaatcatggatattatttataaaggtttcgataaaagagatatgaaacgaccaatggtcttagtagaaccaggacgttattgtgtaggtaatgctggtattactttatatacagtaggttcttataaatatattagagatattagagattatattagtgtcgatggtggaatgacagataacattcgttcatcattatataacgctaaatatgatgctgttatcgttaataaagctggacaaaaagcaaatcatttagtaacagtagctggtaaaaactgtgaatcaggagatattttaattagagatattatgttacaagatcctcaaccaggagacattctagcaatgttctcgacaggagcttatcactattcaatgtcttctaattacaaccaattacctaaaccagcagtagtctttacataccaaggtaaatctaaagaagtcattcgtagacaaacttttgatgatttggttgcatatgatgtagattaaaaaatagaaatataccccaaggttgaatttaccaaggggtttttaatttgtaataaataaaattttatagaatgaatattattaaatgtgaaaaaatataattataatttttagaataaaaagcaatgaaattaatactgtacaatggtaaaatagggtatcaatatataatctttttttaagaaaggagctttaggaatgataataaaaaatattactaatcaatatcttattgaaagtgaagaaaatcagtattttgatcgtaaaagtgcaagaataaaaccagcagatatacttagacatattgttgcctttgcaaatgcaaatggtggagttttagctattggtatagaagataatggcgaaatcactggatttgatggtatgaatgcacataaagtaaatgaatttttagaggcaccttacttagttgatggaaacgtaaaaattaattatgaagaaagagtgataaaaaataaaaaagttcttttgtttgaaatagaacctagtgaaaattatgtgataaaaactaaggattccaaagtgtatttaagagttggtgataaatctaaattattgaatcatgagcaaataattcaattagaatatgataaaggtgaaagaagattcgaggacctagtagtagaagaatctacatttgaagatgttgatatcaagttgctttctaaatataaagaaattttaaatactaatttatcattagaagaaattcttgaagcaagggcacttatgaaaaaagggcatttaacctatgctggtatattattgtttggaaaatttcctacaaagtatttgcctaatgcacgtgttagattattaaagtttgaaggaaatagaatggagacagggaaaaggttaaatattattaaagaaattaattatgaaaatgctattcctagaattatagaagatataaagagagaaatgcattctcaattaagagattttcaatatttagcagaagatggtgtatttaaaacaattccagaatatcctgaatttccatggtttgaaggaattgttaatgcgataacacatagaaattattcattacaaggagattgcattagaatttcattatatgatgatcatttagaaatttttagtccagggaaattaccaaatatagtgacacttgaaaatatgaaatatactagatattctagaaatcctcgaattgcaagggtgttaacagaatttggctatgttaaagaattaaatgaaggagtaaagcgtatatatgatgaaatgcaggaatcatttctaaaagatccaatatacacagagcctaattcttcgtcagttttattaacactagaaaacagtattgtttctagaaaagcaagaatcgaagaaaataggaatactatttttgacccaactactttacctgaaaaacaattattggtttatggtattatatctagtcatccaggattaaatgcaaaacaaatttcagaaatgttgacattaaaaaagagtagtatagaaactgctattaaaggattaagaaaaaaggaaataattgaatatgaaggaacaaccagaaatggtgggtatattataaaaaaataattttataatatacccgagatgaccaccgagatgaccaccgagatgaccaccgagatgaccaccgagataaaaaatagaaagttatgataaagaagaacaacttatgatatacttaagcaaaggacatagtcctaatgataagtatgaaagctatgatgaaatactaatgcctataggcgcattattgaataatacattgaattatcaagaaaagaatgaagtaataaaaggatatggcttggatgatgaagaatttgaagaaaggatgagaaatatgtgtaatttaggagaagttatcgaattagaagcgttggaaaaagggacaaaaaaagggacacaaaaagagagaattagaaagaatatagaatatgtaagaaaaatgatgacaaaattgcaaatgacatttaaagaagcaattcaatttttagaaattcctgaagatgaagaaaaagagatagaagaatattttaaatcatagattaaaaaaattaaatataattcttattttttcaaattatgaaatgaaagagttccttgtttactaagtgctataatacatttagaaaaacggaggtagagaaaatgagttttccaaaagattttttatggggtggagctattgctgctaaccaatatgaaggtgcttggttggaagatgggaaacaaccaaacgttacagatgtacttgtaggtattatgtctaaagatcctggtattcaatggaatgaagataagaaaaaatatgaaatgaaattaaattctgataaagtttatttatcacatgatgccgtagatgggtatcatcgttaccgtgaagatttaaaattaatgaaaggtatgggattcaatagttttagaacttctattgcttggggaagaattttccctaatggggatgaacttgaaccaaatgaagcaggtcttgcttattatgatgatatgtttgcatgcatgaatgaattaggaatggaacctgtcattactttatcacattatgaaacaccattacatttaattactgaatatggtggatggtctaatcctcaattaattgatttttggttacgttatgtaaaaactgtttttacacgttataaaggaaaagttaaattctggcttacatttaatgaagtcaatgcgttatttagaatgccacttgttgctggtggggttttaacaattaaagatcctaaagatcctagtgatccaattggttcaactacaaaacaagatcaatgggatgcttatcataatatcttagtcgcaaatgcgaaaacagttcaattaggacatgaaattagtgaagattaccaaattggctgtatgatgacagcttcatcagtagctacttatccatataactgtgatcctttaaatgttgttggaactttagatgctcaacgtatgaatattttctttatggcagatccattctgcttaggtattgtaccaacttatttaaagaaagtatggaaagaagatcaagtaaatgtagaatttagtgatgaagaattaaaattgattaaagaaaatacagttgatttcttatcatttagttattatcgttcaacaacatttgatcgtgatgtgaacttaaaagtagatacaggtggacttacatgccgtgataatccatatcttaaagataaagcacctcaaccttggggatgggctgttgatccggtaggattacgttatactttaaatgttttatatgatcgttatcatttaccattattaattgtagaaaatggtgttggtttagatgaaaatattgatgaaaaaggtgaaattcatgatgatttcagagttcattatattgaagaacacttaaagaatgttaatgatgctattgaagatggtgttgattgtcgaggttatttatattggggaccaattgatgttgtatcagctggtactggtgaaatgaaaaaacgttatggttttgtttatgtagatcgttttaatgatggacatggtacgctagaaagaaaattaaaagattcttattatcgttataaagaaataattgaatctaatggagaagttttattagaggatgaataaggtgtgattttaaaaatcacatctttttttgatatttttttagtgtaatcatatatgatgataaaggggtaagcaagatgaatacctacgtataacttattgtatgaatggtatcttatttatcatgacttatgaaatttgcatattttctagttaaaagaattaaagaatccttttttgatttttagccatagtatccacctctttaagacaagtatataatattttaaaaaagtgatagattatactcctcggtttaaagtgataataacggtgttaaatcaaaaaatgtgtcagatggttaattaagttttttaacaatataatttcttttatttttgtttttgataagaataaattgatttttatttaagaaaaaatataataaacatcatagacaaatcatgaacaggttttcttccttaaataattttttgacaataacattttgaaatttgcacaagacttgtaggaatttatttgaaggccatttggtcttttttttatcttttttataggtttgtgttataattgatgaaaagaggtgaaaaaatggaacactcaattaaagcaggacttatgattacaagtgcctctgattataatatggaaatatgccgaggagcaaatgaagcgtgtaaagaactgggaatagaacttgttatcttttttggtggttcagttgatccaaatgtaaagtttgtacaatcttctgattatcaaaaagcaaatgtctatgcttttgcaaattatttagatttagattttttagttattcccgcttcaagtatttgtcgtacggatcaaaaaacaagagaggcttttccaaaatattttcatataccagtagttactttaaattcacaaataaaagattatccttttgttgtctataataacaaaaaagctgtttatgatgctgtaagttatatgattgaaaaaaatcattgtcaacatattggaattattactggttatgatagaggggttactgccaagcaaagacttgcaggctatcaagaagccttatcaagtcatgatatgctttttgaagaaaagtatattttatcgacacctggttataatattgattcgggaaatttaatgaataaatggcttcaagaaaaccctgaattagatggaattatgtgcgtgacggatgatattgcttattatttatatcgtgaattagaaaaaacaggaaaacgtgtaggtaaagatattatggtggctggttttgatgataaaccagaatcaacacatatggttccaccgcttgcttcttgtcatgcggatgcttcttttattgcttatttaggaataaaacaaggctatgatctttataaaaatggttctacacaaaatcaatacatagatgcccattttattcctcgtctttctgttgattgtgaaaaccatgaagaaactgaaattggtgaatttattcttttttgcagagctgaaaaagaaagtaatgaatatatagctcaaggaatgacacaatatgtttttgataataaattggtttatagttccaattatcaaaaaactgtatggagtttctttacttatttattggatctttcggtaaaagattgtacgaaacattacgtttatcaacaaataggagattatattaatttgatttttaatgaagatgatattcgttatttggatttagaaagactctttttgtgtctatcatttttaataaatactgaaaactacctcaacatggaagataaaataaaactccaatcttttaaacaatatatttatttacaaatgattagtagttataattatcttcttttgttaaaagaaaagcgttatacaaggagaatgagaagtattggacaagtgaataaagggatgttgtttgaatctttgaatgatgatatttatgctattgcggataatataccttctctaggtattcataatgcacagctttatctttttgaaacacctgttatgacttatgaatttagaccatttatcatgccaaaaacaatggaattaattataaatgtagaaaatggccaaagacagcctattaaaaatacacatgtgttactaaaagatgttttaaatcttgcaaagcaaccttataaaatacttacaagcatttactctaatgaaaatttttatggctttttggtgacggattgtacatattttgatttagaaacacttgaatatctttctaatcaaattgggatatctttaaatgtcaatgccattgttagagaactaaatagtatttctaatacagatgaattaactcatatttataatcgacgaggactgattcaaaatattaaacttctttataaagaatataaagaagtttctgaaaatctttatttctttataggagatttagataatttaaaatatatcaatgatacatttggacatgaccagggagataaagcaattcaaatagtatgtgaaatactaaatgatatttttcaaacacatgctgttattggacgcttaggtggcgatgaatttggtattgcgtttacttgtaaaaatgaagattttattattcatattgattcattaattcaagaaagaacacaatattttaatgaaaaataccagttaccttattatgtcagtttatcctatggaataagtgtctttgactataatagtccttttgatttaaatcataccattagattggcggattcattaatgtacgaaagaaaaaaggaaaaacatttacaaagaggaaaaaaaggataaggaggaactattttgaaaaaaaacaaaataaatctttcaagagaacaattggaagaagctattcaattatttaatcgaagtatggatgattatttatatctttttgatattcaaaatgattattatagtatttcaaaacatgccgtaaatcgtttttgtttgccaagttatcatttttgtgatgcaacaaaagcccataactattttgtttatgaagacgatcttcctttattatttgatgagttcaataaaattaaatcgggagaaattactgagcatagtttacattatcgttggttagatcgacaacataatccagtttggatcaattgtcgaggtgatgtgattttagatgaatttaataaacctttatatcttattggttgtgttaatgaaattggaaaaagacaaaaagcagataatattagtggacttttaagagaaccaagtttagaggagtatgtttcttctaaaagtaaaaataatattacaggttattttatgcaaattggtattgatgattttgaagaaatcaatgggcgttttggtttaaagtgtggagatgaaattttaaaacagttttctaggtgtatgcaatcgtgtatcaatgaaaatcaaaagatttatgaattaggaaatggtcgttttatgattatggacttagtaaatcactcaaaagaagatatcttagaactttatgatgaattaaaaaaatcaattgaggttgctttagaagagaatgcctatcgcatggtttacacgatttcagtagggattgttgagattgataaagagatgcaagactatgatacacttattaaatattcagaatttgctttaaacgaagctaagaaaaaaggaaagaatagttgttatttctttacacaagataaatataaacaattcattcgaagaagagaaattcgcgttggattacaaaatgcagttgatcacaattttaagaattttgatgtttattaccaaccaattattgatatacatacaagaaatcttataggtgcagaagctttaatgcgttttaaaatgaaaagaaatgaacaaattgaatttgtttcaccagcagaatttattcctattttagaagaatctggtttaattattcctactggtcgttggattttaagacaagcggttgcttgttgtaaaaagtggcaagaatttattcctgaatttaaggtgaatgttaatttgtcctatgtacaaattattaaaagtaggatcttagatgaaattaaacaagctttaaaagattataacttaaaacctgctttgttaggaattgaggttactgaatcaggttatttagaaaatacatatcattataaaaaactttggtcatcattaaaagaagaaggaattacgcttgttttagatgattatggaacaggttattcaaatgcatatcgtttaagcaatttaacaccgcattatattaaaatagatcgtgttttaacccaaaaagcactttcttcaaattatgaaagaagtattttgatttatattattgaaatggcacattctttgaaattgaatgtatgtattgaaggtgttgaaacggaagaagaacttcaagaaatcaaaaaattaaatccagattatatccaaggttatctttttggaaaaccagcgccagaagatgagttttataatcgacaaattaagaagaaataattcttcttttttgaattttacataaacttgatagatggtagattgttgaaggtgtaaaatgtttttatattaaataagaaagagtgtataaattattatatattgggggaataaaaatgaacgtatgccgagaaaatagagagttatcatggcttaaatttaacgatcgtgttttaatgcaagcaaaagatccacaagtaccacttgcggaaaagttaagctttatttcaatttatcaaacaaatttagatgagttttttatggttcgtataggatcactttatgatcaaatgttattttatccagattccaaagacaataaaacaggaatgacgggtttagaacaattaaaagcatgtttaaaaaaagtccattatcttaataaaaagaaagatcgtatctatgaaaatgtgatgtcggaacttggacaatcaggatggtcagtaataaaatataaagatattgaaagcaaagaagaccgccgttattttgctgattattttgaaagagaattactaccacttatttcaccacaagttatttctaaaagacaaccatttccatttatcaacaatcgtgaaatgtatgtcgttgtacatcttgaatcgaaaaaaggtaaaaggaaaatgggaattatttcttgtgctaatgcgatggatgaaagactgattgcacttccaagtcaaccacaaaaatttattttagtagaagatattattttacattttgtttcacgtattttttctaaatattctgtaaaagaaaaagcacttattcgtgtaacaagaagtgcggatattgatgaagatgatcattcattagaagggcatgaagattatcgagaaatgatggaaaacttgattaaacaaagaagaaaactttcgccaatgcgtttagagatgacaccaggattggacgaacttgaagtacttatgttgatgaatttcttgaatttaaagaaaaatcaagttttcattaataattcacctcttgattttggttttgtgggtgaattaagagagcgtttaagatatatttgtccaagtatgttctataaacgtttagaagcaagaaataatgcattcgttgaaaataaagtaccaatgattaaacaaattttaaaaagagatttattactttcttatccgtttgaatctatgtcaccatttttaagacttttagatgaagcaagtaatgataaaaatgtggtaagtattaaaatgacactttatcgtgtagcaaagaattctaaaatcgtaaaatctttaattaaagcagcagaaaatggaaaagaagttgttgttttagttgaattaagagcgcgttttgatgaagaaaataatattggttggtcgaaacgtttagaagaggccggatgtcgtgtgatttatggtttagatggtttaaaagtgcattctaaattatgtttaatcacgtataaaaatgaaaaaggaattcaatatattagtcaaattggtacgggaaattataatgaaaaaacatcaaaactttatacagatttatcattaatgacttctaaatatgaaatcggagaagaaattaatggagtctttaatcatttatgtttaggtgaaaccgaaaatcatacagatttactcatggtagcaccacattgtatgatcagtcatatctttaagtatatcgatgaacaaatcgaacttgctaaacaaggaaaagaagcttatattggctttaaatgtaattcggtaaccagtaaaaagatgattgataagcttattgaagcaagtcaagcaggggttcaaattgatatggttgtaaggggaatttgttgtcttattcctggtgttgaaggagcaacagaaaatattcgagttctatcaattgttggaagatatttggaacattctagaatttatatttttggtaaaaataatccaactgtttatatttcttcagctgatttaatgacacgaaatcttgaaagacgtgttgaagtggcagcgcctgtattagatgaaaaattaaaacataagttactaacaatgtttgattgtatgcttcgtgataatgtaaaagcatgttcgttagaaaataatggtaaatacaaacgtataaaaaataaaaatagagaaatgaatagtcaagaatacttttttaaaaatgatgtgaaataggaggagttttatgagagttggaattcttacaagtggtggtgattgtcaagcacttaatgcaacaatgcgtggtttagtaaaagcactttaccaacaaagaaaagatattgaaattattggctttttaaaaggttatcaaggattgatgtatgaaaaatataaaaagatgtctttaagtgattttgaagatattttaaatgttggtggaacgattttaggttcttcacgctgtccttttaaaaaaatgcgtgttattgaagatggttttgacaaagttgaagcaatgaaaaaaacatataagaaattgaaacttgattgtcttgtggttttaggggggaatggttctttaaaatcggcgaacatgttagcacaagaaggtttaaatgtgataggactccctaaaacaatcgataatgatacatggggtacagattatacttttggttttcaaagtgcggtggatattgcaacaaactatttaaatgaaattgaaacaaccgctaaaagccatagtcgcgttttcgttgtagaaatcatgggacataaagtaggacatatttgcttacaggcaggtattgcagcaggagtggatgcgattttacttccagaaattccttatgatattaaagtggttgcaaaaaaaatcaaagaaaatcaaaaaacaggaaaagaatatacaatcattgcttgtgcagaaggagctattagtgaagaagatagtcttttatcgaagaaaaaatacaaagcaaaagttgcaagtcgccaaggacgttcggttgcttatgaaatcgctgaacaattacaagagttgattcctaatgaaattcgtgtggcgttagctggacatattcaaagaggaggcaatccttgtagttatgatcgttttatggcaacacgctttggggtatatggggcaaatcttcttttaaacaaagattttggaaaacttgttgtttttgataaaaatgaaatcaaagcgattcctttaagtgaaacagcaggtaaattaaaatttgttgatcctgagtgtgaagttgtttcgagtgctaaaaaaatggggattacatttggcgaataaacagcatataatggtgttttttcacatcgataaatagtgtataataaagctatgttgatatgaatgaaggtgtattatgagtagtgaaataatgagtttagaaatggatgttttttgtttattgttattgattcgaattttatatcaaatgtatatcaatcgtgaacaaaatgatcataggaactatttttatcataccattgcttgggcttgtgtttatttgtttatggatgcaatttggatcatgaatgtaaaacatcttcttacttttaataagattcaaagtggaatatttaatagcttctatttttgttcactagcaatgcttgtttgttcttggtatatttatgctcaaaaaacatttcattcaactgtttttgagcataaaaaacgcttagtgcctacttttattccacttattttttttataggatcttctttggtttcttattggacacatggattatttgttattgatcaagcaggaaactatcatcgtggcaaattgttaccattctattttttaattttatttgcttatatcctttatctttcaataaaagcaggatatttatctaaaaaagcaaagaattacttatatcaaaaggaatataaagcgattgctcgtttttcttttcttccttttattactgcgttaattcaaattacagtagatcatttacttatttttaatctaggactcacatattcaatttttattgtttataattattttcaacaaaaccttatttcattagatccacttaccaaaatcaataatcgagaacaattggatatttatttaacaacgaaaatgaaagaaaatcatcaaaaaaaagatctttatttatttttattagatattgatcaatttaaaaagataaacgatgaacttgggcatgttgttggagatcaaatcattttaaagacagccgatatattaaaacaaattgcacatttacataattgttttatttcacgttatggtggagatgagtttatcatcgtatgtgaaagagataaaaatgaagagataatgcctgtatttaatgatttacaaagattatttcagcaatctcatgaaggtttaccagattttagtgtgagtattggttatgctaaatatgatgagtcattaaattatattccaaaatttattgaaaaagcagatcactatatgtatctaaataaaaatgtgaaaaagtgataaaaatgagtcatggaaggagaatgtgtatgccaaaaagaaaagcgaaaatattgattgttgatgatgcccagattaatcgaataattttatgcgaattattgagggatcaatatcaaattttagaagcagaagatggaaaaaaagctttagaaataatgaaagaagataaaatgattgatttagtcttattagacattgtaatgcctaatatggatgggtatcaagttcttgaaaagatgaaggaacaacgttatttagaatatcttcctgttattattatttcttcagaaggaaatacgacttctatggaaaaggcttatgaacttggagcgactgattatatcagaagaccttttgaaagttatattattaaccgaagaattaaaaacactttaatgctttatgaaaaacaaaagaaactggttcatttagtagaacaacaagttcaaaaaagagtaaacaataatacgacattaatcaatgtcttaggacatattgttgaatttagaaatggcgaaagtggtttacatatacaacatattcaaacgattacaaaaatgcttttactacaattgggtaaaaaatcgcacgaatataagttaagtgatgcagatatcttacttattagtacagcttcatctttacatgatattggaaaaatttcgattgatgaaaagattttaaataaaccgggacgacttacaaaagatgaatttgaaatcgtgaaacagcattcttcgattggcgcagaaatgttgaaaacagttcctaactacaataataatgatttattggagtatgcttatcaaatatgtcgttggcatcatgaaagatatgatggacatggctatcctgatggattagttggtgatcaaattcctatttcagcacaagttgtttcaattgcggatgtttatgatgctcttacgagtgaacgttgctataaaaaagcatatagtcatgaacaagctatgaaaatgattgttgatgggcaatgtggggtttttaatcctctgttattggaatgtctttgtgatattagtgaagaaatgaaagcgtctttatttgaaaatgaaaattatgcagatcaagcagttgtttcaaagatgacagatgagctagttattaaacaatttagaagtgaaatgcctaaagaaaaaaataatgagtctcaaaacagaaaattttttcaggaaatgacatttgaatacgatgcatttaaagatgctgtttatatttcttcacaagcagcaaaagatctaggaattgatgaaataatttatcacccaaaaaatcatgaattttctttttttaataaatcaacaattaaattacttaaggataaactcaaagaaacaacacatttaaatccagaggttgacttaaagatttatgcacatattggaaaacaaaaacaatggtatcatttacaagcaagtacgcggtggaatggaagtgtttataaaggatttgttggaaaacttgttaaagacaacaatattcaagttatacataatattcaagaaaatatttctttaaaatatacatatactgaaataaaagattttattgaatccttaaaagatatttttacggttgttcgtttgatagattttcaaaaacatcaatccgcaaaagcagagaatgatcaaatagaaattattgaaggcaattgttatgattactggaaaagaaaagatgtttgtgtcaattgtatttctaagcaagcgtatatcaaaaaagggcaagcttttaaattagaatttgttgattataacatttatgccattattgcgcagtatgtagaagtggatgagcgcccttgggtcttagaacttgtttataaaacaaaagaagatattattttaggagctcatggaaaaacacgattcttagaaaatatcgtaacttataataaagagtactatacagatgttttgactggtgcttatagtcgacgttattatgaagaatacgttcaatacatcaatgatgtatcagcagtagcaatgattgatgccgataatttcaaggcaattaatgatcaatatggtcataatgctggcgatcaagcgatcaaagctgtttctaaagctattcaatcatgcattcgacctgatgatatctttatacgttatggtggggatgaatttgtacttattttccaagatatttattacgatgcttttacaagtcgtttgtatcaaattagtgaatgtgtaaaacgaacaaaagtagatgattatgaagatttatcattatcaattactgttgggggtatttatggaaattcaaaagtcaatgatgcaattaaaaaagccgataaattgatgtatgaaggaaagaaatcaaagtgttcggtcgttgtaaagaaaacaagtgaggtggactaaggttcaccttttgtatttgtcaagttattttataatactgaaaaaagtaagcggtttttcaaagaataagttataatggattttgaaattttgtatatcaaaacaaggaggaagaaaaatgagttttccaaaaggattttattggggtggagcaacagctgctaaccaattagaaggtggctggcaagaaggtggtaaaggtatttcttgtccggatatttgtacaggaggaactgctacaaaaagtaaaagaattacaccagtattagaagaagggacattctatccaagtcatgatgcgattgatcattatcatcgcttcaaagaagatattgcgttatttgcggaaatgggatttaaaatgtatcgtttttctattgcatggacacgtattttcccaaatggtgatgaagataaacctaatgaagcaggtttaaaattctatgaagaattaattgatgaatgtttaaaatatggtattgaaccactcattacaatttctcactatgaagtaccatttaacttaacaaaaaaatggaattcatgggtagatcgtcgtatgattgattgttacttaaatttctgcagagctatttttactcgctataagggaaaagtaaaatattggctaacatttaatgaaatcaatagtgcaacaacagcaatgggagcatttttaggacaaggtatcttaaatgaaattaaagaaatggaatttatggatcaagtagacgttcctcaaaaccgtttccaaggattacatcatcaatttatagcaagtgctttagcagtaaaaatggcacatgaaattgatccaaactatcaagtaggatgtatgcaaatcatggccacaagttatggccttacatgtaatccagatgatcaaattgaaaatcaacaaaaaaatcatttaatgaactggttctgtagtgatgttcaatgccgtggtaaatacccaaattatatggaaagatatttcaaagaaaataatattgaaattaaaatggaagaaggcgatgaagaaattcttgcaactggtccagtagatttctatacatgttcttattatatgtcaaattgtcaaactgctgataaatcaaaagaaggtggaaaaggaaatatcttaggtggagttcctaatccatacttaaaagcttctgactggggatggcaaattgatccagttggtttaagatattctttaaatgaaatctatgatcgttatcaattaccgatttttgttgtagaaaatgggttaggtgcttatgatacaattgatgaagatggtaaagtaagagatagctatcgtattgattatttaagaagtcatattgaacaaatgcatgaagctgttttagatggtgttgatttaagaggatatacaccttggggatgtattgacttagtatcagcttcaactggagaaatggcaaaacgctatggatttatctttgtggaaagatatgatgatggtacaggtgattttgctagaagaagaaaagaatctttctattggtataaaaaagttatcgaaacaaatggagaagatttaaaataatagtaaaagagctcaattgagctcttttattactttgttataaaattaataccacgtgcttgcgagtgataactctatagctttagcgttaagcaaaaagcctccagtgataaactaaaaatagcttaacagttagaaatagaaatcaagaagataatatttagatagatttactccttttagtaacaaacaaccatgccatctttatcgaattaatacctaaatttattggcaaagatagttgtaatgcgttataatcattttgtttttcatatataaattatataacaaaaaagaacaatgtttcagcttttgctgtttcattgttctttttctatttttgactgtcaggcttcggtaagtgaagactttggaagtacataccgcgtcttttaggcatgtttattactattgtggtaaagtatctttgtaattagaataatcattttttacaacatcagcataagctttataagcctcttcaagtgtattgtattgtttttttccatctatgtatgatttatattgactagaaccacttttaccggttggagcgatcgctatatatggtttatgagcactatcttttcgttttcgtgcagtcgttgatgatgaaatgtagaattttccatcagctgtactaataatgacaggaatttgtgtgttagcattgattttatctgtatcaattgaagtccaaaataaatatctttcagattcttttcctttttttgcgtttccataataggcccatgtaccatggtttaataaactcttattttcaatctgtttgtttaattctggaaccattgttgaaccatcacattttgaatcaatttcaaaaaaatctctatttttaagatcattttctaataaaccgctattatttaatgcactatgtaaattcgatgaaaaatcaatagtagattcttctgttttacttcctttccaattaaaaacaacagtattcttttctttgttgtatgagatttcacaaacgccaccggctttaggaattcctttccagttatcagtgtcaggatctgatttcttgtgcgtaataccagcaatagttacagaatcaaaagcttgccaatcatctttcttttgtgtaagttctacttctcttacaatatctgttttatatcctgtttttcccatcgcaatgatatctgtacaagcaacacgaacgttgatgaggtcacgcgattctcgactttcttcaaggtatccttgacaagctggaatagcgatagctgcaagaatggcgataattagaagaactactattatttctacaagagtaaatcctttattttttcttttcataggcaccccttctttaatgaatgatttattttactttatcatatttttattaatttgtgagcatttatgagctttttttgtttcttcttctaatacttttaaaaaatattgtgcaggtttagaaaggacacgatattttttccaaataaaggcaagtgatgaagtgatttgtggatcaaggggtctaaaacacaaagaactttccccacttgtattaatgaggttttttaaagaaatcacagctccattacattcctttgttagaatactggcattgtaaattaagttataggttgcaataatatgatatttagaaaaataaggattggcccagttttctatttgtttatattttaattcttgtgaggaacaaagaagaggaacatcaattaaatcttgaggagtaatcgattcttttaaagcaagaggatgttctttgtttatatagattccccataagtcttgataaggtaaagataaatgattgtatttataaatattagcaggttcaataatcaacccaaaatcaattaaacctttttcaagacgatctgtcacatcttgttcattaccactgaataaatggaattggatacgtggataatcttcttgtacacgttgaatggctttacaaatgatttcgatgcctaacgtttctccactgccaatacatacttccccacttaaagtttcatcgaataacataatttcactttctgttttttcaaccaaactgacaatttcttcagcacgttggcgaagtaaaataccttcttcagttaaagtaatcttacgattaccacgaatgaaaagctgtttttgtaaatgatcttcaagttctttcatttgtcttgataaagtgggctgagtcacgtttaagctttcagctgcttttaaaattgtttcctctcttgcaatcgcaagaaaatattgtagaagtctaaattccatgatttcacatcctttgtttttattttaaagctctttgttatgccttgcaagtatagaaatatatttgttataggtatttgataatatagagataaagaattacaataataaaggaaagtggtgatagctttgggaaaagaagtaattgaagaattaattatgaatttaaaagatgcaggatgtgatgaagaacttattacaaagtgtattaaaaaatataataatgatgatttgaagatgttgataaaatcattacagtgtcatcgttgttgtttattagataaattgcacgaggaacaaaagaaaatagattgtttagattatttaatatatatgttaaagaaacaaatgaaggaggattaagatggaattagttaaacaagcttatctaaaaggagaaagagctttatttaaaagtcatgatttaaaagttgaagatagtatttttgctgatggagaatcgcctttaaaagaaagtgatcatatagatattagtggaagtatttttaaatggaaatatcctttatggtattgtaatcacgtcaatgtagaaaacagtaccttacttgaaactgctagatcaggtatttggtatactcatcatattaatattaaaaatagtgtcattgatgcgcctaagacctttagaagagggacacatatttctttagaaaatgtcaatatggttaatgctcaagaaaccttatggaaatgtagtgatattaagttacataatgtggttgctaaaggtgattattttggaatgaatagtgaaaatattgaaatcgatggtttgaatttatcaggaaattattgctttgatggtggtaagaatattactgttagaaattctaaacttgtttcaaaagatgctttttggaattgtgaaaatgtcacggtttatgattcagtaattattggcgaatatcttgcatggaatacgaaaaatattacttttgtgaattgtacaattgaaagtttacaaggattatgttatatcgaaggattaaagatggtaaattgtaaattaattaataccactctagcttttgaattctgcaaagatattgatgcacaaattgtaagtcatattgatagtattacaaatcctatttctggtaaaattagtgcacatagtattggtgaaatgattattgatgatcaaatcattgatccaagtcaaacaaagattcaattaaaggagatgtaaagatgtacgatttttcaaagatgaccaatcgttttaatacaaattcatataaatgggatgttaaagaaaacgaacttcctatgtgggtagctgatatggactttgaaacagctccagccattatagatgctttacataaaagagtggatcataaaatctttggttataatacggtacctgatgattattttgaagcttatcaaaattggtgggaaagaagacatcattttcatatggaaaaagattggatgatgtttgttacaggagttgttcctgctatttcttcggtagtaagaaaagtgacaacagtaggtgaaaatgtcttgattatgtcaccagtttataatattttttataattctattttaaataatggaagacatgttttatcaagtgaccttgtttttgatgggaaagaatatcatattgattttgaagatttagaaagaaaactttctttaagtcaaacaacattaatgattttctgtaatccccataatccaataggtaaaatttgggataaagaaactttacaaagaattggtgatttatgtgcaaaacatcatgttattgttttaagtgatgaaattcattgtgatattaccaatcctcaaaaagaatatatcccttttgcttctgtttcaaaaacaaatttagaaaatacaattatgtgtattgcaccaaccaaagcctttaatatggcagggatgcaaacggcatgtattgttgtagctaatgaggtattaagacataaagttaatcgtggaattaatacagatgaagtagcagaaccaaatagttttgcaatttgtgcaacaaaggcagcttttaatcaaagtgaagattggattaatgaattaaatcaatatattcaaaataataaagattatgcgatttcatttattcaaaaagaaatgaatgatgtttatgtagtgcctacagaagcaacttatcttttatggatcgattgtcataaggtatgtttagatagtgttgaactcacttcttttataagaaagaaaacaggtctttatgtaagtgatggtctagaatatggtgaaaatggaaaagcttttattcgtatgaatgtagcttgcccatttgaaagattaaaagatggcttgaatcgttttaaagaaggaatttatttgtatcaaaacaaataaattctttttttaaagaaaaacgtataaaaaaaacacaatataaataataggagaatcaaaagatgaaagagaagataaccataccattttataatgacctattatttaagtattttgtttatgataatgaagatttagaagtaataaagagaataataggaaagtaaggtacgagaaatcgtacttttctttttctttaatattgaaaaataaattatatttctttaatatatttttgaagaaaaaggggagaagtgaatgattaaattaatagcaacagacatggatggaacttttttagattcttctaaaagattttcaatggaattttttgatatttttgaggaacttagaaaaagaaaaataaaatttgtgattgcatcggggaaccaatatttccgtttgtatcaaaaatttttaccgatttctaatgaaatgtatttcataggagaaaatggaagttatattgctaagggggtaaaattgattgcgacaaatacgttaaaaaaagaacaagtacaagcggtgattcaattagtagaatctcatccagaattgaatatgattttatgtggggttaaaagtgcctattgtttaaatgaatttaaacatttagaaccagtggtacgtacgtattattgtaattaccaatttgtagagagttatgatgatattgatgatgaaattatgaagattgctatttatgatccaaatcatcaaattatccgttatgctgatgatattgcttgtggtttagataaaggtgttaaggcaacaacttcaggtaatgaatggatcgatattcaaaatgaagatattaataaaggtgttgccataaaacgcttacaaagagaattgaatattaaaccagaagaatgtatggcgtttggtgatcaaatgaatgattatactttattaaaatctgtcaaatatagttatgctatggccaatgctgttccacgtattaaagatattgcttatggcattgctaaaagtaatgatcatcaaggtgtattagaagttataaaaaaagaagttttgaatcaaaaataaagtgtaaactcttacattgaaaattgtttttgacatattaaaataaataatgacaattgaaattattgtgatataatgaggaagttattgaagggagagtagcgtatgaatattagaaatatagcgattattgcccatgtagaccatggaaaaacaacattagtagaccaattattaaagctatctggaacattagaagaccgtgaacaaattagtgaacgtgcgatggatagcaatgcccttgaaagagaaagaggaattacaattcttgctaaaaatacagcaattaattataaagattatcgaatcaatatcatggatacaccaggccatgctgactttggtggagaagtagaacgtatcatgaacatggtagatggtgttttattagtagtagatgcttatgaaggaacaatgccacaaacacgtttcgttttaaagaaagctttagctgctaaagtaaaacctatcgtagttattaataaagtagatagacctgtaacacgtattgatgaagttatggatgaagtcttagaattatttatggaattaggcgcagatgatgaccaattggaattcccaacaatctatacttcagctttacaaggaacatcgagtttagatcctgatatttcaacacaggtaccaaatatggattgtttatttgatatgattatcaaagaaatacctgaaccattagtagatgttgatggacctttacaattccaaccagctttattagactataatgattatgtaggacgtattggaatcggacgtattcaaagaggtaagattcatgttaatgaatcagtcacttgtgtaagagctgatggaagccacacacaatttagaattcaaaaattatatggatttattggattacaccgtattgaaattgaagaagccagtgcaggagatattgttgctattgctggtcttgctgatattggtgttggtgaaacagtatgtacaactggtcaagaagaagctttaccgttattacatgtcgatgaaccaacaattcaaatggtttttggaacaaataccgctgaccctctgcttgtaaggcagatgctctcccaactgagctaagcctcctcgactagtgcccacttataataacatccttatccatttacgtcaactcttttttacactttttttgtgtttttttataccttttttattttatgttgattttatcaatgttttttatttctattttttatactttttttattattattgattgccttttattatttggtataatgaatacgtaaaaagtatatatggaggtaataaaatgaaagtacttgttgccggaggtgctggctatattggtagtcacatctgtgttgagttattacaagctaatcatgaagtaatcgtaattgatgacttttctaactctaaaccagaagttttaggatatattaaggatataactggaaaagacgttaaattttatgaatttaatattttagatgaaaagaaaacagaagaagtttttaaagaaaatgaaattgatgctgttattcactgtgctgcttttaaagctgttggtgaatctgtagaaaaacctattgaatattatacaaacaatttaacaacaactttaattgttgctaaaatgatgaaaaaataccatgtcaataatatcgtcttttcatcaagtgctacagtttatggagatcctgaagtggttcctcttactgaagattgtaaattaggagaaacaactaatccatatggtgctagtaaagccatgatggaaagaatcttaacagatgtacaacatgcatgtcctgaaatgtcagttacattattacgttatttcaatcctattggagctcatgaatcaggattattaggtgaagatcctaaaggtattccaaataacttaatgccttatattatgaaagtagctgctggagaacttccttgtttaggtgtctttggtgatgattatgatacacctgatggtacaggtgtacgtgattatatccatgttgttgaccttgctaaaggacatgttctagcaattgaaaaatacaacaaacctggattacatgtttgtaacttaggaactggtcaaggatatagtgttttagaacttgttcatgcttttgaaagagttaatggtgtaaaagtaaaatatgaaattaaacctcgtcgtgccggagacattgctacatgttatgcagatcctacaagagctaaagaagagcttggttgggttgctactagaggcattgatgaaatgtgtagagatacatggaactttgctaaaacaagaatgaaatagcctctggctatttttttattgtttatataggtgaaatttggtattatagaaaagtataaaaggaggagcttctatggatttttttaaaaaaatcgggaaagaagtgagcgtctttgggcttgtatttgtagtttttattgcattatttgcttatcgacaagttacacatgttgaactttcaacaatttcccaagataaattagaagaaaaaatcaaagataaagatagttttgtagtcgttgtaggtagtgataaggataatacgacattaaactacaaaaatgtttgcttaaaatatttagaaaaaaatcatagtgataaaatttattatgtaaatttagctaaagaaaataatgcaacaacatacattcaaaaaacttttaaaacagatgacggaacaattccttcaacattcgttatgaaaaacggaaaagtaaaagttcaaaaatctggttctttatcatattatagaattgctgaattatttaaataaaaagcgaactcatatttgagttcgttttttataacaattcttttacttgtccatcttgaacatagacccttggtacacgtttagaaatcaaacataaaacttcataagaaatcgtatctagatctttcgccatactttcaagagaaatatgttcaccaaaaatttccacttgatctcctatttttacattttcatctactctaaccatcatttgatccatacatacacgtcctacaatttcataatacttaccattgatatatactttacgcccttgattttttctaataaaaccatctgcataaccaattggtaatgttgcaatatattcatcttctttagccgtatatgttaaaccataccctactcgatctcctgcaggaatttttttaatcattgctacttttgtataaagtgacattacttgtttgaattttgtttcttcttcaccatttggtgaacatccatacatggtaattcctaatcttcccatatttgatttttcatcatgatgataagtcatcgctgctgaattacaacaatggatatatttgaatttacaattacctatcatttcataaaataaacttctttgtttttcgtaggcttcatcatctccatcagctgtcgcaaagtgtgtaaagattccttctacattaaatttatcaggatcaactagttttaataaagttgataattcttctttagacattaaaccaatacgatgcattcctgtatctaacttaatatgcacttttaatgtttgccctttatcaattaaatgatccaataattttaaataagcaactgaaaccattgttaaagaaatatcatatttaatagctaaatcaatatcttctttacttgttggaatagctcctaaaatcaatattcctttattaattcctaattctcttaactcaattgcttcttgaagtgttgcaacagcaaacatttcaatataatcaatatcctttaaaaaactagcaacttctttatacccatgaccataagcatccgctttaatcacagccatcaacggtcttttaaattcactatgtgctaattcaacattatattttaaatggtctaaatctacaattgcatacgtgtcacgctttaaattcataaagacacctccaaacaatagtataatccaacccatttcataattcaatttgaaatctctttattttgtcgatgaagtttgcatacttgtcatgactgaaagcatttcttctttcgttaaatcttgtgaatataaagaacacatcattccatgatacatcatcgataattttccaggttgataatatgcaaacccatctattaaatcgatcacttcatcattagaaaactgcattacttgttgatcatttacttgtgtttctaccattgtaaaacttttatcaccgctaaattttaaaatatgatttttatccccttctattgaagacactgtttcgctttctaatttagctcctaatagagaaactggatataaaacatcattatttgcggatgttttgacatccttttttgattctttcaatgcttgattttgattaaaatgtttctctttaaaatttttatttttatgaaattcatttactttacaagtaacaatttctgtctcatcttgatctagacataaaacaatcaatggttttaattttttatcaaaaataacttcttgtttaacaattcttgtatcattagggtatttcacctttgcttctacttgatatcctttttcaatctttttaactttattattttctaataattgaattaaataatgataaatatagggtttaggactattttcaggccaatcactttgaaatttaaacatttgattaagtgttggtgttaaaacatagactccttttttattttttataatgatttgtgattgatttaaacttttatcataaagttctactcgataatatttttgtttatctttttttaaataatctacttttacttcataacttttaagttcatcattttgtgtcatttccatatcacatacaagttgataagaactcatacttttagcttcttttaacgtttcatccaatgaattatttttaaatttaaaaaaagcaacaatacctattgcacaaatgactaaacctataatgacaatatataattttttcaaatctatccctccattataaaaatattctttatttatttttatatgtataaaatacaaatttatgggatagactctatttaaggaggttaagaaaatgaatgcattacaaaaaacagcacttgtttttactgtgatcggtgctattaattggggtcttattggtttatttaattttaatttggtagatagtttatttggtcaaaatagttttttatcaatgctcatttatattgttgtaggaatagctggactcattaatattatgcttttctttacggacttaaatataaaagagtagctaagctactctatttcaaatgtggacatatgtccatctttagtatcaattttaatacgattttttaccatttttaacattggaatatcatgtaatgaatccgaataggcataagataagtcataatctatttctagattatgattttttatcacttcttggattctttttaccttttcttcatttttacaattttttccaatcatttgacttgtatatttaccatctttaatgtctgttttagttcctaaaatttcatctactggtaacttacaaaaacgaagataagcttctacagaggcactacatatataaatcgtatacccttctgcctttttcttttttaattcttcaatgacatttaaataataacaaggttctaatacttcttgataaaacttttcaatctcttgatcagacatcttatctaatggatataaccatgctgattttgctttattaagtggttctatctttaatagatataaagcataatgataaaccactttaaataatttaaaaacagatagtggatgtttttttaaataatactttaaaagttttccaccagaatctccatgaatcaaagtatcatcaaaatcaaaaaatgcaaatttagttaacacctatgcaatctccaaagcaacttccatcattgctgtgaaagttttttctctttcttctgctgttgtttcttcatttgaaactaatgaatcagaaacagttaataaagttaaagcttttttacccgcataagctgcatttgcaaataatgcataagattccatttctgtagcaaggcatcccattttaatccatttatctgctttattgtctgcatgatagaacaaatcagaagataggacatttcctacatgataagttaaattcttttcttttgctttttctacagctttttctaataaactataatcagaaatagctgaatatgttcctggtaattcatattgatgtgcataatttgaatctgtacaagcaccttgtacaataataatatctcttaaacgaacatcttctttaaatgatccacaagatccaatacgaataatattttctacatcataaaaatgaaataattcataactataaatcccaatactaggcattcccatacccgaacccataatggaaacttcttttcctttatacgttcctgtatagccaaacatatttcttgtcgcattaaattgtttaacattttctaaatacgtttctgctaaatattttgcacgtaaaggatctcctggcattaagacagtttttgcgatatctcctttatttgcttgattatgtggtgttgacataaacacttcctcctttatttcctctttaaagtttaacatattctgttttaattgataatatattttaagatttttgtaccttaccatcttttaaataataataagtttctatttcagcagcttcattaagcttttcacccttaatagcatttactaaatgttcaacatactcatctgcattacctgcacctaaaatagccatatacccttctaaaaaaaccattggtccataaccgtaatcatcttcatcaaaatcaatgatttgattgatatgttcttgatagcttgctttcatttcatcaaaggtcttttcatcatccatatcataggctttgattttcatatgtttaccaaattcttttttaattgctggtagaacattctttttaaaatgttgacaattggaacaatcttttaaataaaaataagttaaatgatatgtctccttccattcatttttttgattttgacaaccaactaatggtactaataataaaataattaatagaatcttttttaattttctcattgtttcaccctaccctttcttaaataataatatgtttcattctttgatgctttattcaattcttttccttgaatagcatttacaagatgttcaacataatcctcttcgtttcctgcccctaatattgcaagataaccttctaaaaagaccattggtccataaccataatcatcctcattaaaatcaatgatttgattgatatgttcttgatagcttgctttcatttcatcaaaagtcttttcatcatccatattataggctttgattttcatatgtttaccaaattcttttttaataactggaagaacattctttttaaaatattgacaattcaaacaatcttctacataaaaataggttaaataatacgtatcttcatacgtgttactttgacacccaaccactaataaaagtaaaaatagaattaatatttttttcatctttttctcctgtttcaatgattataccgcatttatttttcaatgaaaagtgatgtgatgagagataaataatattaataataatatatattgaataaaaataatatatataatataatacaagtagaaaggatgatagctatggcatttgtatggtcaacaaatgaaatttcaaagaaaacagttactatttatagtacaaatctcactttaaacacagctgcttgtaaacattttgaaaatgttcaatatgtattattaggagttgataaagagaacaatttattaggaatcaagccagttgataaaacagcaatagatgaaggaatttatccaatcgatcaattgcatcgtatttcaattggtaaaagttatggacgtgtttctaataaaaattttattgaaaaccttgctagagaatatcatttagatttaagtgataaacaaggtctaaagtatcctgcaaattttgatgttgttcaccaaatattaacagttaatctataagggagggatagatcatgatgttatggatatggctaggcgttatcattgtaactgctattattgaattagttacaatcgatttagtaagcatctggtttacacttggtggaatcggtgccttgattgcctatgctttaggtttaaatcaaaccattcaaattattatctttatcattttaagtgttatttgtattggaatcagcagacctcttgctaagaaatacttaagaacacaaacagtcagtacaaactatgatcgtgttattggtcaacatggacttgttttaaaaagaattgatgctgatacaagaggagaagttaaggtgctttctatggaatggtccgcttctagtgtagataattctactttagaagaaggagattattgtgaaattcttgctgtagaaggtgctcatcttgtggttaaaaaaattaataaataaaggagaaagaaaatgagtattattggtttaattttaattatcattgttttaattattattgtcagtgttattgcatttgcaattcgtattgttcctcaatcaaaagcttatgttgtagaaagaatcggtgcttataatcgtacttgtagtgttggacttcatattttagttccatttttagatcgtgttgctaataaggtttctttaaaggaacaagttgtagactttgcgcctcaacctgttattactaaagataatgttacaatgcaaattgatacagttgtttattatcaaattacagatcctcgtttattcacatatggtgtcgatcgtcctattaatgccattgaaaacttaacagcaacaactcttcgtaatattattggggatttggaattagatgaaactttaacatctcgtgatattattaactcacgtatgagaagtatccttgatgaagcaactgatccttggggaattaaagttcaccgtgttgaagttaaaaatatcattccacctcgtgatattcaagaagctatggaaaaacaaatgcgtgctgaacgtgaaagacgtgaagctattttacaagctgaaggtaagaaaacagctgctatcttaaatgctgaaggagataaacaatcaacgatcttaagagctgaagctgaaaaagaagcagccatcgctaaagctgaaggtcaagctgaagctttacgtttagtttatgaagcacaagcaaaaggtattacttatatcaacgatgcacatccagatcaagcttatgtcactttacaaggttttaaagccttagaaaacttatctaaaggtgatgctactaagattattattccaagtgaattacaaggaattgcaggattagcaactactttaaaagaagttgtaagtgaaaagaaagataaggaataatgaaaacagtcttcggactgttttttcatattcttttttttatgtcatatagtgtatagggtgaataatgatgtgtggaattttatgtttatataatcaacaaagaaatgtcttagatgattgtggaaaatttaataaaatgctccatttattagaccatcgtggtcctgatgatatgcgaacttattttgatcaacatgttttattaggtcattgccgtctttcaattattgatttaaaaggaggtatgcaacctttagaatatacttatcaagatattacttatcgcattatttttaatggtgaaatttataatatgaatgaattaaagaaacatcttattgatttaggtttccatttttatagtcaaagtgatagtgaggttttacttgtcagttttattgcttataaagaaaaatgtttaaatatgttagatggtatcttttcatttgttatatcttatgaaaataaaatctttgcttgtcgtgatcatttaggtgtaaagcctctcttttattatttaaaagatgatgatttagtcatttcaagtgaaattaaagctattttaatgtacattggaaaatgtgttgttgataaaacaggaattaaagaattactaggtttaggccctagtttatcaccaggaagtacactttataaagatatttatagtttaagacctgctcattatttatggtttgacggtgagcatttaatgattgaaagatattggtctttacaaaaaaaagcacatctaaaaagttatgaagaaactgttcaagatatacgcttccttgtaaataaaagtattcaaagacaattattaagtgatgtacctatttcttgtatgttatctggtggtttagattcgagtattattacagctataagcagtcaatacgtcaatcatatttcaacctatagtattgattacttagaccaagataaatattttcaaccctatgattatcaacttacaaaagatagtgattatattgatttaatggtcaatcgttatcatagtcatcacaataatgtcgttttatcacaaaagaatttaattatctttttaaaacaaagtctaatggctagagacgctccaggaatggctgatattgattctagttttctattattttgtaaagaaattaaaagaaatcataaagtcgttttatctggtgagtgcgcagatgaaatttttggagggtacccttggttttataaaaaagaactttatagtctagattcatttccatggattagagatattgatcaaagattagaacttcttaatgaaaatataaaaaaattgaacattaaagaatatgttcaaagtaaatattatcaatcacttaatgaaatagactacctcgatcaaagcttttatgataccaataaaagaaaaatgatttatttaaacattgaatggtttatgcaaacactcttaacacggagtgatagccaatctatgtataacgctgtagagcttcgtgtacccttcgcttcaaaagaaatcgttgaatatatgtacaatgtcccttggacctatatgtttaaagatcaacaagaaaaagctgttttacgtgatgctttcaaagacttccttcctcaagaaatctataatcgtaagaaaaatccttaccctaaaactcattctccatttttccttacttacattaaaaatcttctcttagaaacacttaacgataaaaataacattctttatcaactttttgatattaaaaaacttaaacactttattgaaaacagcgaaagcattgaagttccttggtttggtcaactcatgatgggaccacaactccttgcctatttttatcaaatctatatgtggggtaaaatatatcatatagaattagagctttaataaagctctaattctatttcttgactatttaaacgaatgtcttgtagatattcgttttttactcttatttgtgtattattcacagatacttgaggaatgtctttaacccattcttgtaacattttagcatagttaagctttaaaaaaccataacgtatgcttccttgactatcaataataatatcttcattaacataaggtcttgcatctatgtgtattttagtttcaattcctttatagactaaaaccattcttatttgaatatactgatctatttttatttggatatcttttagctttcctttttctataaagaatcgtttataaatgatccaaacaagtttttctaaagtttttacatcaattttcataatctcaccactttattatatgtataaaaaatcaagaagcttaggcttcttgaatatttttatgaataatatctaacatttgattcaattcttgataatcaatttgtcctggagcacttgcttttcctacagtagcaaaagtaattgcactaccgaattgttcccctactaaacgtgaagtaagtccaatagatgacattgacattgtcacaattggtttttgagcatattcatgtttagcttgaactgtaaatgaaagtagatttaataaatcttgataatcttctggcataactgctaccttcataatatctgcttctaaagaatccattgatctaaatttttgcatcaatgaatcaacttctggtgttctatcaaagttatgacttgacatcaacatatatttaccagcatcatgaataagtgttcttaattcaattgccatatttgttcctaacgctaattcaacatcgtaaatatcaaatgcatttgcttctactgctaatttataaacattgaaataatctttaggatcaatttcaacttctccaccttctgcagctgtacgaattgttagaataactggtttttgtatttgtaaggcagcaatgtttaaaaataaatttcttaatgcatcttcttgatgaatattttcataaaaatctattcttaattcgatcatatctacttctaattcattaaattcttttaatttatttagaattgcttcatcatggctttctacgataggaacacatactttaggttttccctctccaatgatgactcctttaatttcaatactcatatttacaccttctttgattatttaataattcaacagcataataatatcatatttttttattagagtgttaatttttttataatttgcaaaaaaagcattaaaattaattaatgcttttgattttttataactttttgtcttgaaaattcttcacgttctttttcttcaagagattcactaataaatttaattgtttcttcaaaacgtggaattgaaatattttttaaggcattcgcacgtttttgtgtttttctaatggtatttgctagacgatagactgagttttcaacttctgctaaaacaacagtcaattctttaacacgatagaaacattcataagcatagtctacttttgaattagatcgatccatgttataactacataccattggttgtttatgataagtaattttaggaatttctacacccataacacttcgataagcaatactgattccataatcaataggtgttgctgtaactaagtcactaatcaaccctaaagaaatatttgcttcttgtaaagcatcgtaagcattttgataagcttccgtaatttcatctctgaccattttaacatcatctaataatgacatcatttctttaataagaacgtttcttttcttatctaatagatcatatccaagaacagctaattgtaattgtttctttgtagaaattaaatttccttttgttggaacaacttttaaagccataattaatcacctgcttcttgtaattctttgatgattgatttttctttaatatggaaacgttttacagcacgatcatgatcataatgttcatctaataatttgttatctagacgatcaagtgcttctctaggtaaaactgaaactaaatcccatcctaaatctaatgtttcttcaattgatctattgacatcgaaaccttgatttaagaaatgttgttcaaatagtttaccaaatgataaatattgtttatctaatggagataattcatcttcaccaattactgatgttaatgatttaacatcttgtacgtgagcgtaacatgcaaataattggttggcaatgtcttggtgatcgccacgtgtatatccttcaccgataccatctttcattaaacgtgaaagtgatggtaaaacatcaactggtggataaataccggctgaatttaattcaggtgatagagtaatttgtccttctgtgatatatccagttaagtcaggaactggatgagtaatatcattgttaggcattgttaaaatagggatttgtgttacagaaccttctgcccctttaataataccagctctttcatataaagaagctaagtcagaatataagtaacctggataacctttacgtccaggaatttctcctttacttgaagagaattcacgtaacgcttcacaataggaagtaatatctgtatagataactaatacgtgcatattttgtttataagctaaatattcagcagcagttaaagcacaacgtggagttaatgtacgttcaatgattggatcatttgataagtttaagaacataacaactctttccataactcctgcttctttaaagctacgtttaaagtagtttgcaacgtcatttgtaacacccattgccgcaaagacaatggcaaaaccttttcctgattcatcagcaacttttgcttgtttaacgatttgtacagctaaacggtcatgtggtaaacctgaaccagagaagattggtaatttttgtccacgaattaatgtagcaagacagtcaattgatgaaatacctgtattgatgtagttacgtggataaacacggcttactggatttaatggtaaaccattgatatccatcatttcttctgcataaatttcacctaaaccatcgattggtctaccagcaccattgaagacacgtcctaaaatttctttagaaacaggtaattccattggtctacctaataatttagtctttgtattttctagtgataaatcatttgttccttcaaatacttggacaacgattttttcaccttcaatttgtacaacacgtccagaacgtgttgtcccattttttaattgaatttcaaccatttcgtcgtaagaggcaccttttacgtgatctaaaacgactaatgatccattgatttcatttaatcctacatattgtagtgccatttttatttcctcctacgctacagattttaatgcattatcaatatcttgataataagtatctaatttttcaatatgatcatttggaatatcatatttcattttaattaattgttcaaaaataccagtttcactaattgcacgaacaactttaccttgagcaacagcttcttgacattttttatttaaatataagataacatccatcatctttaattgtttagcaagtggtacgtatgtatcatccttatggaaggcattttgttgtaaataaccaacacgaaccactttagctatttccatcactaatttttgatcttcaggtaaaacatcaggtcccattaagttaacaatttcatttaatcttgattcttcagcaagaatgaatgaaagttgttgacgatcactgacgaaatcagaaccaacatttcggtcataccatttttcaagatcataaacataatcactataagattgtgtccagttaattgcgaaataatgacgagcataagccaaggctttatctaaggcccagaaacatcttacgaaacgttttgtattttgtgtaactggttctgagaagtctgctccttgtggtgatacggcaccgatgattgaaacagaaccttcttgtccatttaaagttttcatgtatccagcacgttcatagaattgtgataaacgtgatggtaagtaagctgggaatccttcttcagctggcatttcttctagacgaccagaaatttcacgtaacgcttctgcccaacgtgaagttgaatcggccatgattgcacagtgatatcccatatcacgataatattcagctaaagtaattcctgtataaatacttgcttcacgtgcggcaactggcatgtttgaagtattcgcaattaagacagttctatcagttaatggtttaccactcttagggtcaatcaactcactaaattcctcaagaacttgtgtcatttcgtttccacgttctccacaaccaacataaatgataatatcggcatcacaccatttagcaatttggtgttgtgtcattgttttaccagtaccgaaaccacctggaatagcagcagttccacctttagcgattgggaataatgtatcgataacacgttgtcctgttactaaaggaatagaaattggtaaacgttctagagttggacgtgcttgtttaattggccatttttgacataatgtacattcatgaatttgaccatgttcatcttcaattttcattacgacatcattgattttatattgaccattttcttttacttcaacaactttaccacttaaaagtggtgaaagcatacatctgtgttcaattaaatctgtttcaggacatgttgcatagatgtctccaccttttaaaacatctcctacttttactttcattgtaacgtcccataatttttcaacatcaagtgaatcaacatcgcttccggcttcaataaaagcacctgattgttcagcgatagcttttaatggacgttcaatcccatcaaagatatttcttaaaataccaggacctaatgtaacacaaattggtgatcctgtagaaataacaggttctcctggttttaaaccagttgttgtttcatatacttggatagttgttaaatctttagaaattgagataacttcacccattaatttagcatgaccaacataaaccatttctaacattgaaaagtctttggcattttttactttaacaacgggaccattaatagaataaattacattttcactcatctttaatccccctatttaatcatcaatccagaagtcttatagaaccaatctttttgagcttctaaatttgagtctaatgattcatctacgacaacatttgttgttttattttcaataatgaatccacctaattgaatttgttgaccttcttcaacttcaattggtaaagcatatgctttctttaaatcatcagcatattttaaatcttcttttcttacacataaaacacaatcagtcatttgatattcatcacttactgcttttacatgacttgtaagatattcaagataattagaactatttacaaattcaacaagtttattttttacttctgtaaaaattgtattaacatattcttctcttttttcaactaatttttttagtctttcttctaattgagctgaagcttcaatacttgctttagaagaaatttctgctaattctttatctaattgatgcttagcatcaatttcagcttcacctcttaattggttataagcttcttgttcaattgcttttgcttcatctaaaatttctttttcttcagctgatgaaattttttcaatttcatctttgatataaagaaagacttgatcttttttttgcatagcactttctcctataacttaactccaattgcctctgaaacatatctatcaattgtttcaccaattttagaatttccatgtctatcaggaatttctacaagcaatggtttttgttgttttaattttatttcagaaataacatcaggagctaattcaattaatttcgttgtaattaaaatcacacctattgatctatctttcatttttgtttccaaaacttcaagaaaatctcttcttttatgaacaacttctccttcaataccaacaagtcttaaacccatttcagtatcgacattgtcacttattaaataaaatttcataaaaaatcactctctaaattagattttgttgataattaagatagagattaataaaccatagattgcaaccccttcacctaaggcaacgaagattaatgatttaccaaagttcttttcattttcagagaaagctccgatagctgctggagctgctgctgcaacggcaatacctgcacctaaagcagagaatccagttgataaagatgctgctaagaatcctaaaccttgagcaattgttccagtgattgtagcaacttcacctgctgcaaatacacttgaatttgacatagcaactaataaacataaaacgactgcaccagcgaaaccactgatatgaacacctaatcttcttttagcgctttgagctgatacttttcctgtaaatactttaattaatggtaatgttaataaaactactgcaactaatggtaataaaatttctaatactgtcataataaatttcctccttgaatttaatcttccttaatagttttaaatggaattccatttccttcataataacgtgaaaacatttcatagaattcaagacgtaatacttgaataccaacgatcaatccttcaagacacattacgaaaacgtttcctaaaatcaagacgatgatttcaccaaatcctcctaccatttcagcaagagtataaacaacaagcatcataccagcatgtgataaaacgaatcccccgacacgcaagaatgacattgtgtttgtaataaatgataagactacttcaaataattcgaagaatccttcaacaaagaatgctccaaaaccatttgggaacatttcaccatgttcttctaattttctaattaatggttcttttaagaacattaagataagtggtaatacaattaaaattaaaatatagaaaatatttacaaaatgttgtcctgtaagcattccaagtgctgcactaataacagctacatagaatgtaacaccacataaaccattttgacttaaaatcgcttcacccatatttttctttttaaagttcaaaataatattgaatgtcattgaaacaagaattaagacaataccaagcccaatggcagccattaataatgtcattgtattttctggtgacattgcattaaagaatgagaaacctttgaaatattcagataagatttcttcatttccaaagaatgaaccaaagaatacaccgaagattgcactggaaatacctaaacgaactcccacgccacctaattttaaattaaatttcttttcagcaacaaggcctactaaagaaagaataataccttgtcctaagtcaccaaacataataccaaataataaagtatatgaaatagcaactaataatgttggatctacatcattgtaacgaggtacaccatacatttcgacgaacattctaaatggtcttgcaaaccatgaatttttaagtcttgttggtgggtctaaacgtacatctgatgtagcaggtaaaacttcaagtttaacaccatcgatactttcaaaagtgtttttgaaattatctaaatcacttttaggaacaaatccatgaacatttaatttatcacctaatttaacaatatatttttgcattgcataaactgaatttaattttttagcaacactataaatacgtgttaattcttccatattttctgaaattgttttatcaattctattttgtaaatcttggctatattgtttagctgaatcagattcattttgaatttctttttcagctaattcacacgaaccatgaacgaattcaggaatatggattttttcaaaataaagtgatgtaaaaacattatccacttcaggagcatctgtaggtgtcgtcatatacatacaccatacatatttatcatctctttgaaatgctttataaacaaatggtaatgtttcataatactctaactttccttcattattgagaggaagtttaccgaatcttatttttaaatattgtgttccaaataattgatcaaagtcaatattagaaccttcaacatgattcaaagtaatgatggcttcatcattttcttcaatcatctttgtcaattcttttttaacagcatcaatacggtcaatatctaaaaatagatcatctaaaaattctttagctctaaatacattaagttgcgaatctgtttcaacttcaggaacttcaaaatgatattttgttttcatttcttcaattctcctaataatttagagtgaacctctaagcaccggataatttaatataccaaaaataagacttcgttgaagtcttttttttatttttagacatattgttatatggggtgacaaaatggctggtaaagtgtatgaaatcatgaccaaggcaactttatcaaaaggaacgaaaaaaacgatttctaaatatgattatgttgttaatgagattgataaaatactaggatgttggatttgtaatcatcaatatcaaggaatcattagggagcatcaaccatttatagaaggaagttttgatttgcatatttggtatagtcatttaaatgaaagttatttattaaaacaacaagtgcattaccaagatgctattgatttaaatatgaaagatcatcaactcagtcaaaatgatcaaatcattgttgaaagtcaatacttacctcgatgtatccatgcaaccttagaaaataaaacaatgcacatcgaaatagaaaaacaaatgtctttaaaaatcattggtgatacaacaattcttgtagaaagtaaaacaaatgatgaagaacttgaaatgaaaattaatcccgatttcataacatagaaagatgtttctttctatgttataataatcaacgaattagaatgaggtgtaaaaatgaaacaaaaatacagtccaatgatgatgcaatatttaggtatcaaggaacaaaataaagatgctattgtgatgtttagattaggggatttctatgaaatgttctttgatgatgcgatgattgtttctaaagaactagaacttgctttaacagggaaaaatgccggcgctaaagaaagagttccaatgtgtggtgttccttttcatagtgcaagtggatatattcaaaaattagtagataatggacataaagtcgcgattgttgaacaattaacagatcctggaaaaaaaggtattgttgaacgtggtgttgttcaaattgtcacaccaggtactatttttgatgaatcgatgacaaagaataaaaataattatatcgcatgtatgatgatttttgattttgtttatacgcttgctttttgtgatattacaacaggtgaatttcaagtcgtcaatattgataaaaaggatcatcttttaaataatcaattagcttcgatggaagttaaagaaattgttgttaaaagtgattgtacatataactttaatgattcaattatggtatctcattatgataatgaaacatttaatgaaaaatatcgagatatttttcataatataaaagatttaaaagaaatcaaagtatctactttattattaaattatttaattgaaacacaaaaaagagacttagaacatcttcaaatgattgaagaaatcaataatcaagattttatgacaatggatctttatactaaaaaatcattagaattaactgaaaattctaaagatcatgaaaaatatggttccttattttggctattagatatgacaaaatcagcaatgggagcaagacttttaaaaaattatattgatcgaccacttttaaaaaaagaagccattgaagaaagattagatattgttgaaatctttactcaacaatttattcaaagagaaagtattaaagaaatattaaaagaaatctatgacttagaaagactatcaagtcgtattgcttttggaaacattaatgcaagagatttaaaatggattgcttcttctttaaaagtcttaccagaattaaaacaacaactttattcattcaatgaacctttaacagatcaattagccaatcaaatcattgatctatcacatattacaaaactcattgatgatgctattattgataatcctcctcttacgattaaagaaggaaatattatcaaagatcattttaatgaagaattagatgaattacgttatttaagagatcatggaaaacaatggttagttgattttgaacaaaaagaaagagaaaaaacaggtattaaaaacttaaaagttgggtataatcgtgtctttggttattatattgaagttacaaaaggaagtttagatcttgttaaagatgaattcgaatatacaagaaaacaaagtttatcgaatgcagaaagatttattacacctgaattaaaagatatggaaagtaagattttatcagcacaagataaaattcaaaaattagaatatgttttatttactcaagttagaaatgagatcaaaaaagaagtccatttgattcaagatgtttcgaaaattatcgcgcgtgtagatgtttatcaatctcttgcaatgttagcaagtgaaaatagttatgtaagacctgtctttaatgatcaaaaaattatggatattaaagaaggtagacatggtgtcattgaaaaagtcatggggcatggtaaatatgtacctaacgatgtttcaattgatgaaaattcaccagttgtcttaattacagggccaaatatgggtggtaaatcgacttatatgagacaagtagctttaattgttattatggcgcaaattggctcatttgttcctgctaaatatgctaatttaacgatttttgatcaaatctttacgcgtattggagcaagtgatgatttaattagtggtcaatcaactttcatggtagaaatgttagaagcgaataatgctttacgttttgctagtgaaaaatcattgattttatttgatgaaattggtcgaggaacagcaacttttgatggaatggctattgcccaggcaatgattgaatatattgccagtgaaattcattgtatgacattattttcaacccactaccatgaacttacatttttagaagataaaggtcttggaattcaaaatgttcatgccagtgctagagtagataatgatcatttagtatttgaatatttaattaaaaaaggacgttctaataaatcttatggggtcaatgtggctaaacttgctaaattaccagatgaagtaatcaatcgtgctaatttagtattagaaacacttgaagaaaataacgtagaagatcgtttaattgaagaaaaacaagttcaagttattgaaaaagaaagtgaagttgaaaaatatttaaagacaattgatccaatggatttatcaccattagatgctttgtcaactttaatcgaattaaagaaattagtaaagtagaggtggcctatgaaaataaaacaacttgatgatattttagcaaataaaatagcagctggtgaagtcattgaaagaccagcaaatgttgtcaaagaattagttgaaaatagtattgatgcctcttcttctaaaatagatattattatagaagaaggaggaatgaatttaattcaaattattgatgatggatcaggaatggataaagatgatgcacgtctttgtttttcaagacatgcaacaagtaaaatctataatgatcaagatttattttgtattcaaacattaggttttagaggcgaagctattccttccattgcttctatttctcattttgttttaaaaaccagtgatggaagtcaaggatcaacagtaatttatgaatttggtaaatttattgaacaaaaacaaagtgatcttaatagaggaacaaatatttctgtttcaaagctttttcaaaatgtaccagcaagattaaaatatgtaaaatctgtcaatgctgaatttgcacatatacaaaattatgtagaaagactttctttatctcatccagatattgcttttactttaatacataatgataagatgacttataaaacaaatggaaatggaaatttattagaagttattcatcagatttatgggttatctgtggttaaaaacatgttgaatttaaaagctggaaatgatgaatttcaaatagaaggttttattggcaaaattgaagtgaatagggcaagtaagaatcatattgttacgatggtcaatcatcgtattgttaaaaatcaagtagcaatcgatgctattaatcaagcatatcgtaaatatttagcagataatcgttatcctattgcagtcatcaatattgaaattgatccttatttagtggatgtcaatgttcatccaagcaagttagaagttaagttttctaaagaatacgaattaaaacaattgatttttgatgcggtatctaaaactttggaaaatgttaatttaacttaccaagtcaaagaagaaagaccagtctttaagccacaactagatcaaatggatctagatattgattttagacaagaaattcctacaaaagttcaagaaaaaccacaaacttcatttattcaagaaaaaaaacaaccactatttgttcatgaagaaaaaaatgaatatataacagaacctgtagaaaagcttgttgaagaacctatccaacttgaaaaagttgaagtgtctttaaaagaaatgaaaaagaaaatatttgtaaaagcacaaattcatggaacttatattgtaggtgaagatgatagtggaatgtatttgatagatcaacatgctgcacaagaaagaatcaattatgaatattttctagaaaaatatagtcatccagatatgacaatgagagatttattaatacctattacagttgaatatcctttaagtgaatgtatgatgattgaagaaagaaaagatttattaaaagaagttggcattgatttagagccttttggtaatggttttattattaaacaactgccaatgtggatgaatcaaattaatgaacatttatttattgaagatatgattcaacagatattaaaagataataaaattgatttactttctttacaagaacatgctatagcaacattaagttgcaaagcatctttaaaaggaaatagtcatctatcaattgagtcaatgcaaacaattgttgataatttaatgcgttgtgataatccttatgtttgtccacatggaagaccaacgattattcattattcagcatatgaattagaaaaattatttaagagggtcgtataatggaaaaagtaattgttgtaattggaccaacaagtgttggtaaaacaaaaatgggagtggctcttgctaaaaagttcaatggagaagttattagtggagattctatgcaaatttataaacagatggatataggaactgctaaagtcacagaagaagaaaaagaaggtattattcatcattgtgtagatattttaaatcctgatgaaacatacagtgttcatgattttcaacaaacagtgagaaaaaagataacagaaattacccaaagaggacatgttccaataattgttggtggaacaggattgtatataaaagcagctttatatgattatcaatttgatgaaatggaaaacgatcatcatgcaataaatgaaaaatataaagattatacaaatgaacaattacatgattatttaaaatcaatcgatgaagaaagtgcaaaaacattacattttaataatcgtcgacgtgttttaagagctattgaaatttatgaaacaacaggtaagagaaaaagtgaaatgttagaagaacaagagcatatttgtttatatgatgcttattttgtgggattaacgcttcctagagatgttttatatgaaagaattaacaaacgtgttgatgtgatgatggaaaatggtttaaaagaagaaatggattgtctttatagtcaaggacttacaagaaatcatcaaagtatgaaagcgattggttataaagaatggtttgattattatgatcatcaaattgatttaaatgatgttttagagctaataaaaaaacattcaagacaatacgctaaaagacagtatacttggtttaaaaaccaatttgatgttcattggtatgatgtgaatttagaaaactttgaacaaaccattgaacaagcaacagatgatatagaaaaaatcctaaaagtttaggatttttttgtatgatttaattttttaatattatttgtacgcccatgttttaaaatacgtcgataattttcagctaatgctttttcatattgacttgtcatccaaggtacatagaattgattatttgcgatttgatcgggtaaatattgaatatattcccataactcaggacggtcataattatatttttcatcctcttctagaccaacaggtgttaatcttaaatattcaggtgcaggcaaagattgttgtcttaaagaagctaaggcagcatcaatagctgcttctgatgatttagatttaggtgaaagacataaatcaataatagcacttgcaataggaattcttgcctcaggaaatcctactgttctggcagcttgaaaagcagcaacagtacgcatacaagcatttggattagcaagtccaacatcttcatatgcacaaacaaggacacgtctttctaaagattcaatatcattatattctatcaactttgcaaaataatacatagctccattaggatcgcttccacgaatagatttttgtaaaccacttaaagtatcataatattgatcttcatctttatcaaattgaccattagcttgtgttaaagcatttttagcatcttcaatagtaatatgattatcatgagaaataattgtacatacttctaaacaattatatgcaaaacgaatatctcctgatgaaagacgagcaatatgttgcaagacttcttcatcacattgatattgatggtgatagcctttttcgctatctaaagcgtgatgtaaaccttgaataatatcttcttgagttaaaggcttaacttcaatgatttgacatcttgaacgaatggcaggattgatagaatgataaggattagctgttgtacatccaacaataatcaatagaccactttctacataaggaagtaaattatcttgtttcattttattcatacgatgaatttcatcgataatgacaaaaagaccattagataatttagcttcttcaataatcaaatccatttcttttttatttcctgtagatgcattaaaagtacgacaaggcatatttaaatcatgagccaaagccattgcaagagttgttttaccacaacctggtgggccgtataaaataacagacattggatgattcttttctacaaatttagtaaataaaccattttcaccaataatgtgtttttgtcctaatatatctaaaagagattgaggtctcatattataagctaaagttccactcataaaaaaaatcttcctccttaatacaaaatgaattataatgattataacacttttataaaaagaaaggtagaaatgaatatgagattagttgtacaaagagtaagtgaagcaagtgtggaaattgaaggagaaataaatggacaaatcaaacaaggatttatggtattagtaggtattacgaatgatgataatgaagaaattgttgataagatgattaataagcttatcaatttaagaatttttgaagatgaaaatgaaaaattgaatttatcattgatggatatcaaaggagaaattctttctatttcacaatttactttatatgcaaattgtaaaaaaggaaggagacctagttttttagatgctgctaaaccagaaatatcaaaaccattatatgaatattttaataaagcattagaaaatgcaggggtccatacagaaacaggaatctttggagcgatgatgaaagtctcgctgatcaatgatggaccaacaacgatcatcctggacagtaaagaaatcatatagtcataaggcaaagaaacgttctgtaaagatcgttcctaataatttagagtgaacctctaagcaccggataatttaatataccaaaaatagagtcaactgttttttatgacatttgtcatatttacatagatgacaaaaatcattaaaattaaataaagggagaataggagggaaacacatgtctttttataaaaataaagctttaaaaataacatgtattgtaagccttattatgatttgttttgtctatcaccattatttaaacactgatactaaacaaattaaatttggagcaacttatatgacaatgaataataccttctataaagctgtaaataatgaaatagaaaatgttgttaataatcatggggatgttttatatactagagatccagctttggatcctaaaaaacaaaatgaacaaatcaaagaccttgtttctttaggaatcgatgttttaattattaatcctgttgaatcttcgagtattaataaaacattaaaagaagtcaaaaaagcaggaattaaaattattgtagtcgatgctcctattagtgatgatcaaattgcagattgtacagttgtttcagataattatgatgcaggagtacagtgtgctaaagatatgatgcaacgctttgatcatgcacgtattgctttacttgaacattctaaagccttgtcagcggttgatcgtatcaacggctttaaagatacagttgctttaaatgagaattatcaaattgtaggaagtgaagattgtttaggacaaacggaacttgctttacctgctttaaataaaatcattcaacaaggaattgattttgatgttgtcttttgtttgaatgatccaacagctttaggagcactggcttctataaaagaaaatgatttagggcatgatgtttttatttacggagttgacggttcaccaaatataaagaaattgttggcagaaacgaaagagattgtgggtacatcttcacaatcacctacttctttaggaaaagaaacaatcaaggtggcttataagatgttacatcataaaaagtataaacgctcaattattgttccaacaaaattgattaccaaagaaaatgtagaagaatatgatataacggggtggcaataatgaatcatcttacaaaagaatatgttacaaagttaaaagattcattattgtttattaatgcggttgttattatctataatgcttctttatttttactttctaccaaatatatttcagtgcattattatgcacgagatttcttaaataaagtatcttatattactagaacaccacaaaatatcttttttgaatcaatttttctttttatcattcttgttttattaatgaaattaagagaaaaagataatttaaaaatggcgaatggtcttgtttatattgaaattattctttcatttttattaattattcgtttaaatggttcctataatggaattttactctttgtttttgctgatttactttataatatgagaaatattaaacatatggccttacttttattaatggcctttggtttattattgatttcagattttaatattttatcaaatattatacatatgccaagtattgaatcttatttatcattttatccaaattcgagtcgtacatttatgttatttgctaaaaatattttagcttcattaaatgttgttgtttttattctttatcttatttgccaagttttagttcaacaagaagaaacaaagaaaatcagtaaagaacttcaacttgcttctaaagtcaatgatgaattaaaaacatattctgctttatctgaaaaaatggcagaagataaagaaagaaaaagaatttcaagagagatacatgatactttagggcatgccttaacaggtatttcggcgggaattgatgcttgtattgctttgattgatattgatccacaaaagtcaaaagaacaacttttggtaattagtaatgttgttcgtgaaagtattaaagatgttcgacgttctttatataagttaagaccgggagcacttgatcaaagaactttaaaagatggtttgattaaaatgattgaggaatttcaaagtgtttctcatttaaatgttgatttgtattatgaatgggaaaatgttgattttgaaaatacgaaagaagatattatttttagaattattcaagaaacgatgacaaacgcattaagacatggatatgcttctcatattgaaattcatctttttgacgaagaggaaaaatatatgattattatgcaagataatggaagtggctgtaaggaaattcattatggatatggcttgaaacaaatgcatgaacgtgttgccatattaaatggaacgatacatttttatagtgaagaaggatttagaacagttgtagaaataccaaaaataggaggaaaaaaagatgattaaagtgatgattgcagatgatcaagaacttattagacaatctttacaaattgttttatcaacacatgaagatttgaaagtcgtagatgctgttgaaaatggttttgcagttcttgagagtataaaaaaagaaaggccggatgttattttaatggatattcgtatgccagaaatggacggtgtttattgtacaaaggcggtcaaagaaaaatatccagatattaaaatcattatccttaccacttttgatgatgatgaatttgtctttagtgctttaaaatatggagcaagcggttatttgttaaaaggcgtcagcatggatgaactttatcatgccatttgtacagtttataatggtggagcgatgattaatcctgatattgcgacaaaagtatttaaacttttttccaagatgtctatgagtaattatgctatccaagtcgatgattctttatcaaaagatttaacacaggctgaattgaaagtcattcaacaagttggttttggtttatctaataaagaaattgctcaaaaactttatttatcagaaggaactgtgcgtaattatgttagcattgttttgtcaaaattagaattacgtgatcgtacgcaacttgccatctgggctgttcaaacaggggtcacaatgcaagaatttggtgacgataatgactagaataaaaaagggtattcttacgttagtaagtctttctttagttcttatttattgtttgatcaatgatccaagtcgtgatattactcttactttaggactttatgctggaagtagttgggatgtgcctaatggggaaagttatcaagttattgatcaagcaatcaagaaatttgaaaagaaataccccaatgttcatgttgagtataaaagtggaattataaaagatgattattcttcatggcttgctaatgaaattaccaaaggaacaacacctgatgtgtttatggtacttcctgatgattttaatacgttatcttctattggtattttaaagaatttagatcgacttattaaagaagaacgaatagatacttctcttttttatcaaagtgctttatttgctggaaataatggaagtcaatatgcacttccttatgaaatcaatccaacaattatgtgtatcaatcatgatttacttaccaaagaaggtattgctattccttcaagtaattggactattgatgatttttataatattagtaatcaagttacaaaggatacaaataatgatggtgtcatcgatcaatatggctattatggctttgattggcaagatgttcttgattgttatgggttacaagtttttaaagaagataattgtcatcttgataaaaaagaagtcaaagaagcgtttttatatttgacaaagcttaaagctttatccaatggctatcaagtttcatcagaagattttgatcaagggaaagtcgctttttgtcctttgacctttgctcaataccgtacctaccaaccttatccttatcgtattagtaaatatacatcttttaaatggagttgtatttcaatgccgggaacaaaatcaaatacgattacaacacatttagacacttcattaataggaatgtcttcacaaacaaagcatcaagaaatagcgtgggaatttttaaaaatgttgacgatggacgaagatattcaacaatctctacttgataattcgaagggagcctctcctttaaagaaggtcatgttatcaaagaaaacaaaggaaatcttagcacaggatgcagtttcttatgcttctttagattcagatgttttaaataagattttagaaaacacgttagtagaaccaaagtttaaagaatatgaaaatattctagaaaaagcagattatttgattaatcaaagtattgatcaaggaacaattgataatgatcttaataagatacaaaagaaattagaaaatgaattgaaatagatagcttgtggctatcttttttatttatgacaaatgtcatagtaggaatgatatttgtcaatttttttatgatttttgtcacttaaaagtcgtgattgaagacacattgcaagtgctttcatatttggtattctataggtgcaaggagggaaggacatgaaatatttagtattagtaagtcatggtgaatttgcagctggtttaaaaacatcattaatgatgttggcaggacaaagggatgatgtgattgcttcaggtttacctgatggaaagacagcagatgaatttgcggaaatctttaaagaaagtgttaaggacattcatgaagatgatgaaattgttttattagcggatattgtaggaggatcaccacttacaactgctttaaatgttttagctgaaaaaggtttaatggaaaagacaacaacaattggtgggatgaatttaccattagcccttacttcagtattaatgaaagatactttacaaggagattcctttgtacaagctgtcttaagtgaagcaacaactgctttacaagaatttaaagtcgtagaagacgacgaagatgatatttaaggaggaagaaaaatgtcagtttcatttattagaattgatgatcgtatgattcacggtcaaacatgtacacgttgggcaagagaatacccatgcgatggtttagtggctgtaaacgataaagcagcaaataattcagtattaaaagcagcttacaaatcagccagtggaaagaaaacatttgtatggacaatggaagcttggcaaaagaaaagtcaaaaggttttagatagtcaagatcaatatttcttaattactaaaaatcctattgatatgaaaaaaattcttgttgatcaaggatttgattgtggtattaaaacagttattgttggaccttgtaatgatcgtgaaggggcaacaaaactaggaaacaatcaatcgattacacaagaagaagcagaagcttttgaagctttagctaaagcaggttatacaatcaaatttgctttattaccagatgtttcaattggaacatgggatgattttaaaggtaaatttggtttctaacaaatataaataaaggggaagaaaaattatgacaattagttggttacaagcggcattacttggattatttgcttgtttatcaagtatgccaggattaggtggtacttcctttggtaactacacattaggtcgtcctttaattgggggacttgtttgtgggattatcttaggagatatcaaaacaggtattttaataggggcagcaatgcaagttgtctacatcgcattagttactccaggtggaaccgtttcagcagacgttcgtgctataagttacattgggattccacttgccatggtagcgttaaatagttatggtttatctgctgctacaaaagatggagcatctcttgcaatttcatttggaacaatggttggtactttaggtacagtattattctacggaacagcaacaatcaacttagcatggcaacatgttggatggaaagctgttgaaaaaggggattatcataaattatatcttgtagatatggtattaccttggatttcacatattttatgttcatttattccagccttaattatgtgtaaattaggagcagatgttgttgaacttattaaaacaacattacctatggatggtttagctatgaaaactttatttacagttggatcattattaccatgtgtcggaattgcaatcttattaaaacaaattgttacaaaagcagttgatttcattccatttttctttggatttactcttgctgcttcaatgggaatcaatttagttgcaacaacagtgattgctggtatgtttgctttaattaactacaaattaaaaatgttacaaaatcaaagagtagctgcacctgcaggagactttgatgatgaagatgaggaggatatttaagatggaaaagaaactatctaaaaaaacattaactaaatccttccacaattggtattatggaaacttaacatgcttctctcaagaacatatgcaaacttttggttatctatgctctatgttaccagtagtagaagaactttatgataaaaaagaaaatcaagcaagatcaatgaaaacatacactgctttctttaatacagaacctcaacttggtactgttattgttgggatgacagctggattagaagaagcacgtgctaacggagcagaagatgttgatgatgaaacaatcaacggtttaagagctggtttaatggggccaatcgccggtattggggattccctagttgtaggaacagttattcctattttacttggtattgctttaggtatgtctacaggaggttctcctcttggagctatcatgtacatcattgtatggaacttatttgcttactttggaatgaaattcttatatttcaaaggatatgaattaggtggaaaagcagttgatttcttagttggtcctcaaggagaagctataagagaatcagttacgatgttaggtggtattgttatcggtgctgtatcagcaacatggatttcagtaacaacttcatttacgatgaccgcagctggagctaaaaaacctttcatagatttacaaaaaacattagatggtgtttatccaggattattaacagctgtctttgttgttggatgttggtatttattatctaaaaagaaaatgtcaccaattaaagtaatgttattattagttgttgttgcctttattggtgtacttgttggattcttcaatccaggattatcttattaaaaggagaaaaaagatgaatagtcaagaaaaacaaggatatatagatgaaattaattatcaaaagaaaatgattcataatcttataaaatggttacgcaatttgttcttcctttcctctctgggagtcttgttgatgtattatttttcaaatatcctatttgtaaaaatctttgcaatcatattaataataatatctatattagcgattatccttgttggaaaggctatttacagtggtaagaaaaacataaataaaattgttgatcagttttccttcaaatataaaaactctctataactcatacaaaaaaccgcttaggcggtttttatgttatactttatctggtgatattatgataacaaataaaataaatacattattaaataatagtcaacaaaatgatttagattacactatatgtaaatatattaaattaaacttaaaagcagtatcttcaatatgaaggtgatctttttcaaaaagatatgttggttttagatgaaaatgaatcaacaattgaactaaaagaagatgacttattacttgttataggaattgaagaggatgctttaagtaaacaatcttcacgttatttaagaaagcttttaagaagtcaagggcgtaaacttttgatttcaacacagatgattgatcaaaagatgttaaactattttcatgaaacattacttttacctattgatcatttagaaatgaaagagagaagaatcatgtttcattgtttgatagatatgatgatgtctcgttaccacgaatgtgcttaggcacattttttttgtcctgtcaagaaagtttatgaaatataaaaagaaaagaaatttatttatttatgagtaaattaatgaataggaggggactatggaagaaaaattaacaatgaaacaattattagctattttagccgcaggtttgttttctttttgtggtgttttgattgaaacagcaacgaatattacatttccaacattgatgaatgaatttcaggtttctacatctttagttcaatggatgactacaggaaatttattaatgatgggaattctaattcctatttcatcttatttaaaaagaagatttcaaacaaaaaaattatttctagtagcgggatttttattttcaataggattgattgttgatatctttgcacaacagtttactttattgcttataggaagacttatacaaggagcaggtgtagggattgctttaccaatgatgtataacattattttagaggaatcacctcaaagatttctaggattaatgatgggatgtggttcttttgtaacagcggctgcaccagcgataggtcctacctttggaggaataatgacacaatattttacttggcgttatatttttatttgcgttttaccagttattgttctagcaagttttataggttatttttgtatgagtgaacaaataattaataaacatgaaaaatttgatcttttaagttttatagcggtagcgttcgcttttgttgctttgattatgggattttctaatttgaatcaagttgttgatcatttagtgtttgttttatgttgctttatcattggaataagcagtttatattattttactaaaagacaattacatattaaaaatccattaattcacttagatatctttaatcataaaagttttacgtttcatactttagctattatgtttctacaaatgacaacattaggatatggtttattattaccaacatttgtacaaattgttttaaaacaatcagcaacagatgcaggggtcgttttacttccaggagccattgttggtgctgtatttgcacctgtaggtggtttgattttagatcgttttggagctaaaaaacctattattttaggtgtatgttgtagttttattgccacattttgtttcttattcttttttgaaaatcttacttatcaattatgtatgatgctttattttatctatagtttaggaattgggttgattgtaggtaatacgatgatatgtgcgatgtcttatttacctataaatttacaagcagatggaaatgcagtattacaaacattaatgcaactttcagggggaataggaacatccattacagctgctattttagcgtttgtacaacaaggaataaatttatatgatgggacaaatagaggtgcattgtttgttttgatttttttaatgtttaatattaatattgttattttaagtcaatattttgcttttaaaggaggaagaaaaaatgaattttaaagataaagtggttgtaattaccggaggaacaagtggtattggaaagcaaacagctattgagttttcaagaaaaggagcccatgttgttgcttttactgtagataaagaggaagtgtgtaagcaagcaataaaagaaataggaaatgaagctttttatattcactgtgatgtttctaaagaagaagatgtaaaaaaagctattgaagaagttgttttaaaatatgggcgtcttgattgtgcttttaataatgcgggtattggaccagatggtgtacgtatgccttatgaatccttaacagaaatttctgaaaaaacatgggatttagtagttgatgtggatatgaaaggtgtttttctttgtttaaaatatgaattgttacaaatgcaaaaacaaggttttggcgcaattgttaatacggcttctattggtggatataaaatggcacctggatttgctgcttatggtccagctaaagcagcagttattgctttaacagaaatggcagctttagaaaatgcggcatttggtattcgtgtcaatgccatttgtccaggtccaaccatgggaacagaacttaccaaaaattcactttcaactaatcctcatgaagaagcaatgttgaaagaacatgtgattcctatgaaaaaactagcgatgactcaagaagtcgtgaacgctgtcttatggttaaatagtgaccaagcaagtcatacaacaggacaaaaaatatttatagatggtggaatgcatattgcttaaaagggagaaaagatgattaaacatgtatcggtatttactttaaaagataaaagtgaaattaaacattttgttgaaatgttagaagaagttggtaaaaattgtcatttgattattaaaagtgaagtaggggtaaatataggtgaacaaccacctgtgggacctcatttcggtgatgtgattcaaattgttgagttttctaatctgatagacttacaaaaatatccccaatcaaaggaacatcaaaaattattaatggatggtacagaaatggaaactgttaccgcaatagattatataatttaagcattcattcagatatcaaagagcattcattcaaaatagtgctctttttttcattttatattcatttctatgattaaacagtcaaaacataattgactttatgattgaacggtcatataatgaacgcgtaagaggtgatcagtatggataatcaacgccatcgaattattttaaatgaattagataaaaaaggaaatgtgactgtagcttctcttgttgaacttacaggagcgagtgaatcaagtatacgaagagatttagtagaacttgatcatcaaggattcttaaaaagagttcatggaggtgcaacccttattcctaaggtaacacaaacgattgaagatccattagggaaaagacagttattaaatgctgatgaaaagaaaaaaattgcaaagtatgcagcaggaatgattgaagccaatgatgtggtttatttagatgcaggttcatcaactttagagttgattgaatatttagatcaaaaggaagcacactatattactaatggtttaatgcaagctcaacaattgaccattaaaggatttcatgtagtatgtcttggtggagaattgagaaatattacaggggcatgtgtgggtgctaatacgatgaagtcattaagtcgttatcatttttctaaaggtttctttggaacaaatggaattgatttaatgaatggttttacgacaccagatagtgaagaagctgctattaaggaattagcgatggaacgttgtcaaatgagttatgttttatcggatcatagtaaatttaataagatatatcatgtgacctttggtcaaataaatgatgcggtgattattacagatcattgtgaaaaagaaattaaagaacaagcgacagttgtggaggttagagattaatgatttatacaattacttttaatccatctttggattatattatgcatgttgattgttttgaagaaggggaaacaaaccgttcaaagcaagaagaaatttatcctggaggaaaaggatttaatgtttcaacaattttaagtcgtttgaatcttgaaacaacagctttagggtttgttgcaggatttacaggtgaagaaattgttaaagaattaaaagaaagaggatttgactgcgatttatgtcagttagaaaatggtctttcaagaattaacgttaaaatgaaaggggctaaagaaactgaaattaatggaagtggtccagatattcctcaagaaaaattaaatgagttatttgaaaaattagatcatttacaagaaaatgatattttagttcttgcgggaagtattccatcttctttacctagtgatatttatgaacaaatcatgaaaaaattagatcaacaaggaattaaaattattgttgatgcaacgaatgatttattaaagaaagtattaccttatcatcctttcttaataaaacctaatcatcgtgaattagaagaattatttaatgtaaaaatagaaaatcaagaagatttaattttctatgcaagaaaattacaagaacaaggagcaattaatgttcttgtatctcttggaaaagatggtgctattttagtaagtgaggacgatcatgtttattattgtgcaggtgctaaaggaaaattattaaatagtgttggtagtggagatagcatggttgctggatttattgcaggttatttaaaagaaaagaaatatgatgaagctttaaaacttggaagtgcttgtggaggagcaactgcttttagtgaagatcttgctgaagcttcaatgattcaagaagtctataaacaattaaaagtggaagaactataaatgaaaatcttagatttataaaaagatgtttcgattgatgttaacgctacatgtttagataaagatgaagctattaatacattagtttcattaatggcaaaacaaggtaatttaaatgatcaagatgtttataaacaaggaatttatgcacgtgaagaattaagtacaacaggaattggagaaggaattgcgattcctcatgctcaaagtgaagctgtaaacgctccaggacttgcggcaatggttgttaaagatggtgttgattatcaatctttagataatcaaccagcaaaactgttctttatgattgcggtccctaaaacaggtggaaacgaacacttgcaaattcttgcgatgttatcacaaatgttaatggatacagactttaaagattctttaattaatgcacaaagtgtagaagaatttatggatttgatcaatcaaaaagaagctacacaaaaagctaaagaagaagaaaaagaagaagcgcaaaaagaatttacaggaacttatcgtttgcttgcagtaactgcttgtccaacaggtattgcgcatacttatatggcggctgaagctttggaagaaaaagcgaaacaaatgggcattacaatcaaagtcgaaactgatggtagtggtggaactaaaaatgctccaactgctaaagaaattgaagaatgtgaagctattattgtagctgctgataaaaatgtcgaaatggcacgttttgatggaaagccagtgattcaagtaaaagttgcagatggtatcaataaagcagaagaattaattaatgaagctttaagtggaaatgcaccaatttatcatgcagatcatgtttctacaactgtagaaagtgaaagtgatgaaagtgttggtcgtcaaatctataaacatttaatgaatggtgtcagtcatatgttaccatttgttattgggggaggtattttaattgccttagctttcttatttgatgattatacaattgatccaagtaactttggtaaaaatacaccattagctgctttctttaaaacaacaggagatacagcctttggatttatgttaccaatccttgcaggatatatttcaatgtcaatttcagatcgtccaggtctagctgttggatttgttggtggagccttagcaagccaaggaaattcaggatttttaggagctttagtagctggttttgctgctgggtatttaataaaaggattacgtaaattatttgattatttacctgatgattttgaaggattaaaaccagttcttttatacccattctttggattattattaatggcattacttatgacatttattatccatccaccagttgctgctatcaatacagctcttacaaatgctttaaattcaatgggtggttcaagtaaagttattttaggaatgttacttggtggtatgatggctgttgatatgggtggtccaatcaataaagcagcttatgttttcggaactgcatcgattacttcaggaaactatgatatcatggcagctgttatgattggtgggatggttccacctctagctattgcgcttgcaacattcttctttaaaaatcgttttactaaaaaagaacaacaaacaacacttacaaatgttattatgggattatcatttattactgaaggagcaattccatttgcagcctctgatccattacatatcttacctgcatgtgtcgctggttcagcagttgctggtgctttatcaatgttctttaactgtacattaatagctcctcatggtggtatctttgtaatcggtgttatctctaatcctcttggatacttatttgctttagctgttggttcagttgttggaatgttttgtttagctttattgaagaaacctttaaaataataatgaattctaggtgaaaacctagaattttttttgttaaaaggggaatcctatttttgaaaggaacatatataatgaataatgatacaattttattacttaaagaatgtgattcaggattaaaaatggcaatttcttctttagatgaggtgctcgatgtgataaaaaatcaaaaattcaaagaaatctgtattacttcaaaaaataaacatcaaactttaaaaaatgaagtagatcatttattaaaagaacatcatcttcaagaaaaagaaccttcattactcgcaaaaagcatgtcatggttaaaaatgaattttaaaatacaaatgaatgaagatgatcaaacaattgcttcacttctttttgaaggatgttctatgggaatagaaacactttataaatatttgcatcaatatgaaaatgcttcatcaaaaataaaagaagtgacagaaaaacttattgaaattgaaaaagaactatcgcaaaatatacaaaattatttataaataactacgaaacaaattcgtttcgtaatttttttcttaataaaccatatgacacatctttttaaataagatttgaattcataaaatttaaaccataattttataagtaaaattatggcttttacatgtacaaaactttacacctaatcaccaactgtttcagatggtcaattaagaatgttaataaaatgtaagaaaaaagtcgaaaagtgttgaaatcatcggggggggggtactaaaattagaatgataaataatatataaggtggagtaattatgaattttcaagaaaaaatagagatatataaagatattattgtttctctagactattgcgtaaatgattatttatatattttagatgttgaaaatgatgaatattttatttcccctcatgctgcagtaagatttaaaatggataatgcttattttaaaaatcctgttaaagaatttaaaaaaattgtttattataaagattatgatttagttgtagaggatctaaataagattttgtctggagaaaagacctatcacaatatgcagtatagatggctaaatgatgaaagtttacctgtttggatcaattgtcgaggacaggtaattattgaaaatcatcaagtaaaatatttaattgggtgtattaatgaaattggtaaaaaacagtatgctgataatgtaagtggattgttaggagaagaaagttttaaaaattttatttatccaattgatgatgattttgaaaagggttttgttttaagactaggaattgataattttaagaatattaatgaaaattatggattaaagtttggagacgagattcttaaacgagcaggaaagtatatcaaagatcttttaaatgagtatcaagaactttatcatattgtttctgatgaatttattatatttgattcaaatgggacagttgatgatgcaatttatctttataaaaagattcaagaaagaacccttgattttattgagtctacaaactatgaaatttattatactttttcagcaggaatcctagatttttatagtcatccaacagctagttatattgaaattatgaaatggacagaattctctttaaataatgcaaaagaaagtggcaaaaatacatatgctatttttgataactgtgattatcaaaaatttcaaagagaatcagcgattattagatatttacacaaatctattgatcatgattacgaaggatttgatgtgtattttcaacctatagtcgatgtaaataaaaaagaagtaacacatttagaaacattactacgttttaaatgcgatgaatttggaagaatatcaccaatggagtttatcccattacttgaaaaaagtggtcttattattcctgtaggtaaatgggttttagaaaaagcaattcaagcatgtttatcattaaaaaaatatcaatctcaactaaaagtaaatgttaatatttcatatgtgcaagttttaaaatcagctattttaaaagatattttaagtataatgaaaaaatataatgttgatcgaaatagattagttattgaacttacagaaagtggctttatagaatcagatcgctcttttgttaatttttgtaatcaattaaaagaaaatagtattcttttagctttagatgactttggtacagggtattctaactttcattatttatataatttaaaaccagattgtattaaagtagatcgtggacttatgaagaatgctttaagtaatgattatgaaaatttattattaaagcatatgatcgacatggctcatagtgttggggtcaatatgtgtgttgaaggaattgaaacggaagaagaacttcataaagtattagaaatgggaagtgactttattcaagggttttattatagtaagccactgccttttaatgagataacagactatttgaaaaattttaagaagatcatctaggatgatctttttttatgggctataataaaagaagaaaaattaaaggagaagtttatggaacgattagttgaaatatgttgtgggagttatgaagatgctttaaatgcttattatggaagggcaaagcgtattgaattaaatagtgctcttcatttaggtggtttaacgccttcaatagcttctttgaaattaacaaaaaagaatacaaatttaaaaattattacaatgataagaccaagaggtgcaggattttgttataacgatattgaatttgaagttatgaaagaagatgcacgttgtatgcttgaaaataaggcagatgggattgcttttggatgtttaaatcaagatggttcaattaatgaaaaacaaacaaaagaaatgatcgatattattaaagagtatcaaggagaggttgtttttcatcgagcatttgattgtgtagctgatccctatgcttcaattgaattattgattcatttaggtgtggatcgtattcttactagtggtttaaaaccaaaggcaatggatggaaaagaattaattaaagatttacaaaacaaatatggtaatcaaattgaaatattggctggaagtggtataaatgcaagtaatgctagaaagatgatggaggatacaggaatctatcaagtacatagttcatgtaaagattggatcaatgatccaacaactaaaacgcatgaagtttcatatgcctatgcaccttcgcctcatgaaaatgattatgatgttgtttcaaaagaacttgttgaaaaaattgtagaaagtataaaagaggtttgttatgaaagttaaagattatagttatgaaacatttccacgatatacatccaatatagatggtgctttagaacttaaaggaaataaagaaaatctaagatgccggatgaaagatgtagaatatcaaaaaggttgtatgattcgttttttatttccaaatacgattttagatgaagaaagaaaatatccattagtgattcatgtacaaggttctggatggtataaacaagatatgaatgatcatatttttgattttatgccgattgtcaaggcaggttatgtgtatgcaattattgaataccatggtgctcctgaatataaatatccaacgcaagtagatgatgttataaaagcgattgaatatttaaaagaaaactatcaaaattatcctattgattttaaacatgtatttttaagtggagattcttcaggaggacatattgccttacttgtagctttacaagaaaggtataattttaaaggaatcattgatttatacggagtcacaaattttatgacatttagtaattggtatagtaaatatgactggcatgaagaaagaaatgtgattgattttttaggatcattagatatagaacttttaataaaagcttcaccaatgacctatttaaaagaaaatatgtctttaccaccatttctcattcttcatggagataaagatcatgttgtacctattacccaaagtatagaactatatgaaaaacttaaagaatatcactatgatgtaatctttggtagcgttcatgatgcagatcatggaagaagtattttttataatgaagatgtttatcaaacaattgttaactttttaaataaaaacaagtgatcaatgtatgtaaaagtgaggcgatttacttggaattacatattagagaatttgaatatcaaaatataatcaaacaacaattttataaacaattagttgttttatctttatatgttttattattagtttttgctttagaaagtattttatatggttttgattatgtatggattattctttttgtgacttctatggcaattattaatttaaattttagaagaaagaaaaagatattaggttatgatcttgtttatattgatgaaaataatcgtttcttttataacaatctattcattgaaatgaaagatctagaaaattatgttctttcaaaagaaactataactttgaattttatagattattctattgtgatagaaaaagatgaaaatctttatgattatttaaatcaatttgtgaagaataaaagaccaattaatggaaaaaaacagagattatttgttagctgttttgcacttctttttgtatttttctcattaagtttaggtaatcttgtattagggagtgtttatagttatataaatcatgttgaaatgatttcactttcaacgattcttatacctattattcaaataacaagtattatactaggagtcgctcttatcttttttgtagcgaagaagtttaaaaaagggataggtctttatgtgagtttattattgattgtactttatattgccttaccttttattatgggtaatgatattcatcgtttagataatgacatggcttatacacgacaaaatcaaaagcttacactttatagtcggtataaaaaaggttatggaaaatttgaaagacaaataacgaatgtttcaaataaggcagaagtgggaaattatcaaagtgtgctctatattttagaaaatcaaaaaatagaagtgatttctttagaaaatgaaactaaaaacgataaacttttttctaaaatcaataatcacatgtatttaggaacatatatttcaacacactatactttaactattggagatgataaagcttattttgaaaaaaatagttcacctaaaatagtgaaattgcatagaatcaataatcatatgctttattttaaatataaaaaagattattactttatttgtattttagaaaaacaaaaagatatcagagtttatgagctttctaatgatcgagatttaaaattttactttgctccagacccttttgaaatgtctaactctcaaacaagtaatgaggatacaaatgaaagtgagtcacaaaatcaaacagaggaagcaaatcaagaaacaacagcacaagaaagtgatacgactgatttagaaaatgatccagaaagagtttattttgaaaaagtgtatgaccttttaatagcacaaaataaattagacaacccttgttttgattatcaatatgacgctaaaggttatccttatgcagttgtaagtacaaatgatgaatatacattatctcttgtatttaataaatataaaaataatgatgaagattatgaaattgttttagaaaagtatataaaaaaaagtagcacacaaaatcttgttgatttttatttagtgaatacaaaaactttggaagttacagatcaacaacgagattattggtagggtcaagaattatcttgatcctttttatttatgttttattaatgtatatacaaagtatcttaacactatcttaatacctcccattttataatagaaataatgaggggagtattatggtgaattttatattagtgattattttgataattgttttgtttatggtatataaacaaatgagttgttttgatgagcttatagaaagtatagaatacccaacaattcttatcatttatgatgatcaatatcaaatagcaaaaaaatatgaaaatgatacaatcaaatgtataccaaaacaagaaatatatcactttgaacaaagttatcaatatgtcattttatgctgtgaagatgattattataacttattaatgaattatcgcattcatagagatatgttagatgtccaagtttattctttaattggaaaacaaaagtatgaagaattatatcaagaaaatattgaattattacaaacaatagaagacatagaaaggttaataaaacatttatatgatcaaaagaagaacaaatgttgaaatcattgcattaggatttgcaattgttattttagttggaacgtttttacttttgttacctgtttctagtgatcatacggattttttagatgcgctttttacagcgacaagtgccacttgtgtaacaggtttagttgtttatgatacagcaacacattggacattgtttggacaaatcgtgattttacttttaattcaaattggtggtttaggttttattacgattggggtttttctagccacttatcttaagaaaaaaattagtttaagacagagaggtttgattgaagaaagtgtcaattctttaaaattagcaggtggggtcaaacttgttaaacatattataaaaggaacttttttatttgaaggaattggcgcaattattttaagtcttgtttttatagaagattttggtttattaaaaggtatttatttaggaatctttcatgcgatttctgctttttgtaatgcaggatttgacttacttggaacaatagaaccttatggttcattaactccttatgcttctaatataattgttaatataacaattatggcattgattattataggaggtctaggatttattgtttggcaagatatttatgaaaaagggtttaagtttaaaaaatatcttttacaaacaaaaatcgttttaataatgacaattattttaattgttggcggagccttattattttatttatttgaatgtcaaaattcactttcttccttgtctcaagaagaaatgattttagcttcattttttcaatctgtgacttgtcgtacagctggttttaatacagttgatgtttctcatttaaaaccttcaacaagtttattaatgatgtttttaatgtttgttggtggtagtcctgggtcaacagctggaggtattaagacaacgacttttgcagttttgactatttttgtatacgctacaatgaccaacaaaagtgaagccaatgcttttaatcgtcgttttgatagtaaaacgataaaaaaagcatgttccgtttttttaataaatcttatatttatttttataagtgcaattgcactttttgacatgcaacctcaacttccaatgcaagatgttttttttgaaatcttttcagcacttggaacagtaggaatttcaacagggattacaagacaactgacaatgctttctaaaattgtgattgttttattaatgtattgtggtcgagtaggaagtttaactttagctttaagtctttcaagaaaaaagaaaatttcaaattgtaaaaatccagtagaaaaaatagctattgggtaggaggagttatgaaaacagtattaattataggaatgggacgttttggtcaccatctagcaagtaatatgatttcacttggaaatgaagtgatgatcgtagataaagatgaatctcgtttagaagatctaacaaaattgatttcgaatatcaaaataggggactgtacaaatgaagatgttttgcaaagttttggtgtcgctaattttgatatttgctttgtttgtattggaacaaatttccaaagtagtttggaaattacaagtttgctcaaagaattaggagccaagtatgttatttctcaagcaacaagagatatacacgctaaatttttattaaaaaatggggcggatgaggttatttatcctaatcgtgacagtgctgaaaaattagcagtgcgtgtaagtaatgataatttgtatgattatgttgaattggataatgaatattctatttatgaaattcctgcattacgtcaatggttaggaaaaacaattaaacaaattaatattcgagcagcttttcatatttatatcataggaatcaaaaaagataataaaacagattttttaccttcggtagattatgtttttaatgtagaagatcatcttttagttataggaaagaaaaaagatgttgatatgattctaaaatgtatgtcatgatgatcttggtgatttgatgaaagaaaaattaaggtatttagtttattttggtattattatttcgattgaattattttgttcacttactttaaattcaatgggaattaggaaagaaaatattttaatggtatttattgtaggagttttattaatttctacatttactaaaggatatttttatggtttattagcatctattgttagtgtattatgttttaactttttatatattgaccctaactatgattttcatattagtgatcctaatgattttatgcttattcttttctttttgatgacttctgttattgcttgtagtttaacggatcgttttcaaaaacaaattattatttctaaaaagaatgaaggtatttctaaacaattatatagcttatcagaaagattattgaacgtttcagggatcgaatatattttattaaaaggaaatcaatatattgaagaaagtattcaaataaaaacaaatatttccttggaaataaaagaagaaagtaaaaatgtaattcctattataggaatgaatcgagttttaggaagtattgaaatattaagtcatcaaggactcaatgaagatcaaatgattatcattaaagcagctgctaatcaattaggaaatgctttagaaagagaacttacttatttagaacaagaaaaaataaaggtagcgatggaaagagaacatatgcttaacagtatgttaagaagtatctcacatgatttaagaacaccacttacaggaatcgttggagcaagtcaactcatgatgaatcaagatcatcttacaaatgaggatgtttattcacttgcaaaagacatacatgatcaagcacattggcttactcaaatcgttgaaaatattttaaacatgtctaaaatagaaagtggaaatttagtcttacataaaaatttagaagttgtagatgatttgatttatgaagcaatacaacatttaccagagttagaaaaaagaaatgttcaagttgatgtaccagaagatttattatttattaatgtagatggtaaattaatggttcaagtatttattaatattttaaataatgcaatcaagtatacaaaagaaaaagatcaaattacgattcatgtaaagaaattagaagatgaagtacaatttatgattaaagatacaggatctggaatttctaaaaatattttagatcatatttttgaagaatttgtaacagataccaatgtttctaatgatagtcaaaaaggaattggtttaggattagctatttgtaaagcgattattcaagctcatggtggaaaaatttgggctaaggatgaaaaagatggagcatgttttatttttactattcctagtgataaggagttgaatgtataatgaatgatttaattatgattgtagaagatgatccatatatttctcattttctgcaaatgtcttttgaacaagaaggatatcgtatattaatgacaacaaagggtcatgaagcattaagtcttttttatagtcatcaacctgatattgttattttagatttaggtttaccagatattgatggtcttgaagtaattcaagaaattagaaaaatttcttcaaaacctattattgttgtttctgcacgattagaagaacaagaaaaaatcaaagcacttgatttaggagcaaatgattatgttgtaaaaccattttatatgggagagcttttagctagaattagagtagctaaaagattatctagaaaagaagatgaagaaataaagaaatatcaaaaggattatttagaggttgattttatttctagaaaggtattaatagatcaagaagaaattcatttaacaccgattgaatttaatcttttaaagcttttaattgaacatcgtggtaaagtattaacacataattacattcaaaaagaaatctggggttatcaagatcattctaatcaaaatgcattaagagtatttatggctactcttcgtcgaaaaatagaaaaagatacgaatcatcctcgttttattgtcacagaagtaggtgtaggatatacttttaaagattaacaagggaaaccttgtttttttatttcctaacaattaggaaacacaattaatgttgtgtaaaaaaaattactgttataatgataataaatggaggaaaaaagatatgttaaatgatcgacaaatgcatgtaattgatctattgaatgataaaaaatggattactggaaaagagatggcgcatattctaaatgttacagatcgtacaatacgtaatgatatagagcatattaatcaattttacgattgtttgttaattagtgctgataaaaggaaaggttatcatattgatcaaacacttttatcaaaacaagatattgaacccaaggaaattattccacaaacatcacatgaaagatgtgtttggttaatacaggaattattgtttaaagaaagtgaaattaacttaattcaattgcaagatcgagtttttattagtggatattcgatagataatgatttaaagaaaattagaagaatgattagtagttattcaagtttaaaaattgttcgtaataaaaatacaatttatctagtaggagatgaagcagataaaagaaaactttacaaagatttgctgacagaagaaactaaagggaattttatgaatttaaattctattgctgatttatgggaaaattttgatttattagaagttaaagatatattagaagaagtttgtgaaatgaatgattactatattagagatgtgagttttcctatgattatgatacatgcaggtgtttcaatagaaagaattattaatcataactatattgaagataaaacttataatgaaaaactgaaggatagtttagaatataaggtggcgaaagattttttctcaaaagtttcgcaagtgatacatatacccgttattgaagatgaagtggttttattttcgtatcttttattggggaaaagtggaaaattctataatagaaatagaaaagaaagtgaaaatttgaaatatattttttatacaattatagataaaataaaggaatattttggtatagatctttcaaatgattatgatttaaaacttggattaattacacatttacagtctttattggaaagacaagtgaacaatgttaaagttacaaacctttatttaaaggaaattaaaagaaaataccctttggtttttgaaatggcagtacattctggtgaggttattactgaatgcacaggatacactattaacgaaaacgagctggcatttcttgctttgcatttgggagcagcttatgaaagaagccaaagtatgtatcgtcatcggggaatagtcatcattcctcacaatcaaatgttatctataccttgtgtagaaaaattaaaaaatagatttggggagagaatggaaattcttgagatatttcatttttttgaagaattgcaggttgaacaatgtcaaccagatttcattttaacaacagttcccttaaaacatcaacttgacataccaactcttcaaataactttatttgtaaataacgaagatgaaagtaaagtatttcagcttcttaatgaattagataataagctttatcacaatgatgtggtgaagatgttaaaaaaacttattaaagaaaatttatttcatgttcatcaaacatttcatgatacaacagaaattttaaattatttatgtgatgaattgatagataatgatttagctacaaaagcatacaaagaagatgtttttaaaagagaagcagtctcagcaacctcatttatgtatggttttgctgttccacattctatagaagtatctaccaaaaaatcatgtatttctgtattgattttagatagaagtgtgaaatggggagaatttgatgtgaaatttattattttattgggaattagagaaacagataatcatttattaaaaatattttttgattggttatcaagtattgtcgctaattcaaagaaatttgaacaattattagaagtaaataattatgaagaatttatgaaagaaattatcgcttaggagctaatgaagatgacaaaaagaaatatatataaaaatgcacctttaacaagaagagtgcttagttattttattgattggtatttaggagcactttgtgctgcttttccaattgctgtggtttcacaaaaattgtatggaacaatgttaaaacaaaatttattaaaaattcaacaaccttatggatttattgcggggattataggagtaatttttgctttgttttactacatttatattcctttctttgtttataaaggacagactgtaggaaaacgaatttgtaaagttaaaattattcaaaataataatcaagaagtaacgttaaaatcattggttttaagacaaggtttaggaatgattgtaattgaaggtatttttgtgagtgcaagtgcattgtggcatcaacttgtttctttatgcatacacgtaaatattgtttcaatgatgatgtatgttgggtttgttgtgggaggaataagtacgttgatgattatttttaccaaggaacatcgtgcaatacatgactatataggaaatacaaaggttgtaagtgtttgatttcctattgctaggaaacgtctctatcagcctaaagataaagaaatatttataataatagatgtaaagatattggaggaacaaaaatggacaatttagagttagttagttttcaaattatttctgcggtaggtgtagcaaaatcatcttatattgaagcaatgaaaattgctgaaaaaggtgattttgatttagctaaagcaaaaataaaagagggagatcaggaatttgtaaaagggcatgaagcacatgcaggtttgatacaaaaagaagcaaatggtgaaaaagttgtaccaaatattttattgatgcatgcagaagatcaacttatgtctgctgaaacaattaaaatgatggctcttgaaattataaaattgaaccaacgtctttattcgttagaaaaataagaagggagaaggagaatgaaaaaaatttatttattttgtagtgcaggaatgtcaacaagtatgttagcgagtaatatgcaaagtgtcgctaatgcacacaatttgcctattaaagtggcagctttttcacacaataaacttgaagaaattatagaaaaagatacccctgattgtattttactaggtccacaagtgaaatatatgtatgaagaaacagttgaacaatttggaaatacaggtattcctattgcggtcattgatcaagcggattacggtatgatgaatggtgaaaaagtgttaaaatcagcaattaaactgattaaatcaaataaaaaatagaaagaggacaagtcttatgatgaaaaaacttgaaaaaatactaatgcctctagcggaggcgattgggagaaataagtacctcatgtcaattcgtgatggttttcttgtttcaactccattattaattggaggttctatcttcttattgatagcgaactttccaattcaaggttggattaattttttagaaacaactgtggttaattcttcaacaggacagacattagcatcttttatttcaaaaccagcaggggctacttttgatattatggcaatctttgctgtaattggtatagcgtattcctttgctggaaaaatgaatacaaataagatatttggtgcagccgttgccgttgtttcatggtttttaattatgccatattcagttagcggtagtgttgatgtggcaggtaaagcagttgatgtaagtttaagtggtattcctttaggttgggtaggatcaaagggtatttttgtcggaattatgtgtgcttttttatcagtccatatttatacatatgtggaacgtaaaggttggacaattaaaatgccagcaggtgttccacctacagttgaagaatcatttgctgcattaattccagcggcgatggtaatgatcgtattctttacaattaacttattatttggttttttaggtacaaatgtattccaaattatttttgaatttttacaaacaccattattaaatttaggagatacattaggagcaatggttgttgcttatattttcttacatttattttggttctttggagtaaatggtggttcggttgttggtgccgtattcaatccaattttacaaacattatcagcaggaaatattgctggtgaacatcatattatttgccaacaattccaagatttatttgctacttttggtggagcaggatctactttatcattagttattgcgatgcttttattctgtaaatcaaaacgtattacaaatttaggtaaactctcttttgttcctggtatttttggaattaatgaaccaattgtttttggattaccaattgtattgaatccaacattattaataccttttgtattagttccaacagtgaatattgttatttcatattttgcaatggctatgaatttagtaccaatttgttctggaattaatattccttggacaacaccaattgttatttctggtttccttgcaacaaattgggcaggagctcttttacaagtgttgttattaattttaggaatctttatctatatgccatttattaaaataatggataaacaatatcttgaagaagaaaataatatgcaaaatgatgaagaagaagaggatgatatttcattagatgatctttcatttgatgatttgtaggagatgaaaatttatgaaaataatcatgatttatgaccaaattcaatcaggtgctggtattaaagacgatcatgatattcctttaggagcaaaaaaggaagctgttggtccggcagttatgatggaaccatttttaaagaaagtagatggaaaagtcgtggcatgtctttattgtggagacgggacgtatctaaaaaatcctgacgaagtaagtcgaaaattatgcgcaatggtgaataaattaaaacctgatgttgtaatgtgtggtccttgttttaattatttgaattatggaaaaatggcagcaagaattgcttacgatattaatcaaaatacatcttctaaagcaattgcggccatgtcagatgataatcaagaaacgattaacgaatataaagataaattatgtattattaaaacacctaaaaagggtggtataggtttaaatgagtctttagagggaatgtgtgttcttgcaaaggctctttaccaagaaaaagaaattgaagaaattaaagaaaaattttgtttttaggatgctgtttagcatcctttctactaggaggaaagaaaatgtggggaataatagcaacatggcgtatggctgttgaaggaattagtgaagcaagccatattttacaagaaaaaggagatgcaggagatgcaatagaaacagcaataaaagcagttgaagattttccttattataaatcagttggttatggaggacttcctaatgaagaaatggaagtagagttagatgcagcttatatggatggaaatacattaagtattggagcagttgcggctattaaagattttgcaaatccggtatcaattgctagacgcttatctaaagaaaaagtaaataatattttagttggagaaggggctgaaaaatttgctcataaagaaggctttgaacgtaaaaatatgcttacagaccgcgctaaaattcattatagaaatagagtgaaagaagtccgtgaacaagaaataaaaccttatgcaggacatgatacagttggtatggtatgtcttgaccaacaagggaaaatgacatcagcaacttcaacaagtggtttatttatgaagaaaaaaggacgtgttggagattcaccaatagcgggttcaggattttatgttgattcaagtgtaggtggagcttcagcaactggattgggagaagatctaatgaaaggatgtatttcttatgaaatcgttcgcttaatggcagaaggtatgcaccctcaagcagcttgtgaaaaagcagttaatcaacttgatcatcgtttaaaagaaagaagaggtcatgcaggggatctatcgttaattgcaatgaataataaaggagaatggggagttgcaactaatattgaaggattctcatttgcggtggcaacggaaaatcaagaaccaattgtttatcttacaaaaaataaagatggaaaatgtattcatgaagttgcaagtcaagaatggcttgatcattatatgaaaacaaggatggcacctttagaggaaaaatagtatggaagaagaaattataaaaaaaatagatatgctttctttaagaatgattgaggatattaaaacgattgtaaaaatgccaagtgttgaaggaacttttcaacaaggggcaccttttggtaaagatattgctttaacacttgacaaggttttagaaattgctcaatctttagggtttgaaacaaaaaatttagatcattatataggatatgcacaatatggtaaaggtgaagattatattggcattattggacatttagatgttgtacctacaggtttaggttggaaacatcccccatttagtgcgtatgaagaagatggatatatttattcacgaggaatattagataataagggtccaattatgacatgcttgtatgcattatatgcgattaaagaactaaatattaaacttcataagcctgtaagaattatttttggctgtgatgaagaaactggatttaaagatttagagtattatttaaaacatgaaaagccgccagtcatggggtggacaccggactgtaagtatcctgtggtttatgcagaaagaggaagagctgttattgaaataagtgctaaagaaaaacaagttgatgaattttttttgtttattaataactattttttaaatgctaatacgaatgcagaaaaactcggtttagattttaaagatgaagaatttggtataaatgaaatgcgtaattttgtattgaaacatgaaaaaagtaaacttgttttttcggtcacattttcttatcctgcaaatatgacgctagaaacaattgttgaaacaattagagaaaaagcaaaaaacatggaagtaacatgtgttcaacattattttcctgtaaaatttgaaaaagattgcccaatggtttctttgttgtctaaggcttatgaaaaaataacgcatttagatggaacacctgttaccactacgggaggaacttacgctaaattaatgcctcatattgttccttttggtccaagttttccgggtcaaaaaggtattggacatcaaccaaatgaatggatgaaaattgaggatttgaatacaaatgcaaaaatatatgcattaggaatttattatttaggaatgttataggagagagtatggaaagaataatcgaaatatgttgtggaagttatgaagatgctttaaatgcttatcatggtggagcaaaacgcattgaacttaataatgctttacatttaggcggtttaacaccatctctagcaactttaaaacttacaaaaaagaatacaaacttaaaagtaattacgatggtaagaccaagaggagcaggattttgttataacgagattgaatttgaagtgatgaaagaagatgcaaagtctttattagaaaatggagccgatggaatagcttttggttgtttaaataaagatggttctatttgtattaaacaaacaaaagaaatgatagaaatcataaaaagttatcaaggagaagttgtttttcatcgtgcatttgattgtgttgaagatccctatacttcgatagaattattaattgaattaggagtggatcgtattcttacaagtgggttaaaacctaaagcaatagatggaaaagatctaattaaaaatttacaagaaaaatatggaagtcaaattgaaattcttgcaggaagtggcatgaatgcaagtaacgccaaagaaatgatgaagtatacaggaatttatcaagttcatagttcttgtaaagactggatcaatgatgcaacaacacacagacatgaggtctcttatgcttatgcccctgttcctcatgaaaatgattatgatgttgtctctaaggaattagttgaaaaaattgtgaaaagtatatgataaaaaaactaaataaaaataaaaaagcaagaacattggtaacgtttctttgtgttttgatttctgcgttaagtcaagcgtatgtcattcaagtctttattcaacctgcaaatttattatcaagtggatttacaggggtagctattcttattgagaaaattacttctacttattttggcttttcgttttcaacatcattaggcatgattgttttaaatgtaccggttgctattttatgctataaaaatattagccctagatttacacttttttcattactacaagtatttttagcgagtttgtttttaaaagtgtgtcaatttcaacctttatttaatgatattttattaaatattacttttgggggagtttcctatggattaatggcagttcttgtacttagaggaaatgcttccactggagggacagattttattgctctctatatttctaataaaaagggtaaatctatatgggaatatgtttttgtttttaatactttaattcttatgatatttggatcaatgtttggttggatccatgcaggatattctattttatttcaatttatttcaacaaaaacaatcgattctttttaccatcgttatgaacgtgtaacattacaaataacaacaaaaaaatcaaaagaaattgtagaggcctatatccaatattatcgtcatggtatttcttgtgttgaggctattggaggatattcaaaacagccaatgaatttattacatacagtggtttcaagttatgaagtccaagatattatagacttaatgaaagatgtggatcctgatttaatagttaatgttataaaaactgaaaatttttatggcggtttttatcaacaaccaatagaataaaaacttattttttatatatccaaaatagaaaaaatatttttactactgctaataataagtctgttatctttctattgtttcttaaaagattattcgttatattataaagagtaaaaagatgaggaataattatgagtgaacaaatacataaaagaagaaaaagatataaaggaacacatcctagaaattttgaagaaaaatataaagaattagatccagaaatgtatcctgaaacgattgaaaaagtaatttctaaaggaagtacacctgcaggaatgcatatttctattatggtagatgaaatattagagtttttagatattcaaccaggacaagttggtttagattgtacgttaggttatggtggacatacatctaaaatgttagaaaaattagatggacaaggtcatgtttatggattagatattgattcgattgaaattgaaaagacaacacaaagacttagaaataaaggatttgatgaaaatctttttacatctattttaactaactttagaaatattgacgaagtaagcgaaaaatatggacaatttgattttgttttagcagatttaggtgtatcatcaatgcaaattgataatccagaaagaggtttttcttataaaaaagatggacctttagatttaagattaaatcctaaagctggaagacccgcttctcagatattaaaagagttatctagagaagatttagaaaatattttattagaaaactctgatgaaccttatgctgatattttagctaaaaacatatattcttttattcgttcaggaatggaagtagaaacaacacgtcaactttataaaatcattgataaaacattaaattttattgaagataaaaatagaaaagatattgttaataaaacagcagcaagagtttttcaggcattaagaattgaagtcaatcaagaatttgaagtattaaatgaatttgttgaaaaactacctaaaatattaaaaccaggtggaaaagttgctattttaactttccactctggagaagatcgtattgttaaaaagacttttaaagaaatgaaaaatagtggtgtttatgaagatgtatgtcgaaatgtaatacgacctactaaagaagaatgtcatcgaaattcaagagctaaatcaacaaaaatgcgttgggcaattaaagctaaataataaaaggaataatgatttttggtcattattcctttttaataagctcaaatatttcttgatagagaggaaggagttttttgtctttgtgcatgacaatatgatacgttctttgtatttgaaaatcattattttttaaataagttatttcttttgattctttaactaaagaataaggaagtatcgaaaagccatcattttgtttaacgagttcaattaaagcatgaggatttgtacattcaatagttggcacaatatctaaatcatgacttataaaataactatgaacaagttcataaatagaacttcctttttcacgtgaataataatcataatgttctagttcttttaaatcttttacttttaataaaggatgttttggatgaacaataataacaagttcatcttgatagaaggctattttttttaattgatgaagcggtgttgtttcaattaaagcaaaatcaagttcattttttaaaagtaaattttctatatattcaagattattaacgataatatgaaaatgaatagttgggtaaatcatttttaatttttttaataattgaggtaaaaaaacttgtgccatagtgacactacaaccaaaagaaatattttctacatgatcttcatacatttcattttccatattttcaagagatgaaagaatctgtaatgaatgattatataaaagatgagctttttttgtaggataaatttgacggttcatacgatcaaataagggtgtttgatatttttcttctaattctttaatagctaatgaaacagaaggttggctaatgtgtaattctttggatgctttagtaatactttgattttgataaacactcataaagatttctagatgtctaaatgtcataatgcctccttatataggtaaatacctatgtataatattattatataatattttacagatgaatcaatgtgtattaagatgaaataggtgatagaaatgaaggaaaaaagaaaattattaatggaattgtttacctctacactttatttatcagcatttacttttggtggaggttatgtgattgtttctttattaaaagaaagatttgtggatcaacttcattatattgatgaaaaagaaatgttggatttagtagcgattgcacaaagtgctccaggagcaatagctgttaatggagcgattgttttaggatataaaatggcaggaattttagggattattgtttgtgtgattggcacaatcattccaccaatcgttattattagtgtgattgcttatttttataaaatatttattaccaataaaatcatcagtgcaattcttcttgggatgcgtgctggaattggagcgattatcgtaagtgtggtttatgatatggctttaagtgtcatggatgaacataaagaaagaaatattttaattatgataggagcttttgttttaaattactttttaaatgtgaacattatgtacattattttaggatgtattttacttgcatttgttgagctatttataaggagggaaagagcatgatttatttacaattattttgggcatttttccaaataggactctttagctttgggggtggttatgctgcattacctcttattagtcaacaagtaatctccacctatcattggatcagtcagaatacttttacggatcttattacgatttcccaaatgacaccaggacccattgcggtcaattcttcaacatttgttggacaatatgtagctcatttacctggtgctcttattgctacttttggttgtattttaccttcatgtatccttgtttcattacttgcttatttttatgtaaaatataaagatatgaaagtaatgaaaacaattctttcttatttaagaccagcggttgtttcgatgattgcgattagtggaatcagtattttgatttcttcattttttaaagattcattaattggtatttcttatataagataccatgcaattattgtttttatcctttgtttaatattacttagaaaatataaaatgaatccaattttagttatggttcttgcaggaatcagtgaggttgttattcaaatgatataggaggaaagagaatgtatatttattatccaagttgtaattttgctatttcaagtccacaaacagcaaaaaaagtaagagaatatttaaaagaaaagatggatattgcaaaatgttgtaaaattgatcaaagaaaatttaatgaagaagatattggtatttatgtttgtcaagcgtgtagaggtcaaatagaaaatcaagttaatacaatgtctttatggcaatatttagatcaattagatgattttaaatttcctgattatcatggtcaaaagatgtatttacaagattgttggagagatagaaatcatccagaaatacatcaagcagtaagaagtcttttaaaaaaaatgaatattgaggtacttgaaattgaaaagaataaagaaaattctatctattgtggaacgctccactatgaaaataaagaattgaaagataaccatttatctcattattctaaagagatacaagaaaaatatatgtatgattatgtacaacaatttcaaggtattcaagtaatatgtacatgtaatcgttgtttaaaaggtattttacttggaaagggaaatgggattcatttattagatttagtgatgatttaaaatattgaataaaaaatgagaataatataaatataaagttaatataaattttaacaaaatattgacaaaaacatcatagaatgttagtatttctttgtgatttaggaatgtaactctttggaggcttgacctaataaaagtatttttatactttattatgttgcctttgaagagttttttatttatataataaggagaaagaatatgattaacgtattaaaaaagaaaaaatgtgtaatatatgcaccggcaaatggaaaagttgtagacttatcaaaagttccagatcctgttttttcaaagaaaatgatgggtgaaggagtaggattaatatttgaaggagatactttgtttgcgccattagatgggaaagttaaattggttgcctcgactaaacatgcgattggatttgaagcaaataataaagcagaaattttaatgcatataggattagatactgtatcacttgaaggaaagggatttgaacttttaataaaagaaggcgatagggtaaaacatggaacaccagttttaaaaataaatagacaatttatgaaagaaaggaatatagatttaacaacaccaatagttgttactaattcagaatataaagttttcaaaagtaatataacagatgtgacgactgactcagtaataatggaatgtacaaagaattaataaaagaggtaatattatgagagtactcagaaccattaataataatgttgttatatgtttagataacaatgaaaatgaagtagttgcttttggaaaaggaataggatttaagaaaaaaaataatgatataattgaattatcaaaaatagataggacttactataaagttaaaactgaatatgtagatatgatagctcatatttctcaagacattttagatgtttctatcaaaataattgattattgtagaagccatttgaaaaaaacaataaatcctaatgttatttttactttggcagatcatattaattttgcaataaaaaggtatgaagagaatatagatattagtttaccaatatttaaagatgtagaacacttgtatgaaaatgaatatgctgtaggactgtttggattgcatacaattaataaaatgttaagcgtatctttaccagaagttgaagcaggaatgatagctttgcatatcattaatgcagaaatatctgttggtagaaatgaagaaaaacgaaatgaagatatgatacaggatatcataaaaattatagaacaatatttaaaaataaatattgataagaatggatttaattattcacgttttgtttcacatatgaattatttatttaaaagaggaaaaaaaggaaaatatatattttcaaagaactcagaaatgtatgatactttgataaaatgttatccaaaaactaatagaatagtcgaaaaaataactatttatttagaagatgcaatgaaatgtgttttaacagatgatgaaaagatatatttgatattgcatgttaatagattgtgtacaagagaagattgtctaagcaatcgatagagggcgttaccttgcgtagtgggcgtgacctcaggtatataaaattttgctattgtagaatttttaatgcctgaggttttttaatggattttaacaacatagaatcgcgcgaatatgttgataaaataaaaaaagaaagagagaggaaaaattatgacaaaaaaagattatgcaggactagctgcaaacattttaatgttagtcggtggtgcagagaatatttcgttttgtgaacattgtatgacacgtttgcgttttaatgtcaaagatcgaagtttggtcagagatgaagaattaaatgaattagatggtactaatggaagattgtgggttggagaacaattgcaaattattattggtacagcagtaaatggagtttatgacgaagtttgtaaacaaggaaattttattgctagtgatgctattaatgaaaatttagatgtacctaagaaaaaaaagaatattaaagacgtttttaaaaatattttaacaactatgacagagtgtattgttccttgtttaggagcgtttattgcaatggggatgttcgctgcaattacttcgataattggacctacttgtttaaatttggttagtacaaaatcaagtatttacaattatttaacaattgcacaaaatgctatcacatttttcgttccagtacttattgcttatacttcgtcaaaaaaatttggatgttcaccaatatttgcattagtactaatttgtattcagttaagttctgattggatgacaggagtaagtgaaggaactttaaatatatttggagcagctccaatggcaattacattaaatactcaaattattcctgttattatcgaaatttggctattgtcaaaaattgaaaagatattaaatagatttattcctgatatgttcaaatttgtttttgtaggaattttagaattgttaatttgtttaccgatttgtttatacgttattacaccgttaggaacttcattaggatatgttattgcttcacctattcaaatgttagaatctgtatctccagtacttgtagcatttattgtttctggattatatgaattatttgttgcatttggattacatcaagcattaggcgcaatttttgttatggatctttttacagcgggtgtaaactattcgttacttcctgctcaatttgctagtcaatttttgattgttgcagtaacagatttagcgatttcttttaagtcaaaaaataaaaaaacaaaattaacttgtagagaatgtgcaatttctgccattgttggtggagtaatggaaccaagtatatttggtatatatatgaaaaatttcaaattgatgttagctccatgtttaggtatggcaatagcaggaggaatacaccgtatgcttaacgtaggtgtatatgctctatcatcatcaaattttattggttggactgcgctattatccggtggagttaataacttggtacgttcatttccaggtactattgttggttgcatagttgcatttgttgttacatttattttatatggagaaaaaaatttagaaaatagttaggagatattaatatgaaatttcccaaagaatttttatggggctcagatatcgctgcttctcaatgtgagggcgggtggaatctagatggaaaaacccctattgcatcagattatggaactgttggttcgcaatctgggatgcgcatgaaaacatatgtggatgataatggaaatcagggattatatcctttttttgctacattaccatctaattaccattatgatatgcatgataattattattatattaaccataatgctgtagatttttatcatcgatacaaagaagatattgccttatttggtgaaatgggattaaaaacattgaatttatctatttcatgggcaaggatattccctaaaggatatgaaaatggggttaataaaaagggcgttgaattctattataacgtattaaaagaatgtaaaaagtatgatattgaacctttagtaactttacataaatatgatatccctgtttatttagaagaaaaatttggtggatggagtaatcgtcaaatgattgaggaattctatcaatttgcaaaggtgtgttttaaagaatataaagatttggtcagatattgggtgacatttaatgaaattaattctttagcaataccttcatttttaccatatgatttgccaagagaagtatcacaaaataattttagtcaattgcattaccaattagttgcaagtgcaaaagttgtaaaacttgcacatgagattaattctttaaatcaagtaggatgtatgtttagttcgttggcatattatcctttaacatgtgatcctaaggatgttttaataagtcaggaaacatttagaaatatgtgttactacacaacagatgttcaagttcgtggtcaatatccatactatgctcaaaatatttggaataagttgggtattactttagatataaaacaacaagatgaaagagacttattggacggaaaggttgattttattgctttttcttattatatgagtaactgtataacagttcataaagttgatgaagatatggcaaaaggtaacttatcaattggcaataggaatccatatttacaatatagcgaatgggattgggcaatggatccagatggtttaaaatatgtattacatgagttatatgggcgctatcaaatgcctctattaattattgaaaatggattgggcgcaacagacgtattgaccaatgactataaaattcatgatgtctatcgtattgattatttaagacaacatataaattctatgaaacaagcaattactgaaggagtaaatgtgattggatatactacttggagcgctattgatcttgtttctgcatcaagtggtcaaattactaaacgatacggttttatctatgtagatatggatgatgaaggaaatggtacgtttaatcgttataaaaaagactcattttattggtataaaaaagtcatagaaagtaacggagaagatttgagctaatatggaaaaattattatgtccaagtatgatgtgtgcaaattttgcatcactaaaaaaagaaataaaagatttagaagaaggaggaatcgatatcttccatctagatgttatggatggaagcttcgttcctaactttggaatgggattacaagatatcgaatatatctgtaagacagcaataaaaccatgcgatgttcatttgatgattgaaaatccatctaaatatgttgagaaatttgcaagtttaggagcaaaaattatctatattcatcctgaaattgatccacatgcttgtagaactttacaaatgatcaaagatgccggtgcaaaagcaggaatagccatcaatccaggaacatcttttgaaacagtcaaagacttattacatctatgtgactatgtcatgttgatgagtgtcaacccagggtttgcaggacaaaagtatttagattttgttacaccaaaattcaaaaagtttgttgatgaagcaaagaattatggtggatatgatgtcatgattgatggggcatgttctccagaaaaaattgaaatgttatcaaaaatgggtgttaaaggatttattttaggaacaagtgctttatttggaaaagataaaagttatcaagaaattattaatgaattgcgaggattataaaaatgaaaattggaattggaaatgatcatgtagcagtagaatacaaaaaagaaatcaaaaaatatatcgaagaaaaatatggctatgaagtaattaactatggaactgatagcacagaaagatttaattatcctatatctggtgaagcggtagcaaatgccgttgtcagtggtgaagttgataaagggattgttatttgtggaacaggtgtaggaatctcgctagcagctaataaagttaatggcattcgttgtgtaacttgtagcgaaccttatagtgcacttttatcaagacaacacaacaatacaaacatgttagcttttggagcaagagttgttggaattgaacttgcaaaaatgatcgtagatgcctggctttcaggagaatatgaaggtggaagacatcaagtacgtattgatatgttaaaagagattgaagaaaaacaaaaatagaagggttaaagaattataccaactaaattttctcattattattcatttttattgtttggtataattcttttaatggttttgtttttataaaatgaggaattattggatactgttaatgtagattgtcgttttataaaagaattattttattgtaaagaagatcaactttatacaactgctgcacttataaatggaaaagtgaactttttaagataaatctcatgttaaagtttatgatggctatgattttatgtttgatgattgtatgatgaattgtgtatgcataattgctatatggcataactgggatcatcattagtcaaaaaactcattattaaaagggaaagcagatttacgtgaaaaactgcaattccttcttctataagaatgaaagaacttgctgaaattaatctagaaactagaaaagataaccattatttatatttaattagcgcctaatcagtttatagaattttttcaaagctagaaggtaacatgttgcttttaatcaaagaattggttattctcatttttcactccttgtagatgatatttaccaaactcgtcaagatttattaaaagtaggtggtgctttaatggatttgagtctttataatttgcattatgtaatgggattatttggtaaactggtagaagcaaaatattatagtaacatcgaaaaaaatattgatacaagtggacttttagttttaaaatatccatcatttattgcttgttgcgttggggtaaaggatagtcatggtatgtatggtggtatgattcaaggtacaaaagggtatattaaatcaacattaccacctaatatagttggtgaagttattcttcatttaaatgatggaattgaagaaaaatttgataatagctggaaagattaataccagaatttaaagaatttattcgagcaattaatagtaatgatttaaattattgttatgaacagttagaaaagagtattgctgtatgcgatgtccaaacaaaggcaagaatagatgctcgagttatttttccaaatgattaaagaaaatttataaggatagagagttaattttctatccttttgttttaaaaagaaattttattagatttattatttaatttgtagtgcatttgtatttttttaataaggtctataattaagtatagacaagagttatttttttaaggagtacaaaaatatgatggataggttattacaattttatcaagaacaaattcattttttaatttagaaagaaagtgttgcatatggtatatgtattgatttaacagataatacaatgttagctaaagttgatcaaaatttaaatttaatcttttttgatgatcaaaaaatcaaatatgacagttggttaaaaacacatatttatcaacatattccttacatagatgaagttaatgaattacaagatattttacaaagaagtcatttactgaaacaatatcaatcaaatcaagcatatcaatgtatccaacattattttttatggaatcaatgtattcaacattgtaaattaaatgttcatgtttttaaaaatccaattaataatcatatacaagcatatatgttttggcgtaataatacagaagaatatatagatgaacaaataaaaaatgtactttataaaaatgattatcaagcaattgcactcattgatatattacatcaaaatgtttatttaagattaaatcatgcaacaaaagaaataaaagaaaacaattatattgattatcaaaaagttattgatttagttactcaaaatcaaatagctcctaaatatagaaaacaatttattaaaaatacatcattaaaaaacttagaagataatatgaaatatttaggatattattcctttaaagtttttgatttagaaaataaagtagtacattattcatattattggtttgatcaaaaaaagaaattatgctttgtgttgttgatgatatgacaagagaattagaaatagattctgttacagaaacttatacaagagaaggcttttttagaagaacaaataaaattattaaaagaaatacacaacaggaatttgcgattatgtatttaaatcttgttgattttaaaattattaatgatttatatgggtatgaaataggagatatgattttaaatgatttagttgttcaattacaaaattcatttttaaaacctattttagttgcaagaatggttgctgatcaatttacattattaattaataaacgaaacttagattatgaaaaactgataaagtatttacattttacatatcattatgaatcaattacactggatatttatggaagatgtggtatttatcttattccgcacgaaacaacacttaatatttcagatatgtgtgatcgtgctaaacttgctaaaaattatatttctaatcgttatttaaaaccatatgctgtttataatgaaaaaatgaaaagtgaccatgaagaaagaagtatgtcacttattcaattagatgaagcaatcaaaaacaaagaatttcaagtttattatcaaccaatctatgatgctcaaacagaaaaaattgtttcggccgaagcccttgtaagatggcattcaccaacaaatggagtgattctaccaagtaagtttattcctgctttggaagaaagtggatatatcactatattagatacatatgtttatcaaagtgttcaagagtttttggaaaaggaatgtcaagatatacctattaagatttctatgaatttatcaagaatggatttaatgaaccaaaacattatgaatcttattttagaaaatgaaagaaaccaacatattaattatgaagtaacagaatcagcttattcttcattatcagtaaatgcgaatgattttttatcaacattgcatcaaagaggaaatatgattttgatggatgattttggtagtggtgtttcatcattaagtacaattcgtgattttgaatttgatattattaaaattgatatgggatttgtgcgtaatatcggttatagccaaagtaatgatagtattcttgcttcattaattgaaatgattcatcgtttagaaatgaaggttgttgctgaaggagtcgaaacaaaagaacaactagattttctaaaagaacatggttgtgattttatacaaggattttatttttcaaaaccacttattaaaaatgattttaaaaaattaatttcaaactaaaaaacaggttctaattgaacctgtttttaaatagaattttgatgaacataatttgtaatctcaccaagattgatttctttgagcttttgtttgtattgattctctgcagcatttaaatgattcataatgatatcttcggtatgatgtatatttaaagcaggatcaaagactttatcaacaagatgcgttgtttcaataaaagtttccttgccttcaattgcttcaaaaatatctaaaaatgatatatcattcatttttttatttaaaataaaaccacctaatttacttgccttagaagtaataagaccagcaacgaccaattgtcttgttactttctttaaatatgaatcagaaacatctagctttttactaagttcatgactttttaatggcccttcacttgttccaataagtaataaaatacaaattgcttgttcaaaactttttcttattctcattgtaatcccttccctttttttattatagctaattttttatattttgtatgtaagaatattgacaaatatattgaaaaaattataatactctatagacattatatatctatggatgtaaaatgtctatagaagatagaaagaaggatatttatgattaagcaagagtggaaaaacattttaaaaaatcattggattcaaattgttttagttgctcttattcttattcctagtatttacactgttgtcttccttggatctatgtgggatccatatggtaacagtggaaatcttcctgtcgctgtcgttaataaagataaggcagttgattacaatgataagaaattagatgttggtaatcaacttgttgataagttaaaagacaacgattcattagatttccattttgtaaattctaaagaagcaaataagggtctaaaagatggtgactattatatggtcattacaattccaagtaatttttcaaagaatgcaacaactttgttggataaaaatcctaaaaagatggttttaaattatacaacaaatccaggtacaaactatgttgcatcaaaaatggatgattcagcaatcgcaaaaattaaagctgaagtttcagcttcagtaacaaaaacatatgctgaaacaatctttacttcaattggaacaatgtcagatggatttgctgaagccagcgatggtactcaacaattatctgatggtatgactcaattagaagatggtaacaaaacaattagtgataacttaaaagtattagcaagtagttctttaacatttaaagatggtacaaatactttaactaaaggtttaaaagattacacaaatggtgtcgttacagtaaataatggtatttaccaattaaaaacaggtgttggtactttaggtagtgctactcctacattagctagtggtgtaagtgatttaaatgctggcgctcaagcattaaataaaggtgttagtgattatacagcaggtgtaagtcaagcattagctggtgcgaatcaattggttgaaaataacacagcattaaatgcaggtgttaaagcattaggtgaaggtgctgaaaaattagttgtaggaaatcaacaagtagttgatggtgtaaaaaaattacaagaaaatcttgaaacttccaaaaaaactatggcagcaagtcaagattcattgactcaattatctgatggaaaaacatcattagataattatgctacattaattaaaacattaaattcaagtggtgatgctcaaaaacaaggaattgctagtaaattattaactagtggaatgtcaagagcagaaatcgatgcttatggtttaacaaaatatttccctgtagataaatataaagacggtgtagcttcatatatggattcggttgctacttatacaacaggtgcatctacagcaattaatacattatctagttcaactaaatcaagtttaaatgatttagatgcagctcttaatggtggaactttaacagatggtacaaaagttcctacaggattagtaagtggaactcaaacagtccaagctggattaaatgaagtgaatgcaaaagttaatggtggtaaatatgtaactgttgacaatgatggaaatattaaacaagtaactgttgattctaaagatgctttagttgcaggtgttcaagcttatacagctggtgtggatagtttacaaaaaggtttaacacaaatcgctgataacaatacagctttaacaagtggtgctactgctttagctgatggtacttcaaaattaaacagtaatgttcctgaattaactaaaggaattacagctttaacaagtggtgttgatcaattggctaccggtacttcaacattagtaagtaataatgctacattaatgaatggtgctaatcaattatctgatggtgctggtcaaattagtgatggtgctagtaagttggctgctggttctgatactttaggtgatggaattaagagtgcagctgatggtgtaactactttaaatggtgcattaaaatctggtgcagaagaaagtaagattgattcaacagataaaactactgatatggtagctactcctgttgaaacaagtcataaagaaatttctaaagttgaaaataacggtcatgcaatggctccttatatgatgtcagttggtttatatgtaacatgcttagcatttgctttaatgtatccaattagacatggtattaaaaaagctgaaaatgcatggaaatattgggcaagtaaagcaactgttatgtatacagtttctacattagcagctatcgtaatggttactgctttaagattaattaatggatttgaacctgttaatttaggtttaacatacttacttgcaattctcgtatcggcggcatttatgtcactcgttatgttgttaagtttaacaactggatttattggtgacttcttattacttgtattcatgattgttaacttaggtggttcagctggtacttatccattagatacaggtccagctatctacaaagctattcataaatttgtaccatatacttatagtgtagatggatttagaaaaacaattagtatgacagctccttcaatttcagttgaaattgcagtatttgcaggaatcttaatagtatgttcattattaacagttgtttacttcaaatataaaaacaaagaagataaacatgcaattcctcaaatgtttgaagaagtaaattcaacaaaagctgaatagtataaaggaatcctagaaatagggttcttttttatatgtagttcaaactaaaagcgaaaatatcttttgtgaacattttaacaaaatggtaaaataaaggtaggaggatgaatctatggaaattaaaaatgttgttgttattggtggaggcgttttaggaagtcaaattgcttatcaagcagcttattgtggttttgatgtaacgatttggcttagaagtgaaggaagtataggaagatgtcagcctaaattagatcatttaaaagaggtttatcatgctacgattactttaatggatagcgataaaggaaagacacctcaaaattgggccatgggtattagtgattatgaagattttgataaagaacaatgtttagaaaaaactaataaggcctatgaaaatattaaattagaattagatttacaaaaagcagtcagtgatgccgatttaattattgaatcaatggctgaaaatgtagaacaaaaaatagatatttataaaaaaatggcagatttattacctgaaaagacagttatcgttacgaattcatctacattattaccatcgaagttcgctaaatatacaaaacgtccagaaaaatatttatcattacattttgcaaatagtatttggaaaaataatatgacagaagtcatggcacaaaaacaaacggatcaaaaatattttgatttgattatggattttgctaaagaaataagaatgattccattacctgtaagaaaagaaaaatcaggttatttattaaattcaatgcttgttcctttattattttcaggaatggatctctatgttaatggtataagtgatcctgaaagtattgataaagcttggacacttggtacaggtgctcctaaaggacctttccaaatattagatacagtaggacttacaactgcatataatattgtttctatgtatttgaaggttccatcatttttagctccttataattttaaaggtatggctaagatgttaaagaaatatattgatgaaggaaaacttggtatgtcttcaggagaaggtttctataaatattagaagaatcgttttgattcttctttttttgtcaaaatgagaatattaagtagattattggaatgaaatttccaagttttttatttttttaacaaaaaaagaagaaaaaagtaaaaaaataaacgatatatatagcaggaggaactacttatgcaacaattaaatcttataacaagctctaataaaacaatcatgtacgatcagtattgtaaaatgctgataggacatccttatatgctttctagaatcatttcttgttttgttgaagaagctaaacatctttcattagatgaaataaaaaagctaattaaaggagtccgtattggtgataaaatcgtcaatcctcattttcatttaatggataaagaagcttttatcaaagatgaaggattgatgtgctatgatatttatttctatatcgatttaccacagctagatcaatcaaccactgtacgccgctccacttgctttggctccattgatgctgtttgaaaacagaaaattttttctgccaatgacaaagctcttacaacatctttctgctgaattattgcttatttcaactcgcccatcttctatataatatcttaaatatttttcattattgatggcatatgtcattgccgtatccaaatgtgatttctttggtgtatgtggcgcaactgttttcactatttcatagaattcttcaagtactggaagtgattttgtttttctttctctggttatacgatcataatcctttttgtattttttatcgtataccttctcaagataaaacagtttattgatcaactgatacattttatatgtttgggtttcttttattactgtcccttttggcgcaacatccattacttctaccagttttcttctaatatgagcaaaacatcccatgttttttatatcttttatatttgcataggcctggtagccatcactttgaattactccattaaagccttcaagataatcgctggctctatcatattttctgtcgttttcaaactgatagagcaccatcttcttttcttcgcttcttcctgttttatacacccacatctaacagtcctgttttccttcactctttttgagttctaatacttccagctttgtttcatctgcattgatatattcacattttaaaagctgatcatgcatgtactcaacaaattcttgaaagtaaagatcatagagtttcatgatccagttggacattgtctgccccgataatgtaatccctatgcgttcaagtgccttttcctatctgtataatggcaaagaaagattgtattttttatcaagtatcgatgcgagcaatgatggtgaagcaaaacttttaggtatgactgctttaggcatatcacctttgtacattggtgttgtttcaatttcttcatcatactccccgctgtaaacatattgaatatgttttatgacttcataatattctttatgatggacaagttcttttctttcattcgttccaatcagtcttaatggcttccctgtttgaggatctgttttatcttccaaatcatgttcaacaactgtttcaggaagatcttcaatccctcttttctttgatttctttcttgaatgtgatgtaactcttacctgtagttctggttctgtttttaatactgttgattcagtttcagcttcattgaaaaggttgagtgtcaattgatcaggtatttcgatcttttcgcttcttgatccataaaatgtttttttataaagaaccagctgttcacgaacataattcagttcctgtttcagactttctatgactgtattttttgcttcaagttcagcttccaactgtctgattctttcatcctttttcattgtcatcacatccttcaaacaggaaagattataccataaattattagatgagaatacagtttgatacagtatcctcactaattttattttcaaattccaatccttcaatcagccagttgagctgttggggtgtaatcatcaaaacgcctgattcctcatgctttttaaacttgaattttccattttcaagtcttcttgtaaaaagccagaagccattggcttcataataaagcatcttgattctattacgtgaagcattggtaaaaataaacaagctatgatccaagacattcatgctgaactgagatgtaacaatcaaagcaagatcaatcctttatataaatatcttcaaaataatccataatatatcttcgtgtcaaactcacataaaattcatactttttataagtatctttctttaaagaaactttttttaaataaatatcaataaaatctaaaaataatgtattttgatctatcttatattctttatcatattcacaattattgatttcatctactctaatatcgacatatttcttatcaaaaaagctttctctacatgaattttttactccgttacatattttgtcataagtaatcgtagtaatgtactttctttttgttattttcacatttgctcctcctaattctatttattaagccagttatcaaatgattttttagatattcttacaatttttcctagtttaatgattttaaagtaattttcatttaacaaattataagaagaatttcttccaatttttaagatatcttttatttcttccaatgtataaacttgattatcaaatgtttcttcgttatttaaaagaaaacctttattatcaatccattcattaaaagatttcatagatactcgtattgtcgaaccaatcctaacagcattcatgtcatcactttcaataattttataagctaaattcttaccgcatttaaaaattcttgcaatatcctatgctgttaatatctgtttatcccaatcatttattctattcactttctgacttctcctttagtttattaagatgtttattcacatacaaatgtgcaaatttattaatcgtacattaatttaaaccaatacttattcgtaaagacctatccattaaatcgatttcctgatcctctaaaatacttagtttttctaacagccgacttttatcaatgattcttatttgttcaagtaatatcatagattttttataaattcctgttcttttacttataaccaaatgtgttggtaaatatgctttgcctaattttgttgtaataggtgcaacaatagtagttgtactaaatctattgccagtattattttgaataatcacaacaggtctaataccaccttgttcactgcctatacaaggatctaaatcagccatatagatttctcctcttactatgttttctatcaacttcatcaccttcttttttatgtatgactaaaagcaacagtaaagttgcttttagttaattgtaatatcagtagattgctttgctatgcaattccacgagtcccacataaccttcaaggcgttatatgttctcaaaggattctaaccttcaatagtgttttgcgtgcggcaaatttaattactcatgcgaacactatgcgtatcattatattcttatattgtcattgcctcatagcagcacctatgattaccatcaaatattattcgctctcaatacactcaagcaagctttgtgccagtttatagatctttacgcttgatctgtacaactaacttccacttatacctaagcaaaaagtgtgccaattaatagcacactaatcattaataatatagttgtatatatattctatttcttcatctggaatctcaacgttgtaatatgtcttaacttctttcattgagatatttacttgatctataaattcttgatgcttttctttaaagtcttgatcagtaaagtttgaaatagcctgtcttgtaactaatctttctacaagacagcagatatgaacatataatccaaagcatgttctatttttaaatctcttatgtaagatattctgtagatggtcaattgctttcgcaacatgttcaagtagtttatccggatttaatatagttaagttattcatgacattggataatgtgaaattacgtaagatattcttttcaaatatctccatctgttcttttttcatatactttccaaagtatatctctaccgcattctgaccttcattaatgatcaattcctgtataccaatatacttcatagattcaatgttaggatcaagtgttccaataacacatacaacctcataatcattcattaactggtcatagacctgtttacgtattaaagcaggataatcataagtaataatctttagattagaatcttcaggtaaagaattgaataagatttctttgatcttatgcgctgcacctaatcctgatgcacaagaacagattacaataggttctttgtttttcttaagttctacatgtgttttatagatgttttccttaagaatagaatcaatgacttcagtcactgttttattgaatttaattccctgtcctatttctaacgcacatttagtattaatattgtttactaaggcaatatccgcattacttgtatctaatccctgatatatttcttcaagagaacccatatcaactaataaataaagttttgagatattaccaacatgtgcaatgtaatcattgatctttcttgtaatagtttgtacatccacatctaatggcatatcaatcgcatcaaatatataactattcaacattctattggctgcttctgcaatagaactagcagttgaataaccatgcgcaataataaccgcaattgtgagatcttcaccagaatgtgcaaaatacttaatcatacaaatacagataatacattctacaaagtcatcaatatcctgattcatattattctttaagtaatgagaaacatcctgtcctatttcatattcacgatggaattcaagtttaagatatttctttaagttcttcacttcatcataattctcattgatccagttatttgtcagatatgtattcttagagaattctgagatatatgtagcgagtgctatcaactcattatgtgaagtcctaaagccataatgttcagtgatattattaaatatcttttctagatagttagtaagataatcaattgaacctgcacgattatcattaaagattaatttttcaaaatatctatctacagtcttctgtgcatttatcgcaaatgaagtatctctctttatattaattaatgattgataaaaatctttaatgataccctgatctgatacaggaagaagtgtattaagagacacaagcttatgcttcttcataatcatagaagagacatctatactatttctaatactgtcaggtaaatcataagcatgaatttctaacgtatctgaattacttttatataatgcactcacacagcttgcctgaatcgtattagtcagttcaccaatattacctacaaatgtatgattcagtaacaactcatagacattagatgaaataagaattgttttgttgatacgcttctcttcattctttaagaagttatacatgagttctagcttttcattttctcctctttgggcaagagatggaattgtaagaataacaggaatacgtctaaggaatgtttttaataatgctttttgtggtatttctgttgttgcaaatataattctacattttgatttataccacttattattatcacctactaagtgatagattccctggtccatataaaggaatagtttttcttggcattccgcatttaaacaatgcacttcatctaggaataatacaccaccatccgcaaaatgtaataaacctaagttatcactatctgcacctgtaaatgcgcccttcttatagccaaataggtttgctgtgagtagttctgggttattggcatactctgaacagttcacctgtacaaaattcttagatgcatcaattaagcctgtatctacacaatattcatacgtaagtttagccataaatgatttaccagtaccagttggtccataaaacaacattggtaatccaactggtggatatgctactgttgccttaatcttctcaacaatctgatacatactttcattagacccaataagcttttcaaagttctgtaactctgtctgattatttaattcagcttccaattcatccaatgatttgtattcatctgatgaaagtttcttcttatatttactttcaagagaagctcttgaaagatataagataggacttgctttaattttaataagttttttctcattaaaaagttcatttaataatcttatcacttgatttctacctagttttaattcttttgataattgggtggattgacattcatcatatgaattttgatccatttttccattaatcaacaacattattttttcttccaatgaaatcacctcattattcatcataaaacaaataaaacttgtacgcaacaatagttattcggtatactattcaagtaaatatctaaacattaattggcacgaattttgctatatattgatgagaggtgatgacatgaaacagaaaatgcaatatattcaaacattgaaacaaactttaaaattgaatcaaaaactattaaaatccttagatttcttgactgacaacattgatgatatcaacaaagtaatacaggatatactagaaacgaatccttttttagaattaaaatcatcaaagaattatgataatcagcagtttattgaaagtatttctaataaacgttctttaaaagatgatctctattatcagttatatgcctatacacatccttataatgaagatgtaatgacatatctgattgaatcattggatgatagtggattcttatcttatcctcttgatcaatatatgagtgaccttcatatcgatcaagatattcttgatgcacatttagatatattacgttcatttgaacctaatggtgtgggtgcctctgatgcgattgattctattcttattcagttaaaaaataataataaaactaaaacctatacactatttagagattatcaagatgtcatcttaactcagaattattcacttattaaacaaacaacaggattaaataaagaagaaatagatcatttattctatgaaatacgttcttgtaatccattcccttgtaatatgtataacacgtctcatgatgactatgtatctcctgatatactcattgaagtagagaattcagatattactattacacctattaaccaacctgctctcatggtgaatgacactctatatgaaaaagtaaaaaatgatgagaatatgaaagcttattttaatgaggcacatttcttaatggagaatatgacaaagagaaatcaaactgttcttattgtcgcaaatgcgttagtaaatatacaaagtggatatttcttatatgatgatgaattatatccatgtactttatcacagcttgcaagtgagacaggattccatgaatctactatttcacgtactttaaataataagtactatagctttaatggtgaggcttatcctcttaaaaaacttcttgtttctcaaactgcttcaggagatagcagtgattctattaaaaaggctattgttgagttagtagatgatgaagataaagaacatccactttcagataatcagattctcaaaaaactagaggaattagaattacattgttcacgtcgtgttattgtcaagtatagacaacaattgaacattccttcttctactaaacgtaaggtgcttaagaaagtaggctaacctatcactaggctagccccttatcaaaccgtacgtgcactattaatgcatacggcttaccaatttactatttatttaatttatgtacggactatcttgataaagaatcgtccattttctttaatctcttttttgtgtagaatgctatacctagttctttgaatttttgaatgcgtttttccatatcaaccttatttctatgcatgtgaccttcgaatactttgagaaccttgtagacattcaaataatagttgatcttaccaacgatgataggatttatatcctttatccattcttcttttggcttagtccatctataagccatattgaccttgatttcttcaccggtcattctcatagaattgataccaaatgtataattgataaaaatcattttaaaaagtcccacaggattaatagaacatctgccaaaatcactataaagtgattttactaacggatagatgaatttccagtctatcgtagcttccagtgttctaaccaaatggtcttgtggtactaagtcatctaaaggtaagcgtcaaataaataagcgattataaataattgatgaattcaatacaataaggatgtacttaataaggaggcgcatcttttttgatacaggacaaaaaatggttaatgttttaaatgaattattgattgctcatgaaaaatacttaccacaatttgcagataagattgccgagttaaaagcagcaggtgttacaatcaaagatgatgttgcacgtgaattaactgaaaaaggtttataggattttatgtgaataaaataactacctcacactttgccagagacatgaggtagttattttttgcattattttctataatatatagaagtaatttaataacgatatttattattgacatgattaatgtaagtgtagttaacatatagcttcataagctgtcatttccatcacctccgttttcatattttcctagggatatctatgtaaacgaagaatacgtccttcgatcaaagcgctaccgtctttaatgaaggattatagaagaaaatgaaaatgatgtcataatagtttggggtgaatttatgaaaaaattattactatttgatgtggaaggcgagagaaaatggacatcttgcagttattgttactgggagaagtagaagccatatagaagagcccattttagatattggttttgatggaatgattggtggtaatggtgcttatattgaattagataataaagtgattaaagatgagacaactcaagtagaagatgttaaaagaattgtcgattatttaaatcaacatcatttagaatactatattgaagcaaatgatgggttatatggttctttaaattttaaagtacgtggtgtagaggctttaagacaatatgggatgaaagatcctgatgtgctggagatttatccagcaatgacttttccaaagtgtctctatatagaaaatgtaacaaaaatcaattatattttagaaagttatcaagattacttagattttaaagaagcttttcctgaatttaaagatttgacgtggggtgaaaaaggagaaaaagcaatctttggagattgtgcattaaaacatattgataaacaagaggcaattaaagaacttattgattatttaaaaatagatcaagaagatatcattgcttttggtgatgctgaagtagatattcctatgtttgattttgcaggaatttctgtatgtgtgggaaatgggagagaagaagctaaaaaacatgcaacctatgttacaaaaccagtaagtgaagatggcataaaatatgctttaaaacattttgaaattatttaaggaactaaaaatgaagttaaataaacaaaaaatcttatttattgctgttatctttttctgatttgcgcaatatgtctatattccttattaaacaccttatcttacgatgattcaaacaagtacgtcatttattggaattattataggaagctatggtatttcacaaatggtcttacgtttaccggtaggattattagtaaattatagaaataagcataaaatgattatgttaataggatctttatcatcaggatgtgcttctttgtttagaattatttttaataatggaattggttttttaattggaaatcttttttcagtatttgccagtgcaatgtggatttcttttatggttttatatatgagtttttatccaaaagaccaacaaacaaaagccatcagttcaattattgtcgctaacaatttaggaatgttattagaatttattacaagtacacttctttatgaaaaaataggaatgcaaatgatttgtttattaagtgtgatttcagaaatcatttctgctttatttatttcattacttcctaaagaaaaaacacaaccaataaagaaaaaaatttcaagtttattaaaagtatgtacacaaaagaatttaattgtcttttcgcttcttgcactgttcaacaaggggtacaaatgacaacaactatgtcttttacaacacgaattataaaaaatttaggaacaaattctatgtctataggattatcttctattatttatatgttatcagcagtttgttttgctaaaatggcatcaagtgatgtatatatgaaattaggcgttagaacatgtattactgttacatttttaacaactgcactttattgtgttttagtaccacaatgttcatcagtctatatgatctttgttttacaaattttaccaggtatggcaacatgaatcttattttcatatctaacaagtgaagctatgaaatatgtaccacaagaatcaaagtcaacagctatgggcttcttccaagcggtgtatgctttaggaatgactttatttcctatgatttgtggaaatattgtaagtcatttttcaatgctatatgcttatttgtttttagcagtgatttgtttaattgcatcaagtatttcttttatatattgtaaatctcattaacaaataaagctcttacaaaattaataatttgttaatgaaattaaaaatgtatacaatactcttttcgaagaatctaaaaaagtataagctacaggtgtcttaggaaagagaggaataaatattatgagtatcaatgaaattaaatgttgcagcttcatcacggaaatcttttccttctggagaaattgataatcctgatggaacaaatcctttagcagcttgtgaaccgtcttttaaaacattttcacataaatcttttctgttgatagctaatgataaagcttttcttacatttaagttagctaaatcagcattttctaagtttggttgaacgtagaataagaatccttcagaaatatttttgaatgattcatcttttttgtatttatcaactaagtcagagttgataatagcgaaatcagtttcacctgcttcaaaagcttgagcagcaacttttggctcttgaactaatttcatcactaatttgtcgattttaacatctttagcagcatagaatttatcatttttttcgaattcagctactgaacctggttcccagtttgtcataacgaaagcaccgttacctaaaatagaatcagcactcttaccatatttatcaccttgtttttcacagaatttttcattaattggatagaaacatgggaatgacattaattcatcaaagaacgaaactcttgtagttgtagtaatttctaacgttttgtcgtctacagcttttacccctaatttgtttaagtcttcatcagttaaatcttgttctgcatcgattttatctgataattcttgagcacctgcgatgttagcaataccatcgcagaacatgtaatagtagtttcctttctttttgaaaattctttgccatgcataaacgaaatcgtttgctgtcacagcatcaccattagaccatttagcatctcttaatttataagtgtgtgttaaaccgtcttctgaaacttctgaagatttagcaataccatatgtagtagtaccatctttagcaggtttcattagcccatcaataattgcatgtaatgcagtaaatgagcatccgtcatcggcatctgatgagtctaaatttttgatatctaattcacttgaataagtgtaagtagatgaatcatcactagatcccccacacccagcaagagttagagccatcatagcacaaagtaccatagataataattttttcattttttctcttcccttctataaatcgcttttgtatacactaatacatatacaataaaaatttatgctttaatattagtacaatgcgttatagaagtcaacaaaaaaaacgaactttgtatacaaaattgtattattgtttatacaaaaaatatatttttcaatctacattcaaaaataaaatagagcaattgttttttatacatttcattttggcgtttatattaattggaagacaacatatttttttattcttttttaagaagaaacacaataccgaaatattgtgtttctgttgattttatcgactattttgatacatattggaatgtatatggaacacctacaggtctaattactaaaccttttacatctttattttgtaaagttgcagtacctttttcaaatactgggatgtaacataaatcatccatcataattttttctgcatcaatcatttcttgccaacgagtattagcatcagattcattagcaactttatccattaatgcatctaattcactgtttgtatatttaccatagttgttaccattagtagaaatacccattgttaagtaagttgtaggatcaccatagtcaggtccccaacgagttactgataaaatgttgcagcttcatcacggaaatcttttccttctggagaaattgataatcctgaaggtacgaaacctttagcagcttgtgaaccgtcttttaaaacattttcacataagtcttttctgttgattgctagtgagattgcttttcttacatttaagttagctaagtcactattttggaagtttactgaaatatagaataagtaaccttcattaatttgtttgaatgaatcatcttttttgtatttatcaactaagtctgagttgattggagcaaaatcagtttcaccagcttcgaatgcttgagcagcaacttttggatcttgaactaatttcattactaatttatcaattttaactgttttagcatcataatacttatcatttttttcaaattcagctactgaacctggttcccagtttgtcatagtgaaagcaccatttcctaaaatagttttagcactcttaccatatttatcaccttgtttttcacagaacttttcattaattggatagaaacatgggaatgacattaattcatcaaagaatgaaacacgagtagttgtagtaacttctaatgttttatcatcgatagctttaacacccattgcatctaaatctgcatctgtaatatcttcttcattgtcaattttatctgacatttcttgtgcccctacaatacttgcaataccatcacagaacatgtagtaatattgacctttcttttggaagattctatgccaagcataaacgaaatcatttgcagtaacaggatcaccgttagcccattttgcatcttttctgattttgtaagtatgagttaacccgtcatctgaaacttcagaagatgaagcaacaccatttacgacattacctttcttatctgttttcataagcccatcaataacagcatgcattgctgtaaatgagcatccgtcatcggcatctgatgagtctaagttcttaatatctaattcacttgaaaaagtataagtagaactatctccaccagatcccccacatccagcaagagttagagccatcatagcacaaagcaccattgataatagttttttcatattctctcttcccttcttaaattatcttttgtgcaataaatcgacatattgtatacaatctatcgatttattaacatcatcatagtttatataggtttaaaagtcaatagttttttgtatatttgtatataatgtatttaattgattaatgttatatttttttcaatacataataaaaacataacacattttactgtattatgttttcttaaaattattctgttttttctacatattcaaaagaaattatacgacatggtttaatcacaagattttttaccttcatattttgtaaagtagcagctcctttttcaaaaacaggaatatacgcataatcatctaataatatcttttctgcatccttcatttcttgccagcgcttttcaacatctgattcaacaccgacttgatttacaagttgatcatactcactatttttccacttgccatagttattactattcgttgataaagcaattgttagatatgttgttggatctccacagtcaggtccccaacgcgtcacaactaaatcaaaatcaccattttttgtttgttgtaaatacgatcttgttttgttgttgcaaccatttctattttaatgccatttaatttacttaaagcattttgtaaatatgtcgaaaatacatccattggtgattcatctgttccataagtaattcttaaagtaatttcagattttcccaattcttttaacccttcatctaataaatcttgagcttgtgctttatcataagaggtaaaatcaccagaatcttttctaaaatctacaccacatgggcttgtagctaagcctgaaggaataaatcctttaacaacttgtgaaccatcttttaaaacattttcacataaatcttttctattaatagcagatgaaatggcttttcttacatttaaatttgcaagatcttcatttttaaaatttattgagatataaaataaaaagccatcataaacttgtttaaaagagtcatcttctttatatttatcaactaaatcagaattaattggcgcataatctgtttcacctgcttcaaaagcttgtgcagctactttaggttcttgaacaagtttcatcacaagttattgaagctttacatgtttttgatcataatagttttcattttttaaattcagctactgatccaggttcccaattaatcatcttaaaagctccattacctaaaatcgttttagcacttttaccatatttacttccttgtttttcagcaaatttttcattaatagaataaaaacatgaaaaagcaagtaactcatttaaaaaagaaacacgaacatttgttttaacttcaaaagtataatcatctaaaactttaacacccatcttatctagatcatcatctgtaagttcttcaccagcgtcaattttatctgataattcttgtgcaccttgaatgcttgctataccatctgcaaacatataataataactgccttttttcttaaagattctttgccatgcataaacaaaatcatgagctgttacaagatcaccattatcccatcttacatcttttctaagtttataagtatgaactaatccatcttctgaaacttcttcacttttcgcaataccatacgtaatatttccttttttatctgttttcatcaacccatcaataacagcatggatagcacgcaatggacattgatcatcagcatctgatgaatctaagtttttgatatccaattcacttgaatacgtataagtcgaaatgtcatctccacttgatccaccacatcctgttaatgttaaaaccattaaacaatataaaaaaatgaaagtattttttcatatttcctttctccttttttatcttttccttcaaccatatcccattttcacacaccgtcaacaaaattatgtatccgcttccattttttattaaaaaaagaagtagatttctctacttcattattttactacactcatggcaagagctaaagctccaacaacccctgcattatcccctaatcctggataaacgatataatctttaattttatcagtagtcacttcttctttttgaatataaccatttaagaattcttgagtatatttatgaatcattgggaaaagttgtttttgatgcataacaccaccaccaagaataattttcttaggtgaaagagttaaaatataatttgccatcgcttgtccaatataataagcttctaaatcccatgctggatgatcttctggaagttcacttccttttactccccatcttgcttcaatagcaggaccagcagctaaaccttcaaaacatgttccatgatatggacatttacctgaatatgtgtcatcttctcttacaatcattttcatatgtcccatttctggatgaagtaacccgtgtacaagtttaccaccaacaacggctcctccaccaattcctgttccaattgtaagataaagggcactgtctaatccttttgccacaccaaatgttgcttcgcctaaagcagccccattgacatctgtatcaaaagccataggaatatcatatctttcttttaaagcacccataatattataattgttccatcctggtttaggtgttgttgtaatataaccataagttggacttgtaagatctggatcaatcggtccaaagcttcctacacctaaggcttcaatttcttttccatcaaagaatttaaaaacattttccattgttttttcaggtgcttctgtaggaaatgattctctttctaaaacttctcctttttcatttccaatacaaactacaaatttagttccacctgcttcaattgctcctaatttcattattataatctccttttttcctttactcttattttaaacaactctgattataaagtaaatatgcaattataaattgaaaaagagttacatgatttagatgataaatcggtatattaaattatccggtgcttagaggttcactctaaattattaggcggagtcaggagctaaatactactttgcagaaagcggattaatgcaaacaggatggtttaagatcaacggtgaagattactatgcagcttcaagtggtgtaattagtgcccaatggataaaatcaggaaataactggtattatgtagacgctaatggaaagatggtcacaggagattatgaaattaatagagtagttaatcgctttgatgctaatggtgtctggcatggtgtttggctaggataatttaattcattacaatttagtagaaagcagctcagaaatatttattatattatttttgagctgttatatttataattcaagatatgaatgatttattgttgtaaaggttaatttaatatatacttattatgtatatatttaatagaaaggaaatttttatacaaaaagatttgtgtaaaaaagtagtagaaatttaaatggtagaaacaagtgttattatggcaacttataaagaaagcatagaatgtttaaaacagtccatagaatcaattattaatcaaacatataatgattttgaatttattattattttagataatccaaataataaagaacatatagcatttataaatgattatgtatgtaaggatgaacgtattaaattctatataaatgataaaaatatggggctaacaaatactttaaatagaggacttaaacttgctgaaggaaaatatatttgtagaatggatgcagatgatatttctgaattatatagaatggaacatcaaaagaagtatttagaagaaaatgattttgatttaataggtggaatttcacaaatgatcgatgaggatggaaatactatttattcaataaaaaaagttccaactaattttaaaaagataaaaaaatgtattaaatataatcaagttatttctcatccaacatggtttggtaaaaaagaagtatttgataaattaaatggctatagaaatatgccactttgtgaagactatgactttacattaagagcaatacttcaaggatttaaaatttctaatgtgaatgaatgtgttttaaaatatagaatgacaaaggatagtatatcaagatcaaatttatttgaacaatatttatttgctagatacattactaaacaatatagtgaaggaaaagtaagtgaagtagaagaagctaaggcgtatgtaaagaagaatttaagtgataaaaatgcaaagcattatttaaaaggaaatgagagatttaataatgccttaaataacttagaagagaaacaatatattcaatttatagcaaatggtattgcattactttttacttctaaatattatcttgataaaatatttagatttgtaatggtttatttaaactcataatatattagtagaatattgattaaaaaatgggggctgtaacaaaataaaataaacagctaaaaatagaaaaagaacaatggtaatttaaaataacgagggtttctcatattttagttatcaaatgatgtggggcaaagacagagaatatctgcttctggttttctattttttatagattataactagtttatttttttgtatttgttataatgtcaattgtgagacaagaggggggattgtatgaaaaaaggtaaattattaaatattgctttatcgatagcgtttattaatattttatttgtatgtttttcgattataaatgttaatgcggaagaagatacagatacattaaatacaaatgatgagtcgactgtaatggaatctggttggacgaataaagagaatcaatggtattattatgatcatggtgaaaagaaaacaggatggttacatacggattattggtactatttagatcaagatggaaaaatggtgacagggttagcttctgtaggaaatcaacaatattactttaatcaatcaggggccatgcaaacaggatggatccaagcagatggaacatactattatgcaaataatagtggatacaggagctaaatactactttgcagaaagcggattaatgcaaacaggatggtttaaaatcaatggtgaagattactatgcagcttcaagtggtgcaattagtgcccaatgggtaaaatcaggaaataactggtattatgtagacgctaatggaaagatggttacaggtgattatgttattgatggaaaagtaaatcattttgacgctaatggtatttggcttggataattaaaattatgtacaaaaatgggatgaatacatcccgtttttgtgtatattttgtttgaaatatataattttattggtataatcaataagaatagtattagagaaagagggaaagtatgaaaactttagttataattccagcatataatgaagaagaaagcattttaagagttgttagaaatcttgaaaatgctgatattgattgcgattatgttgtaatcaacgattgttctaaagatagcactggaaaaattttagatgacaataatattaatcatattgatttacctgttaacttaggattaacaggtgcagtacaaacaggttataaatatgcttattataataattatgacgcagctatccaatttgatggtgatgggcaacatttaccagaatatatacctagtttagtaaaagaaatagaaaatggatatgatattgttattggatcaagatttgtggatgaaaagaagcattttagtatgagaatgttaggtagtagaattattactgcaatgattaaactaacaacaggtgccactattaatgatcctacaagtggaatgagaatcattaataaagaattaattaaagattatgcttttgaattaaatagaaaaccagaacctgatacacttgcatttcaaataaaaaaaggttataaagcaaaagaagtacaagtgaaaatggaagatagacttgctggtacaagtatttatacagggataggaagttctattcaatatatgttaaaagtattaataacaattatattctttaattaggaggtaacgtatgagtttaacattacaaatattattaattatattcactgttttattctttattgttttagtaaagaatgttaaaaaaggtaaattaagaactgattatgctttagcatggattctttgttcgatagcattaattattttaagtgtttttccacaaatagctttttttgcagctagacttataggtgtcatttcaacagcaaatatagtttttgcagctattatttttatgttgattattttagtatatgttttatttaataaagtatctatgctagaagaaaagcaaaaaaacttaattcaagaagttgctattttgaaaaagaaaaatgatttaaaataaataatatttattaaatacattacgatttaatcgtaatgtatttaattgtttaagtttaataataagggaggaaatatatgaatcatcttttaacctttatatttttaatttttattttttatttttattggttaataggagagtttgtagctgattgttttgctataaaaataaaaaattcaactgcatatgttatatatggatttatatctgtattttttatttcttttatcataggttttccgtgtcaattatttcaattgagttggaatgtttattttattttattttgtgttcttttcttttctttttttgtatttttattatggagaaaatataaaaatatttctacctttgtaaatgaatttaaaagtagcctaaaaaaggaaaacataatagatcatgtaaaaaataattgggttatttatatttttgtttttttattcactttattttcagtatcaaatgtaatggctttatatgagtttgattacgatgatgcttattatatagcgaaagtagttaattctataggaacaccatctttaatgaatgaaagcttttatacaggatggcttacaacatctgtagattatgcacgaatggtgaatacatatgagattacttatggtgctctcgcaagtatttttcatattaatcctgtttatttttgtaaagtatccatggttattcataactatacaatgtttgcattagcaattaaacaattagctagttttgttactaaaagaaaagcacaatatgcacttattccattctttttatttttaataggccatggatatttgatggaaaataatggttcttttttaacaataagatcatttgacttatggcaatttcaaaatgccatatggtatggtggttcagtagtaagagtactttctgtacctatcatgtgtattgtttgtatacctttgattgaaaataaaatgacaattaaaaatattatttttgctggtatcacgagttgttcgatgatgtccttttcgacagtttttttacctgttttaattgttatgttctttgttttatttatacttaaatttgcttataatacatgtatttcaataaaggaaaaaaatactaaatggatcattattaatttatgctgtttcttatttgttttagtattattgattttaacaaataaattggaccatactcctttattatctttagcagattttgaatcttttagtaatcaattatcgccattttatggatattatgtttctactgatacaattatgcaatatagtacatgtattgcagctattgctttagctttggtaattaattcaaaatatggaaaatatctggctattattacattaatgcttattattattgtagctaagaataagttcaatgaactactatgtctatcatcgtttaattatttctttgttatattgagattttattcagcaattcaatttatggttgttttcttgatagggttatctattgctaaaatacttgatattatttctttaaaaacaatatctgtttcagtagcaacattagcgattgcttcatctctcatatttgtttatcaaaattataatcaaattaaatcgtatacatttttaggttgtggaattaatcaatatggttatgattttacacaaatatttaaatacgataatatgatgcttgatatatttaatgatgtaggagaacattttgacagtttgccttatggaaattatacattattggctcctccaggatttacttatcatggaaaagtgacttatcatcaaggattctatatgtcaagtaatcgaattcaaattgtaaaagaaggttctctttatgaagatgaagtgcaattttatcatgctatttatgattattggagtgaaaaagcatcttttgatcaaacgaagtttgcatttgattattatagagaatcatatttcttaacattttctaaaaaacaagctgatgagtttatgagtcatggctatcaattagaatatacaaataatgagtgttatgttattagattatagaagctatatttatttagcttctatttttattttaaaattctaaaatataaagcaaagatatggtagaatatacagtgtgaaatatgaagtgttggacaaataggtatgtatgtggtatatatttataaggtttaataacgaaattattaagaatataagagaaaaaataaaagatttagcggaggtcttatgaataaagaaaatgctattgaagtaagaaatatgacaaagtattttaaagttgaatatgataaggctcatactttaaaagaaagattgttatcttttggaaaaagcaatagagaagttcatacggtattgaagaatataaatttagatattaaaaaaggtgaaactgtttgtttgattggaacaaatgggagtggtaaatcaactttattgaagttgatgactaagattatttatcctaatgaagggacaattgaaacacatggtaagttgacttcgttacttgaattgggcgcaggtttccatcaagattttacaggaagagaaaatatttattttaatgctgctgtttttggtttaacaaaagcagaaattgaaaaaagagtagatgatattattgaattctctgaacttggagaatttattgataatccagttagaacttattcttctgggatgtatatgagacttgctttttcaattgctattaatgtagatgcagaaattttattaattgatgaaattttagcagttggagatcaacatttccaagataaatgttttgataaattaaaagaattaagagatagtgataaaacaattgttattgtttcacatagtttagatacagttaaagatttatgtacacgtgctgtttggatctataaaggtgaatttaaattagatggtgatccaacttatgttattgatgaatatttaaaacaagttaaattagatcataaagaagaagctaagaaaaaatatcaaaagccattagatacttatcatggtattgttgttgttgatattcctcaatcatttgctgaagttaaaaaagatacagctcaatttacaatttctggatggtcattgagtgattgtttaaatgatcgtttaaaagtaacttttgatgatcaagaggttactgaaatgagaaaaataaatagaagtgatgttttaatggcttatcaagaaaaatatggtggttatggaacaaatgatgatgaatgtggatttgattattttgtagatgtaagtcaaatggaattaggagaacattctattcttgttcaattattagatgaaaaagataaagttatatctgaaaaagatttaaagattaatatcatataggagaaaaagaaaatgaaattatttaaaaacttatatgactatcgtgaattattaaaaacaaatgtaaaaaaagatattagaggtaaatataaaggttcatttttaggagtattatggtcattcttaaatccattattaatggttgccgtttatgccattgtatttccttatatcatgagaatcaaaacagataattatcttcaatatttaatttgtggggttattccatggaacttctttacgacagttatgggacttggaatgggaagcattaaaaataatgcaggtgttattaaaaaagtatattttcctagagaaattttaccaatatcagccacattaagtggacttgttaacttttttatcgcttgtttgattattattcttttctgtgtttttggagggcttggattaagttggcatattttattagtaccatttattgcgttgattcaatttgtaattacagcaggaatggttcttggtttaagtgcaatcaatgtttatattcaagatacagaatatattattcaatttgttattaatatgttattttatggaacacctattttatatccggcagaattgtttccagaagctatccgttgggtactttatttaaatccttttacacatattgtaagtgcctaccgtgatttctttatgtatcatacgttaccagcaatgtctagtgtgctttatatggttgtaatggctattatttgttttgtattaggaatgtttatctttagaaaattagaaaaaggattcgctgaagaaatttaaggggtgatctacatgaaaacattagattatataaacgtgagagatgcacaggttcatggtcttgttaatcctacatttattatgtatggaaattgttctttaaaagattattcttttgaagtaactgttgatggtaaaaaaagagaagcacgttttttaccagatctagcaagtgacaattatgaattaacattatcattgagtaaagatgattctaaagttaaagtttatttaatacatgatgatcaaaaggaacttgtttgtgtaagaaagaacactttaatgaaaagaattaagtcaaagattagaacacttttacaaaaaacagttagaaaaacaaaagaaacaaataataaggtaaaagtaaatacttatgctattggtaaagaagttaaatatatagctaaggaatatcattttgttttaacaccaaatagattaaaacaaagtaaaagacgtattaaagaaaataaaaagacaaagaataaatttttagatgtgtataactttttaaatcaaaaggaatatcttctatggttagaaaaaaatgaaaagccgtttgaagaacacccacagtttgattataatccacttatttctatttgtattcctgtttataatgtggaaagaaaatacttagcagaatgtttagattctattttaaatcaaacatatcaaaactttgaaatatgtttatctaatgattgttcttcattacaagaaacaattgatacattaaatgaatatgaaaagaaggattctagaattaaagttcatcatcgtaaagaaaatggacatatttcaaaagctacaaatgatgcattaaatatagcaagtggtgaatttattggtttaatggataatgatgatttacttgctagaaatgctttagctgaatgtgtggctgtcttaaataaaaataaagaattagattttatttatacagatgaagataaaatggatatgaaaggattaagaagagatcctcattttaaatcagattatgcacctgattcattacttggaagtaactatatttgtcactttgaaatcatgagaaaatcaattgttgatgaaatcggtggttttagagtaggctatgaaggggcacaagactatgatattttcttaagatttttagaaaaaacaactcctgaacgtgtatatcatattccaaagattttatatcattggcgtatgattgaagggtcaacggctgccacaattgatagtaaaggatatgctgtagaaaaaggtagaatggctgtagaagatgctttaaaacgtaggggtgttaaagcaaaagtaacagtacacccaagagttccttactatctagtgagatatgaatatgaaacagaaccaatggtttctattattattccaactaaagattatgcagatgttacagagcaatgtttaaaatcattatttgaaaaaacgacatataaaaattatgaagttattttaatgaataataacagtgaaaagaaagaaacttttgatttatttaaaaaatatcaaaacaaatactcaaattttagagtcatagatgcaaattacgaatttaattattctaaaattaataatcaagctgttaaggaagcaaaaggtgaatatatcgtattattaaataacgatacagaaattattacacctcattggttacaaattatggttggttatgctatgcaacctcatattggtgcagtaggaactaagttattatatcctgataatactgttcaacatgctggtattattttaggaattggtggaattgctcaacattgttttattgataatccaagagatgatgttggtttttatggaagattatcagttccatttaattatagtgcagtgacagctgcctgtttaatggtatcaaaagaaaaatatttagaagttaatggtttagaagaagatttacaagtagcatttaatgatgtggattttaatttaaaattattaaaacaaggatattacaatatatgcttgaatcatgttgaactttatcatcatgaatcaaaatctagaggtgatgatacagttgatacaagtagtgcaaaatatcgccgatttgtacaagaacatgattatatcaaagataaatggggttatatgttatataatgatcgattctataatcctaatttgagtttgaaaaaagcatttgttttagataaggaataattaagaattataaaattgaatactggttaaaaaaatgctagtatgtctatgacaaaactagcatttttattaggagaagaaaatgaaagaattattaatgaaatataaagaaatcattatgtatcttgtgtttggtgttcttacaacggtcgttaatattgttgtttattttttaagtgcagagcttttacacataaattatttgatttctaatgcactagcatggtttttatcagtattgttcgcgtatataacaaatagaaaatatgtttttgaaagtaatagtcaaaatattttaaaagaagcagtttctttttttagttctcgattagctacaggaatcttagatatggtacttatgtggctatttgtgtattttaatgttgttaatgatgtgattgctaaagtgattgttaatgtcattgtggttgtattgaattatgtattaagtaagttagttgtttttaaaggagataaataggatggaaaaaataacagtaattgttccttgttataatgaagaagcagcacttcattactattacaaggaaatgagtagggtcatggatgaaatgaatgacgtagattttgaattattattcataaacgatggttcaaaagataaaacattagaaattatgatggagcttgctaacaaagattcaagagttaaatatatttctttttcaagaaattttggaaaagaagcggctatgtatgctggatttgaaaatagtacaggtgattatgtatgtttaatggatgctgatttacaagatcctcctcgcttattaccagaaatgttaaaagcaattagagaagaaggctatgatagtgctgctacaagaagagtaactcgtaaaggagaaccaccaataagatcattttttgcaagaatgttttataaaatcatgaataaaatatctgatactgaattaatggatggtgcacgtgattatcgtttaatgacaagacaatttgtaaatgctttattagaattaaaagaatataatcgttttagtaaaggactatttggttgggtaggatttaaaacaaagtggattgaattcgaaaatgtagaaagagttgcaggagaaacaaaatggtctttctggaaattattattatatagcattgaaggaatcgttgctttttcaacagcaccattggcgattgcatcgcttatagggatgttgatgttatttatagcatttatatttatcatattcattattattaagacattgatttttaatgatcctacaagtggatggccatcattggtttgtattattactttaataggtggtatacaaatattctgtacgggtattttaggacaatatttatctaagacatatctcgaaacgaaacatagaccagtatatattgtaaagggtacaaatattaaagatgaaaaaaattagtgattatttagataataaaaaaattattatagctattttattagtggcttctatattcacacttttaatttgttcaaaaaattcaccattatatccttataatgattgggttgatggtaatgccttttttacaatgggaaaaggtatgtttaatggaaaggttccttataaagatttatttgaacaaaagggacctttgctttatttgatatatggaataggttatttaataagtcatgatacatttttaggtgtttatttattagaagttatttcatatacaatttttggctattttctttttaaaattgctagaacttatttaaatcaattttatgccttattaacatctgttttgacattagctattatttcaggatcgatttcttttgtacaaggaggtagtgcagaagaattttgtttaccttttgttgcaagtagtgtttatttctttattaaaattattaatgaaaatgattttggaaagaaatatttattaattaatggagcaatagctggatgtgtttcattgatcaaatttaatttattaggtttgtggtttatttggatggctttatatttctttaaattaatttctttaaaggaaataaaaaaagcttttataagttgtgtttattttttagtgggaatgtttattcctatctttatatcaattctttattttgttatcaatggggcattaagagattattatgatgtatatattacttttaatctaactgcttatagtacaactattgatttaaaaacaagaatattaaatatgttttcagcaattttccaacaaatgaaatacaatagaacaatttatatattattatgtcttggttttgtaaattgtttaacaacaaagattttaaaaaatatttggatcaatatatttattttattatcatttatctttttaatgattggtgtttatataggtggattaccatttatttattattttttatgttttgaagcatatattatttttggatttatttttgttttttcaattgttcaaaattatttaagtagtcaaactttagcgatatgtatactatgtggaggaatgatgttttctgttcattatccattaaaaagtcctaatagaggatatatgaatatccctcaaagtgcatatgcacaatatgtttttaaagatattattgataaatcaaaaaataaaacattattgaattatgataatttagatgggggattttatacaacatgtaatattgttcctaatgttaaatattttatgcgacaaaatgttggatatgatcgttaccctcaaattattgatggtcaaagagaggctattaaaaataaggaaattgaatttgttgtgataagagaatatagagatacaataggatatcgaaagaatattccttatttaaatgataactataaagaaataaaaaaattcaaacaactttatgaaggtatggattttacttattatttatattgtctaaaataggaggacaccatgaaaaaagtaatagaatatatcaaaaatcatatatgggtcatttatctaatcttatttgtttttatggttgttaggcatgcatctgtaaaattaggagtggcagatgatatatggtttcttgaacaatcaaaaatgggattaattaactatactcaaatgaggatacaaacttggacaagtagaaatatcattgaattggtgatgcttgttttattaaatattaataaatgggtttggatcattttagatagtggaatgtttgtacttgttttacattctttaagaagaataatttctccaacaaaagaaaatgatgggatcattactttttttctaatgcttgtaatcatgttatatccttttggaacatttggcgtggctggatggtatgcgacgacacttaactatgtatggccacttgcgttaggattatatggactttcatatattacgcaggttctttccaatggaaagatatcaatgattcaacaaataagttatgtggttgctagtttatacgctatcaatcaagaacaaatgtgtgcattgtttgtaggattttatgctttatttatgatatatagtttagtaaaacataaaaaggtacctattttaatgtatgttcttttagtgttatcgtttataatgttaggatatcatgcattatgtcctggaaatgagctaagaaaagttgcagaaatgagtgcttattatccagctttttatggctttaagttgatggataagttattgttaggagttctttcaacaatagcaattggttctttacaacctgcatatattatttttgtttggaacattatgttgatttatatcatttataaaaatacaaaaaataaaggacaatatatactagtaggtcttatgacctttgttacctttgtagttagtgtaagtgatagatactgtaatcatagagggttttatcaaatctttaacgtgtttaatgattatacaaaagttattgaacacatttcgttgaatatgaatgtttgtttaattattctttattttatatgtattttattgattagtttttatgtaataaaaactaatctaggaaataagacaatgtttataagtctcataattatttgtgcagcattttgttcaagagttgtacttggattttcaccatctatttttgtttctggaacaagaacgtttgtgaattcattttttttgattgtaattgcaacgtttttatgtgttaattcaagaaaattagaaagtgtgctataataagtatgctgattggaggtaaatcaatgaaagtattagtaacaggtgttaatggtcaattaggctatgacgttatgaatgaattaaatcaaagaggacatgaagcaattggaagtgatattactgaaagtaatgaacattttcaaaaatatgttcaattagatattacaaataaagaagctgtagaattagaaattacaaaaattaatcctgatgttgttgttcactgtgcagcatggacagctgtagatttagcagaagatgatgataaagtagaaaaagtaagagcagtcaacgctaaaggaacagaaaatattgctttaacatgtaagaaaattgattgtaaaatgatttatatttctacagattatgtatttaacggacaaggtgaaacaccttgggatcctgattgtaaagattacaaaccattaaatgtttatggacaaactaaattagaaggtgaacttgcagtttcttctaatttagataaatattttattgtacgtattgcttgggtatttggtgttaatggtaaaaactttattaaaacaatgttaaacgttggaaagaaatatccacaagttaaggttgttaatgatcaaattggtacaccaacatatacttatgaccttgctcgattattagtagatatggctgaaagtgataaatatggttattatcatgcgactaatgaaggtggttatatttcatggtatgattttactgtagaaatctttaaacaagcaggatatactacagaagttttaccagtaacgactgaagaatatggtttatctaaagctgctagaccatttaatagtagattggataagtcaaaacttgtagaaaatggttttaaaccattacctacatggcaagatgctttaagtagatatttaaaagaaattgaatattaattaatttatatgtgatatactatttctaacataaaacttatgttagaaatagtttttttattatttttaaagaaaggagaattatattgaatacacatattaaaagttttaatatttatgattttagaggaattaaaaatttaaaattaaatgatttaaaaggcattaatattattacgggagataataacagtggaaaaacaagtgtattagaagtgattaattatttaagtggtgtagatagtttaagcaatcttgcttattctacaacgcgaggcgtaaatgattataatcaagcaaatactagatttttaccatatgaaagaattcaatatttatttcctattgatcaaaaaagtccagttattcattattgttttgaaatgaataaaaaaattgatgtaaaaattgaaaagaagaaagcctatgatattttaccacaaagtgaaattagaaaattacagggatatacttttgacaaaattaaagaacaaataacaaaatatgatgattctttcatagaaaatacagaagaaattgaaatatcttatttaaaatttttattagatgataaattactaaaagaagaaaagataacacaatatagtagaataaaaagagctgaaagtaaattttatatcaatactgtctatgtaacaccatttaaacacacaacaaatgaagtttatcttacagaagtgttaaataatccaaagtactatcaagaaatgatagaagtactaaaagaatttgatgacagtattatgagtatcaatgctgatactcataatttaacaaacaaaaaaagatatatgattttatctaaaaatcataatcaagcaatacctttagaactttatggtgatggaatgaaaaaagcaatattacttatgagtgcagttattactgcacaaaatggaatattacttttagatgaatttgaaacagcaatacacacatcagcaatgattaaagttttttcatggattttaagggcatgtaaaaaattaaatgttcaaatatttttaacatcacatagtgaagaagcaattaataaattattaatttgttgtcctgaattacaaaatgatatacaactctatactttatataaaagagaaaatcaaacaaaagtaagaacattaacttgtaaagaagcaatagaattacatgatgatttaggattgaagttaaggtaatgaattcaattattatatgtgaaggattaacatcttgcttatttatacagtattacatgagaaatgtatgtcattggtcagataaatctcaaagaaaaaataagatatttaaatggtgtagagaattgatgaatgattcaaattcattattattaggacacaatggtggtagtagtagactatgtgaagcttttgaaagtgttatgaaaagtaattactatgctcaagacagtgaaatatatcataatgttgtaattatgacggatagagatgatgatcaatctgaaggaaatataataaatgatttaatgttcattatgaatcaatataaagtaataaatattaatgaaattaaatctaacgaatggtgtaccttagaattaagtaataatttaggagagataataaaaataaaattattattattagttgtacctttagatacacatggagcaatagaaacagtactattggattctctttctaaaaacgatgaatatgatcatcatattgttgaaaaaagtaaagaatttgtaagaaatgttgattataaaaatcaatacttaaagaaaagaagacatcgtgtaaaagctgagtttaatgtgtttttcagtattagggttccagaagactattatactgaaagacagaaaatatttatgaattttccatggaaagataatcaatatattcaacaagtatttcaaaaattaaatgatttatcttaaaaggtttctaaatagaaatctttttttaaagaaagttccatgactataataccaatattttttatgctatactatttctagcaaagaaaggtagtaaattatgaaagtatcattagtaatggctgtttataatggcgaaaagtatttaattgaacaattagattctattagaaaacaaacgtatctaattgatgaagtaatattaatagatgatgtttctactgataatagttatgagttgattcatcagtatatcgatggttataaacttattaattggaaacttataaaaaatgaaaataatttaggatatcgtaagaattttaaaaaaggattagagatagtagatggggatatcatctttttaagtgatcaagatgatcgttggcatttaaataaaatagaggtgatggttgaaaaaatgagtcaatccaatattttatctctagcatcgagttttaattttatggatcaagatggaaattgtttcgaagtgaataaaataaaaggacgttcaaataataatttactttttaaagaagtaacagaagaattaacggaaatcgatttaaagagtttattagaaatgaatttttctcaaggttgttgtatggctatcaaaaaagaagttaaagatgaatatttaaaagtaacacaaggtaaattgcctcatgattgggaattgaatattatttctgctattcaaaatggatgttattatttagatattcctttaattgattatagaattcataataataatacaattggaatggataatattgttgatgggaatattattaatgaaaagaaacaaagagtgaatgaacgtattgaacagaccaaagcacaaatagaaaatgtgaattttgcattgggattagagctaaatagagaacaaaaaaaatattgtttaaaatataaagattatttaatacaaagagttttaatgatgaaagaaaagaaagcttgttctttgattttatactttttaaaaggaaaatataaaggatttggaagagttaaaacttttttaggagatttagtgaacattattaaataggtgattgtatggaaaaaatattattaatatcaaatatgtatccatctaaaaaatataaacattatggtgtgtttgttcaaaatacagcaagtattttgaaaaataatggatatcaagtagatgtatcagccttaaaaaagaaagatagtaagttagggaaattaggtggatatttaagtttttatataaaaagtatctttttgtgtttatttcatcattatgattatctttatgctcattatatttcacattgtgcattattaattaaaatcattaagaaattaaaaccaagtataaaggttattgtaaatgttcatggaaatgacgttgttccagaagacgcacatgatgagaagtttattcctttagttaaatcaacattacctctaatagatttatgtattgtaccatcaagttattatcaaaaggtcatgatggaacaatatggattgaatgaagataaaatcaagatttttccttcaggaggtattaattttgatgtctttcaagaaatagaaaacgctaaagaaaaattgcatttagatccaaataaaaaatgtattggttacattggaagatatgaaaaaagaaaaggatgggaagtttttttagaagcaatcagcttattagaaaatgtagaacaatatcaaatcgtgatggtgggtgttggagaagatgaagaaaaagcgaatgcacttattcaagaatatcatttagaaaacgtgataaaaaaatatccaatgcaaactcaaaaagaattggcgttattttattcagctattgatatcttttgttttccaacctatcgtaaaagcgatagtttaggattggttggattagaagctatggcttgtggttgtatagttattgcatctaatatggcaggaccaacaagttatattaaagatcaagaaaatggttttttctttaaaccaagagatggtaaagatttaaatcaaaaaatagaagatattttatcaatgaatgaacatcaaataaaagagattaaagatcatgcttatcaaacggccaaagcgtatgatgtaaatgatatttctcaaaatctagtggatatttttaatggaatataggatgtgaaagtatggatgtgtcagttattattcctatttataaagggaatggatatatagaatctttattaaataaaatagagaaaaattatcaagaaagtcaaaaagaaatagaggttatttttgttaatgattatcctgatgaagaaattattgtaggtagtcaacatgattttccaattagaattattaataatgaaatgaatcaaggaattcatcaaacaagaatcaatggtttaaaaaaagcgttaggtaaatatattttatttttagatcaagatgatgaaattagtgatttttttattaaaagtcaattagaacatattggagatgcagatttatgtattgctaatggcattatggaatcagaaaatgggaaatgtttgatttataaaaatcaaaaatcacaagattatttaaagaaacaaattggttttattaaagtaagagacttaattgtttcaccaggtcattgtttgattaaaaaaacaagtataccagaatattggacaaagcatgtcatgtctgttaattcggcagatgattactttttatggcttttgatgattgaaaataaatgtcaatttaatgtgaattatgatgtattatatacccataagtatactggagaaaatgtttcaggaagtctagatcaagtgcataactctaatatggaaatggttgatttattaaagaaatattgtcataatgtcaatgttgatttattgaaaagaactattacatataaatatgatatgaaaaaacaaggtaagttagttccatcaataaaaaatatagatttatttttatataatacaatctatcaattattatggaaaggtatgtaaaatatgaaaaatgtatttattatagggagtaaaggaatacctgctaattatggtggctttgaaacctttgtcgaatatttaacaaagtataaggtcagtgatgatattaagtatcatgtagcttgtttgtctgatcatgaagaagaatttgaacataatcaagcaagatgttttaaagtacaagtgcctgatattggaccagcaaaagcagtttattatgatattgcagctttaaaagcagtttatcaatatgttgttgatcataatattgaagaggggattgtttatattttagcttgtcgtataggtccgtttttaaagaaatatgtcaaaatgtttcatgctaaaaatattcaagtttttgttaatcctgacggtcatgaatttaaaagagctaaatggaattggtttattagacaatattggaaattatctgaaagattgatgattaaaaatgcagattatgtcgtttgtgattcacaaaatattgaaaagtatattcaagaagattataaaaaatatcaacctcaaacaacatttatcgcttatggagcagatgttgttgataacagtgatgaagaaaaatttgaagtatgggctaaggaacatgaggtttcaaaaaatgaatattatttaattgttggacgttttgttcctgaaaataattatgaaacaatgattagagaattcatgaattcaaatacaaaaaaagatttagtgattgttactggatatcaagaaagtaagttgtatcatattttaaataacaagtatcattttgaaaatgatcaaagagttaaatttgtaggtacaatttatgatgatgcattattaaaaagtgtaagaaaaaatgcttttgcttatttacatggtcatgaagtaggaggaacaaatccttctttattagaagccttaggttctacttctttaaatcttttattaaatgttggctttaatcaagaagtaggtttagattcatgtatttattggggtaaagaaaagaataatttaaaacatcttatagaacatgttgaaacatttgatcaagattatattgatactttaggaaaagctgctaaagatagaattaaaaatgcttatagttggacaaagattgtttcagactatgaaagcttgttcttaagaaaaaaagatttgtagataattgtaatttgttatatagtataaaagaagaagagaaaaatatcgtggaggaacaactatgtttaaaaaagtagtcgctctattaatgacatgtgttttatcgatgtcattagtaggatgtagtaatagtgattctagtgataaaaaaacaacaactaagaaacctgctacatcaaacagcattaaaattaaagatgttaatgatttccaagaagctgatggattaatcaaatattttacaattgatgataaaaaaatagcaattcctgaaacagtaggagaatatgcaaattatttatcacaagttggaacagttactttaaatgatacaggtgataaagtagaagatgtggaattagatgctaatgggatttcatcgatggcagcatatctaaatgttgaattagatagtggagatgttgcacgtttctatttaagatatgaaaatccaactaaaaaagctattagtgtagcagaagcatctgtaacgtttattgaagttaaatatgatgaatacgctgaagaagaatacgataaagcagctaaagatgttgttgtagaaacaagtgaaggatcgttagctttaaataataaagtaaaatatgcacaagttaaaaaggttttaggtgaaccaaaccaagaaacggatggtagattccattattcaaatgatgcaggatataaatacatgtttgattgctgtaacgaaaatagaaatggaatttttagaggatttagtatcgaatatccaagtaaataataaaaatatctgctttttataagcagctatttttatataacaataacttatttaaaaaaggaacattaataatggcgcaattaaaacaaatgataaataagaataaattttatattataggaacattgattctctttctatttttattttattgttcaacaaaattatgtatgaatgtagcaccagatgaatatatgagatatgatatccccttatttatttacaatcattcatatttacctaaaggtgatgaaaaagaaatattaaatgcaatatggggattttcttatggatttacaccttatcttccttcaataattagttttttctttatgaaaatagcttctatctttacaactgctccagtacatttattgattgtggcaagactaacaagtgttcttgcgggggcacttacgttttttgtatgttgtaaaattggtgaagaaatatttaatcataagatgacaatatatctttttgctatttttgtttcactattaccacaattcatgtacttatctctttatttaaataatgattcgttttcaatatttacaacagcacttattgtttatggttggattaagggaataaaaacaaattggaattgtaaatggtgtatttttttaggtgttgctataggaatatgtgcattaacctattataatgcatatggatttatattatgtagtattattgtatattgtatgagtagttataaattacattttacatttaatgagtttttaaaaaaaggatttctaatagcaattgctgccttagttgttggcggatggttttttattagaaatgcaatgatccataatggagattttttaggaatgaattctatgtacgattgtggtgaaaaatatgcaatgccaggttatcaattatcacaaagagacacttatcaaaatcaaggaattagtgtgttttctatgatttttgatacaaattggataataacaactataaaaagttttatttgtaccacaggatatatgcaatatatgattagtggaaaacatttttatttatatttaataataattttgtttggtatgattatgatgcttattgctttaaaaagaaaatatcaattcaaatttaaatttgaaaattattttataatatgtttaattttatgtattttgattccaattattttatcaataaaatattcttattctatagattatcaacctcaaggaaggtatattatgtctattttaattccaattgctttatttatgagtattggttatgaatattttagtgaatttattgaaaataaaatacaaataaaatcaagatatatagagttatcaatgataggaatctatattttattattcgttatttgttattcaagttatatagctgtttgtttcggaagtacaataatttaaattgaaggtgattatgtgtttgattcaaaattaaagaaattaggtaaaaatgttgtattaggattttttgctgctataacatcattacttacattgttatgtttatttaataatgcgtatttaagttgggatgaacatacgacaattgttgctgataaaccattttatttattattatggtttgttatagtattgttttttgtttattttgttagaaaacattatagaacacaggatacttattattttaataaaatatttattatattaagcttgatattattgattgttggtatttttatgattttcaaatttgattttgttcctgtagctgatcaagcatctattttagaagcagcagctgggttaaagaatggcaattatagttattttacaccaatgggatatgtaggaaagtgttctaatcaagcgggaattgttgttattctttattatttatcatttatttttggagaaaataattatcaagcatttcaagtgcttaatattataggtttattagttagttattattgtttatgcaaaatatcacaaattagttttcataatgatgagttaaaaaactggacacttattttattatttatatttttccctttaacattttatgttgcatttgtatatggaaatatctttggacatactttttcgctgtttgccatattagcagggtatcaatattttgaaacaggtaaaataaaatatatactactatcgattgtttcaattattttcgcaatgatgtttaaatcaaattatatgattgtttttgttgcaatggttatctttattttatttgatattattttaaataaaaaatatacatctattattttattgattttatttgtaccggcttattttgcatcttcaatgattcctaatacaattatcaaaaatattacaggtattgaacttggtaaaggtataccaatgatagcatatgtagaaatgggattacaagatagtgatgtagcgccaggatggtataacggctacaattggagcgtatatgaaaataataacggagattatgatgtggcaaattcacaagcaaaaagcgatttaggtaatacgttatcttattacataacacaccctggagaatttattcactttttatatcgaaagacagtttcacaatggtgtaatcctgactttcaaggaacttgggtaacgaggcatagtagtttttatattcaaagtgagttatggtaccaaatatataatgtctatgaaacagttattttattaggaacattagcttatatttactttactggaagacatatgaaattacacagattattgttaccaactatttttattggtggatttttatttcatttattttgggaagcaaaatcacaatatactattacatattttgttttattaattccttattgtgcaaaaggtttaatggatatgacaaatgaaatgattgattcattccgcaatatcagaattgttagaagtatacctaagaaaattgggatgattattaaaatggatactgttagatttatagtatttattacagctcttgcttccattataaagataatcgcttaaagaaatcattatgtatcttatctttggaacattaacaacagctgtaaatattgttgtctattatttattttcaaatattatacatattaactatttattttcgaatgctgtagcatggtttttatctgttttatttgcgtatgttacaaatagaaagtatgtttttgatagtaaaaataatcaaattatcaaagaagcaatttctttttttggttctaggttagcaacaggaatcatggatatggtattaatgtggttcttagtgaattttaatattgttaatgatgttgttgctaaagttgttgtcaatgtgattgttgttatcttaaattatattttaagtaagttagttgtatttaagaaataatgaggtttctgagtattcagtgcctttttctttttgctaaaataagctatttttttagaagtaaaaatagtataatttatacaatatatgaacatatattatatatgatcaaaagaaaggaataatctttgtggaaaaactatttgatttagatgaatttgattcatataaagaagataatcgaagagaagtaaaaagtgctaagaatggtttaccaaactccatttgggaaacgtattctgctttttcaaatggatatggtggagttattattctaggggtaatagaaaataaagatgggacatggtttacttcaggattagatgctgacagttgtcaaaaattaattaaacaattttggaatgatattaataatagacaaaaagtaagtattaatttattaagagatgatgatgtagaagtttataaaaaagaagatgatcaaattattgtgattcatgttccaatggcaagaagggaagaaaaacctgtctatattaataataatttatttcatggaacatatagaagaaatcatgatggtgattatcattgtacacgtttgcaagttaaaacaatgttacgtgaccaagcagaaaaaacaatggatatggaagtgctagatgatgttccattagaagatttaaactatgaaacaatccaaggttatcgaaatagacatcaagtattaaatgcaggacatccctttgaaagattaaataatgatgaatatttaagaagcattggtgcagcagcaatttcaaaagaagatcatcaattacatcctacagcagcaggaatgttgatgtttggaaatgagtataatattgtacgtcattttccagattattttttagattatcgagaagttttagatccatctattcgttggactgatcgtttacaatcaagttcaggtgaatggtctggaaatatatgtgacttttattttagagtctataataaaatcattaaagatgttaaagttcctttttcaatgaaaggaggggacaggatagacgatacacctgtccataaagcacttcgtgaagcattagctaattgtttgattaatgcagattactatgggacaagaggggttgttattaaaaaagatcaaaatcaaattattttcgaaaatcctggatatattagaactggaaaggaacaaatgagaaaaggtggggaatctgacccgcgtaataaaactcttatgaaaatgtttaatcttgtaaacataggtgaacgttctggaagtggtgttcctaatatcttcaatacatgggaagatcaaggatggaaagaacctgttattgaagaaaggtttgatcctgatcgaactatcttaacacttgaatttgtagataaaacaaacaaagaaaaagcggcgaagaaaagtggcgaagaaaaaacggcgaagaaaagtggcgaagaaaaaacggcgaagaaaaaaataacaaataaaacaaaagaaaaaatgataaaaataaaagaatatcttagtgaaaataaagaagcaaaaacaaaagatattgcagaatatattggtttaaaacattctagaacgagagagattctttcacaaatggattctgtagaatcaattggtacaaacacaaatagaaaatataggttaaaagataatcaaaaatagaattgtctttaaagatgaaataaaatgtaatatatatgaaaagagttctcaaatagattcattgctatgatgatttatttcaaaatttattaaaaagtaatcacaaacttgtcagcataggtgattactttttttgttcatttttggtttaaataaaaaacaactctcattaaacagagttgctttttaaatgcctcctttctaaacacaagtaaaatctctatattaaactgagaacgcgaaatgtgtttttaagatatgatctcagattttttattttctgtgtgtcggtagtgaaatatctttttttaaattttatttgtatagagatttcactgttattttatataaaataggttgatttttgcttgtttagggaaaattaaagaaatagtgggaaaatcgttaagaaatatgctaaatattttattgaaagagataaatatccagggataagggtatcattttaaataataaaatagtataatatcacaaaatgaggtggaatcatggaaacagttttggtagaaaaaaagaacataaacgaggttgttgaattattaaaacaagatgaggttgtggcttttcctaccgagactgtttttggcttaggtgtgaagtttggaaatctttcggcacttgaaaaaatctatgaaattaaacatagaagtcatagtaaagcagtatctttgatgatctatgattctcaagatatagaaaaatatgcttatgtaaatacaaatgctcaaaaattgattgatgaatttatgccgggaatgataactcttgttttaaaaaagaaatcaattttatcagatgattttacagcgggattagaaacgataggtataagaatacctgatgatccatttgtattagaattattgaaaagagtagggccaatgttagtaacaagcgctaacatttcaggtcaagagacacttttaaatgatttagatgtgtatcatgaatttaatgggaaactaaagatgatcgtcaaaggaaaatgtcaaaatactctagcaagtacagtggtaaaaattgatgatgatgtaacaatattacgtcaaggttgtattagtgaagaaaaaatcatggaggtattgaagtgaaaattgcaatggcatgtgaccatggtggtctcagattaaaaaatgtattaaaagatgatttagaaaaaaatggttatgaagttgtagattttggtacatacacagaagaaagctgtgattatccagattatgcttctaaagcagcaaaagctgttgctgatggaacgtgcgacaagggggttgttgtatgtggaactggaattggtgtcagcattactgccaataaagtaaacggaattcgttgttcattatgtcatgatgtatttagtgcaaaagcaacacgtcaacataatgattcaaacatgttagcaatggggcaacgtgttataggggaaggcttagctttagaaatcttacatgcatggcttgaaagcgaatatgaaggcggaagacatgatgcaagaattcaaaaaatgatggctttagaaaaggagtaataaataatgaaagatacacaattatttgaaagtgttgaaagagaattaaatagacaaagaaataacattgaattgattgcttcagaaaactttgtttctgaagaagtattacaattagctggatcagttcttacaaataaatatgctgaaggatatccagcaaaaagatattatgggggatgtcaatttgttgatgaagttgaagaaattgcaagacaaagaatttgtgaaatctatggggcagaacatgctaatgttcaaccacatagtggagcacaagctaatactgcagtttatttagctttattacaacatggagataaagtgttaggtatgtcacttgctgatgggggacatttaacacatgggcatccattgaacttttcaggaatcaactatgaattttatagctatggtgtttcaaaagagacagaaacaattgattatgaagcttataaaaaacaagtagaagaaattaaaccaaaactcgttgttgctggagcaagtgcttatagtagaattattgattttgaatttatggctaaagttgctcatgataatggcgcattatttatggtagatatggctcatatcgctggacttgtggctgctggcgttcatccatcaccatttccatatgctgatattgtcacaacaacaacacataaaacattaagaggacctcgtggtggtgtcatcatgtgtaaaaaagaatttgctgcagatattgatcgtgcagttttcccaggtatgcaaggtggaccattaatgcatgttatcgctgctaaagcacaatgtttctatgaagtacaacaaccagaatttaaagactatgcaaaacaagttatcaaaaatgctaaagcaatggaaaaagtctttaaagaagaagggttcagattggttgctggaggaacagataaccacttattacttgttgatgttaaagcaagttgtggtatttctggtaaaaaagcacaacgtttacttgatgaaatcaatattacagctaataaaaatgcaattccttttgatacagaaaaaccattcaaagcttcaggaattcgtattggaacaccagcaatgacaacaaaaggattcaaagaagaagattttgaagaagttgctagaattattgcttatcgtttaaaaaatgaagaaacagatgaaattaaagaagaatgtttaaaacgagtagcaaaacttactgaaaaggtcacaatgtattcaaatattaaatatatttaggaggcaaatatgtcagtaacaatattagatcatgctttaattcaacataaattaacaattatgcgtgataaaaatacatcaacctatatttttaaacaaaacttagatgaaattgctaaacttatggcatttgaagtaacacgcaatgtttcattaaaagataaagcaattgaaacacctgtttgttcaatggtgggaaaagaaatggatcaacaaattattcttgcacctattttacgtgcaggaattggtttagttgatggttttagagatattattccaacagctaaagttggacatattggaatggaaagagatgaagaaactttaattccacgtgaatattatgctaaatttccaaaaggtctagaagatgctttagtcattgttttagatccaatgctagcaactggtggaagtgctaatatggcaattgaaaatattaaacaaagaggagcaagaaaaatcaaacttgtttgtttagtaggagcaccagaaggagttaaagcgattcaagaagtacatcctgatgttgatattacacttgcagcattagatgaaaaattaaatgagcatggttatattgttcctggacttggagatgccggagatcgtttgtttggaacaaatgaataataaagagaagctttttaaagatttgctttatgcattgacgttatcaggtaaaatatttggaactttaatagctggcgtcatattgggtttatatttggatagtatattactaaccaaacctcttctgacgctagtatttcttgttttagcgtttatagaagtgatgagaacattattaaaaggtggaaaatcatgaatgaaaagttcgtttttaagaaatcattttttatttttttgataggttttatcgttttttcaattattggtttgatgatgaaatctatcagttattcgctaggttttttgcttggatatttatttaatcttgcaattttttatgttattattatcacgtctgatatgatattgaacttaaaaagatctacaagtttaattatcttattaaatatagtcaaacttgcaatttatgcgattggttttttaattgctatttttattccaaaatggtttaatctgatgggtgttctttttggatatatggtcattaaaataactatatatattgtaagttatcaaatgaagggggtgaaagggtgagtaacttcttagattctttacaggtagaattaatcttttcattgattattatggtggtgatggctattttctttatttatgccgggaaaaaatttgcaactgctgatccaacagcaagacctaaaggtgttgttttagttgttgaaacaggtgttaaaatgatttacgactatttaaaaagtatcatgccaaagaaatttgaaaagaactattatccatactttgcaatgctctttgcatatttgatcattgctaacttaagtggattattaggatttgaagcaccaacttcaaattattctattactcttgcattaacaacaattacattctgtttaattcagtttaatgcaatcaaaaaacaaggattattatcttacatttggggtgctgtatggccaccaacaaacttattaagtattctttcgccattgatttcgttatcaatgcgtttatttgggaatattttaagtggatcgatccttatgtatttagtttatcaattaacaggttacatttcagggttattgatcaactttaactttttaggaccagtgattgctccttggctacattgttattttgatgtctttgcaggatgcattcaaacattggtattcgttacattatcatctatcttgataatgatggaaaatccagattaagttctttactagcttgctagttaagatataaatgaaaaatgaactattttttaggaggaaaaaattatggtaaaaggtttaattgctattgcagcaggtcttgctgtatgtgcaggtttaggaacagggattggtgaagggattgctgctagtaaagctgtagaagctgttggtagaaacccagaagctgaaggtaaaatccgtactatgatgatcttggggattgccttatcagaaacagttgccatctatggtttattagtttctttaatcttattattcgtatattaataattgaaaatctgacaaaggaggaataaagatgccagatatagcaggaaaattattccctaatcttacaacactgattgttcaattattatctacaggagttttgttacttatttttaagaagtttttatggaaaaatgtcatggaatattttgctaaaagagcagattacatagaatctacaatcaatgaggcaaaagaaatgaacgaaaaagcttctacaaatttagaaacagctgaaaaagaagcacgtgaagctgccagtaaatatcgtgaaattcttgatcaagcaaaagatgatggtcaaaaagtgaaacaacaaattattgaccaagcaaacgaagaagcaagagctaaaattgaacaagcacaaaaagaaattgaaacagaaaagaaacaagctcaagcagatatgaaacaaggaattgtggatgttgctattgaggttgcaactaaagtgatgaacaaagaaatgaatgaagaaatcaacaaaggattagtagaagaatttgttgatgatgtggttaactaatgagtgttgttggcgatagatatgctgaatctttatttgatttagcgaaagaagaaaataaagtcactcaatatcttgatgacatcaaattagttggtgaggttctagatagtgatcctcaaattgttcaattctttaatcacgttcttattgaaaatgataaaaagattcaattattggatcaatcatttaaagggaatgttgatcaatatgttttaaatttcttaaaactattagtgcaatcaagaagaattcgttatattgatgatattgttaaatcttatattaaattatcaaatcaatatttaggtatagaagaaggtatgatctatacaccttatgaattaactgatcaacaaattcaagatatagaaaaagcaatcagtcaaaaagaaaacaaaaaggttactttaaaagtatctattgatccatcattattaggtggtattaaagttcaaatttctaaccgtatttatgatggaacaattaaaaataaagtagaaatgcttaaaaaagaactattaagaaagtaggtggaaatagtggggcttagaccaaatgaaattagtgctttaattaaagaacaaattaagcattatgacgatatcattgaacaaaaagatgtcggaacagtcgtgactgttggtgatggtgtaagtgttattcatgggttagataatgccatgttaggtgaattattacttttcccaaatgatgtttacggaatggtcatgaacttagatgaagatagtgtaggagccgtactacttggatctgaaagtacgattaaagaaggagacgaagttaaacgtactggaagaattattgaagtccctgtcggggatgaaatgttaggaagagttgttaatccattaggacaagcaatcgatggtcaaggtgaaatcaatactggtaaaactaaaccaatcgaacgtgttgctagtggggtcatgacaagaaaatcagttgatcaaccattacaaactggtattacatcaattgatgctatcattcctatcggtagaggtcaacgtgagttaattatcggtgaccgtcaaacaggtaaaactgcaattgctattgatacaattttaaaccaaaaaggacaaaacatttattgtgtttatgttgctattggacaaaagaattcaacagttgcacaagttgttgaaaaattacgtcaaggtggagcaatggattatacatgtgttgtttctgccggagcgagtgaacttgcaccaattcaatatattgcaccatatgctggatgtgcaattgctgaacattggttagatgaaggaaaagatgttttaattgtttatgatgatttatcgaaacatgcggtagcttatcgtacaatgtcgttattattaaaaagaccaccaggacgtgaagcttatccaggggatgtcttctatttacattcaagattacttgaacgtgcttgccgtttaaatgaagaaaatggtggaggatcaattactgccttgccaatcattgaaacacaagctggggatatttcagcatatattccaacaaacgttatttcaattactgatggacaaatcttcttacaacaagaattgttcaactctggatttagaccagctgtagatacaggattatctgtatcacgtgtaggttctactgcacaaattaaagcgatgaaacaagtatctggttcattaaaacttgaacttgctcaatatgcagaaatgcaagctttcgcacaatttggttctgacttagatgctgctactaaagcaacattggatcatggggcaaaagtacgtgaagtattaaaacaagcacaatattcaccacatagtgtgccaacacaagtcattactttatttgcattaaaatatggttatacaaaacaaatagctgtagaaaaagtaaaagaatttatggatggtttagtagaaaatattcaaatgtctcatcctgaatttattactgaaatagaaactcaaaaagtgatttcaaatgaattagaagcgaagatgaaagaagcaacaggcgcttatgttgatcaattcttaaaaacacaaggggctaactaatgcctggatcaatgcaagaaattaagcgtcgtattaaatccgttgaatctactaaaaagattacaaaagcaatggaattagttgcgacatctaaacttcgtaaaacaagaaatcaacttgatgaattaaaaccttattatcaaggtgttagacaaacatgtgcagaaattttagcttctaataaagggttaaaagattctgcctatctcgctgaaaataaagtagataaagatgtttatattgttatttcttcaagtttaggattatgtggtggatataatgccaatgtctttaaagaaattagtcaacaaattaaagatgaagattatgtttactcaattggaagtaaaggaacaaattatttccgtagaacgcatcaaggaccaatcaatactgattttgcttcattaaattcaacattagtttttgatgaagtgactaaattagtgaaaagtgtcacagatctttatattaataaagaagtgggaagtataaaaatcatttatactgaatttgttaataacttaacatttaaaccacgtacagtaacacttttaccaattgatacaaatgagtttgaaaatattgaaattaccaataaattcactatttttgaaccaagtcctgaagaagttttagatagtttaataccaatgtatttacaagctgtcgtttatggctatcttgttgaaagtgtgacaagtgaaaatgcgtcacgtagaacttcaatggaaaatgctacagataacgcagaagaattaacagaacaattattattaaaatacaatcaagctcgtcaaacagcaattactaatgaagttagtgaaattgttgctggagctaatgcgcaataaggaggtcaatatggcaaatattgggaaaataattagtgcccgtgggccagttattgatattgcatttgctagcgaagataaattacctcgattaaatacagcaattcgtattcaaaatggtgaagaagaattagtcgtagaagttgctcaacacattggagatgatgcagtaagatgtatcgccatgggaccaactgatggggtagtaagaggaatggatgctgttgatacaggtcacccaatttcagttccagtaggaaatgatacattaggacgtatgttcaatgttttaggtgaaccaattgacggtaaaggtgaattaggaaatgatgttccacgtatgcctatccatagatctgcgccaacttatgcagaacaaatgacaactacagaaatctttgaaacaggaattaaagttgtagacttaatttgtccttttatcaaaggtggtaaaattgggttattcggtggtgccggagtaggtaaaacagtattgatccaagaatttattaacaatatcgcaacacaacatggtgggttatcagtattcgccggtgttggagaacgtagccgtgaaggtaacgatttatactatgaaatgaaagaaagtggcgttttatctaaaacatcacttgtctttggacaaatgaacgaacctccaggagcacgtttacgtgttgccttaactggtttaacaatggctgaacaattccgtgatggacaaggtcaagacgtgttattattcattgataacatcttccgtttcacacaagcaggttcagaagtttctgccttacttggacgtgtaccatcacaagcaggatatcaaccaactctagcaactgaaatgggtgctttacaagaacgtattacatcaactaaaaaaggatcaattacatcagtacaagcggtctatgtaccagccgatgacttaactgaccctgcaccagcaacaacatttgctcacttagatgctaaaatcgtcttggatcgttcaatcgctgctttaggtatttaccctgcagtagatccacttaactcttcatcaagagccttagatccattagttgtaggtaaagatcattatgaagtagctcatggtgttcaacaaatcttacaacgttatcaagaattacaagatatcatcgcaattcttgggatggatgaattaggtgatgaagataaattaatcgttgcacgtgcaagacgtgtacgtaacttcttatcacaaccatttacagtagctagtcaatttactggtttagatggaaaatatgtccgtgtagaagatactgttcaaggatttaaagaaattcttgaaggtaaatgggatcaattacctgaacaagcattccataatgttggtactattcaagaagctgtagaaaaggctaaacaaatcgaaaatgactaaatttaagctaaaaatcattacacctcaaggtatttaccaagaagtggaaattgatcagataaatcttgatacaactgctggacaaataggtattttagctcatcatattccactagcaagtggtgtaaaagtgtctcaaatgaattatattattgatggaaaaagaacatatttttctgtcgcaggtggtttcatttatgtaaatgaaacagaaacaactttaattgctaatgcaattgaatcacaagaagaaattgatttagaaagagcacaagaagcaaaaagaagagctgaagaaagacttaaaatacaaaacgatgaaatcgatatgttaagagcacaagcagctttgcaacgtgcaattacacgtattcatgtcaaaggtttatagagaagaacttccattcttctcttttttttgtataatagttttaaggagaaaaaggaatatgaaaaagaagtttataggagttattgggattgttatcgtggtgatagtgggaggtatttattatcttacacgagaagaaaaaattgaattatcattaaaaaataaaaaagagattattgtagaatatggaaatacagttcaatattcatttgatgatcttattcaaacaaaagacatagataaagataagttgaaagaaataaaaaaagaaacagaaataatagacaatctaaaaaatgaagatcaaaaagattatccagcaattggaaactatacaataaatattaaatatcaagatcaaaaaataaaaaagaaagtgattgttaaagatactacagctcctgtttttaatgaaataaatgaagtttcatttgaagaaggaacagaaaattatgattttaatcaagaaatcaaagcaacagatttaaacaatgttgatttacaatatgatttatcttcattagatataaataaagcaggggattatcaaataaaagtatttgcgaaagatagttcaggaaatcaagcagaaaaagaaataactgtacatgtaaaagaaaaacctaaacaagaattatcagcagctaagatttatcatggcggaggaaaagtgatttgtattgatgcaggacatcaagcacgaggaaatagttcattagaacctaatggaccaggttcatcgacaatgaaagcaaaagtgacaacaggggcaacaggatgtgtaacggggaaaacagaatcacaaatcaacttagaagtggcacttaaattacaagaagctttatcaaatcaaggttatactgtggttatgtgtcgtacatcacaaaatgtagatctttcaaatgtcgaaagagctaaaatagcaaatgaagcaaatgctgatgcttttattcgtttacattgtgattcaagtgaatcgtcatcatcaacaggaacattgacacttgcgccttcaacttctaatagatattgtgcaaatattgcagggaagtcacaatctttatcaaagagcattgtgaataatatttgtaaggcaacaggttctagaaatagaggagtttcaattgttgataatatgacaggtttaaattggtcaaaagtgcctgttactattgtagaaatgggatttttatcaaatccaggagaagatcgattactttcaagtgatggttatcaaaataagattgttcaaggtattgtaaatggtataggtgaatatttaagttaaaaagggaaaaaggtatggaaaaagtaacgttaggaagaacaggaattacagttaatagaaacggatttggagctttaccaatccaacgtgtaactggagaagatgcaacaacaattttaagaaaggcttatgatcgaggaatacgtttttttgatagtgcaagatggtacagtgatagtgaagaaaaattagggaatgctttaagtgatgtcagaaaagatatttatattgcaacgaagacaggatctactacagtagaaggtttttggaaagacttagaaacaagtttaaataatttaaaaacagattatattgatatttatcaatttcataatccatcgttttgtccaaagccaggagatggtacaggattatatgaagctatgttagaagcaaaagcacaaggtaagattcattttattggtctaacaaatcatcgtttaccagtagctatagaagcttgtgaaagtgggttatatgatacaattcaatttccatttagttatttagctgatcaaaaagatattgatttagtgcataaatgtaaagaacacaatattgggtttatttgtatgaaagcattatctggaggtttaattaatcgttctgatgcagcatatgcttatttagcacagtttgataatgttttaccaatttggggaattcaaaaagagagtgaattggatgaatttatttcatatcaaacaaaagcacctgaacttactcaagaaattaaagatttaattgaacatgatcgtaaagagttagctggtgatttttgtagaggatgcggttattgtatgccttgtccaaaagatatccaaattaaccaatgtgctagaatgtctttaatgttaagaagagcaccagcagcaagttggttaaatgaacattggcaaaatgaaatgaaaaaaatagaagaatgtttaaattgtggaaaatgtatgacaaaatgtccatatcatttaaacacacctgaattattaaagaaaaattataaagattataaaacattcttaaaataaaaaggtagacgaaattcgtctaccttttttctttataaagaaaaaggcccagatggaccttatgagacatgtctaattgttataattcttttatagtaataagaaccaggttgaaaatcactaattttaacacaagcatttggatcatttccaaaagtatgtgatccgccaccaccacagtgaattaaacttctagtaccatcactattcaacattacaattccaatatgtgtaactgatccagttccaaagcaagctaaatcaccagtttgtgaatttgaccagcttacccctgaaaacatagatgaataacctgctgcggttgttctacctacagattttcctgcatggtttaaacaataatagactaatccagaacaatcaaacatatttggtccatttgcaccccaataataacgacatcctaattttgaacgagctacttcataaattttatatccaagattagaagatgttgtgttatttgtgttagaattgttagtgttattgtttgtattactattcgagttattattacttgaattattattattgttgttatttgaattattattattgttgttatttgaattattattaccagtattatttgaattattgctatttgtattatttgatgctggtggagcaggtctagctgttgatggttttgtttcataagcttcagcattgaatttatcaatagcagcagctaatgattcacttgcagcaccataatcatatatagcatcttgcgtagaagcaatttgttttctttgttcttctaataatgtttcatattgtacttgaatagccgcttgttctttcttttgttcttctaaaacaattttagcgttttctaaagtaactttttgattttcaatttcctttttcttttctaacatttgagcaatcaaatcttggtcacttgaagtaagtgtattgaaactatctattctagataacatatcagtaaaattatcagccccaaatatataattgataaaagtattttcattcatataagattgcatgatatacatacgatcttttatttcttgattatctttatctatatctgcttgggtattttgtatagatgtttcaacatattgaatttcagcttccttagatgaaatatccgaatttaatgaatttagctttttttgaacactgtctaatgtttgcgttgtactcgccgcagcacttttttgattttctaaatctttttttaacttcttgtttttagctttgagatagctgttgaattcttcgcatgttttcttattactatttgttagttttccacttgcacatagtgacatatattttgattcatcttttgaaaaatcaatagcttctacaggttttatacaatagcatgttgatacaagcattgtagatgcaataaatcctacaaaatattttttaattttcaaacaaaacaccccctcatattatttatacatcattttctaaaaaaagtaaataaaagttatttttatacaaaataaaaacctttaagcttataaacttaaaggttttaagtcattactaataaggtctaactgcacaagtaaatctacttacattagatgcaatcttaacaacatcacctgtttgtggtgcatgaatatattgaccattaccaatataaatacctacatgtccacttttccataagatatctcctggttgagcttgacttaatggaataattgctccagattgaccttgagatccagaatagtgatcaagtgaaacacctgcttgtgcataacaccacataaccaaaccagaacagtcaaatgaattaggtccacttgctccccatacataaggacaacctaatttagaataagcagcagctacaactgtagaaccatacttatttgtagtgggaacatttgtagatggtctaatagttgtagaaccactactgctacctgatgaagattgttgagtaacaacgactgatgataagaatgaatctaatgaactttgagtatcagaaattttagattgttcactttcagcagatgctaaatctttttgttgtttagctaatagatcttcatattgagtttgtaaagtatattgttcgttttgttgagaaacaatatttgcttttactgtttcaatagttgctttttgagattcaacttgcttcttttcatcagcaattttttctactaattctttatcgaattgagtgatttcattgacactatcaattcttgaaaagaaatcagagaagtttgaagcaccaaaaataaattcaatataactattactattattgtatgattgcatagcatacatacgttctttaacttcgttttctttagctgtgatacttgcttctaatgatttaattgaactttccaaatagttgatttcttgttgcttttgttcaatttggttatttaaatcagcaattttagaaacaacgtcatctaatgaactttgagtatctgaaattttagatttagattcatcaatagaactttgtaactgattgtttttcttttttaagtatgaattaaattgtttacaagtattataattactattagataaacttttactagaacaaagtttcatatatttatcttcttgtccttcaaagtttactgcatgaacttgacttgtagaacaaaaaaaggatactaacaaagtaaaacaaatcatggagattaaactctttttcataactataattcctcccgtagctattatcttatttttttaaccaaaagtaaatataaacaacgataataataacatttttgacattgtgacatattttataatgaggtgaaaaattttggtaaaacatggaattgatgtttctaaatttcaagggttgattgattggcaagaagttaaaaaacatatcgattttgcaatcattagatgtgggtatggaagtaatctggaaagtcaagatgatccgtattttaaaagaaatgcggatgaatgtacacgtttaaaaatcccttttggggtttatttatattcttatgcaaccaatgaaagagaagctctatcagaagctgaacatgtattaagactcgtaaaggattatcaaatggcctatcctgtttattatgatttagaagataataatacaacaggaagacaaagtaatcaaacaatagcgaatattgcacaaacatttgctcaaagactcgaacaagaaggttactatgtaggaatgtatgcatcattgttttggtttagaactaaacttacaagtccaatctttaatgagtatacaaaatggattgcaagatataatgatgaacttaattatgatggagaatatggtatgtggcaatatagcgctacaggaaatgttttaggaattgatacaatggtggatctaaattatgcctataaagattttccacaaatcatcgaagaaggtggttataataatttttctaatacgaatttaacaaggtataagataggcgatgaggtagaatttcaccatgtatttttaacaagtgaatctacgcaaccattaatgccatatcgtcattttggaattattacgagaattgttcaaggtgctagaaatccctatcttataggacaaggtgccggctgggtcaatgatcaggtcatagaaagaaagataagatatttaagtgcacctgattatacaggcaatagttttacagatgcattgcgttctattcaagaagatgcttcttttgctaatagaacaaaattagctaaattaaatggaatagataattatacaggttcacaaaggcaaaatgatgaattattaagattacttaaagaaggaaaattaaggacataaaaaaagagcttagattcttttttcataagctcttcttaaagcaccactttttaaagtgatttctccacaatatttaaaaccatatttagttaaaaaactttgcatagaaagattatcatgatgtgtatccattctaacactatgataatctggatacatagcaactacttgatctaaaatcgtagaagctaatccttttcctttatattcattatcaacagcaatacgatgtacacatatataaggacaatttaaaatccattttccttcaatacggttataagcaggttctccatgaatcgttaccatacacgttcctaaaataacaccgtcttcttctaaaacataagcttcattattttctatatctttttcaattgtttcttcattaggatatccatcttgccattgatcaatatcattatttttgaaataagtttttgcttgattaataatgtcaatgacacgtgaaatatcttcgattttcgttggtcttaaaatcattattttacctcccaaacatactttcctaaatgatatagacttttaggttgtttgtcaaattgttttgtttacaaatcaaaagcatttgttataatagctgtatacagaaggaggaaataaaatggtacttgatcaaatcaaagaaattttaaaagatacaatggatattgatgaatcaaaaattactttagatgctaaattaaaagaagatctagaattagattcattagattcagttgaattaatcatgtctgctgaagaagaatttggaattgaaattcctgatgaagacgttatgaattttaaaacagtaaacgatatagtaaactatattgaagaacataaataaaagctataacaagcatttcgctgttatagcttttttactattctaaaatatatttattcataagtgttttatttttttctaaacatttaaataagaatgctccaataattaaaacaataaattcaccaatgaaaacatagaatgcattaatcataaatggtaattctaaagctagataaagttctaaaccaacgattaaaccattgacaaccccaccaattaaagctccagcaaaaacatttttaacataatacataccaagacaagcaatcaatgttgcagttgttccaaaacaaatgtcatataatcccattggagatgcaaggtttgcaagtaaacatccaatagtaagtcctggaataaatttcttgttgtaacatgcaagtaaaacaataatttcagttaagcgcatttgcactgctccataagcaataggtgaaattaaaattgttaaaacggcataagcagcaccaatcatggcattcattacaattaattgtacctttttattattcatttgtagtcctcctcttctaaagtacagttagaagccaaataaaataaaaaagatgacagagccatcttcattacttattcttagttttttatactgggtttggctctcgaaccagtctttgacattatactaaaacgggtagtgaaaatcaatatattttattttataataaagataaggagatgatgattatgttatgtccaaaatgtcatagtttactaacaaaaggagccaaatattgtgatatttgtggaacaagaatatcgcaagaggatatccaagtagaagaagtaggttcaagggttaaaaatagagaaaaacataaaaaagaagtgcgtaaaaaaactaaaattattattttaggaatcatagcacttgtcgtggtggttgctatgttaggatttattttattttttaaaggaaataaaccatcttattcaccagataatcttgttagtcaacatgttgaaaaaccattacatttagaaaaaagtaaagttatattaaatattggagatgaatataccattcaaactaatcttaaatgtacttatcaatcgaaaaatgaaaaaatatgtatcgtagatacaaatggtaaaattacggctttatcatcaggtaagacaaaagtaatttgtactagtgaatcaggtaaagaaaaagcccttcaagttattgtaaatgaaaaaatagaaacaacagtagaagaaaatacagatgaggatgaatatatatttgctcatagtgatacagaacttcttacagaagctgatttagaaaataaagatgattctcagttacggttaggacttaatgaaatttatgctagacatcattgtacgtttaaaacacctgagattgcagactattttaaatctaaaagttggtatagtgcagatgaaactttgacatcagaaatgatgaataatcatatgtcagagtattttaatgaaattgaattaaaaaatatttcctttattcaagcacatcgatgaaaataatttgcatacactaaatcataaataaaaaaatatatgaaaataattatcaaaatctataaatttcattttcaattcataaaagatatgtaaaatgaaagtgtaatcaaagaagattataaagtcattcttctcttagatatttttttgacaactatattcattgaatgacgtaggaaaagtaagcgacgcccgtttacttttccttttttcgttctttgaaaaacaagatgcattaaaatgcctgatcaagttccaccaggtgtatctcgtgcattcgaagttttagtaccagctattttaacattgatcattactgcttgtattggatcagcatattataacataacaggtttatatttaaatgatattattaaaaacagtatccaagatcctttaggaagcttaggtgcaactgttcctggttttattgttttatatttagtaatcatgttattctggttagtaggtattcatggtaataatatggtatcagctgttaaagaatcaatctttactccattagcacttgaaagcgttgaaaaattcaacagaggtgaaaaaacaacaaacattattaatatgtatgctattcaaatgtggggtgaaattggtggttctggatgtacattaggtttagttattgctatctttattttctctaaacgtgaagataacaaagcaatcgcttcattatcattaattccaggattattcgaaatcaacgaaacagttacatttggtattccatttgtattaacatcaatcgttcttgaaatcgtaggttatgtattaacagttattggattctgtccagttgcatgtttaacagtacctttcctccccaaatcatttctttaaatacaggttctacccataaaatatgtcccattactattctccttttcctttttcatgtgttgattcatttcttctttcatcccaatctaaattcatagagacttttttaataagtaattcttgataattctttttaaagagtaaggaatagattaaatctataatataatcactacttattttagaagaaaatgatccaattttattaataatattttcttttgaacacattgttaaacaaatatctgctttttttcttaaataactatcatttaaagaagtgattgcaataatagttcccccatttattttaatacgttcaacaataggtttaatttcatttgtttgtcctgaataggaaataattaacgctactgaatttttagtcgtatgcaaagcttgttgagtctgctctgtaggaataattttcaagttaacaaacttattgacataagtcattttatgttcaaacatcaatgctgataaaaaagaatctcctaccgcaaacaagtcaatgatgtttgctttatcaatataatccactgctttttctaattcgttcatatcaagaacttgattagttccttcaatggtttgtttatagactcctccaacattatgacaaatttcattcatcgaactatcttgcataaatggcttattaaaatttatcgtagaaaatgtttgagattgagttatttcggcaaaatgaacacgaaagtcattaaaatttttttctcccaatttcttacaaaaacgactaattgttgctgttgaagtgtaagttgcttctgctaactctttaagattcatatgaatcacatcttctttatgttcaattaaataatccgctattttcttttctaattcactaaaacctttttggtattcaatcgttgataatagactcatattttcacctcaaattcattgtacctttatatacaatgaaagacaagaatacattgtatccttgtcaaattcattattaagcttctgcagcttgtttgttttggtatttttcgtatgcaattaagaatggtgtgtagataactgttgaaacaacaattaagattgcttgagttactgcacccattacgtttttccatctgcgtctacatagtaccaagtatttcctgatcctacccattgtgctttaatagctccactagatgttgcatagtaatcttcatcgttgattttgaaccatcctgtttgcattaatccactatttgcaaagtagtatttagctccagaaaatgtttgatatcctgttaccatttttccatcagtgtctacatagtaccagttatttcctgatcctacccattgagctataattgctccagatgatactgcatagtaatcttctccatcaattttgaaccaacctgtttgcataactccattggcatcaaaatagtatttagtattttctactgtatagtatcctgttactttttggttattatcatagtaataccattttttgcctgattgtacccatcctgatttttcagtagttccagtagttaattcaccactttcattaaatgtataatcttttccattaatgtttacagttcctgtaaccatttttccttctttatcaaagtaatattttttaccatttaatgttaaccaaccagttgttttttgaccatctttatctagataataccaagaatcattttcttctaaccatccagttgtcatcttaccatcagcttcattcaagtttttatcatagtaataccattttcctctaagttgaatccaagtattagctactgcttttttcttttcaacaacaacaccttcgctattatatgcaatgacataagttactatcttatcattttcatctctatatgatgaaacaatagatattccattagaagattttattaatctaccattttcaaaataatattcttttccattaacagtataaataccatctacaaaattcatttcacttgaaacatagtaccaatcatttccaatttcattccatccagctactctcttaaccttatctacaatttcacctttattattataagcataaagataatcatttcgatagtcagttaatatttcatcactatcacttgtttgaagcataccataaataaaatacaaagattttccatctacagtatattctccatcatatggataataataacctgcatcatttaaataatagtaataacaattgccatttaaataaatcaattcattatctttaaatttagctttttcaataacttttccatctcttacataagcaagtgtatctcctgatgtaacaacttcatccaaatattcagctaattgtccataattaaaataatattctacaccattaattgttttaactcctatataaggattcatatcagcatcatagtaataccatttatccccataatgtgtccaatctccagcaacaatatttgcatgattcgttacaataccacttttattaacagtgacaatcaacccattatctgtaattgtatcttcatcataccaagaagaatatgccatatgaccatcatagctataaaaataatacgtattcccatcaatttcttgaagctctttaagtaattcaccattatcatcataataatatttgtatccatactcttcataccagtcacgtctttcactacttaaagtgacaggtgtattagaatcatttttcacatttgtttctaatgcactaaccatcgtagttggtaatgttgttgctgcaacaagagctgatgctacagaaatctttttaaaatttctactcacccaataaatatttcatagacttattaaaatgcaataccccttatttaaaaccaaacgacatttttttattctaaaaagcaaaagaggtaactgtgttaccccttttcaactgaaatattgattttattaatgtaaggttcaataagtttaaagaaccaatgtgaacataaatgatatattttataaacaatgcatgaaataagataaataattaacgctgatcctaattgatgtacaattaaaaccaaaatacctctattaacaaattgttcaattctaatatgtcttaataagaattcatgaaataaaaaacatgtaaaagcagctttagctaattcattgattattttactttcaaaatgaatatccataaagaataaaagaatataagcagacattaagataataattggattattataataccatgttgctgtatattgtaaatgtaaaacatgttccatcattgaaaaagcatataagaatgctaaacatcttataatccacgtacctgcttttttcttagataatgttattttatttacacggagatatgctcctacaaaatataccaaaacaaagttaataattgtataaccatattgacttccatacattccaatagtacttaatcctaaatatgtatttcctgttatattttcagcaacatctataacaattgtccaaactgagaaaataagcatgagtataattaataagcgtttgaattgttctttattaagttgtttaataattaaattaagataaggactaataatatataatacagaataaagtattaaaaagtaattagcgggtaataaactactaatcaatgaacttactgtaaatactttatgacctcttaatactccaaaaacataaaaaactaaattaaatacgataacttgtacaaataattctagtatcttaattaattttctattttgattacaagctagaaaatacgctgaaatcattacaaaaacattaactgcacaaacaaataaactttctattaaatataaataatattgattaggactgccatctaaaaccattcctaatgcaccacccatacttgcattattataatgtaaaataacgacaccaatcattgaaataattcttaataattcaatagacgaatttcttttcgttttctctttcatatatattcccttccaaacaaaaaccgatttttactcaaaacaatgagtaagatcggtttttaatttattttattcatccaaagaccttggttatcaaaataattgacctttccatcaattatataatctccagtaaccatctttccatcagtatctacataataccagtttcttcctgatttgacccattgtgcttggatagttcctgatgaagctgcataataatcttcaccattgatcttaaaccaacctttttgcattaatccactacttgcaaaataatacttcgcaccattaattgtttgataaccagtaaccatttttccatcaacatctacataataccaattacttaatgatttaacccattgtgcttgaatagctccagatgaagctgcataataatcttcaccattgattttaaaccatcctgttttcattaatccactttcatcaaaataataagtactatttcctactttataatatccagtaaccatataatcatcatttgctatatagtaccatctatttcctaatggtaaccatcctgttaccttttcaccatctacaaatgtttttccatagatttttaatgttccttgactataatatttccattgatttcctacttgcatccatcctgtgtgcataataccatcttcattgaaataatattgtcttccattaataacttgatctcctgtaagaatcaatccttcatcatttacataataccaattacttaatgatttgacccattgtgctcttaattcaccatcagaagaaatataataccaagtatcatctactttaaaccatccagttttcatagaaccatcttccataaaaagatattttctatttccaactttataaataccagtaaccatataaccatcttcagctatataataccatttatcatttattggtaaccaacctgttaccttttcaccttctacaaatgttcttccatagactgacattttcttaggactataatatttccatttatcattttccttatgccatcctctgaccattacaccttcactagtaaaatagtattctttattatttatagtttgtgcgccagtaaccatatcaccattacttgttaaataataccattcaccatttaaactgatccaaccaatggccataattccattagtattaaaataataccattttccattaatcttttcccaaccgatttgtagaatatttttactacttccataataccaatgatcatagtaatatttccatcctacataatcatatttaggaacaccttgatcataccaaacactcatatctacataaccactaataccatcaacaaatgctccattgctatattgccatcctttaggacctctataccaattattactaaatcctaatgatgatgtataagcagctacccaatctacatgttgataaatagttggactatttaattttgtttgtaaaagtgaacgatagctataaaccttcgtattataattactatttgctaatttattaacaaatgcatcaacaactaattcattcgttgttgttgataattcaggtctttccatatctaaataaacaggatatgaaagttctgaaggtgaaattttatatattgataaataatttaaaatcattgttgcttcattatcagcatctgttacattatttgaataatcataaatatagattccaaaaggaatattatattttctacaaccatttaaattattttcaaattgttcatcaatatgataatatccacccttatgagaaacaattctaataataacaccatctacatctgttttacttactttactccaatcaatatgaccattgtattgtgaaacatcaataacctttttaacattttcaccaataatgcgaccatcattatcacgaaaacattttttatttccttgataaaaccaaccattttgaatcatagttcgtaaactataagaattttcttcctttgcatcttctattttattttcatcttgatcaatatgactactttgtcccataattgcatcatcataacttccatctaatgcatttacagaactattttgaaaataactcaatgcaaaagccattccaaaaaccaaaaacaaataaccaaaaaactttttcaaaatctttcctctcccctaaaaatattattactgcataacaccactgctattaaaataatatgtcttattgccaactttataataacctgtcaccatcgaaccatcactttttaaataataccacttattctctaattgaagccatccagtaaccatataaccttcataataagttttcccatatatttccataacacctgtacttaaatagtaccacttaccattaattctttgccaacctgttaacatttgatattggctattaaaataaaaccatgtattccctagtttcttccagccactttgtccatagcctgaatcatcaaaatagtaccatttattgctgactttttgccaacctgtttgcattttaccactatcattaaaataaaacaaattgtttcctactttttgtaatcctgtaagtcttttacctgtattatcaaagtaataccaatcactacctaaagttaaccaaccagtaaccatatagccttcataatacgtttttccatagattttcataacacctgtactaaagaaataagtatttccagagatttcttgaaatcctgtcgccatttgataactatctaaaaaataatacgtatttcctgcaatcatttgccaacctttttgtccataaccaccattatcaaaataataccatttgttattgattccttgccaaccggtttgcatctttccacttgcattaaaataatagaaattatttcctacagtttgtaatcctgttatcattgatccatcactatttaaataataccaatcattacctagtggcaaccatcctgtaatcatatacccttcataatacgtttttccatagattttcataacaccagtacttaaataataccattttccatttatttcttgccaaccggtttgcatttgatagctactattaaaataaaaccaattatttcctattaatttccaatctttttgaccataacccaattcatcaaagtagtaccatttattattaacttcttgccaacctgtttgcatttgtccatttgtattaaaataatagagattattttctatagtttgtaaaccagttgcttttgaaccatttgaaaaataataataccaataattattttcttttttccatccttgtggatgagaaatattatttaataaagtaacatatcgattacttacatatcctgtattatcaaagctataagttccatcactactagcaacttcactttgtatcttataaaaaccattagttgtagaggcatcttttataataaatgaataagctggattttttatcgttgtatataaaacactagaacttgtatttgaactacttcttacattaagggcagtatgtgttgttaaataaatatctttgattcctaaagtataataatcattatctttagaagagatactagcatccatatttttagcaatgcttgcacacttttctccttcatagggatctgaagaatattttccaaatattccacttcccttgtctccaaaataacctcctctaaataaagaagtatatgtaggatttaaatatcttttagacatccaactcgatgtaaaattcataatacaatcatctactgtactaaaggtatctgcatttccacctggattattatctgtagcatttaatccaaataagttatttttatttaatgcaatattgctttttccccatccagattctaaggcagcaaaacttgctgccattaaagcattgaccccatatttattttgatacttaataaaaatatcacctgtattatataatttagaagtacttcctgctttattatttaaataatttgatatttgtgaaccagtataagttgtttgacttctcattggtaagtattgaaaataactataataaggattattaggattaacagcattatttctaacattatttttataatctgtaatcattgtattatagttatcataaaaataatgtccatcatagctataatactctttattctttgttaaataactaggtcctgtccctatataattcttatttccttgatttcctgtcgcattaacattattagaaatataatgatacaaatcacctgatgaattaacttcatagttacttgcataataagtcccttggctaagaacttcaacatattgaggatctactaaaccaacaattcctgaaatcataaacttcacttttccattttcatagcctaaaaaagctgcatccgctgcacttgatttagataaatatccctcttgtcctgtataataatctgtaaaatttgtagttgtccctgctttagaacaattaaaattaaccatattcgctgtagaaactgttcgtgcataggggttatactcttcattcgttgttccatcataaacatctacagtattaatatttccatctttatctacaaactttgtttgtccaataacgtcatttgtttcttcatatgcttttatattagagatattaaaaatcattcccaataatataacaagaaacaaacttatgtacttttttttcatttccaacctcctacaatattttaaatctatagaatattttaacttactaatcctatttgcttttaataatgtgataatatcacataaaataatatacttacaaatatcaactaaaataatcatcttcgtaaatactattttttattataatgatatacattttcaattcaacaaaaaggatatagaattttctattctatatccctattattttctttcttttcttgtaaatatttatttgcatctttaaagaaactaattacaatcaacagtataataaatcctattggaaaagcagcgataatagccactgactgtaaactatacattgaattttcagcaaaaatcaacgctattggaaataagataaagataattgcccagaaaactctaatctttttatctggttcttcatctacatctaattttttataagaatatgatgaaacaaccattgttaaagcatcaaatgttgttgaataaaaagcaatcatagtaataactaataataataaacctagacttgctagtggtagagtatcaaatatctttaaaataactgcagaataatctccacttttagcaatcattcctgaaatatcaattccatgtttcatttgttgtgccaaaccataatttccaagaataatgaatgaagtaaaagttcctgctagaccccatccatatcctcctagaatcgtatttttaattgttcttcccttactgatttttccaataaagaaaggagttgcaacacaccataccatccaataggcccaataataaatcgtccaattttgtggaaatgatgtttctcttaatggatccatccaagtagataatccgataaaattttgtaccatattaccaatagctgaaaaaccagtttctaagatatatgtggtttctcccccacctattaaaaaataaataagtaaagcaaagaataaataggaacaatatgttgctagtttagaaatacctttcattcctgtaagtacagtaaatgtataaactgctgcaatcaataataaaacagcaatagtaagtcctacaccattaggcaacccaaatactctacttaaagctgctgataataatggtgttgctagtgaaaaggttgttgcagttcctgcaataagtgcaaatatagcaattaaatcaataattttacctacaactccatccactttatttcctagtaatggtctacatccttcagaaaacttttgtttatttcttcctcttacatgtaacataaaaccaaaagcaacagctaaaataatataaaaactccaagcaattggtccccaatgaaataacggaaatgttgacgcccatttttgtattccacctaattgatcaatatacttttcattagcatataacgcccattcacataatgaataaaataaaatatctgctgccattgtagaagtaaaaatcattactccccagttaaatgatgaatactctggttgatctgtactcttacctaactttatttttccatatttagaaaatgctatatataatgaacaaacaaaaattccaactcctaataacgcataataaatgccacagtcatttcctaaaaatcctctaatcatttgaatgatatatgaagattttgctggcataagcataaataaaacgcataataagacaacccctaataaaggaattatcattgatacataatctaatcttccctttaatgatttcttttccattttatttcccccaatttaaatatgtttcatcaatactacacaattcatcaaaactatctatttctaaaatatctccttcatgcatttctttaatagataattggtattcatttggataacaaaacaacgctacatcatcccaataaatatcagtattctttttctcttcaaattcaatttctaaatgtttctttaatttctttccatcttcttcattccatctagatacactatataattgccaaccatcttgtccaccagttcttgaacaagaagttacaaaaccatcttctagttttaacatccattcattatgaatttcttgtttgtaaatacagttatatcctgaatatttaaattcttttgaaagaatttgtgtattgttaataatttgatcaccatctaaaataatgacattttttagatgatttctagcaacatataaagaagaaatattgttgcaagtatcataataaggattatctattagatgcaaattctcatatttatcttctaaataataaaattgttcttttaaatagcctacaacaacatagatttcaaagatcccttgttgatgcaattgattgataattccttcaatcataggaatatcatgtattttaactaatggtttaggtatcgaatttgttattggtctcatacgtgttcctttacctgctgccattataattgccctttctacttgactcattatttcatattccccatttcttctataacaatattatagtaatctttcgcaaaacgatattgtgctaatgaatattctccaaattcaacacctagcgtatatttatattcacaccagttgctccataaaagaccacacattgatatataacaatagatttttattcttgtttgttgatcacacttattttcaaaatagatatcaattaaatgatcaatttgttttctatcatacatagaataaatacaaaacattgctatatcaagatgtgcatcttgcattgccgcatattcccaatcaataagttttattctctcttcattattttctctatagaataagaaattatcacaatttgcatctatatgacataatttccattcttttggtaattgatcaataattttctttagagataaaactttttctttcgtttgtttatagtctttatataaagattttggacctcttagattttcataaaattccattttttcaaaaacatcaaattcatgttctacctttaaatcctgattatgaaattcttttaataatttcatacatttaattaaatcttcatcattatcttgattacatacacgtgtatcgtctaaatattttgtaatcttatatccattttgtggattcatataaataacttcatcactgatatttaaatcttttattacttgataaacttcatattcttcttttcgattaataagttgatctgttccttccccaggaattctcataatatatttatcatgattaatttcaaataaaaatgatctatttgtcatacctttttttaagcttttaatatttttaatttgttcaacattgattttaaaaacatcagcaatcaatgataatgtctcattatttaagtgtgctgaatgatcatctacatttcttaattcttcatacgtattaatttcatctacatagcttgtatcaacaatttttccataaataaacattttattcttttgatacaacgtttcttcccaaaaacaagaatcatgcattccgtcatctaaacattctaaacgttcttttaaatataaagaatcatgttgattaataaatgataaaccaatcatttttaaaccatcatcctttactttaacaatttcatttttagtattacatgtaacattactatgtttacttattctattttcaagcatataccatgattgaatttcattatttaaaaatggattttcatagaaataaagatcaccaggaataatataagtattatttattttatcttttactagatttaaactatgtaagttgttcttttcttgatattctctattaacaactaattttacattatatttatcaattaaatagtcaaattcttctttcataaaaccaacaacaattgttatatcattaatatgagcttctataagctgtcttatgagacgttcaataagtatttcatcatttatttctaacattgctttaggcacattattattaataggaatcattctaatcccttgaccagcagctaaaataactgctgacttatttttctttattaagtctattcctaaatctgttaaagaattatcatcattaatatattctaattctttaagattctttattgtttcatttgttttacctaaagaacaattcaatcttttagaaatagctctttgtgaaagtgtattttctttatatagtaactttataagttcaaaatctaaatatgtaagaatgttcatttttttctccttgttaatttatatgaacataataccacgtatatttaataagtaaagaaaaaaagaagtatttctacttcttatgataaaaacttaggtgtaataaaccctctaatatatttactgttgacattcattgttctatattcaacagcatcatttttatttccttcaataactttaaaagtatttccattcacttctgtaacaatacctacatgatcaggccatcctgtgttatcaccatttccactatcatcccaatcatacataataatatcaccaatttgaggaacataagcatcattttcttgccaaatgcccatagattgtgccttttctactgctttaccacatgaacattcaactggaataagatccaataaattacattctctaacaattgctgatacaaaagtcatacaccatgaatctgtatatttaactttataacctcttggtaaaggatctaatttattatatgaatctataattttcttaaatgatccatctttttcattacatcctaaatatcttttggctctttctacaaactcttttctcgtacaatttgaaatccatgaataatcatctctaaatatatatgttttaccatcaataactacatcatctttaacagctgcaccatcttcattaaaataataccatttccatccaatttgtgcccaaccagtaaccatgacaccactcttatttaaataataccattcattacctgattttaaccatcctgtatgcatatcaccagaagcatttaaatagaacctttgattattaatcaattgccaacccgtttgcataattccttgatcattaaaataataccatttgttagtgatcttattccatcctttaacaagaaccgcattagaatcaagataataatattgattatctctataataccaacctaattgcaaatctccattagaattaaaatagtaatattgatcattgatataataatcacctacaaccatttttccaccttggtccaaataataccatgatcctttatgtagccatcctttttgaatatagccactattatttgcatagtaatatgttccatctgcttggatccatcctgttttcatagctcctgattggtcaaaataatattgttgatttcctacagaagctaaccctgtgaccatttttccatcttggtctaaataataccaagaccctttatgcaaccaacctttgtagaaaacaaaaagattgatcatgtttattacaaagcaagtgatattaaaaaagtacttgattaataaaaaatgtcatggagaaacgttcgcatattattcaatcaattcgtaattttaaagatattgaaaatcaagtaaatatagatattaatagaattgtacgtaatagctttcaattaataaaacccaaagtaacctgtgttattattaatgataataatgatcaattaataaacagtataaaaaaagaaatgaaaatatttgatgagattattgtagctaatattcaaaaagaatcgtttacaaataaaataaattgtttcttaagtaagaataagattcaatgttatcaatatgataataaacaagaaattcaaaatgatattttacagtatgttcattgttcttggtgtgttttcttagaagtgaatgaaaattttgataagaaaaataaagatattttatataatattttctccctatttaatgaagcgattgaaaaggaaaatataatgtttatattttataatttgaagaataatgaatactatcatgcacatgcgatttatagtcaacataatcatgaatcaaacattaacgtagaattgaatatttaattaatagaatgatccactcattaaatagacatgggtggatcattgttttatacttaatataagaggatgtaagagaggtagataaatgcaatgtttagttgttgatgatgatagaaagtttagttataaattaagaggttatattgatagttttttaaaaggaatttttaaaaattatcaagtgttagaaataaatgaaaagtttgatgatttttctcaatatcagaatattgatttgttatttattgatatcgatttaaaggacttaaatggtatcaacattataaaaagattacaaatgaacaatgttgattatccgattatttatgtatcatcaagacaagaacttgttttttcttctctttcaacacaaccgttttattttgtaagaaaacaaaatttagaaaatgatttaaaagaattatttaagctattaaatatttattataaaaagacaatgaagatgatcacatttgattattatggacgaaagacaagtatctttttaaaagacatccattatattacttcttttggacatgatatcagtattgtatgtgatcaagaaacgtatacttatcgctctagtttaaaagatgctttaaaactgatagatagtccaattattgtacaagttcacagaagctatgcagtatctatgatgtacattaaagaagtagataaaaatagtattatattaaaagatgaaacatgtattacacttggaaaaaaatatgtagatgaattcatgtttcaatatagggagtatttgatatcatgagtttatttgatttagttataaatattattgaaagttctattatgtgttattttatctataaatattttgattttaaacaggtggaaaaactatggctttttattcttgctgtttttgcaacaataacggcaggaaattattttattagtgaaagttggttggcaattgttttattggctggagtacttattttgtttttgaaagttttcaataaaaaaatgagtatagagaatattattgtttgtttatcagttttgataatggacttggtttgcaatatgattactttaatattaggaagttcactggattttataatatctgatccagcagcaaagctaaagattctaatgattgtttctaaaacaatgtatttattgttttctttgtatattttgaatagaaaaatgaaatataattctaatttggatactaaaagatggacgagtattataagcgttttcttgattctgttattagaactttatattcttgctaatgattatacgattaacaatataaatccaacagatactttattctgcatgttcttaactgctatagttactttggttatatttaacatttatgggaaacttttaaaagaaaatgaagaatcgacacgtattcgtttaaaaaatgaagaaataagatataagaaagaaaatgaaaaagtgctttctaaaatgtctgaagatatttatcaattagaacataatttaagatatatcttaatgcaggtaaaactaaatgaacaaaattattaatcttattcaccttatcttctatgatatccacagccatcacttcgtgatgttgtgctaataatgtagcgatacttaatcctacatatcctgtccctgctactgctaatttcatattaacctcattccttacttttttagtctttttattttcttttttaattttagaagatagttatatacaaaaaatgcgtaattcctagaaattctattttcattatctaaattaagtcctttaattatttcacattttcttataaatagttttgaaaaatcaattgtgctttttgtaatatattttggatcaacttctgaacttcctccaaaatgataaataaaattcttataattttcaattgtttgaatagagtaaccatctttttgaagtcttgaacaaaaatctgatattgaaaaaaaccaagtaaatcttttagaatccaatttataatttaaatataaattcttatccactaaaagacaccatccgtcaggtctattgtcatcataagaacaaacttgacatgcagttaccccttttttatgtactgaaatcattttttccagccattctttatttcttatttcaacatctgaatttaataaaagtataaatttactatctttagaaacatattttgaagcttcattatttcctcctgcaaacaataaatttctatcagagaaaatcaatttatcaattattcctaattttttatacttgtttaatactttttttgttttctcttttgaatcattgtcgaatacaattagctcataatttcctgttgtcttcgctagtgtatttaacgtatgtttaatataatttggagcattatatgtcaacattacaatacttactttttccataaaaaacaccttataaaattataatacaaactcatgaattaattttactatatcctttcttccaataaatataacaactgttaaataaacaattgcacaaataattataataataaaattgtttatcatatttagactaactacactaaatagtagtctaacacccaccataagaacacagcctataactggtacaataatattcttaaaaatacgatttactcttaaattacaatactttcttaacaatattaaagttggaataataacaaccaatctacttaaacatcttaaaataacaaaattatgaaaactaacatttccaaacaatataaaaattaaaaacatgatcataaaatcaaaaatttgcaaatctaaacaaatgcttggttttccaattgatctgaatgcttccataaaaatactaaaaaatagcgttctaattatcgttgaaaatgcccaataaccaactacaaatgatgcttcaatccatttgtaaccaaataataaaacagtacagaattcattaaataataagactcctatacctataggtaatatcatatacgccataaatctatgaaaatcagttaaaaaataattatatttttttcgatcgttttgatatcttgataatacagaatataatataggtaaaaaggctgatgttattatagcaattaaagagttaaccattgaaatagaatttttatacaatcctagataataagcactaaacagtgttcctataaaaaaagtatcagaccaattaacaagccatgaggataatgactccaacaaagcaaagaagctaaaagaaaacatatccttaaattcattatatgcaaaataaaattttaaattatatttcgataaaaaagataataagattgcttttagtattgttccaattaaatttccaataattactgaccaataaccaaatccaaaaaaagctaatggaactgtaatcaataaaggtactagtgcacttagagtttggctataaaaaattggtttaaaatcaagatttcttttaaataatgtcatttgaacagatgaaacacttgttataggaagctgtagacttgcaacaaatatagcactagcaatagaaacatctccgaatgtttttgctaagaaaaatctattaaaaaaaatcaatatcaatagaaatgatgaaatacaaaaatttataaaaaaagcaatattggcacattcttttatcttttcttcattttgaaaatccttttgtattaggtactgttgaaaacctgattcagttaaaagatcagcgaaagaagtaatcattgttattgttgcaataactccaaaaacatctggcaccaatattcttgcaagaatcatgttagttatcggggttaaaagtttagataacaactgtgttaaaaaagaccatcttgttgcggttgatattttattattcataacctacatttcctttctctaaaatattgaatataaaaatagataactattatttttataaatttctaaaaagaaatcgtagttatagttatcaaaaacaaatatatgatatattaccattttcatagttgatatatacttgacacattttaacgacaattaaaatgaaaaatacaaaattatatatttttaatagaagacctcttctaacataaacttagattttataaattactaaaaattgtaaaattaaaattatttgtagaataacaattgtggaaagagcaatccttctattagatttttttaatttgattttttaagaaaacagtattatattagcgtgctttaaatatctaataaatttttatttttttactattaatcaatttaaaaataatgtgtccaataaacaagaaaaacaaattggcaattgcattgtaatattcaaagtaaattatgaattttgcagaatatacaaccaaaataataaatattatatcttgataatttatctcatttttattcctacttatattatcaattacttttataaacatcccataaaaaaaaggtacaataattggaccaataaaagataattcatataatgaagtagaaatgatatcggtaggagattgtccatatcctccagtaatactactattaaaatcccatacagatacaaaaggattttctataatactagatggtaaaacagcaaatggagctgaacaaatatcatccacaatacgaagtttattaaaattaaaaatataattcatactatttttacttgcctcaattataaatgtaaattcattactaactgtgtcaataaatgaagaactatccacttcaaaagtaactcctttaataattttataaatataatctgcattcattactattaataaaataaaaaaagaatacactataaatctacataatattttttttaatggtacaccttcttttttcttttcaaatatattaataagcattaaagtcattaaaaaaaatcctatcataattctactgtcatttattagcatagtgtaaatggaaattataactgaaaagaggaatagtattaatttcgagtatctatactttttttctttttttaataattctaaaaaatataaatatgaacaaaataatgataatgaaaaaaatcttaataaaaaactgtatggattgtttattctacttatacccattcttatagagttcgcataggctaaagcttttattacacccccataaggttttgtccaaattaatatcatgatagccacaattattaaacatacattagctgtcataaaaattgaatgtcctttttttattttaatcttttttgaagatttacataaataacctatatttaaaaacaaatagccaataatagaaaataaaaagaatagaaatgaattaccatctaagttatacatgtatgatttatttatataaatcacacatggaagcagaccataacaaaatgaataaactatcctaatcaaatttatgcatttaatttcatttaaattaattattttgattacttcatttgaaataatcaataaaaaaaatattagatataaaataatcataataatttcatccattcattatatactttttcttttgaaaaatcatttgctctcatttttgattttgtagtgtatttttctcttaactttttatctaaataaaacatctcaattgcttgtttaatataaactaaactgtcattatcaacaatgtttttttcttttgaaaattgtttaactaatattccaaatctttctacatcaatattttcgcaaactgatttaatatttgaatttggagcaataatttctcgaggtccacttttacagtcggtagaaattactggtaatcctaaagccatagcttctaataatacattacctaatccttcaaataaagaggttaaaacaaataaatcacattgccttaaaaatttatgagcatttgaaataaatcccaaaaagaaaacatgttcttctaattctaatttctttactaattcttctaattcattctttaattcgccatctccaagtatatataatcgaactttaggatattgaacaacaatgtctttaatagcatatatcaaattccattgtcctttttggtacgtaagtctacccatcgtaactatattaaaataatcactaaattctttatcgaaagtataatcttcttctattgtcaataaacttttaatatcaaccggattatatattgtacacaattttttctcttttattttaaaaaaatttctcatatcatattctacattttttgatatacatactgttttatccgctctaatagatgaaaatctaatcaattgctttctaataaaagatggcttttctaaagataaataatttctaattgaaacaatttttttacatttacctccacttaaaacatttaccaaatttggtgtatctaaaaaagaaatacaaacatctaaattgtatttctttttaattttcttaacttttataattctttttatattctttttaatggcatcgaacacatttttattaattcctaatgataaatcaattaattttcctttatatggatacgtaatatttgaaccatcaaaagtaattaaatacacttcttcaccatattcatcgaacaaagacgataagttagcagctgttctttctgcaccacctccattaagttttgttattaacaatcctattttagccattattatattcctttcttaatttctccaaatatttgttttcatcacataaatcatcaaatttttttttacaattttgactcatttgtagatataacttattcttgctgacaatatctaaaatacttttaacaagttcatcatcatcaaaatgcaaatatccattaaaatcatttttaataagatgtttcataccatccactggtgtagagacaatcggtgtacctaatgctaatgattctaaagctaccataggtgttccttcataacgagaagtcataatcataacttttgcatcttttattatttttaatggattactttgaaaacctaaatattttatattatttgaattcattagagcaatttctctctttactatatcttccaaatcaccagttccaactatcccaatttttaatgatgagtttttttctagtaagctttgacatattttgattaatctctctggatttttttgataagccaatcttccaacataaactacatcatatgagtaatcattagtatccttagcacatttttcttcgattcttttttttgataaaatattctctaaaatttcactctttttagatacaaatttcttaaaaataaatccgtcatagcatgacttagaaacccaaaaaaaatggtcaatttttaaagatgctattaataatccaatcgttttaatatttatatttttcatattattattatttacatggatatgagatattaactttctttttccttttaaaatggaacaaagtaatgtagctctaacatcatgtgaatgaataatatcaggttgcactttctttataaccttttcaagttctttataagttagatttttcattaattcatattttattttattttcttctaaagtctctttaatttggccatttgccgatgaataaacaaaattataatcattttctaaagaatttatgatataaacaacaacattttcagcaccagaaaatgtattactttgtaaaacatgtaatatttttttcatataaagatcaccaccttataattcctttttgtaaatttcttctatttgtttcttcacattttcaacatcgtaattttttattaatcgaatattattaatttgcatttttctactcatactttcatcctgaattaactgattaattttttcagcacattcattcgaatcattaacaagaaagccatttataccattttttattaaatcgttatttcctctaatatcactaactatacatggcaatccagcagccatagcttccattaaacttcgaggaagcccctcccttttcgaaagtgagatataacaattagaaatttttaataatttaggaatatcgtttctatatcctaaaaaaagaatattcttttccaagttcctttttttcactattttttcacactttctttttaaaggaccatctccacatattaataatttgattcttttgtcatttgttttgtatatactttcaattgtttcttcaaaatttttattactctctattcgtcctatgccaatacagatataatcatcatcacttaaacataaagttttttttaaggtgtttttatcataagaaacattaaaaaaactgtttacatctattcctactccatctactttatacacctttccatctttttttagtttcatattatttgcattatgaaaatcttcattattaatagtaattattgcatctgttttatgcgctaacgcatactcaatattcttatacacaatattattaagtaaaggtgcacctttataaaaatgaaacccatgtgcagtataaataaccttttctaatttattttttgaagcgcataatcttcctaatacaccacctattggtgtattacaatgaatataatctatttgattttcctttataattctatttagctctttgtatgaatagatattatcaaatgataatggatttctattacattttatattatgaagtacaatatccttataaggattgttttcatagtcaaaattattaagatttgaagctaaatgaaattctatacccattttttcacatgcataatatgacggtaaaacaaaatttgttatagaatttgtaatattgcttataaacaataactttttcaaataaatttcctcctaatttgtataaatattttctctttttaaaacagtcaatatcgtcttaaaaaatatttttatatccaatttcaatgatgtattatgtgcataccatgcatcatataatcttttttctctaacacctaaattatttctataataagcttgtgtatatcctgttattccaggttttactaatagcttatctttttcatcatcatcatatgtatctttagattcaacgtcacctgctcgaggcccaattaaacacatatcacctttcaatacattaataatttgaggaatttcatctaaacttgtttcacgtaagaattttccaatctttgtaactcgtggatcatctttagaattatatgtactcccatcttcatttaagatattaggtgcattaactctcattgatctaaactttagcattccaaattctttaaaattcttaccaatacgtttagatgagtaaaaaattggaccattatcatcaagtttgattagtattgctactggtataaaaataataataaaaaaaggtaaggcaattattcctaccaataaatctattatccttttaatattcttttgataaacactatcataatttgttttattaaaactttgttttaattccttttccgtcatcttatttctccctaataactgacatatcaattttgtcttttgcatttcttactgataataaaacttcattagcctgttctcctgcctttaaaacatacccacatccgtccagattcgtatgatattcatttatgatatcagcaatatttagatgttcatatatttcaactccatattcattagctatggcatgaaaatcaggtaaacatttaatttttccttttcttaaagcaagtattttggatgatacttttttaggattcatttgattttcaaaagaaatattttcaccgacagcaagttgtaacatcattttcatataatcaattcctgtgccatatggtattatatgtgatcctattaaattacctcccattctagctccaatatctactatatgaattttttcatcatctgttactagtaaatccatatttactgaaccaatatttatttttaaagctttgatagcattttttacataatcttttattttactttctaatattggagataatccagatggtattgtatggcctaattctgcataatatggtggctttgtcatttcctttttcataattgccaaaacatgtacttctccattttctactaaagattccactccgtattctttaccaaatatgaatgtttcaatttccgccttacaactaagtgaattatttattgcctctatacatgctttttttaaatctttaggatcattcaccctactagcacctctgcttccagaaccatcgcatggtttaaccataaccggataatcaattttatttgataatttctcaaaatctgtattactttctacttcatatggaaaatttgtatcatcaacttttttttcacataatatttttctaactaaatatttattttttattattttagcaacttcataatctaaccctggcaaatttaattttttagctatataagaagctgtaagtacaccataatcagttgctgcagttaatacaccatctattttcttttctttagcatattttaaacatttttcttgatcgacaatatcaatacatttatattcatcagcatatttaaaacctattgcattaggatttccgtcaagagcaaatacatagtaatttagttcatttgctttttttataacaaattgttgaagaaatcctgccccaataatcaaaatttttttcataaatacttctccatttttacctctacatactttaaagtatgtattttttcgtcacaaattatataattgttcttttcataaaattttatagcatgttcacttttatcaaaaacttctaatgaaatatgattgcaatttaattcttttgcaattttttcaatggcatcaatacaatacgtaccgatacctttcccttgatattttggaataattgcaagcttttctaaatgtaactccccttcaatttttttgatttgaaatgttgcaaccaccgtattatgactttttattaaataaatattatttttgccatgtcttttccacattcatataaaattttattcacccgaaattgatcaattatatcatataatcttatttttttatactatacatacaattagatatatcccttcacaacatccttaaagttttcaataatatactccacatcttcatcacttaattttgtatgaagtggtaaagtaatttcattaacaaattgattataagcatttggataatctttaatattaaatcctagattcttataagctgaaagcattggaagtggtttgtaatgtacattacatgctattcctctttcagccattttttctataatttcatttctttgatcacctgtaatatttggtacccttgtaatataaagatgtccacttgattgatgatcttcatcataatgatttaatacttcaacacctaaaggagtaaaagcttcattatatctttcaatgatttcttttcttcttttaagcatttcaggatatcttctcatttgagcaattccaataccacccatgatatctgtcatattgcatttatataatggtgctacgacatcatattcccatgctcctagttttgttttagctaacgcatctttggattgaccatgtaatgataataattgaagttgtttatagatatcttcatcatctattccttcaattgttctccaagtaagtgctccaccttcagctgtagttaaattcttgactgcatgaaaactaaatgaactaaaatcagcaattgatccacacatctttccatgccatgaagcaccaaaagcatgtgccgtatcagcattgactgatattcttcccattgcttcttggatcttattgcttggtttaaataagttttttttcttttctacgatttcatagattctatcatagtcacaaggaactcctcctagatcaactggaatgataacttttgttttttcagtgattgccttttctaaagcatcgtaatccatttctaagctatcttttttaacatccactaaaacaagtttagctcctacatgacatacaactgatgcacttgctgtataggtataagcaggtacgataacttcatcaccttcacctactcctaatactcttaatgccatttctgcacaagcagtttgtgaatttaaacagactgctttattgacacctacatatttagctatttgtctttcaaattctttaactttaggacctgtagtgatccatccatttcttaaggtatcagctacttcattgatttcatcttcactcatatctggtggtgaaaatggtataactcttttgtccatgctatatcctccccttcttttaaataaaaaaagaatatagtttacctatccaataagtatttttattggactaggtaaactatattcaaataagatgtataggcggctccccctacgctatacttctttattttgcatttctatccctgcttttagtttcttgtttaagaattcaatattcagtactgcttcatgacttttcttatctactgaaacgatatgttcttctaattttttcaatggtccttcaatgatctttgttcttccattgatcttatatccttttgacatcaccaagatgtattgtttattcaaaaggatatctagaagctttatttcttctttggttagtgctgatacttcttccttttttaattctctaatgactccatctctttcttctttcattaataaaagcaatgtatcaaactctgtctgattcatagttgtcttaataaagagatagcctggaaacatattctggataacgattttatctttagaacgtatatatctttccattcttgggatgaaagcttccgtatcctttttgagattgaatgtatgatagagcttttctatctttaagctttgacagaacaggacataatagttcattagcttttttcctgtcttttcaaagctctctgtttgagacattcaaagatgctttgatagtcatcacatgctttcatttgatcaatgagttctatttcattgtcttgtagttcttggatagcaaagtccagcatgtcttttaacagttcttcattttcattcatcagtttttctttatctttatccataggatcatacatacttgtaaatacagccatttgttttctccttttttgacattaaaacaaaagcagaagtttcaatgtttgtaggcataataaaaaccatagattattaaattctacgaatgaactatagcacaaataaaccctaaaagaaacataattctacttttttctttttattttaaaaaagtaatgtcgttgagtaaaatataaggtcgttcagtaataaaaataaagaaaaagaggagaaatatatggaagaaaaaaaactaacaattcaagaagaatggctactaactaagaagatctctgttaaatattctacatattgtaagtatgaaagtattgtcacaaaacacataaatccttatttaaaagaaaataaaatagaagaattaacagagcttcatattattcattacattgatcatttaatcaatgtaatgaatttatctacaagtattgttaattcaatccagtgtacgttaaaagctatttatagatacggtgaacgtacacatggattaaagaaattagattttaatgtaatcaagtttagtcaaaaatctaaaactaaagaaccacttacattagaaaaagaaatgattatctggcagtattgtttaaataataaagaaagaatatcactagcaatgtctttaggattatatgcaggacttagaataggcgaaatatgtgccttaaaatgggaaggtattgatttagataatagtatgatttctataactaaaacagtacaaagattaaaaagtgaaaatcatgaacataaaacacagctctatattttagaaccaaaatcaacaagttctattcgaagtgtgatacttcctgattttttaacagaatatttaaaaaaatataatgatctctataacaaagatttctttattttatcaaataaagaaatccctgtagatcctagaattattcaaaaaaattttaggaaaatatgcaaagctaatgatatcgatgctacatttcatacattaagacatacctatgctacaaactgtattaaaacaaatattgatgtaaaaacattaagtgaaacattaggacatgctaatgttaatattacacttaatcgttatgtacacacatcattagattttaaaaaacaacaaattaataaaatagagcctccaataaagccgtagaatttaatattctgcgtatttttattaatacaaaaagagatgtctagaaatcaatttctaaacatccctttgtttataataatatgttttctttctaatattttacaccctcacgaaatagaacaacatcatatacaaataatcagtaaaatattatttgtaagaaaagactttgcttaaataatattcttacataaaagtggtatccattttcgtgatatcactttttttactttgaattattatccattttaactacatagcattgttttttataaaaagagattccatatcctacaacattttcatatttcttaaatcttctttcctctaaatacttttgatctatgatttgttgtcccccttctctagcgtcatctattaaatcatcttcacttatagaatgtttacattctataagtactactgttcctaatatactatcaggcaaaacacatacatcaaatcttccatgctctgcctctttattagacatcacttcataaccattcaataatcctactaaaaatccatgataaaaagattcttgattatcaaagtaactaatgcttcttaataatatgtcattaagcaatagatttactttctttgtatcaccttgaataagttcttgataaagttcattctttctacttgttgtataatcttcaaagtaagccatgaatgtttgtttatagatttcatacacttctttatttggaataacaagtctatatttgttttctcctaaatcttcaatgactcttaaataacctgtaagaagtaaaaaactatagatattattgatattatccatttctcgataagtaagttctggtctgatatacttagttaaagcatgtccattcattaatgattcaaattcttgtcgtaattttctatcaccattttggatataattcacgacaagatcatttccactagtatttgcccaaaaggaaacaggtttaaaagattgatcctgtattttatttttgacatacatcaatatactccaaggattatagatttctgtatttccaaatagatagccatcataccattctttgacttcatccatataagatgataattgataatcttctaataactgtttgacttctttttcattaaagccaaaatactcactacctccattatttaaaagagaataagaagtaaaattatttaaacccgtaaagatactttctttagatattctaagacatcctgtcatgattcctttttctaaagcatcgtttgttttaagcgctgaagaaaagacacttcttagaaaatctaccatttcatcgtaataattattttgatacgctgattgtaatggaacatcgtattcatcaataagaacaatcactttttgatgataatgagtatataaggcattagatataacccttagtgaaaattttaaatcttcaattgatgttgtttcatcatgcaaactatttagttttttctttgttgtatcagttaattgagctgaagataatatttccaaatttttttctaataattcatagatgatattagaaaaagaaattatttgagctttaaaagaagaacttttcatttcttttaaagaaataagtattgttggatatttattttgatgttttaaagcttctttattttttgaaatatttaaatgatcaaataaataagcattttctttttctttgatagaaaagaaataataaagcatgtgtattaacagttattggattctgtccagttgcatgtttaacagtaccttggacatgtccatcattgatctttggattcttggcaacaggtgcaaatattatgggtgcagtaactcaagcaattttaattgcaatttctgtagttatttatacaccattcttaattttttacgaaaaatattaaaacaaacaagctgtagaagcttaatagagcttggagaaatcctaagttttttttataataaataaaaagtatgtttaaaacgcaactaatcgcaagttgcgtttttgtatataggtagctataatctcttcaaggagtgatgaaatatggctattactgcaacaaaaagattacaagaaattgttgatttattagatcaaaaaggatatgtcaaagcaaaagaactttcccaaaaatatcaagtaagtatggaaacaattcgtaaagatttaacttttttagaagaaaaaggagttgttaaaaaagaatatggtggagcaacacttgcaacgttaggaacagaaaaaaatatcgaatttagagaaaaacaaaaatatgatgaaaaaaaagaaattgcacgttgtatttcttcaatattaatggcacataatagtatgatcattgattcaggaagtacttgtcaaagttgttgttcatatattaatttaatgccttcaaaagatatttttacggtttctataggtgcatttgaacaattagatggaaatttacataatgtgtttttaactcctggtcaaaaaagagaaaaaaatcaatcaatagtaggacattggagtgaagaatatttagataaagttcaagtagatgtctgtgttttaggaacttctggattattaaatagtgatggaccaacatgtcattcctatcaagaattaggagttaaaaagaaaatgattgaaaaaagtgattatgtttttgtggttgctgatagtagtaagtttcaagaaaaaggattatatacagtttgttcttgggaagaaatcgatggtattattacggatcatcgcatctcaacaaaagtatatgaagatttaagtcaaaaggtttctgtttatattggaaaaaaagaataaaaatttttcaaaataaaaagtgattttttttaagatatttgaaaataaattataaagtattctataacactatttattgttgtaagaatattttatttttatattgaggtgatactatgagcttactttataagttagaatatcaagataactttacagatttagaaaaaggtatagccaattatattgttgatttgaaaataacagatttagctgaaattacatatacatcaccatcaacaatttcaagattttgtaaaaaattagttgaaaaaagctataacgactttagaatacattttgcctcttcagtaataggtgattataaatctaaaacatatatcatctgatcaaaatagacaagcaatgctttctaataaagatagtgttgctattgtgatttcgtattctggagaggaacaagagattaaaagaattgtgaattatattaaacaaaaagaaggtacagtgattgctgttacttctattaatgatagctatttaagaaaaaatgcaaattattgtttaacgatatgttctaaagaaaatattttttcaaagataggatcttattcatcaaaggtaagtgcagattatataatggatattatattcgctttattgtttaaaaataactataatattaacttaattgaaaagcttgaaagagcaaaaaatattcaaaatatagaatttttaaaaaattaaaacaacgattttcttttagtaaatcttactagaaggaacgttgtttttttattcacataagcgtataatagaggtagtctaaaagaattgggggaaaccagaaatgtacaaaatagtcaaaaaagaaagactaaatgatgttgttgaattaatggaagttcatgctccaatggttgctagaaagtgcgaaccaggtcaattcattattttaagagttggtgaagatggagaaagaattcctttaacaattgctgattatgatcgagaagctgaaacaattacaattatttatcaaattgtaggtttttcaactcgtcaattagcaaaattaaacgaaggtgatgaaatcactgacttcgttggacctttaggtgtaccaactgatttacataaatcaaatcatgttgttggtattgccggtggggttggtagtgcaccattatatccacaacttaaaaaattagctgaaatgggtgtagatgtggatgttatcattggtggacgtgaagcacaatatgtattatgggcagataagttcaaagctttctgtaaaaatgtatatgtgatgacagatgatggatctttaggagaaaaaggatttggaactgttaaattacaagaattaattgataatggtgatccaattgatgaagttatcgctattggaccagtacctatgatgaaagctgttgttggggtaacaaaacctcataatttaaaaacaatggtttcattaaaccctattatgattgatggtacaggtatgtgtggatgctgccgtgttactgttgatggtaaaattaaattcgcatgtgttgatggaccagactttgatggtttatcagtagactttgatgaattaatggctcgtcaaagaatgtttaaagaagaagaacatcaagtagatgcgaatgcagatcgtatttgtaatttaatgggaggtgcaaaataatgcctaatatgtcaccaaataaggttaaaatgcctgaacaagatcctaatgtaagaaataaaaactttgaagaagtttctttaggatatacaaaagaacaagctatggaagaagcaactcgttgcttaaactgtaaaaaaccattctgtatggacgggtgtccagtaggagtaccaattcctgaattcattcatcatgttgcagaaggtgaatttgaagaagcttatcaaacaattacaagagaaaatgcattacctgcaatttgtggacgtgtttgtcctcaagaaaatcaatgtgaaggtaaatgtgttagaggaattaaaactgaatcagtaggaatcggacgattagaaagattcgttgctgattatcatagagaacatggaaaacctgcagaattaaaaattgaaaaaaatggtaaaaaagttgctgttattggatcaggacctgctggtattacatgtgctggtgaattagctaaaaaaggttatgatgtgactgtttttgaagcattacataaaacaggtggggtattatcttatggtattccagaattcagattacctaaaaaattagtacaaagcgaagtagatggtgttgctgctttaggtgtagatttcgaaacaaatgttgttgtaggacgttcaattacaattgatgaattacaagaacaaggatatcaaggaatcttcgtaggtagtggtgctggtttaccacgtttccaaggaattcctggggaaaacttaaacggtgtttatgcagcgaacgaattcttaactcgtgttaacttaatgaaaggatatcaattcccagatcatccaactccagttaaagtaacagatacagtatgtgttatcggtgctggtaacgttgctatggatgctgcaagaactgcaaaacgtttaggagctaaaaacgtatatatcgtttatcgtcgtggacctgaagaagttcctgctcgtgctgaagaagtacatcacgctaaagaagaaggaattatcttcaaactattaactaatccagttaaaattgaaggtgaagatggatgggttaaatctatggaatgtgttgaaatggaattaggtgaacctgatgcatctggaagaagaagaccaattgctaaagaaggatctaacttcacaattgaaacaggaacagttatcgttgctattggacaaagtccaaacccattaatcagacatacaactcctggtttagattgccaatcttggggtggaattatcgttgatgaagattcaatgaaaacatctaaagatggtgtttatgcaggtggagatgttgttactggtgcagcaacagttatcttagcaatgggtgctggtaaaaaagcagctaaagcaatggatgaatatctacaaaataaatagtatttaaaaagtcaattcacattacgaattgactttttctttggctgtcattaaataactaattatattttctattaatgttagaactataatcatatttatttttggaattagaaggcaaatgacttcaatgcacattgttaattttgcttttttatttaaatatttaaaatatttgctcattactagtaataatacaaatagtataaataaaaatacaaggaaataattacttaaatgttgatatgttagtatagaaataaggtaaacaatattagatgtaataaaacatttaattggactattacaatgatagccacctaaatttactcttaagccagaaaataaaagcatccaataaatcagattcaattttacatctatcataatcataaaaatcattttctgaataaagttcaactaacgtataaataccttgacctttgatatgcaaagttatttcattatgtcttttaacataatctaatatttcagaaataacatcaataaaatctaaatcatcatatttttcattttggctaatttcaaagaaaggtttaatacttatattatcatcttgtaacctattgatttttacagaaatcaaaatatcaaataccggatttttagatgcaactaatttttggtaagtgtttttagattgatattgttcaatagctttggatatttcagtgtttgtatcgttgtttaagtgtttaatgtgttctaatatccaatgaatacgatgtttcttatcatcaatatcataactaatgttttgtatgagacgtaagctttgttttatatatttttctttttgtaattgtttttcatattgcatcttttcagtataaaccatattaaagtaaacaccattaagtataattaatataaaaattataaataatagaacaataataagtatttctgcatagcttacatatgcatctactgtagaataaccaataattcctaaactaattaaaactattatttctgtgatgacaactaaaaagtattgtttatttggaacatatatttgatatctaagatgttttattaaccaataagtaaagagaatgagtatgatttttgatataattccaactaaaatataaattgttgaaatgtttaaaattaatgtttgtttcaaaaaatagtatattaaaagcggtaaaatattcattgaaaatatataaaaacctaggataaacaaatcactaaaattaaacacttttttcttatacaagataaatccataacagactataaaattaaatgacattaatacaataccgttttctcttaagatatcacatatttcaaaaccaaataataaacaacaaaataataatacaaatgttttcttatttgaaaatgagtaataaaggtaaacgaaagcagtaagtgtaaatacttctacaaaattaagaaatatactataagctaccattgagtaaataatcctgataagttagtttaaatttctttttatatgttttacctatattgatttctttcttatttcttaagatgatgaacttggaatttacatcatagacaaaatctaaattaataagataggatctatgtacttgtatgatattgttattattgagttgagttttaagttcttttattttttctttgaatttgtattcaccatctagtgtgacaatttttaagtaatgaccatcagcttctatgtagataatatcactggtattaatacgtacgtgtttttctctagcgttaatgactataaaacttgtgttttctaaatgttctttaaacattttaaagaagatagacatgtcttcatttaaatgatcttttctaatgaaataaaatggttgaagttccatggatttatgaacaaagttattgttcatggtcacaaaaacaataagtgctttgggaaacctctttttaagttttatagaaaaatcgataccatttattgatttacttaaatgaacatctataaaaataatttggtagtcttttgtgttatcaatctcttcaaagtgatcccctagacaaaagaaatgggcatcagcgaatagattgttatttttgagtatatcaacaaactcctctacaaaagtatttgtatcctctaatatcaaaatattcataatgatgccaccttccttatttgtttaaattctttaattgttcaggtttttcgaattcataaaaatccatacttgataatgatgaagcattaccgtatgcaattccctttaacaatgtaaagtatttttcaattaaatagtttatcataattacctccttaagtgtactttatatttgacacgaatataaagtcaatagaacgtgcatgaaagagtatgtaccgttcctgaaggtatcttttataatgcgtaaaatgcacgatttaattgttaacatgaattaaaagggtgacggataatgaatgttaatgagataattatgaataaaagaatagaaagaggcgtttctagaaaagagcttgcagagggcttaggagtaagtgagagtactatttatagaattgaaacaaatcctaatttaaatcccaataataaattagtaaaaagaatttatgatattttacgtatgaatgtaacgattattgtggatgatgcaccaatatatgatgagcatgcacatgagatagattttgaatcatatagtcctacaagtaaaagtattatttttaaaacgattgcaaaagaagaaaaaatgaagaaattaaaagaaaaatagttatctgattgataactatttttaggctaatgtgatttttgtaattgtattgtttgaaagcgtgtaggtcattttaactgttttattttcactataggcaatatattgattgttcgcttctttgtgattttcgtaatctaaattatttttttctaaaccaacgtagaaattaccttcaactttgtaatgatctgtaaagagttctacttttttaactttattctttttatttaaagtaatttgaatagaatcattataataaactgtatcattattcttttttgattctatatactgatcaccaatataatcatttatatgatttatcttagaatcctttgtaattccacgaccatcttcaacgataattgtaaaaccaatatcattatttgtaagaagttcttcggttttagtgtcttccttttttgaacaaccacataataataaaataaaacaacaaataaagagtattttagatttcatagaattcctcctttagataattgtactaaatatttgatttttattaaagtaaagattcatagacaaaatgttaatccttagagcatatcttcttcttatttcatgttatgatgaataaaatgaggaaagattctatgacatttggagaacgtattcaaaaatatcggaaaatgaagggattatcgcaagaagaattaggtaaattaccgcatatatcaagacaaacaatatcaaaatgggaaagtaatctgtcatcacctgatatacaaagttgtaaggctatggctgatgtttttggcatctctttagaggaacttttagatgaaagcaaaaaataaaaacggatcaaagtactaatcatcgaaatatgattattatctttggaattgttgtttttctagcatttattatggaaagttatgtagcagttaagatgagtgagaaaatggatgcattggaagaagcaaattcttcgttgcaacaacaaatcaatgacttttatggtgatcaaccaatttcactagatacaaattctatttgttcttattttagtggttatatcagtgatattaaaaaggatagttataatataaatattgatttgattttaaaaaattatcaagataatacaacagcataagttatttttaaaacggataaagatacatatacactttctttaaataaagaagaggatcgttttaatggaacaataaatcttcctattcaaacccttcaatttgcacagcttatttcacaaacaaatggtaaaacaaattcggaagtattagatatagatgtgaactttgaaaactatttagatgaagatgctagtggtggaattatgttggaaagttataatgaaaaaaagaacaaaggtgattttactctttcatttagtggaaataagacaaagaaagatgaaatctatttgtgggataaagaatatattgaatttgaaaaaacatatgcatgtaaaaatataaaaaaagaagatactgtgatggttgaatatacgtatacaaatgaaatgggaataaaaaagaaacaagaagtaacaactcaacttaaaaagaattggcaaggatattatttggcatggaaataaaaaattagtatgataattatattttaatttatttaattcccaatcattatcttatataatctttctatggatagagcgaaattgcttataggaggccattatgaaaaaagatctacttatgacaattcaatataaagacatgggccctttttcgctttttattttttaatttgaaacatatcttttctaagatatgttttttttacaatcaaaaggaggattaaagatgccaaaaagagaagatattaacacagtattagtcattggttcaggaccaattattattggtcaagcatgtgaatttgattattcaggaacacaagcttgtaaagcattaagaggattagggtataaaattgttttagtcaattctaacccagctacaattatgacagatccagaaactgcagatgtgacatatattgaaccattgaatgtagaaagattaacacaaatcattgaaaaagaaagaccagatgctttacttcctaacttaggtggacaatcagctttaaatctatgttctgaattaagtaatgccggagttttagacaaatatgacgttcaagtattaggggtaaaagtagatgctattgaacgtggagaagaccgtttagaattcaaaaaagccatgaatgaacttggtattgaaatggcaagaagtgaaattgcaaatacggttgatgaagctttagctattgctgataaattaggatatccagtagttgtaagacctgcctatacaatgggtggagcaggtggaggacttgtttacaatgttgatgaattaaaaacagttgtaaatagagggttgcaagcaagtttagtacaccaatgcttaattgaagaatctattttaggatgggaagaattagaattagaagttgtaagagatgctaaaaataacatgattacaatttgttttattgaaaatattgatccattaggagtacatactggagattctttctgtagtgcaccaatgcttactatttctaaagaagtacaagatcgtttacaagaacaagcttatcgtattgttgaatcaattggagttattggcggtacaaatgttcaatttgctcatgatccagtaacagatcgtattgttgttattgaaatcaatccaagaacatcacgttcatctgctttagcttctaaagcgacaggtttccctattgccttagtttcagcaatgttagcggctggacttacattagatgagattccttgtggtaaatatggaacgttagataaatattatcctgatggggattatgttgttattaagtttgctcgttgggcttttgaaaaattcaaagctgcagaagataaacttggtacacaaatgaaagctgttggggaagttatgagtattggtaaaacttataaagaagctttccaaaaagcaattcgttctttagaaacaggacgttatggtttaggatatgcaaagaactttaatgatttatctaaagatgaattattaaaattattaattaatccaacaagtgaaagacaattcattatgtatgaagctttaagaaaaggagctactgttaatgaattatttgaacttacaaaaattaaacattatttcattgaacaaatgaaagaactcgttgaagaagaagaaaaaattgcttcttataaaggaaatcaattaccagatgacgttttaaaacaagcaaagaaagatggatttgctgataaatatatttctaagttattagatgtagaagaaaaagaaattagaaatcaaagattagctatgggtatgcatcaagtctgggaacctgttcatgtatcaagtacaaaagatagttcttattattactctacatataatggaaaagatcaagatgaagtttcaaataataagaaaatcatgattttaggtgggggaccaaacagaattggtcaaggtattgaatttgattattgctgtgttcatgcttctcttgccttaaagaaattaggatttgaaacaattattgtaaactgtaacccagaaacagtttcaacagattatgatacatctgataaactttattttgaaccattaacattagaagatgttttaagtattcatgaaaaagaaaaaccactaggagttattgctcaatttggtggacaaacaccattaaatcttgcaagtcaattaaaagaaaatggtgtaaatattttaggaacaacacctgaaactattgatatggctgaagatcgtgatttatttaatgaaatgatggaaaaactagaaattccaatgccagaatcaggaatggctgtaacaatcgatgatgctttagaaattgctcaaagaattggttatccattaatggtaagaccatcttatgtattaggtggtagaggaatggaagttgtttatgatgatgaatcattaaaacaatacatggctgctgctgttggggtaacacctgatcgtcctatcttaattgaccgtttcttaaatgatgcgatggaatgtgaagcagatgctatttctgatggagaaaatgtttttgtacctgctgttatggaacatattgaacttgctggtattcactcaggggactcagcatgtattttaccatctaaacatattccagtaagacatgtacaaacaataaaagaatatactaagaaaattgctagagaaatgaatgtacgtggtttaatgaatatgcaatatgccattgcagatgataaagtttatgttttagaagcaaatccacgtgcttcaagaacagtacctttagtatctaaggtatgtaacatcaacatggtaaaacttgcaacagatatcgttacacgtgaacttacaggtagaccatcacctgttaaagatttaaaagatagaaagattcctcatattggtgtaaaacaagctgttttcccattcaatatgttccctgaagttgatccaattctaggacctgaaatgagatcaacaggagaagtattaggtttagctaattcttatggagcggctatctttaaagctgaagaagctactcaaacaaaattaccaacatcagggcgtgttttaatttctgtctctgatagagataaaaaagatgttgttgctcttgctagaaaatattatgatgcaggatttgaaattgtggctacaggtaaaacatttgaattaatcaatagcaataatattccagctatcaaaattaaaaagatcaaagaaggtcgtccaaatattgtagatgctcttacaaatggtgaacttgatatggtgatcaatacgccacatggtaaagaatctgcacatgatgatagttatattagaaaaacagctattaaaatgaaaattccatatatgacaaatattgctgctgcaaatgcagctgtagaaggtatcttagaagctgaaattcatggaacacatgaagtaaaatcacttcaagaatatcataaagctattaaagactaagatacatgattgttaggaaattatctgatttcctaacaatttttttatttttttcaaaaaaagaacagataagtaggaggactacttatggacaaaataaataaaataacaacaagtaaacaaacaacaatgtatgatcatttatacaagatgatcataggaaatgaagaagtattatcaagaatcataaaggtagttgtagatgaagcaaagtatttaagttttgaagaaattagaagactaataaaaggagtacatataggtgatagaatggtcaatccacattttcatcttgtagataaggaaggctttatcaaagatgaaggagtggtttattatgatattttgtgttatattgatgtgccacaagaaggtggaaagaatatacgggtctatttaaatgtagaaatacaaaaaggatattctattattactagtggctatgcttatgtctccaagatagtgtcaggataattggaaacagagtatgatgataaaaactatgatggaatgaagaaggtctattcatgctaaaggcacctaaaagaaaagatggtcatatgaatgcctatgaaacaaacgaaaggattatttgtggagcaacagtagaagaaaaagaagtttatgacaaggaagttattcttgtggtatactcaaacaaagaacatgatttaaataaaaagtaagtatatgatgaattattgacaccattgatggcctttttaaataatgtattagattataatgggaaacaaagaattatagaatgatacaaagaaaatagaaagtgaggttaaagatatttgtgatttaggtgaaagcattgccttagaagcaagaaatgaaggcaaacaaatagaacgtaaagaaaagaatatagcgcatgtaaaaaactaatgataggattacaaatgtcatttaaagaagcaattaacttattagaaatacctgaaaaggaagtaaaagaaatagaaaagtattttcaatcatagaaagagagaaaaatctcttttttcttatactaaaaaattgttaataaaataaaattacataataataaaaaattataaattggtgttgaaaaatgttgtcaaatctactatactattcaagaacaaaaggagatgagggttatgttacaacaaagtgtcaaatatgattgcttacaattgaatacgagtacctcatttttatattctcattgtttctaacatatcatttttaattgatatgtttttttataacaaaaaaaaggaggaaaatatatgaaagcctatttaatcttagaagatggaaacgtatttgaaggtgaaagcgtaggggctaacaaagaagttgtcagtgaatttgtatttaatacttcaatgacaggatatgtagaagtattaacggatccttcctatgcaggacaatcagttgttatgacatatccattaattggaaactatggagtatgtttagaagatcaagaatctacaaaaccttatgttgaaggatttgtagtgaatgaacttgctagacttggaagtaattttagaaaaaatattgatttaaaagattatttaattgaacatgacattccttgtattcaaggaatcgatacaagacatttaactaaaatcattagaaataaaggttgtatgaatggaatgattacaacaacaaaacatgatgatttaagtgaagtgatggaaaaaatacataactttaaagtaactggtgtcgttgaaaaaacaacatgtgacaaaccatataaagtaggaacaggagatcgaaaagttgctttattagactttggtgctaagaaaaatattgctaaatcattagcaaatagaaatatggaagtcacagtttatccagcatctactcctgcaagtacaatcattgaaggaaactatgatggagtgatgttatcaaatggtcctggagatccaagcgaaaatgttgaaatcattaaagaagttaaaaaactatctgaaagtggtttgccaatctttgcaatctgtttaggacatcaattgatggctttagctcatggatttaaaactgaaaaattaaaatatggacaccatggtgcaaatcatcctgttaaagatttaaatacaggtcgtgtttatatttctacacaaaatcataactatgtaatttgtgatgattctattgatcgtaatattgcaaaaccttggtttattaatgtaaatgaccaaacaatcgaaggtgttgaatatatgggtaaaaatattaaaacagtacaatttcatccagaagcatgtgctggtccattagatacagatgctttatttgatgaatttgaaaaaatgatggaggtaaaataagatggcaagagatttaagtataaaaaaagtattagttatcggttcagggcctatcatcattggtcaagcagcagaatttgattatgctggaactcaagcttgtagagctttaagagaagaaggggtagaagttgttttaattaactccaacccagcaacaatcatgacagatggtgatatcgcagataaagtttatatcgaaccattaacagttcctgttgttaaaaaattaatcatggaagaaaaaccagatagcattttaccaacattaggtggacaaaatgcattaaacatcgctatggctttagcggatgaaggattcttagaagaacacaatgttcgtacaattgggacaaatacagatacaatcaaacttgcagaagatcgtttagaatttaaaaacttaatggaaagaattaacgaaccatgtgctgcatccatcgttgttaaccatgttaatgatgctttagaatttgcagaaaaaattggttatccagttgttgtaagacctgcttatacattaggtggtactggtggaggtatcgcaaataatgaaaaagaacttcatgatatttgttcaaatggtttacgtctatcaagagtaagtcaatgtttaattgaaagatgtattgctggatggaaagaaatcgaatatgaagtaatgagagatagtgcaggaaactgcattactgtatgtaacatggaaaacttagatcctgttggtgttcatacaggggatagtattgttgtggcaccaagccaaactttatcagataaagaatatcaaatgttacgttcatcagctttaaatattattacagctttaaatattgaaggtggatgtaatgtacaatacgctttaaatccaaatagttttgaatactgtgttattgaagtaaaccctcgtgtttctcgttcatcagctttagcttctaaagcaacaggttatccaatcgctaaattagcagctaaaattgctttaggatatactttagatgaaatcaaaaatgccgttacaggtaaaacatatgcttcttatgaaccaacattagattatgttgtatgtaaaattcctaaatggccatttgataaattcgttgatgcttcaagaaaattaggaacacaaatgaaagcaactggagaagttatgtcaatctgtaataactttgaaggagctttaatgaaagctttacgttctcttgaacaaaatgttttctacttacacttagatgcctttacaaaattaacacatgatgaattaaaacaaaaattaaaagatgttgatgatcaacgtatctttgcagttgctgaatcattaagaaaaggaattactgaacaagaaatccatgaaattactaaaattgatgtttggttcattgataaaataaaacatttagtagaaatggaagaaagaattaaaacagaagaattaacagttgatttattaaaacaagcaaaaagattacaattcccagatagagtcattgctgaattaactggaaaaacagaacaagaaattcatcaaatgcgtaaagataataatattgttgcagcttataaagttgttgatacatgtgcggcagaatttgatgcacaaacaccttattactattcaattcaaggtggagtgaacgaagtagaaccacaaagagaaaagaaaaaaatcatggttttaggatcaggaccaattcgtattggtcaaggtattgaatttgattactgttcggtacattgtgtatgggccttaaaagcagcaggatacgatacaattattgttaataacaaccctgaaacagtatcaacagactttgatattgctgatcgtttatactttgaaccacttactgctgaagatgtagaaagtattgtagacattgaaaaacctgatggagcaatcgttcaatttgggggacaaacagcgatcaaacttaccaaagcacttacagatatgggtgttaaaattttaggaacagatgctgatgatgtagatgctgcagaagatagagaaagatttgatgaaattcttgaaaaatgtcatattgatcgtccaagaggttcaacagtctttactgcagaagaagcaattgaagttgctaataaattaggatatccagttttagtaagaccatcttatgtattaggtggtgctggtatggaaattgccttaaatgatggtgatattaaaaagttcatgaaaatcattaatagacaataccaagaacatccaattttaattgataaatacttatctggtaaagaagttgaagttgatgcagtttgtgatggacatggtatcttgattccaggtattatggaacacgttgaacgtgcgggagttcactcgggagatagtatttctgtttacccaccacaaaaaatcaaacaagaaattaaagatgtgatcgttgattatacaaaacgtcttgctaaagcattacatgttgtcggattaatcaatattcaattcattgtttatgaagatcaagtttatgttattgaagttaacccaagatcttcaagaacaattccttatatttcaaaagttacagatatcccaattgttgccattgcaacaaaagcaattatgggacatacaattgaagaacaaggatattcttatggaattgttcctgaaaaagaaacaattgcagttaagatgccagtgttctcatttgaaaaaatcaaaggtgcagaaatttctttaggacctgaaatgaaatcaacaggagaagttttaggtatttctaaaaacttagatgaagctatttataaagcattcatgggaacaggtattcaattacctaagagaaagaatatcatttgtacaattaaagattcttctaaagaagaattcttaccaatcgctaaacaatattatatgtttggttatgatttatatgcaacagaaggaacatataaattcttaaaagaacatgatgtacctgtacattttgtcaatcgtatttgtgaaaaaacaaatacaatctttgatttaatgtttacggatacagttgatttagtaatcgatattccaacaagaaatgataacttaaaagatggtttcttaattagacgttttgctgtagaagctggtattccaatttatacttcacttgatacagcaaaagcacttattgattcacttgaaaaacgtaaacatggtgtgccatcgttaattgatattacaaaactaagataattaaaaaatggtcgaaagaccatttttattttggcataattttaaggagtattttggactatctgtccatttataaaaaaatatatttttctataatgaaagaaggaggctttttatgaatcaagaaaatacttcttttgaaaaacaaaaaaactgattgcaagaagaaatgctctcaaacttttctttattcgtttccctaatgtagatccaatttttttagaaaatctatcaaccaaacaatatgaagaactctttgatttacttttaataggtaagaacttagacgaaataaaaaaggctattttagatatagcctaattctttacatgcataataaataccatcttcatcaatagaagttgtcacaaaatcacttaatttctttaactcattatttccttgtcccatacaaatcgaaaaagaagcatgtttaaacatttcaacatcatttaaagaatccccaaaagccacataacttttcatattccataacttcataaaataagcaatgccagttgctttagaaattcctttaatagtaatatcagcataactactttctcctaccatcacatcaagttcttcaatatctttaaattcttgatagtcataatctaaaggaccataagcaatcatggcacctacttcttgattggtatagctaccaacagggggaattggattattgaaataattacatgaacgaatgacatcttcattgggttccatattaataattcttggtgtacatttaagagctaaaggaatgttgtgttttttagaagcgtctaaagcttttaaaacaacagttgtagataaactttctttgtgaataagttttaaatttttatctaataaagcttgtccactattgcatacatacccatcaaaggcaaaagtatcataaatgtgagtattctttaaagagtcaacacttctacctgtagatactaataaaagatgacctttttctcttaataaatttaaggctttgatggtactttctggtatttgatgatctgtggtcgttcttaaagtaccatcaatatcaaaacaaaacaatttcttcattatttaccttgagggaaaaattttgcaagtgaatttgctactgctgaaataggcattgtttgaaccacaattttaccaggaccagtaaccacggtattaaataatccctctcctcctaaaaatttattttttaaaccaggaactgattggatatccattttacaagtagcatccatcattgcaagataaccggtatcaataaccatttgttgacctggtagtaaattatattctacggtacttccatcaatttcaataaaacatgttccatgtcctgaaacctttgttaaaataaaaccttcaccaccaaatataccagaagaaaatttcttattaaagaaaaccgatgtttctacattttcttcactagctagaaaagcagatttttgaatgatgacttcttttccaggatctacatcaatagcgacaatttttccagggaaacttgaggcaaaggcaatcaaaccatcttcatttgccgtataactatttctaaataaagtttcaccagaaaacattctaccgatgattttaccagcaccaccaccgtttgtttccattttcatacatggatccatccaagccatagcaccactatcactaatcattttttcacctttatttaagtgacaaataacaacagggagagtatctccaacaatttcgtatttcataatctttctccttttataaagctacacaaacaggttgaataatatctaaagtatttcctgtaggcttaatttcttctttttcttcatcaaatgtataaagctctaaaaaatcttcttcttgacttgcaacaacaatataacgatcatcaataatattaaaatcacgaggtccttttcctgtatgcatcatataaagtaaagtgatttttcctgtttcttgattaacgcgataaaggacaatactatcatgtccacgattggaaacaataatatgtttaccacttgatgtcatatgaatagcagcagcacttgaaaagccatgaaaatgacgaggtacacaatgaataacttgaatcaaagtaaagtgtccatcatgatattgataaaccataatactgttactaatttcattgacgagataacaatatttaccatcatgagaaaaaatcatatgacgaggcccactaccaggaatcacagattgacttaatgatgtttcttgtaatttttcattaataaattcatacataacaattttatcagcacctaggtcaacactgtaaagatatttatgatcaggagtaattcctacataatgagcatgaggacttgtttgtcttttaagtaaatcaattcctgaaccatgatggtgaacaactgaaagtttatctccaattttatgatcctttaaagggaaagcagctgttgctccaacgtgataattggctgtaaataaatatttttgatcaggacttaaacataaatgagtataagaacgaccatgggaattataaaaagaaagttgttttaaatcatcttcttcaatatgataacttgcgacacctcctccttcaccaacacgtgcatcttttaaagatacataaagataatcatcttttttaataacataagaaggaaaatcttcggtaggaatatgtttatttaaatgaagttcatttttagtttcatctaaagtacatacataaagacctttttcttttcctttagcgtaacttgatacataaaaacgatacacaaaatcgcctccttttgaaacaattgtaccataaaatgactataaaaagctttctatataagaaaaaaaaaagagatgcatgaagcatctcaaaatcttatttttgcccaatgcctttacaataagtttgtacaacttcataatctctatctaaaacaacaagatcagcatcataaccaacgccaattgttcctttacgatcatcaacatgtaaacatcttgctgggtttgatgtacatgcattgatcgcgtaattaacaggaactaatgcatcttcaattaagatttttaatcctttgtttacatttaaagtagatcctgctaagttaccagcttctactaagtgtgcactaccatctggataaatgacaacttcttgtccaccaaaatcaaatttagtacctacaggaaatcctttacacattaaggaatctgtaatcataatactataatcaggaccttttgaagtaaagaaattatttaaagcggcaagagtagaatgatttccatcacaaataatttctccatacatatttctaatacgtaaagcaccaccaacaagaccatttgcacgatgcgtaaatggtgtcatcgcattataaacatgagtcatacttcttgcaccatggccgtatgcttgaacagcttgttcataagttgcatttgaatgtccaatacttacgaccacattattttgactacaatattttgtaagagcgtaatcttcatcattttcaacagccatagtaatatatttaattaaaccatgagcagctttttgatatcttttaaattgttcaatattaggttttacacaatattcttcaggttgagctcctttatgtgctttatttaaataaggaccttcaaaatgaatacctaagatttcagcaccttcataaccttcttccacaacttttgcgacattacttaccgcatttgtaagaacttcttcactttgagtaagagttgttgcaaggaaagaagtaactccttcatcaacgattccttttgcccattttcttaatccttcaggatcagcatcatttgtatcaaaaccataagctccatggcaatgaatatcaataaagccaggaagaattcttaaatctccataatctttcgtaacttctttttcattgtaaggatatatttctttaataattccatcttctaattctaattgtgctggcgtgaattgatccgcaatccagacttttttactttgtataatcataatttcacctcatatttattatagaacactttacttatctagacaagcaacaactcctcttatttctaataaaaattcaatttaccttgcctctaaattagtatataattagagtcataataaggaggaagaggatatggatgaaaatttacttttatcattaattgaaaacaacgcgaaaatggaagtcgttgatcttgcggccgccttaaacgaaacagaagaaaatgttgataagacaattaaagatttagaaaaaaataaaacaatctatggttatcatactttgatcaattgggataaaacaaaccacgatgtgtgtacagctgtgattcaagttaatgcgaaacctgaaagagattatggatatgatcgtattgcgaaaaaaatctataattttccagaagtagatacaatgtatttattagcgggaaattatgagtttttattaattgttaaaggaaaaacaatggtggaagttgctaaattcgttaatagtcgtttagcggttattgaaggtattgaaagaacagccacaatgtatgttttgaaacaatataaaaacatgggtagacttgttgaggatgataataaagatgcagcagaaagattattggtaactccataatggattttgaaaaaattgttaatcctgttgtaaaagatattccacctagtggaattcgtaaattttttgatttagctaatcaaatggaaggtgttatttctttaggggtaggtgaacctgattttgcaaccccttggacaattagagaagctgcaatctattcaattgaaaaaggaaaaacattctatacagcaaatcaaggattattagaattaagaaaagaaatttgtaaatatcaaaaaagaagatttaatttagattataaaccagaacaatgtattgtcactgttgggggatctgaaggaatcgatttagcctttagaacaattattaatccaggtgatgaagtcattttattacaaccaagttatgttgcttatacaccgggtgttgcacttgctggtggagtggtaagaaacattactttaacagaagaaaatgaatttaaattaacacctgaacttttaaaagaagctatcaatgaaaaaacaaaggccattcttttaaactatccaagtaatccaacaggtggatttatgacaaaagaagactatgaaaaattggtgcctatctttaaagaatcaggaattatgatcataactgatgaaatctatgcagaactttcttatgaacataaattctgttcaattgcatcttttgatgaaatcaaagatcaagttattcttgtcagtggtttttctaaagcttatgcgatgacaggatggcgtttaggttatgttcttgcgaatgaatatctagttaaaatgatgaaaaaaattcatcaatatgtcattatgtcagctccaacttgtgctcaatatggagccattgaagcgatgagacattgtgatgaagaaattgaaaaaatgcgacaagcttatcttgcaagaagaaacttcttagtcaaaacatttaatgaaatgggacttaaaacatttacaccacaaggtgctttctatgttttcccatgtattaaatcaacagggcttacatcagaacaattctgtgaagaattattaaatgatcagttagtagcctgtgtgccaggaagtgcttttggtgaagcaggagaaggatatattcgtgtttcttatgcttatagtttagaagaacttaaagcagcaacaaagaaaattagaaaattcttagaaaataagggagttatttaactccttttttttggttttaaaacagatacaaattaatcataaaaatcatcatctccctataatatagataaagaaaaggggatgattttaatggtagttaaaagttatgaacaaatgacagatgtatcaattatggaggtaaaaacatatttattaattcatagtaccggaatttatcaacaagatatttatgatttaatgaatacgtgtattgatgtttttcaattaaaaagaaaattaaataaaagaaaagatattcaattatggcttttttcaaatattaaaagatatattgattgttgcttatcttataatgaaatggaatatcatttagtcatgatgaatttattaatcaatcaacattttaaaccattagtcgaatataaatataatttattttattatattttagatcatagtgattttaatatagaaatttattgtctagtaaggcatttgcttacatttaaaatgaatcaactcaatcaagtcattttaggtatgacacattataaaatgatgagtgatgaacaaatgcattatcaagcaagtcttattcttttattagaaaaacaatataaacaagcttattttcatttaccatttgtaacacttgatgaagcctttaaacgctttgaaaaatctctttataattattcaccatatcgttatgaaatgttgtatcataaagacaagacatattcacttaattatgcaagataggagaaaactatggacagactctattacacatatcttattatcaaagaatcattagattatatacctgctattgaaataaaagggcaacttgaagaaaaatatcgaatcaaagttgatgttaaaacggtttatcaagctataaaaaatattaatgaattatcgaagtatatttatcaaaaagaaatcattaagactaaacatcgtaaaggctatacaataaatgaagaattctttaatgatggacaaatacaatatttatgggatagtattctttataataatgatttagatcaaaaagaagtaaatatactacttacaaaattacaaacattaagttcaaataaacaattatctcgtattcaaaatcaaacaattagacaaaatgatataagaaattatgatttgctattaaatatgacaaccattattaaagctattaatgaaaagaaaaatatttattttaagtatgttaattatgaaataaaaagaaataggttggtagaaatatcaaatatccatggtaatcatcaagataataaagaattttatattatttctccgtataaactcattcaaaataattctaaatattatgtgattggttattttgataaaagaccagatagtttatctctttatcgattggatcgtatgagacttgtaagaaatcataaaagtaaatattttgaaggagaacaatttgatgtagaacaaattgataatccaattaatatgtatatttccggagaaaaagaagatttagagattagttttgatcaatcgattattaaagaagtggtagataagtttggacaagataatcgtgtgacaaaggattatgaaaatcgttatcacttaatagtaaaagatgttttaattaatgaaggattaataggatggttaatgatgttacaagataaaattacagttattaaaccttattctttacaagaagaaatgaaaaaaagaattgaaaagacattaaaacaatatcaataggagaaattatgatttatataacaggtgataagcatggagattttagtgaagtttatgcattttgttgtaaaaataaaacaacaagagatgatcttatgattgttttaggagatgcaggtattaactattacgccaatgaacaagatatttatttaaaaaatagtcttttacaatatccaatgactttcttttgtatacatggaaatcatgaagaacgtcctgaaaatatagaaggctataaaacaaaaatatttcatgctgggcttgtatattataagaagaatatcctcatatattatttgcgaaagatggtgaagtgtatcaatttaatgaacaaagtgttttagttattggtggagcttatagtgttgataaaaactatcgtctacaaatgggatataattggtattcaagtgaacaacctagtgaagaaataaaagataaacttttaatgtatgtagaaaagaatccgcaaatagatgttgtactttctcatacttgtccttataaatatcttccgcgagaagtgtttatgaaaagtattaatcctttaaaagtagattatagtacagaattttttttagataaattagaattaagattagattataagaaatggtattgtggacattttcatactgataaaaagatagattgtatgatatttatgtttaatgaaattgttgaattttaaaaagctgctacaaatgtaacagctttttagataggaaatattttattattgattattgaatactttaggtaaatcttttgtttttttccaatcaagatcttttatttgtttaagaagtggttgatagaattgttttttgtcttttggataaatagcatagtagttaacatgagcctctttatctgtgattggtattaaaatacgcttatcttcttcattgtctctttgtattgtaatattacttttaaaattaggcaaagcagacatctttgtaagttcattaaagacaaagggatcatcttgaaataacaaatgagatttaggaatcatttgtttacatacttcattccaaaatccaatatgtgataataaaagaacactttgtccatctaaatcagaaaatgaaatttctttaaatggtgctaaaagatgtgccggaggcacagataagtaaagcgattcatttaagaattcttggcaaatatagtttttattatctaaaggatgtgttaatacaattaatgaatagtctccattttctaaaccatcaatgagtgtttgctcatcttgaataagataactttcaaattgtgaatttgtatttgtttgaaaagtatattcaattccccataaaggagcaggtgcacagctagcaaaagataaataattttgattatgttttgtcagttctttgatcatttcttctctaccatcaagtaactttttcgcaaattcaaccgcaagtaaaccattatcatttaattctattttatttttcttacgattaaataacgataaacctaaatcttcttctaaacgttgcatggattttgtaaggccaggctgagaaataagaagttcttcagctgctttagaaatcgttttattttttgctatagcaataagatgtttcaattggttgaattcaatcattgtatcacttctccttttccgtattataacacagtataacttttggttatagtgatatttgtttttagtcatgtacaatgggataaataatgattaaaataatagtaaagaaatggaaaaagaaataagatgaaagtacttattattaatggtagtcctcgtcctcaaggaaatacaaaagttgctttagatgaaatggtgaagattttaaaatagaaggaatagaaagtattaatcaaaataaagaatatatgacttttagagattttgcttcacctgatgatatttattattcatctcatttttcaaaggttaatcaagatgtaaagattacttctttttctgatcataacttattatatggagaatttaagtttaaataaaatagtataactgaaagttatactaatatgcattattcatattgtactttttagtaaagtaaaactaaaatataaatgaaaacaaggaggaatgacaatgaaaatatttgaacttaataacaaacaaacaattccagcagtaggatttggagtctttatgattcctaatgatggacctacttatgatgcaactttagctgctttaaaagcaggatatcgtcatattgatacagctgcaggatatatgaatgaaagtgatgtaggaaaagcgattaaagatagtgggattgatcgtaaagaaatctttattacttctaaattatggttacaagattatggttatgaaaatgcgaaaaaaggtattgaaacttctttaaaattattaggagtagattatattgatctttatttattacatcaaccatatggtgattatttaggagcttggaaagctttagaagaagcttatcaagaaggtaagattaaatctattggtatttctaatattaccgttaatttatggaataaatttaaaaatggtatgactgttatgccagctgtaaatcaagtagaatttaatccatttgttcaacaaaaagaattaagaaaagtgatggctgaaaataatattcgtttagaagcttggcatccattaggacatggaaataaagaattattagaaaatgaaacaattgtagagcttgctaaaaaatataataaaaatgcaggtcaaattattttaagatggatttatcaagaaggagttatttctttacctaaatctacaaatgaagaaagaatgaaaggaaacattgatatctttgactttgaattaacagatgaagaaatgaaaaacatgcaagccttagatacaaataaaccatctcataatcctgaagatcctgccaacgaaacacgtttaatgggattaaaaattcatgactaatttcattactttaaataatggataccaaatccctcaacttggatttggtaccattcaacaatttggtaaacaaattgaagacaatgtagcttttgccttaaaccatggctatcaacttattgatactgccaatcgttatgaaaatgaagttgaagtaggtaaaggtttaaaattatcaggattaaaaagagaatattattttttagaaacaaaattaggaccaacactttatgaaaacgatcaagcaattgatgacactttaaaaagattaggtgttgattatgttgatgtgatgattttacatcatcctgttaataactatatttatgcttataaaatgctagaaaaagcgtataaagcaggcaaaatcaaagcgattggtttatctaactttagagttgaacaaattcaagaaattttagatcaatgtgaaattccaccaatgatcatgcaagtagaatgtcatccttattatccagcagaacatgtttatgatttttgcaaggaacatcatattcaacttcaatcatggtatccactaggacatggtaatagtgaaatgttacaagaacctgtgtttgttgaacttgccaaaaaatatcataaatcaacagttcaaattgttctaagatggcatcttcaaatgggatttggacttgtaccaggaagtaaatcaatggatcatattaaagataatgcgaatatctttgattttgaattaacagatgaagaaatgaaagaaatcgaaaaagtgaataaacataccccattttataaagtgactaaagaatcattgcacaaaatggcgacaacaaaatgtaattttgaataaggagaataacaatggaatacaaaacattaaataatggagtgaaaatgccagttgttggttttggtgttttccaagtgaaagatgaagaagaatgtaaaagagttgttttagatgcgattgatgcaggatatcgtttaattgatactgcacaatcttatggaaatgaagaagctgtaggtaaagcaattcaagaaacaaatgtccctcgtgaagaattatttattacgacaaaagtatggatttctaattatgggtatgaaaaggcaaaagcttctgttgaagaatcattaaagaaaatgcaattagattatttagatttagttttattacatcaaccatttaaagattatcatggagcttatcgtgctttaattgatttatataaagaaggaaaaattaaagctattggtgtttctaacttctatccagatcgtttagtagacttagctttagatacagaagttgtaccagctgttaaccaagtagaagtcaatccattccatcaacaaggtgcagctttaatttacaatacaaaatatggtgttcaattagaagcatgggctccatttgctgaaggtaaaaatggtattttcacaaatgaaacacttgtagaaattggtaataaatataataaatcagtcggacaagttattttaagatggcttgtacaaagaggaattgttcctttagctaaaacagtaagaaaagaaagaatgcaagaaaacttaaatatctttgattttgaattaagtgaagaagatatgcaaacaattgcttcacttaataaagatacaagttctttcttttctcactatgatccagcaactgtagaaatgatttgtggcttaaaacgctaataaaaagactacatccattttaaatttgtgataatatgttcgagtagtttataggatagtgattatttaagtataagctaaacctatttattgccaccctttttaagtgcgcaataaataggtttttattttggaggggtgattatggaaataagccaagtttttaacaataatgtagctgttgttcttgaaaataatgaagaaaagattgtgatgggacgagaaatctgttttaaaaagaaaataggggatacgatagaaccagaaataattgataaagatttttatttacataaccaagaagttttaagtcgatttaaagaacttgttgtggatattcctttagaatatttagaaatcggtgaagaaattatggatgaagcgagactaagtttaggcaaagctttaaatgataatatctatatttctatggtcaatcacatttatacagctgttgttagagcaaaagacgatattttagtgaagaatgctttattatgggatattcaaagattttataaagaagaatatctaatagtgaaaaaggctcttgtaattatcgaaaagaaaacaggtgtgcttttaccaaatgatgaagcaggatttattgcgttacatattgtcaatggacaattagatgaagatgttcatgacatgtatgaaattacgaaaatcatgcaagaaattgaaaatattgtgcgttatcgcttcaagatagaatttaatgaagaaagtgcttattactatcgctttattacccatttgaaattttttgcacaacgtttagttgaatataaaaaaacaaaacaagcaagaagatgtttttttgaatcgaatgcatagtaatctatgttcaatgacaaaaaaagacaaaagctggtttatattaatgatgatttatttaatggaacttttaaaagaatacatacgagagattatcgttgtacaagagaacttttaaatgagcttgtagaaaaaggaatgcttgaagaaaagggtgttactaagggtaaacgttataggaaaaaataataaaaagtgagttcgtgtttataaacatggacttttttcattttacataaacttaacataaaccatacgttcttttgatttttgaaagtgttgaaaaacactatgataggagtgtcttaagaaaaggaaacaaaaataaataatatcttaagagaaaacaaaggaaggtaaataaaaaatgaaaaagaaagtattaagtgttttaatggttttcatgatgtgtcttggtttagccggatgtggcggaggatcaaatagtacatcagatgacattagtggaaaggtaagtttaaacggatcaacttcaatggaaaaattcgttaatgccttatcagaaggaattaaagaaaaatatccaaacttacaattagaagcacaatttacaggatctggtgcaggtctagaagcagttgcttcaaaaacaacagatatcggagattcttctcgtgctttaacagatgaagaaaaagcaaaaggattagaagaaaatattgttgctatcgatggtatcgcaacaattacaaacaaatctaataaagtaacaaacttaacaaaagatcaattagcaaaaatctatacaggacaaattactaactggaaagatttaggtggacaagatgaagcaatcgttgttatcggacgtgaagctggttcaggaactcgtggtgcttttgaagaattattaggaattgaagatcaatgtcaatatgctcaagaattaaatgaaactggtgctgttcttgctaaagttgctaaaacttctggatcaatcggttatgtttcattagatgtattggatgatacagtttctcctcttcaattagatggtgttgaaccaagtgaaaaaactgtaaaagatggaagctatgctttacaaagaccattcgtaatggctacaaatggaaaaattagtgaacaatctaaacaagttcaagcagtatttgatttcatcaacagtgatgatggacaaaaaatcattgaaaaagttggattagtaacaccaaataaataaaaataaagagggaagtattatggaaaaaaagttatcaattattagccataagaaagcaaaatccctagtagaaaaaacagccgcgatgatctttcgtggctgtgctattatctctgttttagcagttgttactattacaggatatatgattatttcagggacacctgccatttttaaagaaggaattacaggtatcttgttttctacaacatgggcgccaacagcagctcatcctcaatatgggattgcttatgttattttaacttctattgtaggggtttttctagcaatttgtactggagtacctattggtttatttacagcaattaaccttgctgaaattgctccagcaagacttagaaaaatattaaaatcagcaattgaattacttgcagggattccgtctgttgtctatggattattaggtattttgattgtcaatccaatgatgtataaattagaattaatgatctaccatggatctaaaacacatcaatttacaggtggggcaaatcttttatcagctattatcgtactagcaatcatgattttacctacgcttatcaatatttcagaaacagccttaaaagctgtacctgatgattatcgtaaaagctcacttgctttaggggcaagtaaaatgcaaacaatttttaaagttgttgtaccaagtgctaaatcaggtattatgtcagctattgtacttggcgtaggacgtgctattggagaagcaatggctattttgttagtagccggaaatgcagtatctcttccacttccatttaattcggtacgttttttaacaacagccatcgtttcagaaatgggatatgccagtggtacacatagacaagtactatttacaattggacttgtactgtttatctttatcatggttattaacttagtcttaacatatgttttaaaaagaggtgacttagatgaataatacaatcttagaaaaaaagaaacgtgtcagtgatcaagttctttatgcacttattcaattaagttcatttctttcaatttttatcttattagttattattggttatattctctatcgaggaataccggcctttgatttttcttatttagtaaatacaacaagtattattaatgatactgtaggtatattacctaatattattaatacactttatattgttattgtgacacttttaattgcttgtccaataggaattggtggagcaatttatttaaatgaatatacaaaaaataaaaaattcgtcagtatcatttcatttacaacggaagttttagcaggtattccatcaattatttatggattatttgggatgttgttctttggatcattttgtcatttgaatttctctattttaacagggtcacttacacttgccattatgattttaccaatcatttcaagaaatactcaaacagctttagaatgtgttcctaaaagctatcgtgaagctgctttaggaattggaacaacaaaatggtatatgattcgtacagtacttttaccaagtgccattcctggtattttaacaggagttattcttgcaatgggacgtatcgttgctgaatcagctgctttattatttacagcaggatcagttgctattttaccaacaaatatttttggacatttgttaagtagtgggggaactcttactattcaattatatttagaaatggctaaaggaaattatgaagtttcatttgtgattgctcttgttttagtagttattgttttaggtttaaatatgttagctaaatggattagtcgcagatttgatgtaaataaaggggataattaagatggaaaataaaatagaagcaagacatctgaatttgtattatggacaaaaacatgctttaaaagatgtcagtttagatattaaagaaaataaaattactgcgtttattggcccttcagggtgtggtaaatcaacatttttaaaaacgttgaatcgtatgaatgattatgttgataacgttaaaattgaaggggatgttatcttagatggtgaagatatctatgatagccgtgtagatacaacattacttagaaaaaaagttgggatggttttccaacaaccaaatccattccctatgtcaatttatgataatgtggcttatggaccacgtattcatggtattaaaaataaaaaagaacttgataaaatcgttgaagatagtttaaaagcagcagcactttatgatgaagtgtcagatcgtttacattcaagtgccttaggtttatctggtggacaacaacaaagattatgtattgcgcgtgctttagcggtacaaccagaagttatcttattagatgaaccgacaagtgccttagatccaatttcaacacttaaaatcgaagaacttttattacaattaaaagatcaatatacaattgctatcgttactcacaatatgcaacaagcaagtcgtattgctgattatactgccttcttcttagttggagaaatggtagaatatggaccaacaaaagatgtctttggtatgccaaaagataaaagaactgaagattatattactggtagatttggataggaggaaagaaagatgccaagaagtcaatttgatcaagagcttaataagatgcatgttgatttagatagaatgtgtcatcttgttattttagctattgaaaactgtgttacagcatttagggaacaagattatgaacttgctcgagatattattcatggggataaacaaattaatgatgtggaaagatcgattgaagcaaaatgtttatctttgattttaaaacaacaacccgttgcttctgatttaagagatgtttctactgctttaaaagtagttactgatttagaaagaattggggatcaaagtgcagatattgctgaattgattttagaaatgaaagaaatggatagtttcttaatgattggacatattcaagatatggcaaaaattgcaactaaaatggttaaagaatccttagatgctttccatcaacatgatttaaaacatgctttagaagtaaagaagatggatattaaaatggatgaattatttgatcaagttaaaaaagatattattcaaatgattaaagaatcaaatgataaaggtgatttaacaatcaatttcttaatgattgcaaagtattttgaaagaattggtgatcatgttgttaatatctgtgaatggattgagttcaaccaaacaggaaaacttaacaatactcgattaatttagacctcttttagagaggttttttctttatttgatttaaaaggatgattgatttctatataataaaaatataaggaggtattattatgctaggtcaaattcgtagacatatagctaaaaagaatgagaagctattttatatttttgttctttttatcattgcctttggtataagtattgttcattatatgtttttagaaaaagatgctgttttatctttaaaacaagatgatgtatcttcaacttattatgcaaaatatcattatttatcaaaaaatgtcaataatataacattttatttccaatatgaaaaagatggtgaaattattcaagatgttttaggcagttacgaaatcaataaccattttgatataaaaaatatatttaaaggttatagtgctgatgaagggaaaataactgtgaaattaatcgatgaagatacatgtatttatcttgattgttctagcaatataaatacctcaaaaccaaaaacaatatctaaaattaatttattagaaaatgaggatttttctaattataaatgttattttatttcagaaaaaaggttaaaagataaaaatgtttatacattgatggaaggagaaagtttgaaaagtaattcaaaaataaaattgcacttaacttacgaataaaattaataataattaggtaagaaaagatgtaaagaaatttaatattttgagtggttttctttgatttttacttgtttttcttaaattattaagaaaaatttgaaatctaaattcatattttgtatcagttatacatttatcgtcatgaaaaaattatagtttgctataaatacttctatatataacgaaaataatacaaaaaaagctaccttacacggttttggagaacatcgaggtagctattttttctcaaaaaaaatccaaggttagtcgtttatgactattcctttttcatttatattataatttatgaaattttctaattcaatataataaaatgactgttaaaaaagcttttcatgcaaataaagaacatcttgtgcaataaatatatcattaatgctaatcatcatatataattgtattaattagggaggattaccatatgaacaagaaaagaaatattataattgggtcaatagtttgtgtactgcttatgacagtggtattttttgtttttaatcatggaaaaagtaatgaacaagttgttacagaatattttgaacttttaaaaaagaaagattataaacaaatgtatcaaatgctagatcaaaagacagtctatactcctacacaaaaatattttattgaaaagcataaagaaatctatgatgtaataaatccaagtaatatacaggtaaaagtaatagatgaaaaagataatatggttcaatatcaaatatcgatggatactgtagctggaaaagttaaatataaaaataagattgaaattaaaaatgaacaaattaaatttaataagcaacttatttttgatgaattttctgataagaacaaagtaaaagtgattacgacacaaccttatagagggtatattttagatagaaatggaaaatatttagctaaacaaggaaatgcttattcatttggtcttgtaagaggaaaattaaatggtgaaaatgattatgcacaaatagctaagtatttagaaacggatgttgaagccattcaaaagaaaatgagtgcatcttggatcaaagatgattcttttgtacctattaaaaatgtatcagaacaagtaaaaaatcaattgattcaacaaggaattttaaatattaaaggtgttaaaatcaatacgatttctacgcgtgtttatccttatgataaaataacatctcatatcattggatatgtccaaaatgttaattcagaagatttaaaaaaacataaaagtgaaggatacacaagtagttcagtaattggaagaagtgggattgaagccacttatgaaaagcagttacgtggagaagtaggtggaaaaattgtcattgttgatgaaaataacaatatcattaaaacagttgcccaaaaagaagctaaagatggaaaagatattcgtttaacaatcgatattgatttacaacaaagtctttataatgaatatcaaaatgataatggttgaagcaagaagctccgacttctaaacgaagtgtaagtcggagtagttcacctcttacaatcttatcaagatgatgcattatcatctgtagaagttcaagaattattcttaaatgaaataaagaatattgaaaaagacatcattgatttacaaaaagaataccaaaataaaaaagatattcttgaaaaacttaaaaacataaatcaagaatataatcatctcttaaaacaagatgatgaagcattaattacgattcatcaagataattataaagaatatcaagagtatattttttcaatcattcataaaactttaatgaatttatctcctgatgatacttatcgtaaaagagatcttttaaagtctattgaaaggaaacatcaactatgaagcatttatcaactttgattgctgtaaaaaatctaactattattcaatttacaaaaataattcaagatttattttatttagatgaatttatattagattcattgatcattcatttaaagaattgcacaatttatcatgatgaatcagcgattgctttttgtattcaatatcaaaataatgattatgaatatatttttaacgaaacaaaacaaaatatatatctttctattaataaacgtaataatcaatttatcgatttaataacatatcttaataaatatcattttttaaacaataatcatttttcatatattcaaccaaatatcaaaaatatgaatgatttaaatcaagtcattgaatttatagaaaataaaacaattcttcctgttatttatttaaatatgtctttaaaagattttaaaaatgagattctaactgaaattcaatcaacagcttatattcttacaagcgaagataaaaattttcatcaagcatttcaaaaccattttcatttaagaaataatagttatattctttatttaaatcatgaatttcaaaaaatttcttttttaaaaaaagaatctcctcaagaatttattgagaaagtaaaaataaaaattcaaagttatgttttacaacgtacatattcatttccttataatatgaaagattttcaacatcatattattaaaaaaataattgaaaatcataaagaaaatgattttctcgaaaattcttctattgaacaacaagtcttagctttagaagataagaaaaagaatttacaaaaaaatattgatgatttaaataatcaaatattgattttagaaaatcaaaatgaagaattaggaagttatattaaacaacaaggatattatcctttaatattaaaaggaaacgaaaaagaattttacaaaggtgaacaaagagatcttcttctttatcttttaaaagaagaacttaaaaataatcataatcaaaaacaacaacaaatcattcatacaattcttgaacaaaattctcctgttggtaatcgaaataaatatttaacagatatttttaacttattagtcaatgaaggtctttcaaagaaatctattgatactttaagtcgttatggaattattttaagtcatacaggtaaacatccaacaactactttttttaatgattcacgttatactatgacattttcttcaacaccaagtgatcttaatgttggtagacaatattatcgtcaaattagaaaactattcttttaacttttccataaaaaaagaggtgtgtttgacacctcttttgattatcctctaagtactgctccaaaatctttttcaacagcttttaagattttttccatagcttcattaatttcttgttcttttaatgttttcttatcatcttggaaagttaaattaatagctactgattttttaccagcttctacatgttctccaacataaacatcaaagatgtttgttgctttaacaagtttattacttgacttaatgattttttgacaaacatcatttgctggaactgattcatccatcactaaagcaatatctcttgaaacagatggatattgtggaattggttgatatttaactttaccagtcttgatatttaataatgctgataagttaagttctacaacataaacatctttcacatcatatttcttttccattagtggatgtacttgtccaacgaccccaaccacttcattttgtactttaatataagcactacgtccaggatggaatgattgattatcactttctacacgttctaaacgataacgagattcattaattcctaatctttcaaagattgtttctacaaatcctttaactaaataataatctgctttgtatgaaatttgtttaaatgataacccatggtattcaccagtacatgcaatcgcaaggttttgtaattcaacaccttttgaatatgttgttgataattcatataaatgaacatctttcatatttcttgattggttataattgataacttgtaataatgatccaataattgattgtcttgtaacagatctttcttcacctaaaggcattgcaagttttactggttcttgatcatggaaaatattgaaatcatgaacaagtgatggtgatgttaatgaatatgttaatgtttcatgtaatcctaaatcttttaataagactttcatcatatgtttcttttcttggatttctgttctttttccaattgtcatagacatttctggtaaagttgatggaatgttatcaaaaccatacatacgcacaacttcttcaattaaatcagctgccatcgtaatatcattacgataagttggaattttaacattaaatgtatcttcttttaattcatatttgaattttaatgaattaaagatttctgcgatttcatttgtttgaatgtttgttccaagtaatccattaacttgttgagttgaaactgaaacatatttatcttcaatataaagagttgttgaaacagtttcatagatttctttagcatcagcaagttcttctaataagttagcacatctttctaaaatatttaaagaattagcagtatttaaagcccctttaatataatgttgagaagcatctgttaataaatttaaacgtcttgctgtttctcttaaacttggtccatcaaaagtagctacttcaatgacaatattttgtgtgttttcatcaattttagtactatcagcacccataacacctgcgacacaaccaacaccattatctgttgaaacaatgatatcttgaggttctaatttatattcttcaccatctaataagattgctttttcatcaaatcctgtttttacgataaattcttttttagttaatttatcataatcatacatatggattggttgacctgtttctaacataacatagttagaaatatcaacaatgttattaattggtttaataccagaagcaagtaatgccgttttaagccatgctggtgattcttttgttgtgacacctttgacaagtttagccccaaagaatggacataattcagtttctactttaacttcaatgctgcttccaggcattcctttttctttaatttcaggtaagttaacgtctctttttaaaacagcagccacttcataagcaagtgaagttaaagccatacaatccgctctatttggtgttaaaccaatatctaaaattgtatcttttaaacctaaatattctaaaggatcttttcctacaggtgcattttcatctaaaacatgaatgccatctttatcttcaggagataataaacgttgatctaaaccaagttctgccatcgaacaaatcatcccgttagattcttgtccacgaatggtactttgtttaataacaaaaccttctcctaaatcacatccaggattagctacaataactttttgtccagcagcgacatttggtgctccacaaacaatttgagtcacttctcccggtcttacttcaacttgacagacatgtaaatgatcactatcaggatgatcgatacattctttgacataaccaattgtcatattgtttccattggctaaggaatgcattccttctacttctaaaccaattgaagtaattttatcagcaagttcttttggatcttgatcatctattttaacgtatttatttaataaatttaaactgacttccattttcttactcctctctttggaattggtttaagaatcttaaatcatcattatagaaatcacgaatattatcaataccgtatttcaacatagcaacacgttcgattccaattccaaatgcaaaaccttgatattctttactatcaaaaccacacatatctaaaactttagggttaaccataccagtacctaagatttcaatccatccagttcctttacacatagcacatcctttaccaccacaatgatgacaagagatatctacttctactgatggttcagtaaatgggaagtaagatggacgtaatctaatttcacgtttttccccaaagaattttcttgcgaaaacttctaatgttccttttaaatcagcaagcgtgatatttttatcaacaacaagaccttcacattgcatgaattgatgtgaatgtgtggcatcatcatcatctctacgatatgttttaccaggacaaataactttaataggtcctttccctttggcagcaagtaaggtatgtgcttgtactggagaagtatgtgttctcattaaagtattttcatcaatatagaaagtatcttgcatatctctggcaggatgtccttttggtaagttcattaattcaaagttgaagtaatcactttctacttctggaccttcagcaatttgatatcccatacctaaaaataattcttcaagttgagaaacaatgattgataaaggatgcattgttccttgatctaatttataacttggtaatgataaatcaatagtttcactattgattttatcaataattgcttgatgttctaaaacttcttttttatcttcaacagattttgataattcttgttttactttattacttgtttgaccaaatgtttttctttgatctgggtccatgtttttcattgatttcattgcttcttgaataggaccttttttccctaaataaagaacacgaatatcatttaattcttttaaagatgtacaagcttcaattttttctaaagcttcatctttaatttttaataattcattttccactttatttcctccttaaatataaaaaaactcattcctctaggaacgagttgatcgcggtaccatcctaattcatgtttaaaacatgctcttaattaaacattaacgcagtctcacgtcactgattaggtgctctccatggtgaattcaataaactatctgtaggagtttccagcttctctccctctctaaaacagcatcctttatttactaatccatatcaacgatttatataccccattattatatcaaaatttatgatgaaaacaaccccaacttaaaacaaaatcatagtaacaatctcattgacaccccttaagcaaaggaagataattaaattaaagatggttttcaatctaattgatcttaaataagattcctttagattgaaacattttaaaaagaaaggagatatttatgaaaaagaaaaaattatttttagcatccttgttgtcattttcattgacagcctcaatgttttttacaacaaatattcatgcattagaagaagtacaaaatgaaaatcaaattgaagaaagtaatgagactttaacagaaacaccatcattaacattggtatcatctacatgggatggagaaaatgatattgtttttaatgttcaagcaaaagatacaaaagttgaactattagaaatgtatatttatagtaacggatcttctataggatctatttatgttaaacctgacaaggcagttgatgatagtggaaacgggactatcactattagtaataacgaattaaaaaatataaaaacacttattggtcctgataatcaaacatttaattggtctcaaatcgaacaaattgaaatggtttttagtttttctaaaggagaagaattgagttcatttaaaacagtttatgtacctgttcatattttagagacaccaactccaataaatcctgataaaacagataaaactgaaactgttaaaaatgatacaaataacaaaacaactgtaaaacaaacatcttcaacagctgtaaaaacaggagataatacaaatatcactccttatgtttcacttcttgttgtcagtgttgttgtcattattggtattgttgtttataagaaaaaatcatctaaaaaataatctataatattttttgcataaaaagtgggatgaacattcatcccacttttattccccttaacatttttaaatcatttaattattttttttactcttttttactacaaggataaaagccaatgcagacaagcatgcaaagacagccaatggcattacttgtgttgaatcacctgttttaacgtttgtagttgtagaagtcactgtatcgtttttagctggtgtttttgttggttcattagaatctgatggtttttgatctgggttagttggtgtttctggtgtttgtttatctaaacgaattgtttcaccagtattaacatcacgagcatatttactcatgaattcccacatcaatttagcatcaggagtatagttccaatgtccccatccataaatacgagccatgctaatttctatacctttagcattttccattgctcctacatcaattttagcaatattttcagctgtaggttcaattgtataacgttttgtccaaggaactccatataaataagcatctgcttctaaaacatcttcaagttgtgttacttccatatcatttaattcttgataaagttgtgcaacttgtaatcctccatttgattcagttgtatcaaatgcacctttacaatattcatcaccatcacctgtaaagtagataataggcatatcatatttatctttattttcagcaactgcttttttatttaattcacttgctccaaatggacctgagtgacctgctgctgctgcaaaatattttgaatcagataaaccagcatttgttgtattcatacttcctgctgataatcctgaaatataaactcttgattgatcaatttgtggatatttttcttcagtaagttttaacattgtaataacatctgaatctgcagtagcatttaaatcatctgtcattggatcatatgtatatccttgataagtgtgtccttgccattcaggacaaataagaataacgccttcttcactagcaatttgtgcccaaccagatgtatcatattgtgttcttggatcatttgtatttccatggaataaaacaactgcaggaacactaccttctttagcatcttttgattgttcaggaatatattcataccataatgaatcaataccatcattatctaaatcttgtgtattaacataacgatcaatattatcaatagcatctacagaatcaaaatattgatattttcttgcttgatcagcttctttattacctgaaattaaaggacgtgaataccaagtagctgtttccttataaacatcactataatttccaattctaccaaatttcttaagtactttttcccaagcatcttttgttgcagaaactgcatctaaaccagtatccttattaactgcaacaacttcataatggctttctggatttacataataaccatcttcagttttagttgcactatttgcttttacataagtatttacaatttcatcattatcagttactaaataagttggtactgaaacattaacatccatacctttttctggattaactaatgcaagaccagaaacaaagttcatataagaagctaaattttgattaatgaatgtagccccattaccaattccaattaatttaaagttactagatacacctattttacctacgattgcttcaaatccttgaacatcatcacttgtaaattcaacaccattagctggtcttgctacataaactttacttgctgaacgattaacaatttctttaatacctgatgcttcaatatatttttctgcttcttcatcagacatattaccatcaggataaacaacaaatgtaggtgcagcagctgcatttactgattcaatacttaattgatcactaccactataaacataagcttcttgcatttgattaactgcttttttataagcttcaatatatttaggtaatgtatcgatttttgcttttgcaccattacttgaaagttcaactgcatctggtgcccaagatgctgctgtataactatttgaaatagttgtaccatctaataaaccactaataacttgagccatatcattgaaatattgaattgacatttcatttggtctttgtgcattatcttcccagaattgttgccaacgatgacctgctaaaatagatagagatggattattatttaaaatctttctagcaagtgaacatcctttatctaatgcagcaagtggattaccaccatttgtttcaaaaagtgcccaaataaatccactaccgaaagtatcacctgtaaataatgcttcatgtgtttcatcagtaatcattaatgaaccttcagtatgtgcattaacaacattaaattcataaggtgcaccataaatatcaactgtttcaccactatgtacttttgttattttgccatcaaattgagaaatagcttcaaatgcaacatcataatcagcatcacttacatatacattgtctactgttacattactaaaaacttcttttgatctaccaaaaccagtatgatcaccatgactatgtgtaatgataattgataaatgtttatcacctgtcatagattcaacaattgttttagcgttttgaatatcttcttcattttgggaaccatttcctaagtcaactaatacaacaccatcttctgataacacaaaatacattgatgatggattattcattgccccattttcatcagttgctccaccaggaagtttctttgttccttcatcccaatgataaacattatctttgattttttcgactttgtaccttcctaattcagcatatccatctttcattaacgtttttaaaaattcgctattattttcatcaagcgttaatagttcagaaatatctgaatttgttttttgttctccagtattttgagcttgtacaacacttatcccacttagtgcaaacataatacttaaagaactaataaataccttttttgtaaacatccatattccctccttttctattattatataaaataaagcgcttacatgcatgtcaaaaacatgcataaaatcggtctttttctatccaaatgtatttttttacaaaaaaagtcaaagatttttcaatccttgactcttaaatattattcatattctttatgtgcaataagcaaataagcacagcttgcaacagctaataatgacatataagtaaatattggactattgtctcctgtttttacagctgttttttctgttgttttttgagaatcttcaaccttatctgctatttctacattttcattttttacttgtttgctttgttttgataaccatgaaaataattctaatgatgtatcatcttcaatggcttctccattgaacacatagatccatgaccaatgtgttgaatattgatatggttttccatcttctccattataaagtcctgatgtatcatgaacatcatctggtgaaaagacatgaagattagtagcgttagcggcttttaatttttcaataagtggtcttgaaaattgatttggatctaacgtatcatcattttcacaatacgtaataaataatggaaaatctttaagtttttgagcatctttttcacttaaatcactagcatcaaaacctgtgcaaattggaaaagctgcagcaaaataatcagtatacgataaaaccatttgcattgtcatatacccaccattagaacatccaccaatataaatacgacttgtatcaatatcatcattactatcaacatacgctttaatacattccattaaactctttacatatgttgaaggtgtatgtcttggtgtaaattttaatcctgattcagtaaattcaaaatcaccataaccatccatccaaagcgttggacattgtggaacaaaaacataagcattaccaagtttttcttgaatttctggactaattaaacctgtcactttatttcccaatactgctatttgaggatttgtaccaccttctcctccaccatttaaccatacaactaaagcatttttatgatcatcttttgctggtgaatatgtagcaaaactataatttgttccatctgttgcttgatatctacctgaataatcaaattgatctcccgcagataaagaacgagatgtataatttgtatcaatatttaaagtatcatattcattttgaccatcaattatttctttattttcttttaatgaaattgttaaataataaggatctgcccattcattaaaacttttataaatgaaaggacttccttctgttggacttacttttaaatcaattgtaaaatattttgaagcaccttctactttttgaccattttgatcagaaatataagcatctacaattgttctttgaaaatcttcagcattttctttagtttctacaacctttaaaacatctttatcaattgtcgttatttcttgatcaacatttacaattactcttggtgttgctactccccaatcatattcatctacaattaaagaataagttccattaagtacatgattactatttactgcatagacaggcgctatcgcaagtgaaaatagcatcacaaaacaaagcaaaaatctttttgtattcttcattagaatttcctccctaaaaaaagtatatcatttattactctttataataggtctttatttgaactaataaactctattttaataactttcgatattcatgaggtgtcattttataaattcttttaaaaattctattaaatgatttaggattcgcaaagctattattataagcaatatctgtcatcgatagattagtatgtaatatatcattaattgctttttccaatctaacactatcaatatattttttaattgttgttccaaaattttgtttaaaatatcttgataaataagattgtgaaacataaaaatgatcagctaatacttgtatacttaagttttctttataatgttgatcaatataattaacaatcttcactattttattattatttatttcattttcttgaagtacatatttttttcttacaagtaatttttttaaaagtatatacattaatatatctgttagacctttaatcgcaatatgaccatactctttatcatcatcataaatatcgactattctatagattgttcgtactatttcccgggaaacttctccatctggttgtacaaattcataatgatcaatcaaaggaaatatgcttttaatataatcataattaatttgaatgccatatcctttataaacctcatacccgcttacaaaagaaatcccatgaatatttttactattaataatataaacatcaacattttgacttctaatcatatgtccattatcccatatttctaccttacctaatataggaaccaatatttctatactattatgccaatgtttttcaacattttcttcactactttcataatacaaatctaatattttaataggtaaatgttcatccaattttattttttcgtacacgtacattcatgaagcaccccctcgtgatacaatgctttgattattccctcttgatcaaaatcatcagtcacataagttgccttttcttttaaaacatctactgcattacccatcgcaatgccatgtcctacttctctaaacatcgcttgatcattataaccatcgccaaatgcataagcactatccttatcaatatggaaataatctaatagataggcaatcgcgctgcctttatcaaattcaattgttgaacaatcacaagaacccattccgccatgatcattaataattaaatcttctttaaagatttcaaccattgtttgataatgttcttgactttgataaaacatatcaaacgtataaaaatctccttctaaagaatcaacaagatgttcaataccatattccttttctaaatcaacttcttgtttttgatctaaatgatattttaaagctttatcatcactaacaaacatcgcccctagttttccttgatcaagcttatgtacataataatctaattgttccttagtaaaagctctactataaagcttctttccttcataaagaatataacgtccattacagctaataatcccacttacaagattaccgaataaacgacttgcataaaaaggtgctcttcccgtacaaataaacgtcttatatcctttttcttttaataaatgcagtgcttttaaatttgattctgtaataacaccatgttgtcctagtgtcccgtcaatgtcaaaaaataatatcttatccatacctattctccttgaaaatgatacatcataatacttcctgccacagccacatttaatgattcaatggttgtaattggaatataggcaatttgatcacaaatgtcgataatatctttttccatcccattcccttcatttcctaaaacataggccattttttcttgttttttaatttcatgaataggccttccattttctaaagcactgcctacaacacagacacctttttcttttaaagcaggaataatttcttttaaatccccataaagacaagaaagatggaagtgtgctccttgcattgatcgcagtaatttatcattataaagatccacacattcgttagataaaatcacttgatctatgccaaaagcaagtgctgtacgaataagtgttccaatatttccaggatcttgtagataatctaaaatcaaatatctttttccatcaactaatttcttatctttttgaataaaacatcttgccataataggttgaggtgttttagtaaaagcaagtttttccataatttctttagatactactaaattttctacacctaaatcaaccggttcagttgaaataatcaaatctgtttgtttagctttaattgcttcctctactaaatgatttgtttctactaaataataatcttttcgatatttcttttgttttaattttaataattctttaaccgttttattttgcattgacgtaatcatatacccacatcctttaataatctttctctttctttataatctggcattcttttttctatttcatgatagaatgcttttgaatgatttgcttcaagaaaatgacaaagttcatgaacaataacataatcaattaaagcataatcaatatgtgctaatactaaattaaagcacactctatttttttgataaaaacaagcaccccatcttcttttcattttcttaatttgaatttcaggaaaaacatgatgaaagctcgtacttaaataaaaatctattctttcttttaaataattcatcaattcttgttttaaaaacatttcaatggttgcttggatattttttgaataaacatagatttgacgatcatgaatagcacattttttgatattcatatcttttaaaacaatttgatatttttgattaaacaaataaacataaccatcttcttgatagttatatttaggaacatatccttttatttgttcaagtatttcttcttgatgatttctaatcaatttttctatttcactttgaggaaacagcggtgaacaacgaattaccacttctcctttttctactcttaaataacaattcttaattcttttataatgaattttataaacaatttcttgttgatctaaaataattattttagtttctaccatgtatatttttctcctttttgggtcactctttttaaggagtgataaaatggatattcgacaagctatatttcaaagactacatgcttgttcaagtagtgaacttaaagagattattgaaagtggtattgcttctaaagaagaaaccgtcttaccagggcttggtgttctttttgaaacttattataattctttaagctcaaaagatgaattacttgacagtcttagtcatttattaaaatagactcttagagtctatttttatatatttgtttcagtgaacgtaaaatcataaatccaaacatcaaataagcatctatatgaaataatgttggcaattgaacaatttgtataataacaagtaaaatagccatgattacatatatcatccatgagattgaataattatgttcatgatacataaattttaatgtttgataatgattttcatcataccaatcattaatgattttaaacaattcaaaaagcaaataattaaaaatccataaaagacaaaaatacattaatgtaaaaatattattaaaaaagatgtatggtattgttgctggaaaggatatttgataataattcgataaatccaaactaaatgtaaaaagtgtaattaaaaaagtcatgattccatttcttgcaagatataaaacaataaaatctttttttaattttaagtatctttctttattcatacaaaccaccattttcctttgaaaagtttaatttgaaaacataacttttttgactttgatcttttgataaaataataacaacacttaattttttcttttttaaagatccttgatttaaatcatggttatatgtttgatagattttttgattaacaatatcttttgtttttcctgttatctttttaaatacaatataatttttatcatttttatcatttaatttattactttttaaataacgatattctaatgaaatatttggatatttcttcaataaatcttcatctgtagacgttaaatacccaagcctcataaaatcatcactgacacatgcattttctactttaaatgtttttgaagaacatgctaatttttcaacttgttttaattttaaagtatgttgataaaccgtcttttggttattatctttgatgattaactgaacatttttgatttcttttatattttttaaatcttccttattttctaaagaataacttccaccctctaaatattttaaagaataatcaacatgttgttttctatttatttgaattatgacatcaatatcttgtccgtctacaagagaatcgatttttcctaaaacaagtgtcccatctccacaatgataatttgattgatctttataaagctcataatcctgtaaagtaaagccttgatgatttaatgataaaaaataatcataatacgtttttgtattatatgtatgaaaagaaaaattatcatacattgttagtaaagaaacaaaaacgattatcaggcataaacatgtaataattaaatttgatttatgtttttgatccatattttctcaccacaactattatacacaatagttttgtttttaccaaatatgacataatatgatatgatttaaaaaaggaggatttctcatggaaaaagaaatattattaaaagaaatagaaaatacaaatcatttaaatgatctttaccaattatggaatgaatttaaagcttatcttgaaaatcaaccaagtttattggaacttggtcaactctttggatttaattatcatcttcaagaaaaattcaatcaattaagtcaactttttattcaagaaaagaaataccaagaaagtatagaatttcatcaagactttatgaattattttaaagatgataaatatctttgccctttttataaaaacttagctttatcttatttttatcaagataatgatcaaggaatttcatattttcaagaattacttgaacgttacccttatgattatgaaattatggatgcttatttttcgtgtctttataaacaaaataacttacaagaattaaaaaatatgattcaaaaacatttacctctatctatcgaatataatattgaaacagaaaatattattcatcatgtcattgagctttttaaagcaataaatgaagaagaacttgctttacaatatgctcaaattgaaaagcaacaaaatgattttggtaagaaaaaaccaacaaaagtcatcaaagtggggcgtaatgatccttgtccatgtggaagtggtaaaaaatataaaaaatgttgtggtaaataatgaagaagttctttcttatttttataccgatcattttgattcttacttacattttttatcaaaataatcttttacctcatccaaaatatacaaatgatgattttggtattcaaacttataaaagcataaatgatcaagatcatgatggtattgacgatcaaagtgatattgtacaaaacgttagaaaatatattgaaacaaaacctcaatacaaaagtaagtattatcaaggtggttacccaacagaccattatggagtatgtagtgatgttgtcgcttttggcttattgaatgcaggttataatttacaaattcttgtagatcaagatattagagaaaatcctcaaagttatcaagttgaacatcctgataaaaatattgattttcggcgagtaagaaatttaaatgtttattttaaaagacacgccctatctttgacactcgatatttatgatttagataaatggcaaggtggcgatattgttatctttaaaaaacatattggtattgtttctaattatcgaaataaaaagggaatcacttttgtgattcaccatgcttatcctcatcaattttattatgaagaagatattttagaaaaaagaaatgacattattggtcattatcgtatttcttagtaccaccaatggtggtacttttatatttctttgccaacagcatcagcaattggttttagttctttcatcaattgttcaaatttggctggttttaatgattgtggtccatcacataatgctttttaagcaatgagaaaattagctgcagaacatgaatcagaaaaagtcggaaaagaaattagaaaactttattcttggtctgatgaagataaattaattaataactaatcaattatgaggatagaaatatcctctttttttatacaaaaaagctattgaatataaaataaataagtaaagattaaattaatctctacttatttaaaacattcaataaattgatttataagaataggtgtttcttcattctttctcgtaataaaagcaatacctgtatataaatctttatcttctaaataagcatattctaaagaagaatcataatttaaagataagctacttaaaggaacgatagcaacaccaataccactgtttgcccaaataagagaagttcggctatcgtcacaagtcacttttatttgaatttgaatgtgtttatttaggctataatcattgattaaaggaagatatctttgatggataatcaaaggtatcttttttaagtctttcattttagaaataggtcttttaaaatattcttttttacctataacaatcataggttctttttctaaataaaacgtattaactttagaagtatcaaaaggagttctaacaatccctaaatcaatattatgagacaataataaatcaagtatttcataagtagaaccttcataaatacgatattgaacatgatcatagtgttcaataaaatgcttaatattatcttgttgaattaaaccaccattagaagaagtaattccaattcttaatacatcttgaaaagattcttttaattcatttttagtaatttcagttaaatctaatatttgaagacatcttttataaaaacgcattcctgcatctgttaattcaatttgtttatttcctctttttaacaaagtaataccaagttcttcttctaattgtttaagttgaatagataaagggggctgtgccatatgtaaaacctgtgcagctttagaaatagttccttcttctacaattgttttaaaatacttcatttgtcgaatatccattataaatcctcctttatatgttaataatataattattatataatatatatattttacatatagataaatcttatcatataataacgcagaggtgaagaatgtgaaactgttaaaatatgtaaaagagtttaagttttcagcaactttaggttttttatttaaaatctttgaagctgctttagaattatgtgttcccgttgttatggcctctgtcattgataaaggaattgcttataaagataccaattatattttaaaatgtgggctcgtccttattggtttagctgtttttggttatttatttgcacttgtttgtcaatggtatgcttcccttacatcacaaagtgtggggacacaacttagaaaagacatgtatcatcaaatcaatcaatatgatgatgccaatttagatacccttacagcaccatcattagttacaagacttattaatgatgtagtacaaattcaattagctgtagcgatgacgattcgtcttacatcaagagctccatttttaatgattggttcattatttatggcttttatgatcagtggttctttatcaatgatctttgttgtaggagctgttattttagcggtatcgatgttatcaattacaattatttcgatgccttatttctctcgtattcaaaagttattagataagattgctttaatagcaagagaaaacttaaaaggtgtacgtgttattcgtgctttttcaaatcaaaatcatgaagtaaaaagatttaatttagaaacaaaaaatcaaaaagatgaacaagtaaaagtaggtaaaatacaagctttattaaatccctttacttatttaattgtaaactttgcaatcattattattatttatgctagtggtttccaagtcaatgtaggaagtctttctcaaggggaagttattgccttaattaactatatgaatagtattttacaagcactcattgtctttgcgaatgttttatcaatctacaataaagctacagcaagttatcaaagagtttttgaagtacttgaaacaacaccgcaagtagaagatcaaggaagttattcaacccttattcctaatgaaaaaatgattgaatttaaagatgtcaactttggatatcttcaaaaagatgtgttacacaacttatcatttacgatcaataaaggtgaaacagtaggaattattggaggaacgggtgctggtaaatcaacactagtatcccttattggaagaaattatgatgttagaagtggacaaattaaaatagctggtaaaaatattcaaaattataaactagaaacattaagacaacatatcagttatgttttacaaaatacatcattgatttcaggaacaattaaagaaaatatttgtatgtcaaaaccttaccaagaagaaacaatgaataaagctttagaagtttcacaagctaaagaatttgtaagtcgtcttcctcaaggaatagaaagtgctgttgttcaaggtgggaaaaacttctctggtggacaaagacaacgtttaacaatagctagagcactttataaacaagcggatattttagttttagatgattgttcaagtgcgttagactatgcaacagatgctgctttacaaaaacaattacaagaattaaaagaaatgacaaaaattgttatttctcaaagaacagcgtctttaaaaagatgtgatcgtattatggttttatatcatggtgaacttgttggttttgattgtcatgaagaattattaaaaaattgtacggtttataaagaaatttatgaatctcaaaatagtaaggatggtgatctcaatggataaaaaaacaattaaaagattgcttacatattgtaaaccttatcgttttttaattatgttattaacacttttatcaattgtctctgttgtctttactttacttacacctgttttaataggtcaagcaatagatttattggttggaaagaatcaagttcattttcaagcgttattgaacaaacttatttttattggaattgttattttaattatttctttgattcaatggatcatgggacaaattacaaatacaattacttataatattacgaatgatttaagaaatagagtatttgatcaaattcaagttcttcctttaaaatatattgatgctacaagtcatggagatattttaggaagattgatcaatgatattgatttaattggacaaggcttattacaaagttttacatccttgcttacaggaattgcaacaattgtaggaacgattttgattatggcttatattcatttttcggtagctgtaattgtggttgttttaacaccactttctttacttgtcgcttctttgattgttaaaagaacacattcttatttccaagaacaacttgctttaagaggggaaatgaatggttattgtgaagaaatgataggtaatcaaaaaattgttaatatttttgattatcaagaacaaaacgaagaaaagtttaatgaaatcaatgaacgtatgcataaaagtggggttatttcacaattctatggggctttaattaatcccacaacacgtttagttaatagtattgtttatgctgctgttggtatttttggagcatttcaagtattaaatggttcatttacagtaggtattctttcaagctttttaacatatgctaaccaatatacaaaaccatttaacgaaatatcatccgttatgtcagaaatgcaaacagccattgctgccagtcaaagagtctttgcattattagatgaagaaacaatccaagaattaacaacatctaaaatcattgaaaataaacaaggacatattatcattgatcatttaaatttcagttatgatccaagtaaaccattaattcaagattttaactatgaagctaaaccaggaacaatgacagctattgtaggtaaaacaggttgtggaaaaacaacattaattaacttattaatgcgtttctatgatcctcaaggtggaaaaattacaattgatggtgttaatattgaagatatgaaccgtgaagatttaagaaaaatgtacggtatggttttacaagatagttggttatttaaagggactattaaagaaaatattgcttatggaaaaacaaaagctagtgatgaagaaatcattgaagcggctaaaaaagcacgtgtgcataaatatattatgtctcttcctcaaggatacgatacaatggtcgaagaagatggtggaaatatgtctcaaggacaaatgcaacttgtgtgtattgcacgtattatgttaacacatccaccaatgttgattttagatgaagcaacaagttcaatcgatacgcgtacagaattacaaattcaaaaagcttttgatgaaatgatgaaaggaagaacaacctttattgttgctcaccgtttatcaacgattaaaaatgccgatcaaatcatcgttatggatcaaggacatattgtagaaattggtaatcatgaagaattgcttcaaaaacaaggttattatcatcaactttattacagtcaattcgaaactgaataatcaagaaagttacgattttaagtcgtaacttttttattagttactttgaagtaactataccacaatattgtgcgtgcttttttttattagaaataaaattataatgaaaaacgaaaaaggaggcacaacaatgaatgtttcaacttgtttaaatattttaagagaaatcaaagatgttgcttttgcaaccgttgatgaaaataatcaaccacaagtaagaattatagatgtgatgttggttgaagataataaattatatttttgtacagcaagaggaaaagatttttataaacaattaaaaaatcatccatacgttgcaattataggaatgaataaagagtatcaaatggttcgtttaaatggacttgttaaacgattagaaaatcaaaaatattggatagatcgtatttttaaaaataattcattaatgaattatgtttatccaaatgagagtcgttatattttagaagccttttgtcttgaagaaggtgaactagaattctttgatttaggcaaagaacctatttatagagaaagtttttcagtgaataaagagataaaacctaagggatttatcattagtaatcaatgtattcaatgtggcttatgtcaaaagaattgtccacaacaatgtatttcaaattatcaaattcaacaagaacgttgtttatattgtggattatgttatgaaaaatgtcctgtacaagcaatagaaaataaagtattgtaatattcatacattagctaaagtgattgataatataagagaaagaatgcaaagtgatgatagtttttcttattcctattttccggtaattcaattttatgattatggaaatgaaattaaacaaaaactctctattggttatggcaaagaacttcctatagggagttccttagaaattatgtatgaggaaaatcatcctaaacgtatattgattttagaaaataatccacaaaaaaagctatatatcatttttataattgtgggtatttcttcgttaatagcaggtttaataatacgtattctttaaagacttacgagatgatttcgtaggtttttttattagaaacttttttggactatccgcccattgaagaaggtaggagagattgctaaaataataatagaaatgagacaaatgtgagacgaattatctttaaacatatgatacaatgatagaaaatgtagatgatccaacagaaatcaaaagatatcgagatgtcgtagaaatcagtcaaagtatgtttgcaggaaattatgatgacttaagaaacaatcgtaaaatcgaaacagaaagcttcatgatggcggcaacatttacgtgtacaaatattagaagagaagacttaccagaagaagatgaaatcaatatgtgtaaggcaatggatcaattatttcaaagaacgagagatgaaagaaaactcaatactttaaaagaattgcttaaagtgaaattaggaactttatcaagtcctttagaaaaacaactcacaaacaacaatgttggcaggtagcaagaatctcctgtctttagacatggggagtgtcaattgtggaagtgattttcatggtaaaacgaaaccagcaattcatctaggtgaaaatagatgtgtttcaccagatgaaattaaagaacttttaattaaatatcaattaataagaggctaatttagcctcttaagtatttttttaagttttctaattggttattacaatcacatacacctaagtcatacatttgttgaatgacttctttgtctttttcaagtcgtccaatagggatgagttgactaggtcttaaaacaaaaatcttcttttctttttctaattttgtaatcaaatctaaagacgcattataatttaaataacgattatttaaagtttctacaaaatgaggatattgatgataaaagagtttattaagatgtttattggatggttttttacgataatctaagggtcttgttaaaacgacgatgattttatcaacatccatctctaacatttttttaataggaatactgtcactacagccaccatctaaatattcatgaccattgacttgaatgatatgagatacaaaaggcattgaacctgatgctcttaaatattcaacttgatcataattatctaaagtatccaacaacttatattctgcttttcctgtttgtaaatttgtcacaacggcataaaaatcaacaggagattcttgataactttgataatcaattggatctaaatcatcaatcaatttttcgaaacaaaattcttcattcatgacatttcctgtttttaaaaaagaataaacacccatataatctttatttccagcgtaagctttattatatctcaaaacacgtcctatttgttttgatttataattcattccaaataaagctcctgctgaaacaccaataattgtatcaacatcaatcttttcttttaaaaatgtatcgatgacacccgctgtgtataaaccacgcatagcgccaccttctaatactaaaccaactttcatttatatcaccgagggtattatatcataaaatttgaacatcaaagcaaaaaagaagatgtttgaataaaatatatattttgcgtataatacgattaggtgattaaaaatggaaaaaggcaaaatacgtatgctcgccaatttaatagagctaaataaaatagaagtaagactttcaaaaaaatattatgggggaatttctccaaaattttatttgagagatttaaataaagaaacacttgcagaaattcctgttgctgaaacatgtgaagatgatatttgtgttaaatattattttaaaaatgttcatattgatttaacgcatcattatgagatggtagataattatggtttaagtgctattttacaatatgtaagactttctgaattggatgattttgatgaattattttattatgatgggaaattaggacctctttatcaaaaagaaaagacaactttcaaagtatgggcgcctacggctttagaagtcatggttaaagtaggaaatgaagcttatcaaatggaaagaaaagaaaaaggggtttttgaagtaacgattcaaggagatttggataatcaagaatataattatttgattcgtcatcataaaagttttcatgaaacattagatctttatgcttatgcttctaatgctaatagtaatagtaatattgtcattgatgttgataaaatcaatgaaccactttatttagaaaacttaccacatatgaaaagaaaaacagaagcgatcatttatggattaagtgttcgtgattttactatgtctaaaacaattaacgcaacacatccaggaacttttatgtctttagtagaaagtggtttagttacaccacaaggtaataaagcagggtttgattatcttgtagatttaggtgtcactcatgttcaaatcatgccaatgtatgattttgcgacagtagatgaacttcatcctacagtgatgtataactggggttatgatccaattcaatacaatgttcctgaaggaagttatgctttagatcctcaagatggttattcgcgagttaaagaatgtcgtcatatggtttcaacatttcatcaaaaaggtttaagagtggtgatggatgttgtttataatcatatgtatgattattatacaagtgcatttgaaagaacagtaccggggtattattttagaaagaatcaatatggagaaatgtctaatggttcttggtgtgggaatgatttagaatcaagacatcaaatggtaagacgatatattaaagatatgtgtttgcgttggcaaaaactttatggagtagatggttttagatttgatttaatgggtattattgatattgaaaccttaaatcaagtttatgatcaagcttcaaaaatagatgatagttttattatgtatggcgaaggatggaatatgcctacagctatggatgatcatgaaaaaggaatgcaagataatcatcgtaagatgttaaatattggcttctttaatgattattatcgtgaaactttaaagggtggtagtggagattctgctttaaaggataaaggttattttgcggggaatatgtataattgtgaaattggtggtgaatgtatgaaaaatacaaatcgctacagctatgttgatcaaagtattaattatgttgaatgccatgataatgcgacaacatttgataaatttgcaattagtaatggagatgaaccacttgaaacccgtaagaaaagacaattgatgttgaatgttgcgcttattttatcacaaggaattccttttattcattgtggtcaagagttctatcgtagtaaagatggacttggaaatacgtataatacattagatcatattaatgcagtcaattggtctttagttgatgaaaatcaagaggatattgaaactcttaaacaaatgattcaacttagaaaagaaaatggtggatttaagtatgaaacaattcaagaagtaaatgaatatgtaggtacaaatcattttgattatcgtattttaagatattgtgtgaaacaaaataaaggaaaatatcaagagattgttgcatattttaatccttcgtattatgattttgaaataaatgatatggatgaatatgaagtgatttataatgatcatgaatcacgcacatatttagctcctatttcgatgaaaatatttggattaaagaggtaaaaaatgaaattaattattggtttaggtaatcctgggaaagaatatgaaaatacaagacataatacaggatttatggtattagatcgtttaagtgaaaaattaaatattgaaatgacacaaaacaaatttaaaggactttatggaaaaagtaaatataaaggtgaagatgtgattttattaaaaccacaaacttatatgaatttatctggagaatctgttagacaagtcatggatttctttaaaatcaatcaagaagatatcttagttatttatgatgatttagatatgccagtagggaagcttcgtttaagacaaagtggtagtgctggtggtcataatggtattaaaaatattatcttgcatactggaagtcaaaattttaatcgtattcgtgtaggtattgatcgtagtaaatatataaaagttgttgattatgttttatcacgttttacaaaagatgaacaagatgctatcaatcaaggaattgaaaatgccagtgatgcagtcgttgattatttggatcatggatttaaccatgcaatgaatcgttttaattagaggcacatatgaaaaagatactacatttattaaaagataataaagcatttaatgctttattgaataaacaaaatatcgttgtcaattcttctaacagcgaagcgctactgattgctagcgcatttttgactttaaaaaaagatatgctgattgttaaatcaaatcaatatgaagctaatcttctttataaacaagtttcacaaatgattgatgaagctctttattttcctgtagatgaatcttatcgtattgaaagtttagctgcttcaggagaattattaggacaaagattaggaacgatgtatcaacttacacgacctggtccacatcttttgattagtcatggtcatagtgtgatgcgatatgttccaactgttgatgtttttaagaaaaactgtatgactttaaaagtaggagatcatattgatgtttatgatttacaaagatttttagtgcaagcaggttatatgcatacaacacgtgttgatcaacctttctatttttctaaacgtgggggagtcgttgatattttttcaatgcaatatgaccatcctattcgtatcgatttctttgatgatgaaattgattatattaaattttttgatgaaaaaacacaaagaacgattgaaaaagtggatgaaattgaaattattccagctaccgatcttctttatttagatcaagaagtaggttcagttgttacacaaatcaaagattcttttgaagaacaatatcaaaagatggatgatttatttaaagatgattttgaagaaaaaatcatgatcgatattgaaaacttaaaagcacatgctacagatagtagtcaatatgcgtattatcatctctttaaaaatgtgacgagtattaaagattatttagatgatccaattactattttatgtcaagaagaagatattcattttcaaatcaaaaactatatttcagaaaacttctattattatcaagaattaagccaaagtggacgctttttaaaagataatcaactttatcaagactttgatagcattattaaagataactatcaagccattaatacctttacaacaaataaagatgatgttgtctttttaagtcacgatgtgatgtttaatcgagatgatgaaaaacgtgtcatccaacaaatcaatgattatttaaagaatagtcaaattttaatttctctagaaaataaacatcaacttcaattgatggtggaactttttgatcgtcatgaaatgaaatatacacttgtaggaattgatgaagtaatttatccaggtattaatctttatgtaggaaaacttgcattaggattagaacttattgaagaaaaagtagttattttaacagccaatgaattatttggaaaagtcaatgtttctaaaacaaaatattttagatttaaagatgctaaaacattacgtaacttccaagaattaaatgttggtgattatgttgttcatgatagctatggaatagggcaatatttaggaattaaaacacttgatgttaaaggatatcataaagattatttatatgtggcttatgctggagatgatacgctttatattccagttgaacaatttaaaatgattcgtaagtatgcaagtgctgatggtaaagtaccaatgatccatgctcttggaagtagcaaatggacaaaagctaaacaaaaggctaaaaataaaattgatgatattgctgatcgattaatagaattatatgctaaaagaatgtcttcaccagggtttgctttttctaaggataatgaattacaaattgattttgaaaatcaatttggttatgctttaactgctgatcaacaaagaagtgttgatgagattaaattggatatggaaaaacctcaaccaatggatcgtcttttatgtggagatgttggttttggtaaaactgaagtggccttacgaggtgcttttaaagcaattttagatcataaacaagtagcttttctttgtccaacaactattttatcaatgcaacattttaaaacagccaccgaacgttttaagaattttcctgtagaaattgctttactcaatcgtttcacttcttctaaagaaaagaaacgtattttaaaagaagttaaagaaggtaaaattgatttattaataggaacacatcgtattttatcaaaagatgtcgcgtttaatgatttagggttacttgttatcgatgaagaacaacgttttggtgttaaacaaaaagaaaaaatcaaagaataccgtgaaaccattgatgttctttctctttcagctacaccaattcctcgtacattacaaatgtctttaatgggaattagaggattatcgaaaatcgatacaccacctaaaaatagattacctgtacaaacttatgttgttgaaaaaaataatacgttaattaaacaagttattgaaagagaactcgctagggatggacaagttttctatctttataatcgaacagatcaaatcgctaatgtagcttataaaatttcttctactgttcctaatgcaaaagtagctataggacatggtcaaatggataaaaatgaactagaagatgttatgcttcgttttatgaataaagaatttaatgttcttatttgtacaacaattattgaaacaggaattgatattcctaatgccaatacgatgattgttgaagatgctgataaatttggtttagcccaactttatcaaattagaggacgtgtaggtcgtagtgaaagaggcgcttatgcttatcttctttataaaaaggataagtctattcaagatgatgcattaaaacgtttaaaagcgattaaagaatttactgaacttggtagtggttataaaattgccatgcgtgatttatcaattcgtggttcaggagatattcttgggggtaaacaagctgggtttattgatgatattggttttgaaatgtatatgaagatcttacaagatgccatcaatgtaagaatgcataaagatgaaaagcctgaagaagaggttaaaaacttaaatgtgagtgtagatggttatattcctgatgactatgtagaaagtgattatgaaaaacttgaattgtatcaaagattagataaagcaaaaacaatgagtgaacttaatagtttaaaagcggaatttgatgattattatggaaatttaccagaagctattttaacattgattgaaaagagaaaacttgaaattctttcacattattctattattgaagatattaaagattctggtaaacaactagaaattatcttttcaccaaacgcttttgaaacaatttcaggtgataaattattcttgcttgctaatcaactttttacaaagccagcctttaaatctttagataataaaataacaattaaaatcaataaacatgatcaatggcttaatcgtttaaatgagtttattgaaacgttatcaaaaaaataaacgaaagaaaagtacaattttgtcgtacttttcttttttataaaaaaagcaagttaaataaaatgccttggggtttcttgtttgtatattaacttattaattaatgatttttaaaacgtcatcttcgtttgtgatatcaaaaattgaaagtgttaatgtattgagtttttctattgagctattttgtatcgcttgttcgagttgatttgatacgtttcctaattttactttcaataatgataatagtgttgttttcttttctcttttttcaccttccataagtccttcgcttcttccaataatacgtccttcatttctaaatccttctgccattctttccattccttcacacatatcgattttttttttttatgtttgttaactaaaaaatcctaacagattgtgttaggatttttaaatacattgttttaatttctctacaattagttctattttttcactatctaatgaggaatagttcataacataaatatttttgttttcttcattatttttgtaatattgagaaagtggacttaactttattcctttactgtaggcgttgttaataatgtctttttctgttttttcactttttattttcattaaaaaatgaacaccggtagtttcattataaatttcaatcttattatttatattgcttgtttggaaagcatttaagattgtattttgtttttttaaataataatttcttaaacgattaatatgtctttcaaaatgtccgttttcaataaatctagaaagtgtatattgttcaaaatttgaaacggtacatgaataaaatgagagacgtttataatattcatcagctaatgattctggtaataccatataggacatacggatggttgatgatagagttttagtaaaggtattcatgtagatgattttatcggaaacatcgatactttgtagggtaggaattggttttcctcctaatcttaattcactatcataatcatcttcaataatataatgtttttcaactttatttgcccaacctaaaagttcatatcttcttgaaattggcataacaatacctgtaggaaaatgatgagatggggagatgtgtattacgtcaattttcttttcttctaattcatttggatcaattccatattcatccatatccacatattcaaaatcaacattcatacttttataaatttgtgcagtttttggataaccagggttttctaagccatatttaacatcgtttcctaaaagttgaataatcaagctatatagatattctgtacctgcaccaataatgatttgttcaggtttaatattcatatctctaaaatcttttaagaaattcgcaatgttttttcttagttcaagaattcctccacaaggtgagttgatcattaactcttcttgattatttcttagtacttctttcatggttttgatccaggtagtaaagggaaagatatcactttcagtttgattactagaaaaatcagctaagtagtgattatgtccacttgttaaaatcactttctctttattcatttgttttttagaaggaatattttttagatcagtgacataaaaacctttttttggtaatgaataaataaatccttctgacataagtaaactataagcattttcaacagtaatgatacttactccaagattttttgaaaaaggtctctttgatggtaatctttctcctggttttatgtttcctaaaataatgtctttttttatacatttataaagatattcataaagggaatctgaccctatatttgtaagattatatgttaacataattgattcctccttaaactgaccttaatgaatatatttaatttgaatattttaatatgttcacatttaagtataataaaagccataacaaaagtaaacagggggattaaaaaatgtcaaatgaaagatacgcattaaataaacaattagcacaaatgttaaaaggtggtgttattatggatgtaacaacacctgaacaagcaaaaatcgcagaagaagctggagcatgtgctgttatggcacttgaaagaattcctgcagatattcgtgcagcagggggagttgcaagaatgtctgatccaaaaatgattcaagaaattcaagcagcagtcagtattccagttatggcaaaatgtcgtattggacacttcgtagaagcacaaattctacaagcaattgaaattgattatattgatgaaagtgaagttttatcaccagctgatgatgtttatcatgtcaacaaaagagaatttgaagtaccatttgtttgtggagctaaagatttaggagaagcacttcgtcgtatcaatgaaggagcaagtatgattcgtaccaaaggagaaccaggaacaggagatatcgttcaagccgttcgtcatatgagaatgatgaataaacaaattgcccaaatttcggctcttcgaaaagatgaacttttcgaagttgcaaaacaattacaagtaccatatgaacttgtagaatatgttcacgatcataaaaaattaccagttgttaactttgctgctggtggagttgctacacctgcagatgctgcattaatgatgcaattaggcgcagaaggagtctttgttggttcaggaatctttaaatcaggaaatcctaaaaaacgtgcagaagcaattgttaaagcagttacaaattataaagatgcaaaattgatagcagagttatcaaaagatttaggagaagcaatggttgggattaatgaacaagaaattgaaattttaatggcagaaagaggaaaataatgaaagtaggagtattggctttacaaggtgcttttattgaacatgaaaaaaagttagaaaagttgggagtagagtgtattgaattaaggcaaaaaaaagatttggaacaagattttgatggtttaattcttcctggtggagaaagtactgttcaaggaaagctcttaaaagaattggatatgtttgatattttacaaaaacgtattcaagatggcttaccgacacttgctacatgcgcaggactcattttattagctgataaaattgtcaatcaagatcatacttatttttcaacaatacctatgacggttaaaagaaatgcttatggtagacaactaggaagttttcacaccattgaagaaatgaaaggaataggaaaagtacctatgacttttattcgcgcaccttatatcgaaagtgtacaagatggtgttgatattctttctaaagtgaatgacaatattattgctgttcaatataaaaaacaattagcacttgcatttcatcctgaacttgatgaagatgattcaattcatcagtattttataaatatgatcaaaaagtctacaatgtaggcttttttcttatataataaaaaagaggtgaataaaatggatcatcatctagaaattgttaaaacaaatattaaatatcctattgttttttataatcatcaatttaataaaagtcgaccagtaagttcccactatcatcaagatattgaagttgtatatgtcgtttcaggaaaaatagaagcatgtattgatggaaagaaagaaatattttatcaaggggaaatgtttattattaactcacatagtgtacatcaattcaattttcctgaatttacacatttatatacatatttattgtcagttgatgtctttaaagaatttcaaattcaatcttatttctttaaattaaaagctccatcaaacaaagaatggtttaaaccttggttagaaatgaaatatattcaccatcttttaccaatagaacaacatattttaatgtatcaactctatcaaaaactcatacaggattgtttattagataaaaaacaagaagaaaatacaaaagaaatttataaaataatagaagaaatagaaaaaagatataaccaagatttaacacttgaaattatagctgaacaatttcactttcatcctaattctttatcacgattatttaaaagacaaacaacgatttccttttatcaatatttacaaaaaataagattaaaacatgcttattatgatttaatacatactaacatgaaaatcattgatattgctttaaatcatggatttaaaaatgtaaaatcatttgaaaatgtttttaaaaaagaatatcatacaacaccaacaaaatatcgaaaagttaataattgactataaattgttaaaaaaggcaatgaatttcctttataaaaagagaataataaaagcaggaggaatcaatatggaatggtggaaaaagagtgttgtttatcaaatttatgtaaaaagctttcaagatagtaataatgatggtgtgggagatctacaaggtattatttcaagacttgattatttaaaaacattaggtgttgatgtattatggttaacccctatttttaaatctccaaatgatgataatggctatgatatttctgattatagaagtattcaaagtgaatttggaacaatgagtgattttgaggaattattagataaagcgcatcaaaaagatatcaaaattattcttgatttagtttttaatcatacaagtgatgaacatttttggtttcaagaaagtaaaaaatctaaaaataatccttatcgagattattatatttggaaagaaggaaatgagggagatgttccaaataattggacaagctgctttcaaggctcagcttgggaacttgatgaaaagacaaatgagtattatttgcatttattttctaaaaaacaacctgatttaaattggcaaaatcctaaggtaagacaagaatgtattgatattatgaattactgggtagataaaggtgttgatggttttcgtttagatgtcattaatcttattagtaaggatgaaagtcaatactatgtagacagtactattaaaggtcatcaagtatgtgcaaatggaccacatattcatgaatatattcaagaaatgaatcaaaaagtattttctagaaaagaacttttgacagtaggagaaacccctgctgtaacaatcgaggatgctaaaaaatatgctcctttagataataaagaattaagcatggtctttcagtttgaactaatgaatgttgatggtgcagaagttaataaatggacagatcaaagattttctttaaaagatttaaaacaaattatgtcgagatggcaagtaggaatgtatcaacaggcttggaattctttgttctggaataatcatgatcaaccacgatgtgtttcaagatttggtgatacttcttctcctttgtgtcatgaaaaatcagcaaaaatgttggcgatatgtttacatatgatgcaagggacaccttatatttatcaaggggaagaattggggatgacaaatgtaccttttaattcacttgatgattatcgagatattgaaacattcaatagttataaacaacttgtagaaatagaaaaatcggtaagtcatgaagatatgttacgctatatgagaaaatcaagtagagataacgctagaacaccaatgcaatggaacaaagaaaaaaatgcagggtttagtgaacatattccttggattatgatgaatccaaattatcaaacaatcaatgctgaagcagaaatgaaagatacaaattctatttttcatacttatcaaaaattaattcaattaagaaaagaatatgaaatcattactttaggtaaatatgagttaataatgaaaaatgatgaaaatatttatgcctataaacgtctttatcaagatgaagaactttatgtttattgtaattttacggataaggaagtaagctatgatgcatctattttaaataatgaaaaagtattgattcaaaactataatcaacatcaaaaaggaattcttaaaccctatgaaagtattgttttctatcaaaaaagcagagcctaagctctgcttttacattaaatatgatattccataggataagttaaataatctaaacgatctaattcatcaactgtaactacaccagcaggtgcaactaaaacagttggaatacgattgacaatcgttgcacatgtatgttcaaccgttgcaggttttacaacatgaaactctgtatctggttcacctgtaattttccaatcacacatatctccatcatcttctccataaactttaccaatacattgtgtttcaataattggtccttggaaggtttctgttgtaacaacagcagccataccaatacaatttccttttggaatggtttttcctaaagtagaagaataaagatctgtttcatggaaataaggaacacatttttgagtttgtgacttaattgtccatcccatacgtgcagctaaagcttcatttgaattccatacataagaaggttctaatacttctggatgagcaatacttgcttcaaattcttcaggtgttaaaccaactccatgagctttggcaagagctaatccataatcttcgacattataacttacagcaccttcaatctttttaatagagtgacatccaccggctactaaatcaaccatatttacccagaagatatcttccataccactaccaacaaaagtacatccattttcttttgcgataacatctaattgatttgtacgaactggatcagttgtccaactatatgttgcttcttcacatgtagaaataacactaattcctcttgataaacattttacataatgatcgaagcaatcactgactaaactaaataaagtgacaacagcgatatcaggatctgtttcatctaaaacttgatcagcttgatcactaatacaaacaccagtcttaataccaagacctgcaaaatcaccaatatccattccaataatagctggattagtatcaatggcaccaacaatcattgcaccattttcataaagataacgaataatatattttgccatctttccacagccatattgtacaactttaatcttttccatattgtatgcctcctatttctttacttatatcatagagtcttatccaacatgagagtcaactattttttaaaaaaaacaggaacttgtaatcttaaaaacattgaacgttcatgatgatcaaacatactgagttcacttaaaacttcacaaatataatctccatatattattaaattgttcattcgacaataatcaagaagacgttttgcataatctatttcttgatgaaaatcatcaagataaatacaagcatacattccattttcaataatttgaatatctttttcaggaaaatgatcatccacaaatacaaaaatacgatctgaaataaactcttgttttaaaaatctttctttggaaagaaaagtacccgcattacaataataaatttgtgaataatgacgagaaagcatattattttttaattgatttaaaagatgttcataaacatctaaatcatgttcataaaaattaatgtcagtattcatgacataaattcttcgacggtcaatatattctaaagtaattgtcccacttgggggtgatttacgatacctttctaaactataaatcgttcttgaaatagcatctttagttctttgtaaatcattgatttgtatagaaagctgttgtttctttttaattaaaatggcttcaattaaattaatatcttctttatcaagaagttccttaatttctttaagattcatttgaagttctttcatatattgaatcaaatctaaacgtgcattttgtttaatatcataatagcgataatttgtctcaggattaacataaacaggctttaataaatcaagttcatcatataatcttaaagttgttacagtaatatgattcattttggccatttcaccaatgcttaaatagttattattcattcgtatcacctcaataagattatagcaaactctcttgttagatgagagttattttaattattcatctaaaaatagacaaataatcttatattaatgagagatttccttttttacgaaagattatgtacaatagagttagttttaatcttaagaaaatctttagaaagataaaaagaaaatatttataaatcatctctatactttaagacaagaggtgaggaagatggaaagattaaacaaaatgattttaataagctgtatttatgcagggtatatatgtattagttttgcattgttttcaatgcttagataaggagttaaaaagggaatggaaaaatatcatgtattagttgttgaagatgacacagaaattgcaaatgcaattaaaatttatttgcaaaatcaagggtatgacgtttatgtaggaaatgatggattagaaggcttagaaattattgaaaaagaaacgattcatttagcaatcgttgatattatgatgccaaggatggatggtttaacaatggtttctaagctaagagaaagatatgattttccagtaatttttctttcagcaaaatcagaagatattgataaaatcatgggacttaatttaggtggcgatgattatgtgacaaaaccatttgtacctatggaacttatggctagagtacgctcacatttaagaagatatggacgttatttagatgcgacagcaccaaaagaaagtgatcatgtttatatttgtggaggtcttgaactcaatgttgatacaaagacagtttcggttgatggtaaaaatgtcaaagtgacacccattgaatttaaaatacttgaattattaatgaaaaatgcaggaaaagtattttctgcagatgatatttatgaacgcgtttggaacgaagaagcaatcaatagtgaaaccgtaatggtccatgtgcgtaatttaagagaaaaaatagaaattaatcccaaaaaaccacaatatttaaaagttgtttggggtgttggatataaaattgataaacaataggaggaaacatgaaaaataaaagaatacttaaaatctttttgttttctattttaattgttgcatctcttgttacttatttaagttatggagtaaaagaaaagacaacaacatcaagtcttaatttagaaaataataagagtgattttacaaatattttgatggaaaaaagcattatattagatgtgaaaattcaaagaagaaaaggagattatgatttatttaatcattatgtaagcggagatattgatggtgaaataaatgatggttattctttaaaaagtgcttttaaagattttatcatgtatttagaagataataattctcgagaaagtcgaggaattcaatattatgtttatgataaaagtgatgaaaagatttgttttacaaattcaaaaaagaatttaaggaaagcatttgaatctaatgataaaaatattttaaagaattaccaatggtatacaactattgattttgatgaaaatgggaatgtttctttacaaggaagtaagtctaacgattgggaaggctctttctacaatacatcctttgatcaactctttaaaaacgattatttagatgaagaagaaaacgatattatcaacaatattactgttaaaaatccaacaaatatcaaagtattgattgcagttcctaaaaaactaccaacaaatagttatttggaacaaaactatacgaatcaagtttctatttctgatactttaatgacctatgtttttgtatgtattgcagtattagttgtttgtatgttattaattccagtaagaaaagttattgatatcgaaccctttaaaactgttgtcaacattaaacttttctttatgtttattctttattctattgctacagctttgtggcttactgttatgacagaagttttaagagagtcatggagtgggacttttgcctggatgataagagaaaaaggtatggcgggtgcaggtgttgctttagaaccattagttaatatctttgggtggtttgttttctatgctttaattatgtattttatattttatattaaatcgattcttgtttttggaaaagattttctaaaaaaacatacacttatatgtagtatttatcgttcttttaaagaagaaattaaaagtttggtacaatttgatttgaaaaatcaaagtggaaatattgttttaaaaataggaattatgagtggtatctttatagaaggaatactgttatttattagtttctttatgtcggtaacaggaaggggtgtttattactacagtataagagtttatgttgtacttacgtgtcttgtatcttttgtagcagtaattataatcatgttaatttctaaaaagatgcttacacaggttacaaatgattatcaaattcttttacaatcagcgcatcatttatctcaaggagaatttaacgataaaatcaatcaagatcttggattatttaattctttgaaagatgaacttaattgtatcaatgatggttttaaagatgcggtaagtaaagaagttgcatcacaaaagatgaaaactgaattgattagtaatgtttctcatgatttaaaaacacctttaacatccattatttcttatatcgatttattaaaaaatgaagaattatcaaatgaacaacaaaatgaatatattgatattttagatcgtaatactaaaagattaaaaacacttattgaagatctatttgaagtatctaaagtcaatagtggaaatatccaattaaatcctatagatttagatattcatgctttattacaacaagttctctttgaatatcaagaacaatttgaacatcatcatttaaatctaaaaaatgattatgaaaataaaaaaatcatttgtcatttagacagtgaaaaaacttatcgtgttttagaaaatttatgtcaaaatatttgtaaatacgctttagaacatacacgagtttatttacaaatcgttgaaacgaatcaacaagtcattgtcgttttcaaaaatatttcagcacatgaaatatcaaattcagatgatttaacagaaagatttgtacaaggggatacttcacgtaaaagtgaaggttctggtttaggacttgccatttgtaaaagctttgtggaggttcaaggtggaacttttgaagtgaatgtagatggtgatctctttaagacaacaattatctttcctaagaaaatagaaaatgattaaaaagattataccctggatcttactctttctccttcttcttataatcaatacagaaatgatttttatgatttataaaactatctcatttttgagatagtttttcgtattttgaaaataaaattcaaagattaaaaaataagtataatacttttgaaagaggtgaaagtatgaaatttaagttttcaatcaaactagcaactatttctttaattggaaatattattatcgctataggtgtttcaacatgtcgtatatcacaaatgggaattgatccatttacatcaatgacaacaggaatcagtagtttattaaatatacctttaggtgtttttcaaggaagtgttaatgcaatcttatttttaattttaattttattaagtagaagtaatttaaaatatttaaatattggtgccattattaatatgtttttacttggtttctttgtacaattctttaataatgtttattgtcaattatttaatgtttcttcaccggatgttataccattttcattaccaatgaaattcgtggttttagcgattggtattttatttgttacacttggatgctctttatatatcacatcagatcttggaactggatgttatgatgctttatctatttatatggcagatgtgatgtcaccatcttatccagtatgccgtattatgacagatgttgtttgtgttttaattgggtttattacaggtggaccattaggaattgcgacaattattttaatgtttggtacaggtcccttaattagtacatggaataaattggtatcaaaaccaattgttgaaaaatttgcctaaaatattcctcggtaattgtagagttatcgaggatatttttgtataatggacacgttatgaaagaaataaaaagaggaatgaaaaatggaataccaattgctttaggctatttatctgtgtctttttcttttggagcgattgctgtatcaatgggatttagtgtcatgcagtctgttttgatttcattgtttaatttaacttcagcagggcaatttgcttcactaggaattattgcaggacaagggacctatttagaaatggcgatcgtggaattgaccgtgaatattcgttatgcgtttatgtcactttcactttcccaaaaagtagatgaaaagtttaaaggaatttataaatggctcttaagcttttttattaccgatgaaatctttgccttatcgatgcttgaagaaaatgtgagtcggacttacttctttgggcttgcttcaatttctacggcaggatggatgcttggaacaaccttaggggcaatgcttggctctattgtacctacggtcattagtaatgctttatcaattgctttatacgcaatgtttatcgcaattattattccaggaatgaaaaaagataaaaatataattaaagtagtagctcttgcaattattatccgttcaggtttttactacttacccatcatcaatcaattatcaagtggttttgcgatgacgatttcagctcttacaagtgcttttataggcgctgtgttatttaataagggggaagcacatggataaacagttttatatttatttagcgatcatgtcgcttattacttatgctattcgtgcgataccacttgtctttattaataaaaaaattacgaacccaaccattcaatcctttttggattatattccttatacggtccttgcagcgatgaccttcccagatattttttattcaacaggtcatttgatttctggaatcgttgcgacaatcattattatttatgcatcttataaagaattaagtctcattcaagtcgcttgtattggatgctttgttgtagtaatgattgaacttattttatagtatttgacgccttttaaagcgtctttttttctatgtcaaataattttgacatagaaaaaagtcctatgtaaaagatatttgatagactctatcaatagattatgaaaaaatgaaaatgaaaggagaaagaaaatatggaaataggtaaaaaactaaaggaggcacgtttaaatagggatttgactcaagaagtcattgctgaaaaactaaatgtttctcgtcaaacaatttccaattgggaaaatgaaaaatcttatcctgatattataagtgtcattgagttaagcaacctttattccataagtcttgatgatttattgaaaggggacgatgcaatgatggaacacttacaagaaagcacaaacgttgttaaaagtaatcaaaaactattaagagcgattatcttaaatattattgtggtaatcttgttggttacactaggaatgtttttaccaagtaaaagttattatttagtgatgatcttttgtcttgctattgtgagttcatcattgttgctttatcaaatgattaaacgtatttaaggaggaacggatcatggaagtaaaaagtattttagcgattatatgtgcggctattgcacttgttgggggaattgaaacagtttatcaaatttatcgattaacggtgattgatgccacaattcgtggtttaaaacatcctaaactatggggattactcgcaagtaatggaaataattcaagtggtttattactttatttgataggaagaagaaactatcctataaattctattgattctaatcaaaaaacaaaaatgattcaaagaaaaaaagcagcaggaatctctttatgttttatggttgtaggaatccttgggttgattttaagtataagtataagtttataatttttagcactcacatcttgacagcgctaaaagcaagaactataatgtatttagaaattaggaaaggtattaataaagaacctagtttcaagagttaacaccgcttgaagtaacgatgctaatgactaagcatttatattgaaaggggaaatgacttatgatgatgcctagcttatttacagaaaacttatttgatgatttctttaatgattttgatgaagatttctttggaaagaaaaatccattgtatggaaaacatgcaagaaacatgatgaagacagatgtcagagaaacagatacgacatatgaagtagatgttgacttaccaggtttcaagaaagaagatatcaatgtcaactatgaaaatggatatttgacaatatctacaagcaagggattagataaagatgaaaaagataaagaaggacattatatccgacaagaaagatatgttggcaatatgacacgaagcttctatttaggagatatcccaaaagaagatatcaaagctaaatatgaaggtggagtacttcgtttatcagttcctaaatctgatatgaaacaaattgaaaatacttctacaataagcattgaataaggaatgtcatttgacatttctttttttattgtttaaaatagttcaaaaatgaactatctaaaaatgaagggagtgataatatgaatattgattttgctagaaaattagaacttgcttatcatcaacaatgtaaagatctttgtaatgaatttcatttaaagcaaacagggtttgatattttgatgtttttgggaaataacccacaatataaatatgctaaagatattgtggaaataagaaaaatcaaagcaaaccttgtttcaattcatgtggatcagttagttgatcaaggatatttatctaggatagatgttccaggagatcgaagaaaagttgaattagttttgaataaaaaagcgaatgatgttataaaaaaaggaaaagcgtttcaaaaccatttcttttcttcacttttttcagatattgatgaaaagcatcaaaagatatttaaagaaacattagaacttatgaaaaaaaatatagattgtttattggaggaaaaataaattggaaacaaatattttatttattattcttgtaaccttttttgctggaatgggagcaggtctaggaacagggtttgcaggaatgtcagcggctgctgttattagcccaatgctcattgcttttttgaaaatggatccttatatggccgtaggtattgctttgtcatcagatgtccttgccagtgcggtttcagcttatacttatggaaaaaataaaaatttagatattagaaacggtttattgatgatggtaagtgtacttatttttacggtagtaggtagttatgcggcaagtcttttaccatcttcaacaatgggaagtttttcagtttttatgacttttattttaggagttaaatttattgttagaccagtaatgacaacgaaagaagcaatgaataatgtttcttctaaaaaaagagcaatccaatctataatttgtggaacttgtataggttttatttgtggttttgttggagcaggtggaggtatgatgatgcttcttatcttaacaacagtcatgggatatgaacttaaaacagcagtaggtacgagtgtttttattatgacctttacagcccttactggagctatttcacattttatgattggcgggtttcctaatttgacagtatggattttatgtattctctttactcttatttgggcaagaattgctgctttatttgcgaataaagcaactcctaaaaccttaaatagagcaacaggaattgttcttgttgttctaggaattgttatctttttattttcataaaataaaattgaggaatgaatcctcaattttttatttattgattagccatttctatgatacctttaataccgcttttaaccatatttttaacggctgtatttgtatagaaggccatgtgttgagtcatgatgacattaggaaattgatggagataagccatatttttattagaaagaatatcacttctatgatcgatatgcgtaatgccttcttctccttcaataacatcgagtcctaaagctccaatttttttactttcaatagcctcaataatatcttccgtatcaataagttcaccacgggaacaattgatcaaaattacattatctttcattttttgaatagtttctttattaattagatgatacgtacttttaaataaaggaagatgcaaacttatggcatcactttcttttaataaagtatctttatctacataagttgcatattttttaacatcttcattttcctgaagatcataagctaaaatacgacaaccaaagccagaaagaagttgaacaaacgtacgtccaatatttccagttcccataacaccaacggttaaatcatgaagttcttttccttgtaaaccacttaaagaataatcattgacttgtcctcgccataaagcttgtttatagtttctcatacacattaataaaagcattaaagcaaattcggcaactccattaggtggatatttcgcattacatacttgaattccaatttctttagcgtgttctaaatcaatatgattcaaaccaattgtacgagaagaaacatagcgaataccaagatcataccatttatctaatagttttgcattaatgtctccttgacctaaaatagttacaccaatacatccatctacattatctgcattttctaaagtgggtacttggtgatttaaaacaacagaaacaccatatttcttttcatattctttaaaataacccatttcatcttgtcttacttcataagcataaattttcatatgaatcctccattttcaatttcacaatataaagaccgtcttggaaggtatcaacataaataaaaccacgatcatcaactaaacaatcttcggtaattgcgactttagaacctggtaataaagtgtcatcttcattattaaaaagatcaacttctggatcaggaggcataaagtaggcaatttcttttggaataaaaggatccgtcgtatcaaagactctaagtccagctccaaaataacaattataaattaaacctttataaggttcataacaatcttttccaaaagcatcaaataaattatgaggtccaaaaggaacacgaacaccatcaacaatattaaagttctttccatgagtatatccaacaggtacttctggatatgggaaaatagaaataagtgatggatttgtcggatctgtagtttcgacaattccaatcgtattcattggctgtgttacaagctttttaaagagaccgtctttattttcgttagaaaaataacgaggtctttccccttcagtagaaacaaccgcataaggtaaatcacctaaaggcatgtaggtatgaatagacatcccagcagcgcctcctccaaaaggtggattcattggtaaataaccgattaattgtggatttgtgggatcgctgacatcgatttgacaagcgccaaagtttgcaaccgcagcataacaaatatgatctttaacagtaacagcatgaactgttgccatttctaagaactcttttgaaccaaaggcaacatgaccaccaccaggtttattagcacggtattgattatctgcccaccatgaaccgacttctactggatgggttggatcttgaatatctatgattcttaaaataaaagttaaaaaacctggcttatttcctacacaataaacataacggccaccattatagaagaaacgatgaacgcctgccattcctttacattcaaacttacctaaaagttttggattcataggatctgtttcaatatcccaaatcatcataccaccccaaaaaggaagggtatttcctttaggagttccatgtaaaacatccatcgttccaccatgagctgtaattaaataaccatcccctgattgtatctttggtagactttgaccatctttgatgccttctttgacccaaggaccttctacccatttagaaggagtaggatgataaggatcggttacatcaataatattaaaaccattatgtctaaaacaagcaacataaagataataacgaccttctttgcttttatgaagagtcatttgaaaaccaggttttccatttaatccttcataagctacaaattccatatttttcatcaacatttcttttctttgtgacattgtttgtcctccttatttatctacttttattttaaaacaagattaaaaaaagtaaattaacattaaattaatggcattaaagaaattctaatgctagaataaaaaagaggcgaaaaaatgaatagtcaagaacttaaatgttttgttgtggcggctgatcgtttaaactttacaagagctgccaaagaactttatgtcacaccaccaacagtaacacatcatattcaacatttagaagaggaacttggtgttaaactctttattagaaatagtaaatcagtacagctaacaacagcaggcgaaatcttttatcatgatgctcatgatatcttattacgtatggaagctattcctaatcgtttaaatgccgtaaaaagcaatgaacaaactcttttaaaaataggttgtactatgtcacaagaaacaaaataccttacccaagcattacgtttatttcatagagaaaattcaagggttagtccacgtatttatttagatgactattttcaattagtgaatcgacttgttgaaaatcaacttgattttattttaggaactaaaataatgatgcaagatcgaccagagtgtacttttagaaagctttcaacaagtacaacaaaagccattattcctaagagtatctttcaaacgtctaaagaaatgatttcatttaatgaaatccaagattgtccttttattacattaagacaaaaaagtattcctaaattaaaggaagatgatcttgaacattttctttcaacaaaagtaagagaaaaaaatgtgattagacaagatgacatcgaagctgtacttgccttaacattaagtggttatggaattggtattttaccggattatgctttttcaattcaagatttagatgagagtgtgaaggttgtttctcttcaagaaagcttagaaatagattatggaattatttatcttaaaaaagatagaaataaactgcttaaagaattcatagaatgttttaataaatagagacaaaaagagtataaataaaagtatacttcatatactaataatggttgatttctatatttaatagtaattgacttatacattaaaaaatgtataatttatttgtagatagaaatatcgataacgagagaggtcctgctatagtggacgatttaaaacgagagtggccttgctttagtaggcgatttaaaacgagagagatcctgctatagtggacgatttaaaacgaagaattctagtttatgagttcttcgtttttcttcatcgggagaaaatatgaaaatacatttaaaagataataaaattgctttatatgatatagaaagcgattataggcagtatttatttcagtatgattttagagtgaatttaaaatcgggtagaagatttgtaggaattattgttggaatagaagattatacatattttataccattaacttcaaagcctttaagaaaaaatggaaaaagaagaaatccgagaacaacagtagaaatttacaacgaaagtcacgaaatcattgctgcattgcttattaataacatgatacctgttcctcaaggtgtatataaaagaatagatatcaataatgataagtataaagattatttaaataatgagtatatatatttaaagaaacaatctactcgtgaagaaatagaaagaaaaattaataacgttgtcaatgctgtttttgtaaagaaagatgaatttttgacgagtttttgttgtgattatttaaaattacaagcattgtgtgatcaatggaaatataaataaacaactaaaatagatattgtgtattttagctatttcatttattatattagtactatgtgtttggaggtcttatatgaagataacattattgtcaaaaccaggtttttcaggaaatatgttggttcgtaaaatagaagaagtagctaaaagtcaattaatggatattgaagtgtttttaaatgagcatttacaagaggccgatgtggttttacttacgccacaaagaagtgaagatttaaaggaaattaaaaaggtagttaaagtgccggtaggcgtaatttctttaaaagattatggtttgttagatggaagtagtattataaaatatgcaaaacagttgattcaaaaatagggcgctctaaataatcgagtgctttagcgaaattcgctctaaattattaagggggcaccatgggtcataatgaataacattttcagccgatgttaagttaagacctgtacctcctgcttttaaagaaattaagaataatgttgtatcatctttttggaatcttgaaacaagttctcttctttcttccttatttgtacttcctgtaagcatgtaatatgtaataccagctttttgacattcctcagcaattaaatccaaagcggaagtaaatgaagaaaagagaagtactttttgtttattttcttgcattgttttaataagttccatacaggctttaagcttcgatgatggttgatcgatattatcataaacaagacgtggttctagacataattgtcttagtcttgtaagcatttttaaaatttgcatcttatctgaaccttctatgtcataaagttgttgaagttcttcattgactttagcaagatttgcaacatagattttttcttcttcatcactaaatggaagaatcatattttgttctattttatctggtaattcttttaatacttcttttttatttcttcttaagataaatggtgttactagttttttaagctgttttgttttttcttcgtcattatttttaacaatacttgattcatattgtttttggaaataatggtaattgaataagtattgtggcattaagaaatcaaaaatagaccataattctgctaaactattttcaattggtgttcctgttaaagcaagtttacatcttgtttttaaagttttaaccgattgtgcattctttgttttttgatttttaatatattgtgcttcatctaagattacatattcaaattcaatatcttgatacaattcaaaatctcttctcatataatcataagaggttacatataaaccttgtttaatctctttaattaattcttttcttaaagcaccattacctgtaatacatgtgactgataactgtttagaaaacttatgcacttcatcttcccagttataaataagtgaagatggacatacaacaagactcggtctattagtttctaatgaatctaataaagtgataatttgtaatgttttacctaaccccatatcatcagcaagaataccattaaaaccataatattttaacgtatgaagccatacatatccttctttttgataatctcttaagattttttcataattttgaggtactggatactctttttgcgttgctgatttaaatctatctagtgtttctacaaaggattcttcacgatcaagttctacatattcaaaatcattttcttcatcaattgcgagcattctctgtttattcattgaaaactcaccattatcaatatctttaacatcaacatgataagcatccataaattcacttaattcttctaaatcaggtgaatctaaataaagcagttcgccattttttaaacgatagaatttctttttacgacgatattgatttaagacatcttgtaattctttctttggtatttcatgagacgaaatatcaaattttaaaagattgttttcaacactaacccctacatgtaagttataagaaatcttcttacctactcttttcaatgcttctgatacataaacatctccatattgttttaaataatctaatccttcaaagataaattcataggttgtttgactattggtatcaaaataagcacgatgcttattttgatctattgatgaagcatattgttcaatatatttttcaacgatatcttgttgataggttgtaataatattgtcattaaaaccataaacacgattttgattttcatctacataaactggttgaaaataaatcatttgatcatcatcaatatccccatagattttaatttcatcataagtcggtatatcatttgaagtttcatcaaacacttcaaaataagaaagaattggtaacaaaacatatttatagaagtcttgatattgttcctctaaaataatcaattgtccttcattatccataatgctacttaaaaaacgacaaacattcccttcttcatcaaaaatcatgcgatccatataaaacttaccattattcattccataacgatagccatgtttaccaccgatataaataggttcatctacatttactcgaacaatataataatcatcttcttttaaaatatataaacgtaaattacattcaatctcacctaaagaaaagatttctttattcgcatcatagaattcatcaaataaacgaggatctattgttatacttcgtttaataggttcataatagtaaggatattcttccatatcatagcgacgaatgatcagtgcttttttcattaaatcaatttgttttaaagcatcatctgtaaagcttttttcactgtggacaaattctaaagcttttccatatttatggttttcttgattttgaattctatctataaaatcagcaatattttttaatacatatttcttttcatttccaattttatactcgagtactatttcatctccatttagataaacattcggtgttaaatcatatttttcttgattaattgaaaggcgtaagtctgtttgatattggcttttattaaaatcaataagctttgtagacatagaagccatttgtcttaattgtgcttttcttctttgtctttgattttccttttctatttctttgattttttgtaatttatcactttgataatcaaaagggagttcattgatttctaattcattaagttttaaaattactgcacctaaatgaccacacattgaatcttgatcattaaatggacatgaacattcataagaaataacttgattatctttaatatctaatgaacatttttgaggatgattaaatactgaaacgacagcatctatatgataaacatcttcattagctgtaacatgtatgctttctacattatcatagtgatgatattttctagcaatttctaagttatttttactttttacaacatttgaattaatattgaatttcaatttcatcaccttcctttaaacatgcatctaacatttcatgtagtttcttttttcttggatattcttttttcaacatatctactaactctagtttagacatttcatctaactcatgaaataagtcataaatataatctcttaaataataatttcttattccttgatttatataatcttttaagcattcaacatataccattaaatacatttctaaactgtattcttttatcattccttttagtggatcaaaaaaattcatatttggtttttgtagtaagatataaatagcatattttgcttcttgttttcgtttaaacattatcgctaattcataatcactataataatcatctactttatttataaaatcaatcaagtaattttcaaatttatttccataaaactcttttaaatcatcataataaataggaacttctgaacaattataatagcttaattttgaacataaataatttaaatacgcatcttcattttctggattgagtaaggattctaattttgcttttgtttcttttgttctaatattttgtatatgttctttatagtattgcttagcatgtcctatttgttgattattcatataatagcgtatcatttccataatataatcttcattgttattataaatttggatctcatctaagtatttttttatatccaaatgatgatcattaattattttaaaatatgtatttaataaagctggatttcttttatttaaaagcatttctttaataatagctatttgatcttcaacatctaataaataaacaacagacataatatgactaaatgcattttcatatctttgatatttcatattttctttaagccattgcactgttaattctttattatgttcattagtaagcaacttacagtatccttgaaacataatattaagtatttcatggcgataatcttttggataattagaacttaaaaattcttcaataacttgttgataattagaaatatgaaaatttccttgcttatttaattgaataatattctttaaatatttcttaaattcttcattaaattcacgttttaacatataactactacgtgatcttgcacgaactctttttaataaagcattaatatcgatatattgttgttcatccttaggaagtctttcttcaatcgcaaaataaagtgctgcctcatgtttacaatgatgaccatctttagcataggggcaatcacatattgcatcaataacttgatttgtatcatctactataatttttgtatgataagcttcacttcctaaaacaatccctgtataagtttgatcacctttttgattaacggaaaaaactctgttttgttcaaaatatttttttcctctttctaatattatatctgtaaaaaatgaactcatactcttcctcttttcgtatttattcaattatacaaaatagatcactattaaaaaagcacaaactttaatttgtgcctaaaatatatttattgatgacttccgccacagcattttcattatttgtcgccttggtaatcacatcacattctttcttcatatcttcaacggtgttttgtaccccaacaccaagtcctgccactttaatcattgataaatcattaaaattatcaccaacagcaatcgtctctttaatatctacacctaagatatccgcaagtttctttaaaccttgtcctttattaaccccttgatgattaaattcaatgtaacgatttgatgaataactgacatccaaatcccctgtaatatcctttaaatcatcttctatctttttcaaataatcataatctgtattcatatacaacactttaacaatttcttgtccctttaaaaaatcaatatgatcatcaaagatttctttaacttccattcttcccgctaaatagtcaatttcttcttgaacaaacttataagcataaaccatatcttttgtgtaaacatgaatacatacatcatagtttaaacctcgtttataaagctcacttgctttttcaaaagtaattccttcaaaataaagaagtttacttcctttattttcactaatggctccgccattataagaaattacatattcattttctaagtcataaagacctaattcttttaaagttccatcaaccgtattgtatcctcttcctgtagcaggaacaaacttaacacctaattctttggctttttgaattgcttcgatattttctttagaaattgaacgatcatcacttaataaagtttcatctaaatcacacgctataattttatacataaagagcctcctttatttattattgtatctaatcaaatatctcttacacattaatttcataatatgaaattaattctacctatgtatctttaatgagggtgataacatgaaaaaacgtatttacgaaataatagaagtttctaaagaagacgataaagcaagtcatgtatatgatttagtgatgatgtttatcatatttataagcattattccacttgcttttaaaactgaatctcatctatttaatatgattgattctatctctgtctttatttttattatagattattttctaagatggttgactgcaaacttaaagtaccataataatgatataatctcatatctaaaatatccattttcatttatagctattattgatttactttcaatcctaccatctatcagccttttaaataaaggattcaaagcattaaaaacaattcgtcttattcgaacatttagagtactacgtatatttaaaagttttcgttattctaaaaatattcaaattattatacaggttggaaagaattcaaaagatgccttaattactgttctttatctagcaataggttatattattgtctgtgctttagttattttcaacgttgaacctgatagcttccatactttctttaatgctatctattgggcaacgatttctcttactactgtagggtagggagacatctatccagtaacaacattaggtagaatgattaccatggtttcttctttcatgggaattcctatcgtagcattacctgctggtattattacggcaggctatatgaaagaaatagaatcagtataatcctgatcctctcgatacaccatggtcagtttcgatactttgcataacaaaacacgaatacattggataaggacattcctttaatccaaataacaatgcatacttcatttcttcttctgtttcaatttctttataaccatctaaatacttttcataacctaataatctctttaaatcttcataaatatctaaactataacaatcatctacaaaatgatgttcttgtcttaatttatttttcatatcttttaagtaatcattttcccattttattattttttcaaaatcattttctacccaaatacgtagtgttttatcatcaacaatttgatcaatagaaatagcatataacatttggaataattgatcttctgctctattatttgtatatgttttaagaaaatgaatacttagttcatagtctttttcttctaaagaaatatctttttgttcattccatttttttaataataaatagataaggattgatttatcttgtggtaattcatcaattaatgataataaataataaacatattgtaaatctttaataggtgtattcattgtttgtatttttttataatttaatacatgttttttatgatcttgatattgaataacaggataatgatttttaggttttttcttataaaagtaataaagaataatgagcagcaatgcaaatacaaatagtaattccataatgatcactcctttaaatcattataccacaacatcaaaataataaaattaatatttttaatttatttataatactaatatctatcttattaaattatccagtttacctatttcaatggttataaaaaatggaggaaaaatcctccatcttatttaattcttacaaatttatctttaatatcttttacttttacgccatgatgaacttctctattttcatcatcatataaagaaattgcattatcttcatctattttagttttataactcattacaaaatagatatccttttgaccattattgattattaaataacaattcttttctttatcaaacatatgcgttacatctacaatattatcttgataatagaataaatatttatcttctttttcatcataaaagataccaaattcatcatttaaactttcaacaagttcatctcccgtcataggtttcatccctgtaggtgtccatttcgtccctgaatctattcctatatcaattacattgccattttcatctgttgtataaagatgataagtatcatcacctactttttcatattgaacatttcttttttcaccatggaaccagacatccaatttactttgtataccccctacatcaaaggcataggcaacagtaaatgtagataataaaacaattaatgatgttgctagtgtgatgagtggtttaggaattcttctttgatttaaattgatttctttttgataatgtacatgtttaaatgcttgtttataagcttctttattcttcattgttccagttctccttaagttgttcttttaatatttgtcttgctctagaaagtcttactttaacattcccttcattgagttttaattgttgagcaatttctctaattgaataatcttcataataatataagtgaattacaatactatactttgatggcaaagccatcactgcttgaaataattcttcatcctgtggtctatcaaatggaatcgttgccatataatcttctatagatacttgttttcttctccaaaactttctttgaatatctttagctttattaatcgctactttatataaccaagattctatatgtttctttgattcaaaatcttttttatatgtatgatatctaagaaaagtttcttgaacaacatcctcagcatcatcaggattttttaacatcgttaatcctatcacaaaaatacgatctttatatttttcaatcacttgttctgtatctatcttcataactgcctcctcaagagctctttcacttataatacgttttatatagaaaaaaggtaacaaaaagtctatgtatttctacataaactttttattacttattcatctctatgataaaatgaatttcttcgtcttgtacaactttacaagtatagttgtgtaaatctaaaatatttctaacaatcgctaatcccattcctgtagaattggtatcatttcttgatacatccgctttatagagaggttcaaatatatgattaatatctttattttctatttttgatccatcgttacttataattattttttcttgtttataaacaatacttattttttgatttgcatatttaaaagcattgttgataagattgtcaaagacaatcatcatcaattgttgatcacatgaaatattgattttaggatcaatatcaattgtaatgatttttgattctaaatcataatgttttaatacttcttcaaacattgtcgaaagattatgattttgtttatgtaattgataagaatttgtcgttcttgtatatatcaacatttgatttaaaagattattcatatgcttagattcatcttcgatcatttttaagtatttatgttgtttttcaggattaacattctctatcaacatttctgaactatttaaaataactgcattaggcgttttcatttcatgagccattgcattaataaataagtttcttgttttatttaattcttctctttcattttcaagatacgtatatataaaataaatacatgatagaataatttgtactaaactaaacattaaaataaatctatcttttagactatctaaaacaatatttggggtatcgataaacatattaagttttatattattttctttatttacataatgaacatatatctttgacttatcagaagaaatatcacatgtttcttgttctactttaatatctttttcttttggattcttttctagtgtttgctttgaattaaaaaacattaattcaaaatcaccaagtctattttgattacttgcttttttatttttatatttataccatgaataataattcattgttccttgtgagttaccaagtttataagtcgtatgactattttcatcataaaagataatttgatctatgacgtattgattatcttttgaatgaaaactcatcttttttatagtacaaccaacttgattttgattataaaagtctaataaattattgatctcttttttattaaaagaattttctagattaaaaaaagtatatttttcatttgcactatctttaaaaaagataataaagtttttattactaaattcatatttattttttactttatattcaaaagctatattttgtttaatatcaaaaccattaccatcataaatagtagatagtacatcatgcatattattttcaatatttttatcactttgcgttatcatttgattcgtaacatcacttgctagtgaccacataacagtatccattgtattaagattactcgtgtacatctgcctacctataataaaaacaataattaacacactttcaattaataaaaatcttttaaatttcttatttttaaaggcaagataaaacatgcctaataataaaacaatacttagcgctcctaaaaaatcaaccattttcaaacaccttcgtttcaaaacaataaccttgtttaatcactgtctttattcccttttgataaggtcccaaggcttttcttaatattttaatatgtgtatcaacacttctttcttgtcccgtataatcaaatccccatactttcaataagatttgttctctagataagatcatattgggattttttataaaatattctaatattttataatctattatttttaaatttaaattcttattatttagataagcttgtttttctcttgtatttaattttaaaactcctctttctaaaaattgataatgttttctattcatgattgcattacatttagcaagtaataccggtaatgaaaaaggtttaataatataatcatcacaacctaattcatatccttttaactgatcaacttcttgtaccttagccgtaataaaaagaattggtatttcttctttttcacgtatctttttacataatgtaaaaccatccatcttaggcatcatcacatccaataaaacaagatcataactttcagttaaaaagctatagtaagcatcttctccattatcaaaactttccacaacatacccatgaacaaccaaataatcttctattatttctcttaaattatcatgatcttcagcaagtagtatcttcataacaatacctcccttcatctttaatatactttcttcatttgtaatctttgtgtaagttctttaataatttaattttatattatgatatcttaaagattcaactctattccatcatatttcatataaaaaagaaacagtatcatactgtttccctcgccctagttattattatctttttttggtaaataccaataattattgaactgatataagaatgtttttgaacccggtggcatttctacaaatgcatgatatacattcatgaaatctactgctgaatttgcaacaacaaacatagcggccattcctaaaaaaaacttacattttgttaatgaaatataataaggaactaaaccaaataaaatatcaggaataagattgatagctatatattttttctttgtaaactctgttgtatatactcctgcaaaaccaacacgtggtattttaaacatataaatttctttatagaaataaaactgacatagttttgaaagaactaataaaatatttgcaagtataaaatagctaaaaagatttgataaatccatagaatcaacatctctaaaaagaacatttaaatattctggtacaaacataatacatataataataaaagtaacaatacttgtttgtatattctgtttttttctatccgttggctcattaaatcgaatagccccttctttaagcttatttgttggaagtggattagtttctggatctaatttccccatatattttatcttcataagttgtctcctcgtatatcctgtttcacttttatctataaatacatcataccatacatatcactatttattttactaaaacataatacaaaaaaaagaatgacataacgccattctcttataagttcttaatatcttgaacgacacgttgtaaatcttctctgattttaatagattgtggacaaagtttttcacatttaccacatttcttacaaaattcagcttgtgcatctcctagatttgtataacgtcttttagctgtatctttaagacctaacataccatattcattccataacttgaagttacctggaatatcaattccaaatggacaaggcatacaataacgacatcctgtacatccatttttagtttttgctttaatcatattagctactttttctacaagtttttcttcatcttgatctaatagtttaaattctttaaaagtagcaagattatcttctacttgatcataagttgacataccacttaaaacaactttaacatttggaagtgaagccacaaaacgtaaagcccaacttgaaatgctgacattttgattatagtcagtaaagactttttcaatatcatctgaaaggctagcaagagctccgcctttaataggttccataataactaatggtacattcttttcttctgtaagtttgtatcctttcattcctgcttggatatctgcatcaatgtaatttaattgaatttgacagaaatcccaatcacgataattaatgatttcttcaaatacttcataatcatcatggaatgaaaaaccaaagtttttaattcttccttgtttctttaattcttcacaataaggaatgatatttaaatcaataacttttttccatgtatctttatttaaagcatgtaataaatagaaatcaacataatcgacatcaagtctttttatttgttcttcaaagatttcttttgcttgttccaatgaatcaattttaaacattggtaactttgtcgcaagataaaaatcttctcttttatatttctttaaaactctacctacaaatggttcactttcgccatcatgataaggataagctgtatcaatataagtcacaccactttcaatagcatgatctaacattctttctgcttctacctcatcaatagtgccatcttcctttttaggaaaacgcatgcagccaaatcctaataatgaaggattgacattaagtttatcaattttactatattccatccttttatcctctctaaattaacctacatttattgtaaaccctaaagcttggtttatgtcaagatagatttaaactttacattcttgctaatatgacatacaacattagcaaatttgtaaagtaattaataaatcacaaaaagaaagccctaattataagtttataaaatactatttttatccatttactttactgttcaaccatactttttcaacataatttgatataattgttttgttatcgtcctccctgaaaggaggtgatgttaattgttttccgacttagtagtatctgtcgtggcaggtgtgttagtttattacatatgcaaatggttagacaaaagatttaagcgataactagcctagtgttagaccactctaaaagttagaaaaggtaaggatccaccaatccttaccttttcgttttgatgcaattgttctccgacttgcaaataaagtataccatactttgcgtgtagtacacaagttattgtacattcacttaaatttttattttttctttcagaaattactttatcaaaaaatttatcctttatttcatataactcctttaaaaattgaatttctatttttgttcttctctttagttttactgactaattatcactttctcttttatatctaaaatataagaaatttaatatcaattatccaagaaaaaggatattaatatttaacaacaattattttaatacttctactaaatcacataaatcatcatatagagtatttaagtatttgatattcatatcaaaattatatgtttccgttgttttaatcattattgtacaaaatagtcgttcacttaataacgttgtataattataaaatccaaatggtatttcttttgtaatattgtcatattgaaaatgacaaactagactaaatatttgcattggtaatgattgtggaaatggatcattattattcgttaaaagtgattttaataattgagactttttatttccacttaatatctttacttttcttttatttgttaattcatcatatgttcttataaaaatagcaacttttaaaggataaatagtatatttatcatctatcttttctatatataatccttcattttcatcaaatgtatcaatccattgtttatcatactcaatagcattccttagaaatttaacagcattactatttaaaaaattatgtctttgtttactttctatttttccaattgtttgtttacaaaaatagaataagtcatcactcattaaaaattcatttaaatcttctaatgaaatatgcatattcttccaaatatcaggtggcaatatctcaaattcttctgtataaaataactcttgaaaattattatcaagattatttaaaagatcaacactataaactaatcgattatattgattacaatgttctactaattgaataattggattaacattatatccttttacttctatttgattttcataaataatgttttctataatactttctaatttatcgttactagctaaatcaaatcttttatatgccatattttcaatcaatttttcaatttgatatgatatgttattaaattcgttattagtattacaaaaataataaaatgcttcttcatcatcaaataaatttaaaacaataaatgataaatgatttccttttaaagcaccttcctcataactttttttataatctacattttctaatgaaagacttttaaatatattttctttaggaaaaataaaataattcattatataaaagaaataaagcacttgtaaatactttttatattctaatgactcactaggttcataaacaccaaaaacctttaatctattatttaaagcaaatctacttttatcatttcttacaagtatttgctttatttcttcttttcctctatcccaagtagcttcatcaatactcactctatcaacaaaaacttccctattattttgatccctatgtctacaaacaatttttccttctatattatatatcttctctgttattcttattatttcttcagctaaataattaatatttgcttgttcattagataaatcttttcctatatcaaaattactttgtaattctttattgttaaataacatagtgatctttcctttctctattaataaaaatgtaatcatattatgtctaatattaactacatttcttatatattctattattgtaactatgtataactatcttgtgattaataaaccactataaaagaaaacaagcaaaccaactataacgatcaatgctattaatatgtactttttcatttaattgcctctatattcaaaatgtattttataatctttatatttatcatttgttttaataaatgactttaattgctttttagcactttcttttgctctgtcatataagccattgtcaattgcatccttcaacgcagtatcttctaatttagttagtgctttattattttcttctaaagtaacatttgtaaaaatgctctcttcctcatgataaactttgaaagaatcttttttaagttccttacttaaaactttaatttctggcacaattacattaacagtgttatttcctgcttctccccaatcaacttgcgaaaagtctattccagccttaacgataacatcatagctataaatatattttgtttgtgtaaaaggtacgtttacaccgtaaaattttcttgatttgtctaccacatcaatttctgtcattacacatgattctgttgccaattctccaatatcctcaaatcctaattttgttgttttactttcagtaaaaaatgatttttttattccaataattgctacaaacaatactagaattattaatacaatttttattatttgtttatttaataaacctaatagattagtaacaatttttttcttcttactttctttaacatcattattttctaatttcttataattaacttcattcatattttctttcccccttataattatattttttaaaaatttttcttactttctataacttaatatttttccacatcatatattgattaatttccatattaataattttccaacaagctgataaaacagccacatcatcaatatagccaatccctggaatagcatcaggaattaaatctacaaccgatactaaataaataagcgatgcaacgattgttaaaacagttgaaacaggcggtttgtcatatgtaccatcgatataatcttttgtcattgaaaccataacaagaatttttgataacatgttcccaatacatggaatatttttagctactttataagtttctgatatcaacaaatcaaatttatctggactttcaataaccttttttgctttcgttttatttttctttatttgctcagctgcttgagcttcaacatttttaatattattcatcatatttcttcctctcttttccaatttttctaaattgatatttagatatatcttttaatcctactttttttgaatattcaggatattcttccatcttttctattatttttaatagctgtattctttcttttacattcattcaatcccctctgtctgtcttgtttttctattacacttaaattataattttcttatatcattatatgaacacttcacaaggagacatctcgcttgcatttcaccttgtgaggtgaaaaggagatttagcatgggaaaaaatgaagaattagaagataaaagtatatattataggtatagaaaagaagcaggttacacaagagaaaaagcaagtgaacttttagatatgcctgttagacgaatcgaaaaaattgaaacctatagtcaagatgctacacccttagatatagtaaaaatggcaaaatgctataaaaaacccaatttattaaattattattgtgtccacgaatgtgatatcggtagagacaatatacctgaaattgcaacttctgaattagaacatattattttagaaactgttgacagtctcaatgaaatggcgccacaagttaaccgactaattcaaattggaagagatggtagagttactgatgatgaaattgaagacttcgctttcatttgttgtaaattagaagaaattactcttgccgttgattctttaaatttatgggtaaaaaacacaagcttagaaaacaaattaaatggtgaattattgaaaaaatataaagataaatataaaagataaaatatacgtagataaattttctacgtatattttatttactaatcttcttcgtctatctcttgatcatcatctgttgtatccgtagtattttgattttcattatttgtactaggagcagaaattgaaacatttaactcaaaatcatcttcatcataacgaatatcaatcttatatccttcactatttttagcataataagaatcatcaaaattatctgcatccactgtataacccattttcttacatttatcaacatagctatcatagtcatctttagttaaaccacatgcaacaaaagaaaaacttttcttattatctatataatcttttttaataacttgtgctttaggtttaggtaatttatctttaaatgttccttgtgtccaatagatagctttttcagtcttttcatcttctgtatattcttttgatttataatcataataggctgtatgtattttatcgttacttatatattctatagttgctgtagatggatcagccaaattaatataacttgcatcttgtaaataatatataccactatagtaataaactctttgattttttactgttttatttttatttacaattctattagattttgcataaaattcaatttttttattttttatttcttccatgccttcatcatctgcatttactacatcttttatatgtttataaaacttttctttatcttcttcttttaaatcatctttttcttcaaaagttaattcaaaatgtgtaatcgtataaggtgtattatttgtataatctagtaatgcatatcgatcaccatctacaattccttgtctaactttccaatttatatcttctatattaatttttgattgtttttctaaatcactatttgtgttattcttcttattattagaactacatccacctattatagcaatcatacatattaaaattatgcactttattcctcttttcatttttcatatcctccaaaatatttctttttaatatatattgataactccaactttgtttctagctgttctactttctcatcaatcatttgtaatatctcattattggtttttgaattaaagctttgtatttctaatatactaaatcctatagattggaagtcttttatttctatgtaatcattcaattgtttttcatcataaaatctatatcctgattttgtatctatgatagaaggctttaagattcctatttgatcataatatctaagagtgtaaacactgcatttacaaagtttggaaaattccctaatttttaacaactattctatcacctctaattttagtttatcattctagctaactagagggtaaagcctaaacaacacctctttgttatctacatttaaaatttatcattatttatttacaaacattaaaggcaaaaacatagaaatatttagcgataaaattttttacattatgatattattaatttagaaaaactaatacttggtgtaggcgctattgtaggtggtggattagatttatttgaaactaaagttatagcagatagatcttatgattggtttatgaaggaaaatttctcataataattaatattttaaagttagaaaaggtaagaatccatcaatccttaccttttcattttgatgcaattgttttcagatttgtaaataaatcatagcatatttgcttcctgaagtatgttttaaaattatatattatttaagctatatttagatgaagtattttataatttaactatctttatgatttccaagccaatgacttacacaatatgcaaaacatgccgcaccaataacacaaacattttcatcaatctgtgctttaggatggtgtaaagaataatcgccacgttcatccataaatccagcagttaaaatcatataagttgtcagtattttttcagcaataatagcaaaatcttctgatgctgctgctgtactattaggtatcccttttaatccttcaattcctacctgtgacatatattctgccatttctaaagttaactgtggatcacacataagtggtggtactgtcgaaaccatttcaatttcaactgttccacgataagtgcctgcaattttgtgacatacttccttcatacgacttaataaattttctcttgttgaaacattatttgtgcgaagtgttccttgtaaaatagcactttctggtatgatattagctgcactcccagcattaaattttcctattgtaagtgtacatatatcttgtgggtttgcttctcttgcaacaagttcttgtagggcgagatgaatatgtacaccaatatttataggatctattccttgatgaggataggctccatgtgttccttttccatgaattattattttaaattcatcaacagagttcatcataatgacccctgcattatacatataagtacccacttgatttttccctatcatcatatgataagccattgctgcatctggtcttggattatctaaaattccatgttcaatcataccattggcacctttaaatacttcttcagcattttgaaacattaattttactgttccttgtaaatgatcttcatcctcttttaacattcttgctgccgttaataacatagctgtatggatatcatggccacaggcatgcatgtttcctgaagtacaagtaaactcttctccacttaattcagtaatcggtaaagcatccatatctgccctcaataaaataacaggttttcctttaccaatcgttgcagttactccatgtccacataattgggggttgaattccatattctttcaattgtttcataacatattcaaccgtatttggtaaatctaatcctacttctgcatttttatgaagatatcttcgtatttcaatagtatcttcttttaattcatttgctcgattataataatccatttacatcccccctctatatacaaaaataattatatatcgcttattaccaccgtcaacttcttttatatccccttatcaaaagttaaaaaattcattttcactaataaatcatcaaattaaaaggcaccaacaattcctatttatctaggtttattagtgctcttcttaattttttcatgtccaacttatttattggttttgctttcagcttttatataatcacaatcgctttattttttcttcttttatattattgataaatgagttcaaaataacataaggtatataaatttttataaggaaggaaatataccttagtctaattcttcagcatttgttgtaataacttttttataccaataaaaagaatctttttttattctttttaagctacctttgcctaaatcgtctaaatcaacatatacaaaaccatatctttttttcatttctcctgttccagcagaaacaatatcaatacatccccatggagtatagccaagtacatcaactctatcgatttctattgctttttttaattcttttatatgatttctaatgtaagaaatacgatagtcatcgtgaatttcattgttttctaatatatcatcatttcccattccattttctactataaataatggtttttgataacgatcatataattcatttaaaacaaatcttaatccttctggatcaattggccatccccaaggtgttttttctaaatatgggtttggtgatgcttgttgtccaccagtagttgtcgtattaggagaaaaacgatcaaatgcagttgttcgataatacgaaaatgcaagataatcagatgtattttcttttaaccatttttcatcctcaggttccatctttaatttaaaattatattcatcaaaaatagcttgtgcataattaggataatatcctcgacaagtaacatcactaaacatcaatgcttttcttctgaattcatatgctccaaatacatcatctggatgacaagtcgcaggataaattccagaaagtgcacacattgtacctaacataaaatgtggattgatctctcttgccattttatttgccattgcgctggcaactaacatatgatgaattgattgaaacttaattcccgcatcttctaatggtgtttctccttgattagaatgagctccagttttacgatgattcgaagctaatccaagtgtccaataaccacccaatacatttatttcattaacggtaatccaataagtaactttatctttccatctttcaaaaagaacttttgcaaattttaaataaaaatcaattaatttacgattgatccatccaccatatttagtagctaaatttaaaggcatatcaaaatgtaaaattgttactaatggttctatattatgcttttttaattcatcaataacattatcataaaaatgtagtccttcctcattaggtgtttcatcatcaccgttaggaaatattcttgtccacgatatcgaaagacgatacgttttaaatcccatttctgccattaaagcaatgtcttccttgtagtgatgataaaaatctgtagcttgatggcttgggtaataatacccttcttttaagaaaccaacatatccataaggaatgcattctcccatttggattgtcacttcatcatcttgatcattcttacaaaaaatacgtctaggttcatccttagttccattagttattaagtcgtgaacagcaattcctctgccaccttcctgccatccaccttcatattgattagcggcagtagcaccaccccataaaaaattctttggaaaactcatatttcatttactccttcttcgttttacattaattaaacaatttttaaagaacaaactattttatttttgttcaagtttggcttgtttattagacatcaaaacaaatggaacccaaataataaatgtaacaattaaaataatagcttgaacaataattccatgaattccatagctaataaatcctgttacaaatactggtaaccctggtggacaatcaagtactccacaagttaaaaatcctatatttgtagcaactacagcaataaatgctgcaataactgaattaagtataaatggaattgcaaagattggatttaatactaaaggtaaaccgaaaactactggttcattaataccacaaataccaggaattaatgaaaattttgcaatagatttatgatcttcacgttttgaaaaaatgaaaattgctattaataatgatagagtaattcctcctccaccaacaacaacgaaactagtccaaaaacctcttgttaaaatatttgttgcaactcctccagcttgtacagcagaaatgttttctgcaagtccagcagcagataaaggacctctaactccttcaataaccataccaccatgaatacctaaaaaccagaataattgatttactaatgcaagaacaagaataccacctgttgtatttgctaacgcttgtaacggaagttgaataatattgtaaatccaaacatttaaataattaccagtgaatgtattaaataaacatcccccaactgaaaatgcagtaataataatgaaaatagggattaaaatattaaatgaacgagcaattcctgttggaaccgaatctggcattttaattttaatagcatctatgttagtcaataatccaaaaaattttacagcaaccattgacataatcattgaaacaaatagtccttgtgctccaataacacctgcacctaatccattgaccacaactggatcttttaaaccttcgaccactgtacttattgtatttggacatacagctaaataacttaataatccaattaacccactttctaattgtggtaagttttctttttcagcaagtttataaccaattaaaaatgcaattggtaatgacatacaagaaatagtcacaaaatttatcgctgtaaatgctggagataaatttgataaccatggaacccattgtgccaagccattagctccagatactaatatatttaacatactaccaaatgaaccaacaataataaacggtacaaacatcgtaaatgcttctttaatcgaaccaagatatttatttgtttcgacttttgagcttattgataacaaaacattttgtaatttatctttcattttttttcctctctctctaaaaaatataagaatttatttctgcagatctatctatatctttcatatgtaattataaaacctctattatagaactcaatgtatataaattccattttattgtggaacttttcaaaatatagaaaaagaattgataaattaccaattctttttctatattttcaattcaatatcattaaatatttttataatttcttcttggttttgtttttttataattctttttatatagttagaattatccgcaaaataagaaagttccttatataaatctaagatttttatccctatatttttaccaataagcggtataataacaagttgtacttttttcttattccataaaataggttttgataaaatacctataataatttttgtctttggttcatcaacacaacaagataagatggcgagcatattttctaattcatagtttcctatacaatcctcttcaatcaatttttttgaaatactttcatttcctaaagtattttttataatataagaaagaactccttcctttgtttcttcattaatatttttaattattaaattcctcttaattacttcttgcatatgaaaactatcttgatcatccaaaaaggagagtattctttttttatcattattatttaaaaaataattaacttctattactggtataggcaacttattttttatcggtgtgctcgttataagaaaatcaacatcttcaaaatcataacttttaattccaatataatcaaccgtttgaatttcatttataaattttccgtacatttcctttatctgatacgctaaagtacttgatgttcctcttcctacaccgcacattaaaagaatgttctttttatcttttattttctttctaagaagagcaagttctaaatgtaacgcgatatatcctatttcctcatcacttaaattatttccatgataatctacaagatgattacatgcagcaacagctaattgataagccaatatattttgttgttttattttatcaataagcggattacgaagaactacattatatcttgaacgaacctctaatggaataagatgtaaaagtaagtaatctcttaattcattatcattagaaaaatcaatgtgccattgtgattgaatattaactaacatagtatttacaatttgattaacatcaaaatctttgataatacgatgaatactttcatcaaaatttctaataattctctttgatgctaaatgtattgaaagagacacaatttcttgatcactcatctcaattcctaagtgtttatgaatttgttttgctaattctacagcaacaacactattagtccaacgagaaatatcaataatcatttcttctgtagctttcaataaaataccttgtttaattctttttaatgatacaaaaataacaataataaagttttgaacagatacttctgacattgaaatttgatatttgaccattacattttcaagaatttgactaatattttgaatcattaacaaatcattagaattaaactgatttcctggaaaatcatcgcgttgatcaatataagaaatatatattgctgctaagcataatctcttgttaaattctcttccttctactctcattccataatgtggtttttgtactaattttaaatcatattttgacagtgattttctaattccctttagattttgcgacaatacagaagcagaaacaaatagcatttcacataatgtttctgatttaacccaatcattagactctatcaaatatttttgaatccaatcttctctttcattaacactaaaaacaaaagaatcttgtaaagagcgataggaattacataaattaataaattcatcaacattattaataactaattttaatccttgagatgttttgacatcaatataattctttgttgatttcatgtcttcatttattaatttaatgtcttttaatattgttttggtacttacattacataacgcacttagattttctgaagtcacatattcgccgttctcttttaaatattttaatattgtgtaatttctttcattcatattgctattataatattttatctagaaatttgtctactcatcatattaaaaccaattagctataatatatacttttaataagaaaagacacatctaattaatgatttttatacctaaataagtactattttaagtatatttatcatcaatagatgtgtcttattttgatgtgttaatcacaaatttaaaatcaaaaaaatgttgattttattgttgttttatttgtttcttggcttcatttgagggaagagtataacttcttgaatagattcttgccctgtaagtaacataactaatctatcaatacccattcccattccacctgttggtggtaaaccgtattctagagcttctacgtaatctagatccatttcgtttgcttcatcatttcctaattctttttcttttaattgatcagcaaatctttcatattgatcgattggatcatttaattcagtaaatgcgttagcatattcgtttccacagatgaataattcaaaacgttgtgtgaaacgtgggtcttctaaattctttttagcaagtggtgagatttcaattggatgaccatatacaaatgttggttcaacaattgtttcttctacatatttttcaaagaattcattgataatatgtccataaccaaagtgagcttctacttcaataccatgttcttcagctaattttttagcatcttcaaatgacatatgttcattgaaatcaataccagttttttctttaatagcttctgtcatagaaacacgtttaaatcctggagctaaagaaatatgatgtcctttataatctaattcataagttccattaacttccatagctgcattagaaataataccttcagttaaatccatcattccttcaagatcactaaatgctttataaacttcaattgttgtaaattcagggttatgagttctatccataccttcatttctaaataaacgtccaatttcataaacagcatccataccaccaacaattaatctctttaaagataattcagtcgcaatacgtaaatagaaatcagtatctaatgtattatgatgagtaacgaatggtcttgctgcagctccacctaagattggatttaatacaggtgtttcaacttctacatagtttttactatctaaataatgttgaattgaacgaatgattcttggtcttgtaaacgcaatttttttagcatcttcattcatgattaagtcaacatatcttcttctatatctttcttcaatatcacttaaaccatggaatttttctggtaaaggacgtaatgcttttgttaaatgtgtatattcacttactttaattgaacattctccagtatttgtcataaatactgtacctttaaccccaataatatctccaatatcaccttttttaacgatttcataagcatcttcaccaatagtatcttttcttacatataattggatttgtccatctctatcttgaatatgcataaaacatactttacctttacgacgtttagtcataattctaccagcaacagctacttctacagccatttcttctaattcttcatgtgttttatcaccatattgttctttaataccttttgaataagctgtcacatcaaatctttgaccaaaaggatcaatccctttgtcaataagttcttgcattttttctctacgaacaagttcttgttcactaaactttctttcttccataatatcctcctaaaatataaaaaactctctatcccatgggacgagagctaaatcgtgttaccacccaaattcattaataggtcaccctattaacctcaataactatctattaatagtcttgcctataacgtggcttacgtcatcctatcaaaacatccaagatgcagctcctagtctttattcataatagtttcattatcttttccaccaaccaagactctctttgaatgaaggactattattacttgtctattcattgcctttatttctacttcgttatcttaacttaattcaaatttattgtcaatataagcgataaaattagttttaataatgaaaaatgcacctgagtgcattaatcatgaatcttattatttaataccattcttacaaaatcaggttcaaaatgttttgctcttgatcctgaataacccatatctaatgatgagatttgtttcatttcttcttcattcaattcaaaatcaaagatatctatattttctttaattctttctacatgtgttgattttggtataacaatgacttgaacttttgcatatttgtatggctaacatggtattttaattgagcagtttcttttgctctaatagtctaacagggttgttcaacgagcacgaaagtgctctttcgtattataaaactagaagttattcatagtaataattctagttttataatacgaaaagagatatgttaatcattattttatatataatgagattaactatctctttttttatatttgtgcattttatgacgaaaattaaccacttatgtatatattcttttaataaatacggtaatcaaatataattaattattataggaggatttattgatggaaattaagaaaaaatatattataggaattagtgtttgtgttttactgatagtttctgtgttctttatatttaatcagggaaaaagcaatgaacaagttgttacagagtattttgaacttttaaaaaagaaagattataaacaaatgtatcaaatgttgaatcaaaaaacagtttatacacctacacagaagtattttgttgaaaaatataaagaaatctatgatgatataggtgcaaataatatacaagtaaaaatattagacgaaaaaaatgatatagttaaatatcaaatatctatggatacagtagctggaacaattgaatataaaaataaaattggggttaaaaatgaacaaattcaatttaacaacaatcttattatgaaagactataaagatggttgcaaaatcaaagtaacaacatataatcctgaaaaaagaggacgtattttagatagaaatggaaaggtacttgctgaagatggaaaaggttattctgttgggcttgtaaaaggaaagcttaacggtgaaaatgattatggacaaatcgccaaatatttagaaacagatgttgaaactattcaaaagaaaatgagtgcttcttggatcaaggatgattcatttgtgccgattaaaactgtttctgaaatcacaaaaaatggtttggtctataatggcattttaaatatcagtggtgttaaaatttcaacagtcggtattcgtacttatccttatgataaagtagcttcacatgttgtaggctatgttcaaaatgttaatgctgaagacttaaaaaaacataaaaatgaaggctataattcaacttcagtcattggaagaagtgggattgaagcggtttatgaaaaacaattaaggggaagtagttcaggaaaaatagatcttgttgataaaaatgataaagttattgaaaatctttgtgcactagaaattgataaaagcccacaagatattacactaacaatcgatattgatttacaacaaagtctttataatgaatatcaaaatgataacgcaccggattgtggctccggcattcgtgagttcgattctcatcgtccgccccattagtgaagataaagtccttaataaaggatttttttgtttatggagaagaatatgattaaattagtacaaccacaaataacagatttaaaatatagaaaaaaattattaaaagataaaaagacaatggcttttaataaaatcaatgggggaactgttgattttaatgaaaaaatatggaagtcttggtatcaattatggatgaatgatactaaacattattatgcttatgtttatgatgatgaaataaaaaaatatattggtgaagtatcttattattttgaagaagaatatcgagaatatgttttaaatattatcattgaatatccttatagacatttaggaaaaggaaaagttgctttagaacttttatgtaaacaagctaaagaaagtggtctacgctttttatgtgatgatattgaaacaaataatccagctaaaaatctttttcttgatataggctttaaagaagtttgggcaagagaaaatattacaatgttgaaaaaacgtctttagaaccattttggttcttttcttttcacaagatttacacatctcttttatatacttaaataaaggaagggtgaagtcttatgaaaaagaagttagacatgtatttgatttatcttatttatatttttgaattaatttatacaatgagtgccatgtattttaataattcgatagtaacacataaaatagaaatctttgaaaatatctatcaaatcgcttattgtatgatttttattgtaggaattctttatattttgttgcttatttataaagtagggcatcatgaaagtattgatttaaagaaaaatacaggtttattatttggaatcgtttttatggatcttgtattatatggcttttttattattcctatgttagtaagttcacctgctatgaaaatggtttgtatttgttttttaatacatttacttatttgtattaaagagaaacaattatttgttttagaaaaataattttaagatgaaagtgactgctttcatctttttttcatttaagcatggtatgatagagatggtgataattatgaaaaaaatattaattgtagaagatgatgaaagtatcgcagattctttaaaggaaatgttggagcataaggattatattgtggaagtttcttattctaaaaaagaaactttagagaaattaaatgaatatattgatctcattcttttagatattcaattacctgatggtaatggaatttctttatgtaaagaaattaaagaaaagtatgaggtgcctattatttttttaagttgtttaagtgatgaagaaactattgtaaggggattaaacgaaggtggcgatgattatgtatgtaagccttttggtattaaagaactttgtgccagaattgaatgtaaccttagaaaagtaacaaagcaacaaggggtttactatatagatgatttaattattgatacgttaaaacataaagtttttaaagataataaggaattagaattgagtacgattacttttgctttattagtggctttggtagaaggtcatggaagggtgcttaccagagattatttattaatgttgattgaagatataacggggcatgtagtggaagataatacgttaacagctcatttaaaaagattaagacaaacattaggagaatatcaaaatcgaaaatatattgaaacattaaggggtgtagggtatcgatggaaaatataaaaaaagaaaagaataatcatgtttgtctgattatttcatttgtattaatgattgttgtagaaatctattcttttttggtaagtaatatttttaatgtctttatttttacaagtattcttttttattttttggaacaaaaaaataaaaagaaacaaatgaattatttaatacagtgttgtgatgccattattgaacaaaaagatttttctatcattgatggtgaatccaaagaaagtttattatctaataaattatttttacttaataaaagatatcatcaatccttaaaagctatcaaaaaagaacagctaaaactaaaggattatatcgaagatatctctcatcaattaaaaacaccaattacttctatccgtatacaaacagaacttttacttgaagaaaatcaaaataaaaaactctatgcaatagaacatcaaatacaacgaatacaacttttagtcaatgacttacaaaccatcgccttattagattctcataatatccaatattgttttaaagaatatgatttacaaatgcttattgatgaaatagaagaagatttagactacctaaatccgcaaattcatttaaataaaaatataaaagtattatgtgatgaaaaatggtttatagaagcattagaaaatattattaagaattgtttagaaaaaaattctacactcctttctatttttgcttatgaaaatgaaacaactttaaaaatgatgattcaagatcaaggaaatggttttaaggaaaaagatcttccttttttatttcaaagattttatcgtggggaaaattcaaaagggacaggattagggctttatatagctaaagaaataatagaggctcatcacggttttattaaagcttataatcaacaaggtgcttgctttgaaattgtacttcctcaaatgaaaatgaagaaaaaaatctaatttcacttagttttcacgattgaaccgtaagataaagttaaaggaggaaagaatatgtcacatacgatcaatatgctcgcaaaaagaaatattcaaaagtataaaaagcattatcttattgtttcaatcgttcttttaattgtttctactcttattttttcaagttcttttattgttgataatctgtatcagatgaaaaagaattatcatatttcaacctatggttcttggtatacacgaatagaaaatattgatgaacaaactcaaaaaggaattgaaatctacagcaaagactattttaaagatattattaaatatggttatgtagattttcaaggaaaatatgataattaccaagtaggtcatattgaaaagaatatttattcattgtgtcgagtaaaaattattaaaggaagaaaaatacaaaatgatcaagaaattttaatcaatcaaaaagtttctaaaaagtataaactttatgatcaaatagaaatagaaggaaaaaattatacgattgttggtattttacaaaccgccaataaaaacttacctgatatttatacaaacttagagacgtatcaaacaaaagattattattcgaatatgtctgttttatcagataatcattatattcaatttaatgatggaaataactatcaagaaatagaaattcattatgattataatccttatggttatgatcaaaatgaaattcataatcaagtagaaaaagcaaccaatcagctccaacaaacgtttgaatttattataattacactttttgttttattcgctttaacttctacttccctaaagaagagaatgaaagaaatggctctttatcgaggaataggaatgacaacgaatcaattaatgatgatggtcatgcaagaaaacatgctgatttcttttctttctattttaataggattgttaataggtgtatgtgtatctttaggttatctctatcttcaaagtaaaacctatcatacatttatttatcaaatttcatttaaagaaatattatttttagtattggtattgatgagttgtatttttataacggttctcattcccatttattcaagctctaagaatgctttggcaggtacttttgatagcaaaaagtttaattatattcaagtaagatataaaaaattaaaaaaacaaacacttgcttccttaagtgcgagagagttatgggcaaataaaagaatgaatatctgtttttatgtatttgttttaatactttctttatatggacttgtttatttctatcaaggacatcccattcaaacaaaagatcaaaatgaacaaagtcaggtagaacttatgatggcaactcaaaaagaagcaaatttatttttaaaagaattttctcaaaatgacattattattaatcatcattatattgatgaaggaataactatgacttatcgagaaattcctcaatctgtttataaactttgccaactttattattatcaaagtgataaagatgatttaaaaggaagatttccccaaaaaagtcatgaaattgtcgtaggcaatcattttaatcatgttattctttcaaaagaacggtatccaaatcttaaagttgaagcgaatcaagtaacttttaaagggaaaaaatatcaagtagaaaattcaacatcttctcatggtgatcaaggaaattatttaggagatgacaattatgagattgctcttgatgaagtaaaactcaatgaaaaagtgataattgcaggtgaagaatataccattgttggaatcaatgaaaatgaatattataatgattcaatgatttatatgtttgaagatgatttaaaacgattcaatacaagtgatgaatattattcaggatatcattggtatccaataaaagatgttataaaagtagaaaagttcatgaaaaaacattataaagcaagagtttatgaaatggtaacaagtgatgaactttcagtaagtttgttttctacattaaatattcctaaacatcttttaatacttgcattagctgtaggttttattttaatgatgtttttaaattacaatcatattgaaaataattatcaagattattttatgtatcatgttataggtttaagttatcgggaaattaaaataaaacaagtatggaaatcaataaaaatgtttttatatacacttattccttgtggtttttatgagttgattttattaagaggaagtatcgatcattatttcccaatagcgcaattaatacttttagtagggattatttttctagtttatttatgtgtttataatattcctttattaattgttttaaaagcacatcaaaatgaagaaataagaaaggaagatgactaatatgaatgttattttagaagcaaaagatattgttaaaacatatggttatgaagataataaaatttatgcaactaatcatattgatttacaaatagaagaaggctcttttgtagctattgttggaagaagtggaagtggaaaaagtacacttcttcatatcttggcaggtttagtaaaaccaacaaaaggagaagtttatttagaaggaaagtctctttatgaaatgaatgatcatactttaacgcgttttagacgaagaagaatgggttttgtctttcaattcttcaatcttatttccacacaaaatgttttagagaatatagttttaccaattcatttagatgatggcgagattgataatgattatttaaatgaaattattaatctattaggtctagaagaaaagaagaattcttttatttatgaactttcaggaggacaacaacaaagagttgcccttgcaagagcccttgcaagtaaaccagcgattattttcgcggatgaacctacgggaaacctcgatgctaaaagttctaaagaagttgttgatttattaaaaatcgcccaaagaaaatatcatgaaacagttattttagtaactcatgatcaagaaattgcctctattgctgatcgcgttattacgattgaagacggaaaaattattcaagatacaaatcatatttaaatacgtttatttgtggtttaactaaagataaaaacatctttaatattttctttttgttagagtagggctatggaggaaagttatggatgatttaacgatttatgaaacagaaataattgtcgtaaaaatggacgaagagtccatttttttgatagaatagagaaaaggagagaatgattatggaagtaacaattaatggtgtaaaaaaagaagttagcaaagaagaaatgaaagatcgtgtgattggatattatgatgcagtagggatcaaacatttttatttagaagttgatgaaatggatgatgaagaattaaaggctttatatgtaaattcatttgcgagagaataattgtatgaaattaattaggaaagatcaggcgattcatgtagataaaacaaacggcacagaagtggactattatttattagatgatgccgaaattcattataataaaatcaatcctcatacttcacaagagtggcatagacatcgtcatatttcagaaaacatttttgttttaaaaggagaacttgtttatcgttatttggataaaacaaataaggaacaatatttaaaactaaaacagggaaatttacttttggttgaaaaagatatacatacttttgaaaatcaaacagatgaagttgtagaatttattgtgtttcggtatcttccttcttataaaaatcaaagagaattgattcaaaacgataaagaaatgattaaaaaataagataagtgatagtttttgtagattgaaaataaaaaaatagcgtataaaggaactgttattataaaaatagcagtttttttattaattttaatagtgtataaattatattatatgatttatacagtgtatgaaatactgtgattttatcatcaatagtgtataataaatgtataaaacaataaaacgaatctatacagtatatgaaaaactgttctatagtgtataaaaataaagaatattagggatttgtaagccctaacaaaatactttatagttgtaagcggttagaacggttgtaacggaggacaacatgaaaacaaaaaaagaaatacttttagaatttattaaagaatattcaaaccaatatcaaatggaagaatatccccaattaacaactttgtttctatccgaaaaattgaatatgcagcgaacaaatatttcaactcttttgaatcaattagtaaaagaaggaaaagtaaagaagattgatggaagacctgttttatatcaactggtttttaatgaaaatgaaaaacgtgattttgaaagtttaattggtcatgatcaatctttaaaagaagctattatgctagcaaaagctgccattttatatccttctgttttacctaagattctcttaactgcagaaagaggaagtggtattgattgttttgtaaagagtatttatgaatttgctgtaaagtcaaaagtattaaaaaataatgcaccttatattatttttgattgtcaatcttatagtgaaaatcaaaataaaataaaagacatctttttagaaaatcaaggtttaattcaaaaagcaaatacaggattactttttttgaaaaatgcacatttactagatgattatttattatctgattttttacaatcaatgcagcatcttgcaacaaatgataagtataaatgtattttcatttgtcatattgattcacttcaaaaaataacatcctatacgcttatgaatgaattggattatacaatttctattccacccttaaaatcaagaagtttaaaagaaagatataatttaattgagatgtttttaaaccaagaagcaaaacaaattcaatgttctattcaactcgcaaatactgttttacattctttattgctttatgaatgttcaggacaaattaaggaattaaaaaatgatattcataatgcttgtgctaacagctatgtacgtattcaaaaaaatgaaaggcatatagaattgcttctttctgattttccaaatcatgtaagaaaaggcatgatttattataagcactataaagatgaaattgatgaacttgtttcatcaaatagtcaatatacatttacaggtgatcaagtattaaaaagtacagctctacaaaaagaacatatttattcaacgatagacgaaaagaaaaaagaattaaagaaacaacaattaacacaagaagaaacggattctttaattcttgtagaattaaaaaaagattttcaagaatatttttatcgtattactgaaaatatttattcaaaagaacaattagaaaaaatagtatcattaaaattaatacaggatgttgaagattttttaaatcaaatgtctaatcaatataatattctttttgaaacaaaaactttatatggattagccttacatattgatacagcaattattcagacttctaaaaaacaaagactatcacctaaagaaaaaaatgactttattcaacaatttccagaatattataaacaaacacttcaatttattaaaaaaattgatgaagattttagaatacaccttcctaacgatgaagtcattatggtgatgttatttcttatttgtggacaagaagaaatacaccatcaagaagttgtaacacttattgcaatgcatggagataataccgcaacctctattgttgatgttgttaaaaaattaagtggaaaacaatcaatatttggttatgatttaaaattagatcaaacaattaatgaatcttatgaagaactaaaagaacatattttacatattcatcaaggaaaaggaataattcttatttatgatatgggatctattcgtacaatggccgagtcaataaaagttgagttaaatattgatattgaatttttagaaataccattaacacttattgcgatgacgagtgtcaataaagcacatgaattattatcgcttagtgaaacatatcaatatttacaagaacattttaaagatcttcaatatgtaagaaacaatagtcaaaaagaagcacttgtattgatttcttcatttgaaagtgaattagtacaggcaaagaattatcttttagaacattttgatttgaaagatattgaaattttcttgattcaagaaagtcaaattgaatctatttataatcgtattgatcaaattgccaatcaatataaaattaaaggacttatttctagacaagaaatacatttatcacaatatataatgatttctatttctaatgtttataaattaaatgccaagagtttagatgatctatttactgatgaagatgatttagaaaatttatttgattatctacaagaacagtttgaagatattcaaatagaagatctaaaacaaccattgatccattttgcaaataaacttgaaatcattttaaatcaaaaaatagattatgatacacttattggattgttaattcatattatatgtttaattgatcgtttgaaaaaacatctttcaccagctgttcattttcaagcagcaagtgatattctaacaaaagatagaagtactgttgaaaaagtgaaagaaattcttttaccaatagaacaaatatgtcgtattactattagtgatgtagaagctgcaaccattatttcaattataaaggggaaagaacaatgacaaaagaagaagcaagtatgattggttttgaaattgtagcttattcaggagatgcaagatctaaattattattagcagttgaaaatgcaaaaacaggaaattttgataaatgtgatcaattaattgaagaagccaatgcgtgtttagttgatgcacataaatcacaaacagaattattacaacaagaagcacgtggtaaccacgtagaagttggctttattacggttcatgcacaagaccatttaatgacaactttattattaaaagatattatttcaacactcattgatgtttataaaaaataaggagaatgtgtatggatgcaattattaagccaattgaaaaaatgaaaccattttttgataaagtggcaagaaataagtatttaaaagcaattaaagatggttttatttcaagtatgccaattattttattttcaagtatctttcttttaattgcttatgttccaaatgtttttggtttttattggtcaaaagaaatagaaacaatcattatgaaaccttacaactattctatgggaatcttagcgattgctgtagcagcaacaacgacaaagcattttacagatactttaaaccgtgaaatgccagcgaataaccaaattaatagtatttcaacaatgatttgtgccatttgtggttttctaattttaagtagtgatgctttagaaggtggctttgcaagtgaatttatgggctcaaaagggttacttacagcctttatgacagcttttgttgtagggggtatttataaattctgtattaaacgtaatattacgattaaaatgcctgaacaagtaccaccaaatttatctcaaacatttaaagatgttattccatttgctttttcaatgattattatttggctatttgattatctttttagaatggctataggtatttgttttgctaaaggggttattcaagtattccaaccactattttcagccgcagatggttatgtcggtttagcacttatttatggagcaatgtctttattctggtttattggcgttcatggaccatcaattgtagagccagcaatttcagcagcgttagttttaaatatgtctaccaatttagctgctgttcaagcaggacaacatgctgataaagttttaactttaggagcacaatattttgttgtttgtttagggggtacaggagcaactcttgttatctgtttgatgtttgctttccttgctaaatcaaaagaattaaaagcaattggaaaagcaagttcgattccagtactatttaatgttaatgaacctttcttgtttggggcaccaattgttttaaatccagtattctttgtaccatttatttttgctccaatcgctaatgtttggttatttaaaatctttgtagatgtttttaatatggatggtttcatctatacgcttccttggacaacaccaggacctcttggaattatacttggatgtggtattaaattattacctgttattttcttggtgatcgttttagtaatggattttgttatttattatccattctttaaagtttatgataatcaaaaattagaagaagaaaaaaacaatcactttgaagtaaaagaagatgacagtgttgaagttgatggaaaagtattagattctaaaaaaattcttgtattatgtgctggtggtggaacaagcggtttacttgccaatgcccttgctaaaggtgctaaagaagaaggaattccattagttacagctgcaggttcttatggagcacatttagatattatgggtgattatgaccttgttattttagctccacaagtagcttcttattacgaagatttaaagaaagatgcagatcgtatgggtgttaaatgtattgcttgtgaaggaaaacaatatattgatttaacacgtaatccaaaaggtgctttagaatttgtgtttaagattatgggggaataatgatgagatttgcaaatgattttatttttggtggggctacagcagcctatcaatgtgaaggaagtacaagagagtatgggaaaggaaaagttgcttgggatgactttttggcagaaaaaggtcgttttcaagcaaatccagcaagtgatttttatcaccaatatcctgttgatttaaaattatgtaagatgtttggaattaatggtatacgtatttctattgcctggagtcgtatttttcctgatggtacaggaaaaatcaatcaacaaggtgttgatttctatcatcaattatttaaagaatgtcataaaaatggggtagaaccatttgttacattacatcattttgatacaccaaatactttatttcaaaaaggtgattttttaaataaagaaactgttgatgcttttgaaaaatatgcaagttattgttttgaagaatataaggatgaagtaacttattggtttacttttaatgaaatttgggcagtttgtacaaatcagtatattgaaggaacttttccaaatggagaaaagtataatatgacaaaagcatttcaatcaatgcactatatgatgcttgctcacagtaaagcagtattagcttataaaaaaggtgactataaaggaaagataggaattgttcaatcgttagaatataaatatccttataatgaaaataaattagaagatattattgcagcaaaaaatgaagatgttttacaaaatcaattcttattagatgccacttttttaggatattacagtgatgaaactttaaaaattgcacaaaaattatgtgcccttaatcaaggaatgttagacattgaagaatctgatttagaaattatgaaaaaagcagctaaagaaaatgactatttaggaatgaattattatcaaagccgttttatccaagcttatgatggtgaaaatgatatccatcataatggtacaggagaaaaaggaacatctcgttttcgcttaaaaggtgtaggagaaagaatgaataaagaaggtattgatcgtacagattgggactggttgattcatcctgaaagtatgtttgatatgcttgtgcgtattaaacaacaatatcctcaatataaagcaatttatattactgaaaatggaatgggttataaagatgattttgaagatggtattattgatgatacaccacgtattgattatgtaagaagacatctttattacttgttaaaagcgattgaagcgggtgttaatgttaaaggatattttatatggtcattgatggatatgttttcttggacaaatggttataataaaagatatggattattttatattgattataaaacgcaaaaaagatatccaaaagcttcagcttattggtataaatacatttcacaaacaaaggaattgttttaatgataaaaggtgttatctttgattttaacggaacgttgttttttgataacgataaacatgtcaaagcctggggtgcgatatcaaggctattaagaaataaagatattacagatgaggaacttcataaacattttaatggagttcctaatcaaaaaataatccaatatatgaaaaataaccaagcaacaaaagaagatattgactattattcaaaattaaaagagaaatactatcgacaattttgtaaagaagatcaagctacattccatctagttgaaggaagttatgattattttaaacaacttaaagaacaaaaaattccttttacaatagctagtgcatctattaaagaaaatattgatttttttgttgaatcatttcatttagataagtggatgaaagtagatgatattatttatgataatggaacatatcaaaataaaatagcgatgtttaaagatgccgctttaaaattgaatgttaatattaaagattgtttaattgttgaagattctaaaagtggtatagaaaatgcttatcaagcagggtgtagacaaattattgttgtaaattctgcaaataataaaaaagaatatgaaaaaatgcctggagttataaaagtaatcgatgattttaaagaacttttataatacctccgggtattttaattaaaaggaaaatgaggatgttatacagtcttggttttccttattttgtttgtgtcacttgtgttggtcttgcttattttgatacttgattcatgcacgttataaatggattgaaaagtacctattctattttaaattctttagtatatttcaaaataaaaacctccaaagttactaacttggaggtatagttcattttatttactgttttttaaatggaaattccatgctgtttgaataatttgtttaatatcagtgtattgaggatgccaacctaaaatttctttagccttagaattatcagcaactaatttagcgggatcaccagctcgacgaggtgccattgtgacatggattggaagttgagtcacttctttggcagcgttgataatttctaaaacagaatagccttcaccatttcctaaattaaatgtttgacttggatttccttgatataaataatttaaagctctaatatgtgcatctgctaggtcatttacatgaatataatcacgaatacatgttccatcttttgtatcataatcatttccaaaaacataaattgtttcacgtttttttaatggtacttgtaaaattaatgggattaaatgggtttcagggttatgtaattcaccaattagacaattttcatgagcaccacaagcgttaaaataacgtaaagcaacatatttcatgccataagcttgatcgcaccacttcatcatcttttccattgctaattttgtttccccgtaggtatttgtaggatttgttttatcactttctgtgattggaatctgtttaggttcaccataagtggccgcagtagatgaaaaaacaatatatttaacaccatgttctttcataacttctaataaacaaatcatgccataaacattgttgttgtaatattcaagtggttctttcatgcttactccaactaaagaatttgctgcaaaatgaataacacctttaatgtcttctttttcaaagacattatttaaaaattccttatcacgtagatctccttgataaaattttgctttaggatgaatcaattgtttaaaacctgtttgcagattatcaacgataacaacatcttctcctttttcgattaatgcataaactgtatgagagcctatataaccagctcctcctaatactaaaacactcatttttagtcctccttgatgactttattctatacttttagtaaaacatagtcaataaattagtaaaacatttactaaaattagtaaaattatttgacattatttactaaaatgatacaataagtatagaaagaaagcggaggaaagaataaaatgaatcatcaaattaatcgacttattcattttggtttacaacatcatttaattagtgaagatgatgaaatttatgcagtgaacttattattagatttatttcatttagatcattttactaaagaagaaattaatgaaaaattagaagtggcgacagatattttagaagaaatgttagattatgcttgtcaagaaggcctcattgaaaataatattacagaacgagatctttttgatacacgcattatgaattgtttaatgcctcgtccaaatgaagtgattcaaacatttaaagagtattataaagaagattctaaaaaagcaacaaagtatttctatgatttatctattgcatcgaattatattcgaaaaacaagaacagataaaaatattcgtttcaaacaattttataaatatggtgatattgaaattaccattaatttatctaaaccagaaaaagatccaaaagaaattatgaaggcaaagacaatcaaagctagtggttatccaaaatgtcttttatgtaaagaaaatgtgggctttgcaggaaattttaatcatcccgcaagacaaaatcatcgtattattccattaacgttaaatggacatcgctattacatgcaatattcaccttatgtttattataatgaacattgcattatttttaatgaaaaccatcaaccaatggtcattaatgaaaatacgtttagatcattattttcatttgttaaacaatttccacattatatgttaggttcaaatgcagatttaccaattgtaggaggatctattttaacacatgaccactatcaaggaggacattataacttcccaatagaagaagcaacagttgttaaagatatttctttagataaatatcctgatttacaaatcagtgttttaaattggcctttatcaaccattcgtgtacgttcaacaaatgatgaacaaatgattcgatttgccttagatactttaaataaatggatcaattattctcatgaaaaattggatattatcgcttatagccatgaaacaagacataataccattactccaattgtaagaaagaaaaatggattgtatgaaatggatcttgttttaagaaacaatcgaacaagtgaaaaatatcctgatggtattttccatcctcatcaaaatttacatcatattaaaaaagaaaatattggtttaattgaagtcatgggacttgcggttttaccagcaagattaaaagatgaattagaaattttaaaagaatgtttattaggaaataagaatattttagaaatttcaaatatgcaaaaacatgtagcgtggtataatgaattaaagagtcatgattttaatgaagatacagtggatcaattacttaaagaagaattaacacataaattcgttaatgtattagaagatgcaggtgtctttaaaatgaatgaagaaggaaaagaagcttttattaaatttgtagaaatggtaggagaaaaataatgaaaaaagcaagtttagtgattaaagaaattcaagaaggaagttataatgatattttaaaagtagtctatattgatgaaaatcgtattgaaaaacaacctcaaagatatgtagaagctattgaaaaatttatttcactttatggagatcaagaaattgaaatctatagtacaccaggaagaagtgaagtgagcggaaatcatacggatcatcaaaatggtgaagttttagcggcagctatcaatttagacattattgcggttgtttctaaaaatgatgtggtgaaagttttatcagatgattatgatttaaaacctatttctttagatgatttatcgaaaaatgaaaatgaagtaggaacatctgaaggactaatgagaggcgttcttgctcgttttaaagaattaggttatgacattggtggatttaacggctatatgacaagtgatgttttacaaggttcagggttatcttcatcagcagcctttgaagtcatgattggaactattctttcaggtctttataatgaaatgaaagtcgatcctgtcgtgattggacaagtgggacaatatagtgaaaatgtatattttggaaaaccatgtggtttaatggatcaaagtgcttgttcagtaggaagtttgattcatattgattttaaggataatagtaaacctgttgtcgaaaaagtagatgttgagttttcttcatttaaacatagtttatgtatcgtagatgtccatgcctctcatgcagatttaacagatgattatgcagctgttccttatgaaatgaaaaaagtagctcaattctttggcaaagaagttttaagagaagtagatgaaaaagatttttataatcaattagtagaagtaagaaaagaagtgggagatcgtgcgattttaagagcaattcatttatttaatgaaaataaacgtgtggaaaaagcagtatcttctttaaaaaataatgattttgatacgtttagacaagttattaaaaattcaggagattcttcatataaatacttacaaaacgtttattcaaataaatatccagataatcaagctgtttctttagcccttgctttatcagaaggtattttagaaaaccatggtgtatgtcgtgttcatgggggaggatttgcgggaacaatccaagcctttgtagaagatgaatacgttgatcattataaagaagaaattgaaaagtattttggtgaaggttcttgtcatgttttaaaagtaagaaaatttggtggaatgaaggtactttaagatgattaaaattgagaaagtagaaaataatattgatttaattacaatcaaaaatgatgaattagaagttgttgtttctaattatggatgtacgcttgttaaagtgttgatgaaagatcaagcaggaaatgttgatgatgtggttttaggatatgatgattttaaatcttatcaaacattagatgcctatattggggcgcttgttggaagagtagctaatcgtattaaaaaaggaacttttgaattaaacggtcaaacttatcatttaccaattaataatggacctaactccttacatggaggaatcaaaggcttttcttatcaagtatttgattatcaagtgcttgatgaaacaagtgttgaattccattatgtttctaaggatggagaagaaggatatcctggtgagttagattttaaagcaatctattcacttgaaggagatacacttaccatgtattatcatgcaactacttcgaaagatacgcttattaatattacgaatcattcgtattttaacttatctggcaaaaaagaaaatgtgtatcaacatttattaaaagttcacgctgatcgttttgcttgcattgatcctgatggacttcctacaggtgaaataaaagatgtcaaaggaacatcctttgatttcaatgaatttgcttatattggagaccgtgtcgataatgatgatgaacaattacaacttggtaaaggatttgatcatccaatgatctttaatacaaaagaaaaccaagttgaattagttcatgaaaaaacaggaagaaaattaaccgtttcaacgactttaccacaagcacaaatctatacagcaaattatttagatggacgtcttggtaaatatggacaacattacaatgcccgtgatgccatttgtattgaaacacaaaatatgccggatgcgattcatctagaagaaaacccaagtacgattttaaaagcaggcgacacttatgacgaaaaaacatcttataaatttgaagtgataaaaaatctctagagaaaatctagagatttttaaatacacgaatttctttcgattaaaaaacaaggtaaaagaattttgattggtgaaatattttcattatgtttaaaagcatcaaagagttgtctagctgccataaagcccatatcaaatgttggcgcaaagactgttgtaagcggtggatcggtataattggttgtttcaatattatcaaaaccaataatcgatacctcctctggtattttgatgtcatattgttttaaagcacgcatggcaccaatggcgataggatcgcttgccgcaaaaatggcggaaggaagtttcttgtttttaataagttcataagtcatattaaaaccagattcaattgaaaacgtttcttcgcttatgaaataatcaatgttgtattctttacaatagcgttcaaaatattcttttctttgatcatgatagagcttatcatgaattatttctttaccacctaaataggcaatagaagtatgtttttgacttaaataagaaaccacatctttaactgcatttttaaaatcaagtaaaatacaacattcatgaataggatcaatattcatatctaaaaaaataacatttgaacatatctttttatatgtttcaatatcttcttgactatattttccaatacaaactaaaccttgaatatcttctaattgatttaaataatcaacatctgttttaaaaacacgtttgatagcaatcttgtttttaaaacaatattcttctactccttgacgaatacttaaataataagggtcattggattcttcaataggagatatccattgaatgattcctaatgtcatcaccgtatcatacatttttttatttttctttttataaccaagctgattagctgcatcaaggacacgttgtcttgtttctttaggaacagacaaagtaggatcattatttaaaatacgtgaaacactggcgcttgatactttcgctaattcagcaatatcttttattgttgccataaaaacctccattctatagctattttatcatttagtaaatttgaaatcaatgtttactaaaatattgtcttcgtttacaaaatgtctattcaaaggtaaaataaggtgtaaagaaatgaggtagtacaatgaaaataaatgaatcaaaacatggctttgtcgttcagagaatgatagaagtgagtgaacttaatgcaacaatgtatgaaatggaacatataaaaacccatttaaaacttgcttggttaaaacgtgatgaaaaaaataaaacatttggtattgcgtttaaaaccttaccaagtgatgatagtggggtttttcatattttagaacattcggtcttatgtggttctaaaaaatacccggttaaagaaccttttgtagaattaatgaaaagttcaatgagcacttttttaaacgccttgacttttgaagataaaaccttttatcctatttcatctagaaataatcaagattttatgaatctaacaaaagtttatttagatgcagttttcaatcctttgattttaaataaaaaagaaatttttttacaagaaggatggcatattgaagctacagaaaaaccaacttataaaggagttgttttaaatgaaatgaaaggggctttttcaagtcctcgtgaaattatgatgaatgcgttgaatcgtgctttatttaaagacaactgttatcaatatgtttcagggggtgatcctgaagccatcactgatttaacctatgaacaatttatccaaacttatcaaaaatattatcatccttctaatgcttttgtctttttagatggagatgtcccacttgatgccgtcttagaacttttaaatcaagaatatctttcttcaatggaagcaaatttaccaatagaaggaccaatttatcaacaacctgttcaagtttctagacaagtgatagattatgaaataggggaagaagaaaacgctgaaaataaatatcgcatggcatggggaaatgtgattggaagttatcaagactatgaaaaagttattgcgatgcaagtattaagtgatgttttatgtggtgataatcaagctgttttaaataaagctcttttagaaaaaggacttgctgaaaatgtttatttggctattaatgatggtgaattacaaaattggtgtcaattagaagtagatcatgtaaaagaagaaaacttagatcaagttaaagaaattgtttttgatacgcttcaaacattaattaaggaaggtattgatcgtcaacaatttgatgcaacacttgcttatttagaattaaatttaaaagaaagaaactttgggggatatcctcaagggattatttttggtttccaagtattagaaagttggctttatggaggtaaaccagaagcccatttagaatatggaaagatctttgatgatttgaaaaagaaagtaaatgaaggatattttgaaaatcttatcaaagaagttcttttagaaaataaacatagttgtgaaattgtattgaaaccttcaaaagagttaggaaagattcgtcgtgaaaaagaagaaaagaaattaacgaatgttttaaattctatgacagatgttcaaaaacaacaattacaaatagagcaaaaacaattagatgctttccaacaagcaccagacactttagaaaacttaaatactttaccaaaattaaatcttgaagatattgaagcaaaagtacaaaagattccttcaaagttgatggatttagaaggatgcaaagttttaaaacatccaacagaaaccaatggtatttattattatgctctttattttaatatagatcatttagatttaaatcaaattagtaccttatcttttatatgttccttattgggaaatgtctctacaacaaaacatagtgctaaagatctttctacaaagattcgtcttctttgtggaacaatgaattattctattaatacatatgaaaaaactaataaagaaaatcaagtttacttcaaagcttcattttctactttagaacaaaatgaaaaagaagctttacaacttcttgttgaaatcatacaagaatctgtttttgatcaagaaaaaatgattcatgacattttaaaacaacgtattatttcattaaaacaagcgattactatgtcaggacatagtttatcaatgaaaagagttttagcgatggtaagttcttcgggtgttgttgatgaatatagtagtggaattgcttattataaatggttaaaagaattagatgatcattttgattttgttgctttaaaacaaaaattagaaagtgtttatcaaaatgtttgtttctataatcgtttaactttatcttttactggaaatgatgatacaaacttagaaaaacaagttctttatttaaaagaaacattaaaaatctctgatgctttagaaaaagcaatcatcaaacctttttctattaaaaaagaaggaattataattccttcagatattgcttatgcctctaaaggaggttatctattagagacttctaaagtaacgccacttgcttcaaacattatttctttagcgtatttatggaatgtagtaagagtacaaggaggggcttatggtacaggtttagtatcacgtgcttcaggatttacgtgttgttattcttatcgtgacccaaatggaaaagaatctttaaagaaatatgaaaaatgtggaacatttttaaaagattatttaaaggaaaatcatgatttgacagggtttatcattggcacactttcaggattaatgccacttatgatgccttataatattggtaaatatggtgatttgtattattttaatcaaaaagatgaaaaagcaagacaagaacaattggaagctattttaaatgtagataaggatgaattgttagaaattgcgaaagaaatcgatgaaactttagaaaaaggtggaatatgtattattggtggtaaaaatcaaatagatcaatgtgatcttgatgaagttatttcattataaaagaggtgttttcaatgttggagaaatatgatgtttatttaagaccatttaactgtcaaagaacattgcatatttatttacctaatgattattatcaaagtaatgaaagatatccggttgtttatatgtttgatggacataatttgtttttgaatagtgatgctacttatggtaaatcatggggcttagctgattttttagattattatgataagaaattgattattgtcgggattgaatgtaatcatgaagggaatgaaagattaagtgagtattgtccctatgacctaaacagtcgttattttggacgtgttcaaggaaaaggtattcaaacattagattggcttgtttatgaattaaaacctatgattgatcaaaaatatagaacatatccttttagagaatgtacagccattgcaggaagttctatgggtggtttgatggctttttatggagttatcaaatacaatcaatatatttctaaagctgcttgtttatcaccagcctttggcctatgtaaaaaacgtttagaaagagatcttccacaaaatttaaatcctgatacacgtatttatatgtctttaggaacggaagaatttaaaagaccacaacgctttattaaaaatattcaagagtttaatgattatattgtgtctcaaggtgcaacaagttatatcaatattattcctggaggtcatcataatgaagctgaatgggaaaaacaaaatgagttgtatatgaatgtgatgtggaaataaggagataaaaaatgattaaacctcaacgtttaaaaaaaggagataaagtagctattgtaagtttatcggcaggaactttaggagaaaaatgggctattcatcgttattatatcgcaaaagaaagattagaaaatgattttggtttaaaagtggttgttatggaaaatacgttgaagggtattaaatatcttgatgaacatccagaagcaagagcaaaagatttaatggatgcttttaaagatgattctataaaagctgtttttaatgcgattggtggagatgatacgattcgtttacttccatatattgattttgaagttataagaaatcatcctaaagtatttacaggatattctgatacaacaattaatcatttaatgatgtataaagcagggttggtttcttattatggattagcggtgctaacaactttatctgaatatgtcaaaatggatgattattcattgaaaatgatgagaaaaacattattcgagccagtacaacaattggaaatatacaaagcaccttattactacgatgacgatgatgaaatgattcgatgggatgaaaacaatataaatgttttacgacaatatcataaagatgaaaatggatatgaggtcattcaaggaaatggtgttgttgaaggtgaattgttaggcggctgtttggatacttttatagaggttttaggaacagaattatggccggataaagaaaaatggcaaggtaaaattatgtttttagaaacaagtgaagtagatatgtcagaatatcaattagcttggatattaagaaatttcatggcacaaggtctttttgatgtgataaatggtattgttgttggtaaaccatcacgaagaaaaaaatatgaaatttataaaaaagtttatcaaagggttattgggatagaagcgcatcatccagagctaccaattttatataatgctaatatagggcatgcacttcctatagctgtcatcccttacggagtgcgttgccgtttagatttagataaaaagacatttacactattagaacctgcatgtaatctttaaaagattgagaaagtgaatcgttttacgatgataaatataaaatgaatgtgatgtggaaataaggagataaaaaatgaaaccattttgggaagatgaatatttaaataaagaaaaatcaacatttggaaatccaagtaaagaggttaaagaatttgttccgtatttaaagaaaggtgcaaagatacttgatgtgggttgtggcgatggaagacatgctttataccttgcaagcttgggttttcaagtagatgcatttgatttatcaaaaaatgcgattgaaaaaatagattatttaaaacaaaagaataatttaaatattcatacatgggtatgtgatgtgttagattatccctttagatattcctatgatttaatcattgttcatggtgttttacaatttattgataaaacaaaacaaccacaagtaatagagttgttaaagaaatggacaaatgtaaatggatatcatgttattgctttatttacagatgaagaacctattccaaatgatttaaaagatgttatggtaggtgtctttaaaaacgaagaaattaaagattattatacaaactggaaaaccttaatgtttgaaaataaaaaatttcatgatgaacatgaaaatggtattaagcatcttcatgctatgaataaattagtggtaaagaaaatagggtaagcaaatatgaaaataagatgctttgaagaaaatgatataaaacctatttatgaattattaaaaaatgaattagggtatgaagttgattatagtttgtttgttttaagagtacaagaaatgataaaaaataattatttgatttatgttgcttgtatagaaaataaagttgttggttttattggaatagaagtaagttatgtctttgaacttccaaaacaaataatgagggtaaatgctcttgctgttgataaaaattatcaaaacaaagggattggaaaacaacttatacaagaggttgaaaaatatgccaaaataaataatttagctgcgattactttgaatagtgggatttctagaaaaacagcacatattttttatgaaaaacaagggtattctaaaaaaggttatagctttattaaatatctaaaataggggggtataaaatgaatatcgaattatacgattaaatcaaaaatctttatttaaaatatcataaagaaaaaacatggaatcatgtagaaaatgtagccaaagaagctaaaaagcttgcaatacaatatcatttagatattgaaaaatgtatgatagccgctttgttgcatgatatcagtgcaatcctttcaccagatgatatgtataaatatgctaaagaattagggtatcaaatagatccaagtgaagaaaaatatcatttcttattgcatcaaagaatttctaaagaaattgcatatgactattttcatattgaagatgaagatattttatcagcaattgaatgtcatacaactttgaaaaaagaaataaatgattataataaaattattttcttagcggataagcttgcatgggatcaaggaggaataccgccttattatcagccattaaaagaagcaatcaatatttctttagataaaggatgctattggtttataagttatcaatttgaaacacatcaacttcttatgcctcatacttggttattagaagcttatgaaaaattaaaacagacaaatgaaggcaaatagtgtcgggagaaaatcttttttcttaactataatacaaatacagtagagaaaaggagagaaaacatggattgggtaaatgcaattgaaaaagcaattcaatatattgaaaaccacttagtagaagatataacagtgaaagatgttgcaaaatatgttcatatttctgaatattattttcaaaaaggatttgctatgttatgtggatttactattagtgaatatattcgtaaaagaagattatcgcttgcaggtaatgaaattgctggaagtgatataaaaattattgatattgccataaaatatggatatgattcgccagatagttttaccaaagcttttacacgttttcatggtgtaacaccaacagttgctcgtaagaagcatacaactttgaaatcctttgctccactgaaattaataatagctttagaaggaggatatcttatggattacaagattgaaagaaaaaaagcgtttaaagttatcgcaaatgaaaaaacgtttgcttatgaaaatgctaaaaaagtcattcctgatttttggaaagagcattatcaaacaggcaaaggaaaagttgttagaggagtttatggaattaacattgataaacaaatggggcaagaaaactttgattatttaattgcagatccttatcaagaacaagttattccagaaagctttgtgttagaaactattcctgaatttgaatgggcaatttttccatgtgttggcgcaatgcctaaagccttgcaagatgtaaatattaaaatatttacagagtggttaccggcattaaaagattatgaatttgctgctggatattgtgtagaatattatgatgatccagcaaaatatcttaaaggtacattggatgaaaaatattattgtgaaatttggattcctattaaaaaaagataaaagaaatctctaatagagttattttctattagagatttttatttgataagatatccactaaaaatggaacaactttttcattagacatttcatctaaagaagaaataagacggtattcactgtgttcttctggatctaattgaattacataatcatttgtattttttaaagtacaaatataaacaagacgagtaaacatcgtatttttacctttatcaaaattactatcttcatgaatgatttgttttacttcaacatctaaattaacttcttctttagcctctctgattaaagcttctacaggagtttcaaaatcttctacagaacctccagggatatcccaatattcaggatatacatttggttttcctcttttgataaaacttcttttaatgataagatacttgttattgattttcattaaaccatggacaataagtttgtttcgaaattctttcatatgattttcctccttatgggtaagttttattataaatctgttttcaataaaaatgcaatgagaaaaatatgatataataaaatcaataaagattagaggaaatgtgtatggataaaaataaaaaatggattgattatattattgaattacaaagtttagcacaagccggacttacttatggaaaagatgtttatgatcaagaacgctatgaacgtattcgccaactttccgctatgatggcagatatttcaaataaaccagtagaacaagtagaagggcttttttgtaatgaagtagggtatcaaacacccaaaattgatacacgtgctgctatttttaaagaagataaaatcttacttgtacaagagaaaaatggaacatggtcattacctggtggttggtgtgatgtcaatgtctcagttatggaaaatacgataaaggaagtaaaagaaaaagccgaacttgatgttgttgttaaaaatgtcattgcaattcaagatagagaaaaacataatcaaccaatctatgcttataaagtatgtaaaatatttatgctttgtgaagtagaaggtggtgtttttaaagaaaatagtgaaacaataggttttgattattttacaaaagacaaactttcattacttgctacaaaaaagaataatgaagaacaaattcaaatgtgttttgatgcttataaggcaggagaaaaatggaaaacatattttgattaaggaggcatatttatgggattttttacgaagaaaaaacaaacactatcatttccttttgatgatcaacaaaatacagcatgcattgtatgttgtcatattttagaaggacatcctattttatatgtaagtcatgataaggatgatggtatgtggcaatttttatgtggaagcaatcacgatatggaagatgcaagaattgtttttttatttgaagcttataatattgataactctattggcttattaaaagatatgccacgaggttattatgcaataagagaaaatgtagaaagtgattggattgttaagaaataataatgctggaggtgttatctatgacaataaagtttaagggttatttaaaaaatgataaccagttaaaaagtgttgatgaatcacgattggagaagatggttattggatggattgactatctatttgtttttttgattattttatatcctttaacaaaaagcttaaaattattaatttctaaatataatggaaaaattttaaatgtatttttaatagatatattgggttttattattgtaattttattaatgattgtccatgaatactttcatgcaataactttttctaaaaaagaagatatttatatttggtttcaggggtttggaatgataacacattgtacagaaataaagaatgtaaaagagtatctttatactttattgttacctaatttacttattacattgccattatcgatttttgtaatatttgtaaaactatcaaatccattgattttaaaaatgataggattagtttcaagtattataattttaggagcaattaatgatcttgctactatagtttatataattagaaataggaagcagatagagtatttacaattaagtggtaaatacatgtattataagaaagcatatagaggaaaggtagaaaaatgaaaaaaagatattattttattattattttagttattttgattcctattttgatcgttacgtctttaataaaagattctaatcaaaaaccagctattaaaattaaagataatgaaatcattacatctgtacctaattgtagtgaaccaacaattaaaatagataaaatacgaaatattaaattattggataatgttgaaattggaaataaacaagtaggttataaagaagataagtgctatgcaggttattttgatacacaatttggaacatgttttatttatataaatccaaatattcattcatatatttattttgaaactaaagatgacaattgtttgattaattatgaaaatgaagaaaaaacgaaggaattgtatgaaactataaaaaatatttaacacgaagggaatttgagatatatgaaaaataaagatgtacaagaaatagcaaaaatgacaatacaatatgcaaaagaaattattaaacctggtatgtcccttgttgatttgagaaatgatttagagaagaaaatgcttgagttgggcgcagattctttttggtattgggatgtaggagcatttattttttcgggagatgaaacaaatgtttcaatatcaggtaaacattatgtaactgcaaataaaactatacaaaataatgatattattacgattgatttatcacctcaaaataataatgtttggggagactatgcaagaacaattattattgaaaatgggatagttgttgattgtgtaggaaatattgaaaatgaagaatggaaaaaaggattacaaatggaagatagacttcatcaagaattattgaaatatgttactgttgaaacaacctttgaagatctttattttcatatgaatcacttgataaaggaatatgggtttataaatttagattttttaggaaatttaggacattctattgtaaatagaagtgaagatagaatttatattgaaaagggaaataaaacaaaattaatagatgtaaattattttacgtttgaaccacatataagtgttttaaattctaaatatggttataaaaaagaaaatatttattattttgttgaagaaaaattagttgaattataacttatatttaatggggagtcgtcaatgaaaaaagattttgaaaatttaaaaaaaatatttgaacaagcaaatgaacaactattaaatcttgatattgatttatttgaatcacaagtatctgaacaaacaatttgtggagcactggctataagattacatgatatattaaaagatacccaatattccaagtattacgttgatattgaatataatcgcaatagaggtggaaaatttaaaaaaatgtctaaaagtatacagggtccaggcgaagaaataataagaattaaaacagatttaattgtacatagtagaggcgaatgtgtagaacgagataatttacttgcacttgaaatgaagaaaagttatcgacctaaaaaggagaaggatgcagataggagccgattaaaatgtttaactaaagatagctttaatcatgagtggtcttttgatggaacagaacctcctgaacatgtttgtcgatatgctataggcatatattatgagattgattttgataaaaatactatctcaatagaatattatcgtaaaggaaagtatcatacgaaagataagaaactcattaaaaaaggaacagattaattaaacaaatgttccttttttactttatttcataatgtgatatgcaaagttagcaaaaccatttttatcataagaagtagaaatgtagtttacaattttctttacatcatctactgcgttattaacagcaccactataatttactttttttaacatttctaaatcatttaaatgatctccaattgcatacgtattttctaaattaatattaaaatgtttgcataaaatatcaatagcatttgcttttgttaccgataaagaagatatctcggtgtttagttgacctgaagaagtgattttgaaatctttgtcatattttttatttatactttctataaatttaaaatcatgagtaatgatttctaatttaaataaatctttatcttttgttttaaagtcgttgataatttgcttagtaagagggacacttgaaaatataatatcatagtaaacttgcataccataaagagcataatcaatatcagtagttttagtcattgctaattgataaagtctttttattaattgtttagatttatgataataaaagtgacattgatcgtaaagaatataatagtaatctaatttattacattgatcgataatatcaaaaatcttgttttctttaataggcatatttgcaagtaagaaaccatcttgtaaatagatttgagcaccatttaaagcaataacaggtatttgtagatgatatttttctaatagatttattttaatatcattataactacgcccagatgcaaagacgacaataaaacctttattttgtaattgatataaagcttttaaattttcttcactaatttcatgttgagcagttaaaagagttttatctaaatcagtaaatataatcttttctttattcataaaaatctccttaatcgtttgacaatgtttaaaaattaagataggatttttttaactttaaattaatatattttctttaaaacatcatgtttataggtgagagtgtaaataaaatgtcttagaatttatatgatttaaagtttttctttttctaaccattgtacttttttgttaatgataaagtgatcgataagccataatgttccattaaaaataataagaaaacgataagcattatttaatgaaaataatgagcaggtaataagtgaaattgaaagaccaataattcttcctagggcaattggaaattcagatgcaacaatatattcgtattggttataatcgttgtttgctattttggctaattggaatttaacggattgaaagattgtttgattccaacagtagacaacaccaagtaagatataagtgattaataatattttaggcgattgaaaaattcctaataaggacattattccaaaataaatcatagaagcaattaaatgataattcttttgattggttctattaaatttactagcaattaaacttgaactgaaaataccaatacaagccataattgaattaaattgaccgataatttgttcgttagaaataattgtataagcaaaaacagtaaatatctgattaaatattgaatctctaataccgttactaaaattataatatttattagcattccaatatttgttacctttaagttttaaaacttctaataatctaatattttgatttaaagtaagtccttttataaaaatagacatataaataccaataataagtaacaaagcggatataaaaaataaaatataataacctgttagtttagtataaatggaaataatataacctgaaagtgaaggtataataattccaaaaagataactgaatgtttgttgatatgaaaagaagcgaccttgttcacttttttttacgagttgtccagtaagtaggttaaacgaaaaatagtaaaaaccttgaccaattccattaaagatacctaatggaattaaaaataattgggcttgttcttttaatgataaaataagcaaataataagcaatcattgaaaagatgccagttttaagaaaagtaacaagatttatttttgatacaaattttgttccaataataaaagcaataagcaaagaaacatagttaagaatattttgaaataagataataaatatactatttgttagtcttactaaataaacattcaaaaaaactgaggcaatatttgaaccagcaaggaataacattcctacaataagtaaatattttgtttcctttgttaaagtatttttaatttttagcatttctaaaatttttaattgctatttttaataattctgaaacttcttcttgcgaaagtgaaatgctatcaacaagaacataagttgcaataccatgcgtataaaatcgaatattttgaaaaagttggcaagcttcatcaaatgaaatttgatactgtttttcaatctttttaataatattttgattgtacgatgattgaattatttgtgatagcgttctttgaccaccaatatctgaaatataaacagctttgaacagatttttttcttttcttgcaaattcgatataggcatagctaacgcgatacaattcatcattttcatcaacataaatatctgtaaattctcgatagtatttatatatttcttcaataagttcttcttttaattcatccatatttttgtaaaccctaaaaataggatttgtagaacaattcatttcttttgcaatacttcttgcattaacttcctcaaaaccactttttcttattatttcaagagatgaagttaaaatatcttgcttattaatttttgattttggtggcataacaaaactcctttcttataaaataacatttgttacgtaacatatgttattttataattaaaaattaaatttgtcaatggaacacatcatagaagatattttaattcctcttttttattatttgtgtaatattataattctatttagttaaagatgttgatttatacggaaatattagcttttacaggagtaggaatatcaaaataaagtaatatgccgatatctatagaaaagcagaagtagggtttaatgataaaaaagagatattacagaaaataggaatgttcaaaaaaaagaaaaatgacaattcgatgtataaaaggaattattaaatttggttgttgatatataaaaagtttcccattatgagaaactttgattttaaaacttaatgttttttaattttctttttagctaaccttaccatgctatcatctaatgtagtacgtgggttttctaaattataagtttttgccaaatctttgtaatgtttatccatgtaatcttttatttcattagttgattttgtttggaatagggtaattaagtttacatcatcttctattttaaaaatatcatttaatttcaaaataaatttagatgtattttcttcgatgtctgaactttcaaaaaagtaatttcctgtgtttgtatagatgtttaaatctacaaaataattaaagtaaatactaaattttccagaattacggtgtgacataaaacctttgaaaccatcttttaaaagacctacagatggattgtagattctattaacaggtaaaattttgatattattaatactactaaacggaatggtaatatctacgttggattcatttttaattactaaagcatcttcgtttaaaataagttgttgtacatcatcagaaatacttgttactgaaaattgtgcttttattcttttttcttccattgcaaaaacctcctttttaaaaaataaatttattacatcaaagaactttaaattatgaatagtcattttatctttattcaattataccatataacatgtagaaatattgtgatttaatcagcttttttatttgttgaaatgtttttaatgggttataataagcactaatatcatctataacagtatatatcgattctttaagttagatacattcaaatatatagagagattggttttaatcattgcactttatagataaccaatagaaatatgtgatataatttcatgtagttaagggagttgatttatatgaaaatattagcttttacaggagcaggaatatcaaaacaaagtaatattccaacatttatggaaagaccagatgtaagagaaaaactatttagaagttatgccaatacacatcatgaagaatataatgaggttattaaacagcttaaagccaatatgaacggtgctaaaccgaatgatgctcatattgctttagctgaatatcatgtaccaattattactatgaatattgatggattgcataaactagccggaagtgatgctttagaattacatggtggtttaccagaagatgatgaaatgaatattgcgtattctttatataataaaccggtactttatggtgatccagcaccaaattatcaaaaagcttatgaaatggtttatacattacaaccaggagatatctttttggtagtaggatgttcatttcatacaggaatatctgttgatttaagagaagttgctaaagctagaggagcaagaattatcgaaatacaagaagatgctgctcataatgtaagaaaagtattagaagaattaaagaaaggatgatttaaatagaattatttcaagg
